United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 38

SEQ ID NO: 167759 - protein, 222 aa, Glycine max
  Coding DNA Sequence Number=SeqID_50981
  Gene Ontology: Mol. function=DNA photolyase activity; Biological process=response to DNA damage stimulus
  Homolog annotation: Hit_ID=Q8UG24; Match level="QueryCoverage=90%, HitCoverage=55%, E-value=1e-80, Identity=67%"; Hit description=DNA photolyase
MAGKPLRRVPDGRRRYFAGRQMRRKQRGGVLCRKVAAFFITLQSAIDEIVEFLPRPDFAGRPDVAETLRRIRRRMWLLAALQRPPEGRIDPMAGKAADRQAVIPKRLFQRLVRRHAGRIVSAVPEYRLRTGFGYQMAQCLAGVAAEKHEAAADFFQCSGKGREGVTGMTGPPCSTAASKARLSERRRSLRNQTMAGEAVVGMKGPGSLPLERVLKRFVPQIG

SEQ ID NO: 167760 - protein, 94 aa, Glycine max
  Coding DNA Sequence Number=SeqID_50982
MENGELANSARESIRGAPDSMAINLRGSRLDGGGHMNSARQSIHGSPNKIENGELASSARQSIHASPNKIGEWELANSARQSIRGAPDLMVEDA

SEQ ID NO: 167761 - protein, 211 aa, Glycine max
  Coding DNA Sequence Number=SeqID_50983
MGRICGGDINSMPLSRSPFNSTILLPWMNFMGRNDPVSAPQHHYRAGDIPVRHHFQLDRFSIGSSGTRFRVTREVSRDSSFSSATNKNNLEEHLWPRVNFSLQLKHTSFSRRIASSLAERRLKGMEGEGCLVGLGSRGVGETSGGGCGPSGLVQARKAAWINDSSCKACTSQWIFGLSPETKQLSRNGAGRPIIRFARDSNSDKCSLTEAR

SEQ ID NO: 167762 - protein, 87 aa, Glycine max
  Coding DNA Sequence Number=SeqID_50984
MTPTHDALLYYSGRWNMPHQHDFVGYSSIGKNPKKFDIPSGCTIYELKDLIKQVALHGILPYGIHESQTVMEMEDDVSWSQHDSMQN

SEQ ID NO: 167763 - protein, 336 aa, Glycine max
  Coding DNA Sequence Number=SeqID_50985
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-39, Identity=27%"; Hit description= UPI00006A17C9 related cluster
RPCLQGLHALAFGGLHVLAFRGLHVLTISGVHVLSFRVLHALAFRGVHVYTFRGPHVLAFRGLHALAFSGLHVLAFRGLHVLTFSGVHVLSFRVLHVLAFRGVHVYAFRGPHILTFRGLHALTFRGYHVLSFRGLHVLALRGLHILAFRGLHALAIRGLQILSFRGLHVLAVIGLHALTFRGLHILVFSRVHVLTINRVHALTFRGLHVLAFRGLHVLVFRGLHVVAFRGLHALAFRGLHVHTFRGLHAFALRGLHVLAFKGLHLLTFRGLHALTFRGVHVLAIRRLHVLTFRVLHVLTFRGILILAFKGLHVLAFRGLHVLTFNGVHVLAFRALH

SEQ ID NO: 167764 - protein, 33 aa, Glycine max
  Coding DNA Sequence Number=SeqID_50986
MSTNIEMKGSGVVYVSGRVDKGVALAPMYPRVR

SEQ ID NO: 167765 - protein, 76 aa, Glycine max
  Coding DNA Sequence Number=SeqID_50987
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=98%, HitCoverage=15%, E-value=3e-15, Identity=41%"; Hit description =Kinesin, motor region; Prefoldin
MQLSSQEEAIKQKDVLATEVSSLRGELQQEKCSLKDNQIKALEEQLATTEKKLQVSNISAYETRTEYKGQQKFVNE

SEQ ID NO: 167766 - protein, 91 aa, Glycine max
  Coding DNA Sequence Number=SeqID_50988
  Subcellular localization annotation: CTP_CleavageSite=34; ConfidenceScore=5.30e-01
MAISALLSGKSQTPRIVPDFSQVTVIDLFTTIPVFVMGSDSMPMMFKIESRTLQGSRGNLISRIKNQDSSFKLPRIKIKIQDSRFKNQEKT

SEQ ID NO: 167767 - protein, 74 aa, Glycine max
  Coding DNA Sequence Number=SeqID_50989
  Homolog annotation: Hit_ID=Q1T2T2; Match level="QueryCoverage=56%, HitCoverage=7%, E-value=9e-09, Identity=59%"; Hit description =Ribonuclease H
MEQSMVVLALWGCGGMFRDHRGFNVRSFAIYIDSELVTKAFKKPNIVPWRLRNWWKNCLSILRKFNFKVTHIYR

SEQ ID NO: 167768 - protein, 47 aa, Glycine max
  Coding DNA Sequence Number=SeqID_50990
MTSYLDEQLQEATPLKGVRLWQRELLVKRHNVRVVGSSTTVSTKPPS

SEQ ID NO: 167769 - protein, 116 aa, Glycine max
  Coding DNA Sequence Number=SeqID_50991
  Gene Ontology: Mol. function=endopeptidase inhibitor activity
  Homolog annotation: Hit_ID=Q1SMC6; Match level="QueryCoverage=78%, HitCoverage=44%, E-value=3e-14, Identity=50%"; Hit description =Calcium-binding EF-hand; Kunitz inhibitor ST1-like
MASVFGSQRCPHHSIVWMLHLFDASIGQTYLTTAGVVGNPAEHTILNWFKIQKYEDAYKLVYIVLVCAPLATICARILECLWIPIGECMWLSVMIPSKLSSKNPEIKALSNDGKIK

SEQ ID NO: 167770 - protein, 765 aa, Glycine max
  Coding DNA Sequence Number=SeqID_50992
  Gene Ontology: Mol. function=motor activity; Cellular component =dynein complex; Biological process=chitin metabolic process
  Homolog annotation: Hit_ID=UPI00006A17C9; Match level="QueryCoverage =99%, HitCoverage=100%, E-value=3e-59, Identity=28%"; Hit description= UPI00006A17C9 related cluster
LEGFNVLAFRGLHVIAIRGLHALAFRGLHVHTFRGLHALALSRLHVLAFSGLHVIAFRGLHVIAFRGLHGLTLRGLHALTFRGLHVLAFRGLHVLDFKGIHALTFRGLHVLAFRWLHVLAFKGLHALAFGGLHVLAFRGLHVLTISGVHVLSFRVLHALAFRGVHVYTFRGPHVLAFRGLHALAFSGLHVLAFRGLHVLTFSGVHVLSFRVLHVLAFRGVHVYAFRGPHVLTFRGLHALTFRGYHVLSFRGLHVLALRGLHILAFRGLHALAIRGLQILSFRGLHVLAFIGLHALTFRGLHILVFSRVHVLTFNRVHALNFRGLHVLAFRGLHVLAFRGLHVIAIRGLHALAFRGLHVHTFRGLHALALSRLHVLAFSGLHVIAFRGLHVIAFRGLHGLTLRGLHALTFRGLHVLAFRGLHVLDFKGIHALTFRGLHVLAFRWLHVLAFKGLHALAFGGLHVLAFRGLHVLTISGVHVLSFRVLHALAFRGVHVYTFRGPHVLAFRGLHALAFSGLHVLAFRGLHVLTFSGVHVLSFRVLHVLAFRGVHVYAFRGPHVLTFRGLHALTFRGYHVLSFRGLHVLALRGLHILAFRGLHALAIRGLQILSFRGLHVLAFIGLHALTFRGLHILVFSRVHVLTFNRVHALTFRGLHVLAFRGLHVLAFRGLHVIAIRGLHALAFRGLHVHTFRGLHALALSRLHVLAFSGLHVIAFRGLHVIAFRGLHGLTLRGLHALTFRGLHVLAFRGLHVLDFKGIHALNFIGVH

SEQ ID NO: 167771 - protein, 148 aa, Glycine max
  Coding DNA Sequence Number=SeqID_50993
MIQLKYVILVWLRSEGFTFHELIEYHGLKKLVEKKDTYYTNLLGLKDAGFAFNKVDKYKSMMKTPSTYADVVTKSKGKEHFGIRSLMLEHGLLAYMVAWIITPRGSSHAQLNEEDLLLINLMEGRLKIKWVNIIVDIMLKMLDQVASE

SEQ ID NO: 167772 - protein, 71 aa, Glycine max
  Coding DNA Sequence Number=SeqID_50994
MRTCNPLKVRAGSPMKARTCRPLTSSEGEDVKASEGEDVLSSDGENMHSAEVEDMQSSKSEDMKPTEGEGV

SEQ ID NO: 167773 - protein, 154 aa, Glycine max
  Coding DNA Sequence Number=SeqID_50995
  Gene Ontology: Mol. function=chitin binding; Cellular component =extracellular region; Biological process=chitin metabolic process
  Homolog annotation: Hit_ID=P15305; Match level="QueryCoverage=67%, HitCoverage=19%, E-value=6e-08, Identity=30%"; Hit description =Dynein heavy chain
MSKVSRSGKALKRKGEASFPLLKMFKAPSNYLPNAFRGIHVLAFRGLHVLAFSGVHVLTFGENCTSTTLEGYMPSPSEDCTSSPSDGFTSTPSEGYTPSPSVGFMSSLLEDCMSSTSAECMFSPSEYYMSSPSAECTSSPLEDRTSSPLEGYTP

SEQ ID NO: 167774 - protein, 106 aa, Glycine max
  Coding DNA Sequence Number=SeqID_50996
MKRIGSFRCPYAVLISRILCYFGVDTQEEVVGFVEVEFEVKTKVLSQMVRKDQTEQEEAEKKPLSLFEQMMLAKMDELMRIHEEDYAKLKECFEYIVEASFMMNQD

SEQ ID NO: 167775 - protein, 133 aa, Glycine max
  Coding DNA Sequence Number=SeqID_50997
MESGDMWGYRMVTRTFRQPRANEPVDAQRLTSSSVPFVIQGQRVKWQTEIPYGFYSRRPETFKPDDALDSSLLGGDDQVRWRFAGRDINRPDDDSYPNFVRGTLFGGMQPSLHRLEGVPTEGVAFWWKQPSSP

SEQ ID NO: 167776 - protein, 53 aa, Glycine max
  Coding DNA Sequence Number=SeqID_50998
MEREKGITRRQYIWRLQCLLRLSDVWELYRSSWRKNWRNLREPLEMPLSLSED

SEQ ID NO: 167777 - protein, 249 aa, Glycine max
  Coding DNA Sequence Number=SeqID_50999
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=82%, E-value=9e-79, Identity=37%"; Hit description =Leucine-rich repeat
  Pfam annotation: Domain name=LRR_1; Domain location=116-138; Score =6.8; E_value=15; Accession=PF00560.23; Description=Leucine Rich Repeat
  Pfam annotation: Domain name=LRR_1; Domain location=140-163; Score =3.2; E_value=71; Accession=PF00560.23; Description=Leucine Rich Repeat
  Pfam annotation: Domain name=LRR_1; Domain location=17-40; Score=6.1; E_value=20; Accession=PF00560.23; Description=Leucine Rich Repeat
  Pfam annotation: Domain name=LRR_1; Domain location=189-210; Score =9.3; E_value=5.1; Accession=PF00560.23; Description=Leucine Rich Repeat
  Pfam annotation: Domain name=LRR_1; Domain location=213-235; Score =7.5; E_value=11; Accession=PF00560.23; Description=Leucine Rich Repeat
  Pfam annotation: Domain name=LRR_1; Domain location=42-65; Score=8.4; E_value=7.7; Accession=PF00560.23; Description=Leucine Rich Repeat
  Pfam annotation: Domain name=LRR_1; Domain location=91-114; Score =6.8; E_value=15; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=116-138::140-163::17-40::189- 210::213-235::42-65::91-114
MNKFSGNPFASLRSLSKLLSLHIDGNLFHGVVKEDDLANLTSLTEIHASGNNFTLKVGPNWIPNFQLTYLDVTSWQLGGPSFPLWIQSQNQLQYVGLSNTGIFDSIPTQMWEALSQVLYLNLSRNHIHGEIGTTLKNPISIPTIDLSSNHLCGKLPYLSSDVFQLDLSSNSFSESMNDFLCNDQDKPMLLEFLNLASNNLSGEIPDCWMNWTSLVDVNLQSNHFVGNLPQSMGSLADLQSLQIRNNTLS

SEQ ID NO: 167778 - protein, 77 aa, Glycine max
  Coding DNA Sequence Number=SeqID_51000
MKNFVTIMKEGIGHILDLTPMGEKRKESLKRLTLTSHTSKGRIVDFHPLTKPICWLSELSAERNNPWLSARKNLEEG

SEQ ID NO: 167779 - protein, 308 aa, Glycine max
  Coding DNA Sequence Number=SeqID_51001
  Gene Ontology: Mol. function=RNA-directed DNA polymerase activity; Biological process=RNA-dependent DNA replication
  Homolog annotation: Hit_ID=Q8H6Q8; Match level="QueryCoverage=96%, HitCoverage=53%, E-value=5e-33, Identity=29%"; Hit description=CTV.20
QSANGDIPYENLSYGQLISYVQKVALKICQDDKIQRQLAKEKAQTKKDLETSEEETETETSSSVFSDENLNLIQQDDQLSSTDDDDKQINTLTREQDLLFEAINSIPDPQEKKVFLEKLKKTLEVKPRQKDFIANNKFDVSNILKRLENSSTKPMTIQDLQTEINNLKREVKELRQQQEIHQIILSQLEVESDSENTNSEENQPENLEDDMFMGLINKIKIQNFYINIKIIINDFVLETMALFDTGADSNCILEGLIPTKFFEKTSEKLSTTNGSKLKINFKFSNAIIEIQGLRINTNFLLVKTLKTK

SEQ ID NO: 167780 - protein, 107 aa, Glycine max
  Coding DNA Sequence Number=SeqID_51002
MAYHASSKANQDSMKNHEIHFGKSYSIENFQGGPELQPYYQNEAEREIQVGELAEEVTQFMSRQEKYFVKVEAQEESPVKEHESREKDEEQAQQQWEKYSTVENNQE

SEQ ID NO: 167781 - protein, 111 aa, Glycine max
  Coding DNA Sequence Number=SeqID_51003
MTSRRYMPNESEPTNKNPMKNSQRDPSTLIDANPQVKIYLDAHHLNLKISVKQNSQHPMGPTLPLSLPGCHGLMQHLDDNQEDTSHAGTGHGALTNHGYNSALVRNAKYGL

SEQ ID NO: 167782 - protein, 60 aa, Glycine max
  Coding DNA Sequence Number=SeqID_51004
MVDEVENGVVNTVLIAIIATTMGKLKSNVSPRSTYQTMMGVGHESRGLYQLSRYYRQWPM

SEQ ID NO: 167783 - protein, 190 aa, Glycine max
  Coding DNA Sequence Number=SeqID_51005
  Gene Ontology: Mol. function=sugar porter activity; Cellular component=integral to membrane; Biological process=carbohydrate transport
  Homolog annotation: Hit_ID=O04249; Match level="QueryCoverage=97%, HitCoverage=36%, E-value=1e-75, Identity=71%"; Hit description=Sugar transport protein 7
MDDFLIEFFPSIYRQKKHAHENNYCKYDNQGLAAFTSSLYIVGLVASLMASPVTRKYGRRASIIGGGISFLIGSALNASAINLIMLILGQVMLGVGIGFGNQAIPLYLSKMAPTHLRGGLNMMFQVATTFGIFTANMINFGTQKIKPWCWRLSLGLAAVPVLLMTMGGIFLPNTPNSLIERGLMEKGGSC

SEQ ID NO: 167784 - protein, 190 aa, Glycine max
  Coding DNA Sequence Number=SeqID_51006
MQIVLLTQINRNKHQAVSFVCLWKLEYTIRYHILVFNSDLNPPSGDQKLNPDPHKLLSPFAFKDLNSRSSSRDSHVRAINTEIQQHNQSTNSSSPPQREEPRDRNGARIGAQPVRGSQYKIETTVVVVERIGAAGVLGAERLASLEDLDLAHDKVRAGAFHHHAGAVAVVELPPASLVRVGARVWVRVSL

SEQ ID NO: 167785 - protein, 336 aa, Glycine max
  Coding DNA Sequence Number=SeqID_51007
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-37, Identity=30%"; Hit description= UPI00006A17C9 related cluster
HVLAIRELHALTFRGLHVLTFRGLHVLAIRGLHALNFRGIHVLAIKGLHTLTFRGLHVLAFRGLHVLLIRGPHALTLRGLHFLTIRGRHTLTSRGLHVLAIRGLHVLVFRGLHTLTFRGLHALTFRGLHALAFRGLHVLTFRGLNVLTFRGLNALAFRGQHILVFKGLLILTSRGLHVLTFRGLHVLAFRGLHALTFRGLRAPTFRGLHALSFRGLDVLAFRGLHVLTFRGLHIITFRGLDVLAFRGLHALAFRGLHVLAFGGLRAPLFEGCTCPSLEDCMSSPSEDCTCSHLEDCTSSPLEGYTASPSEDYSSSPSEDYTSSPLEDCTSSPSEDY

SEQ ID NO: 167786 - protein, 192 aa, Glycine max
  Coding DNA Sequence Number=SeqID_51008
ISLIAQSNSSRLGFTALITALCKARGVTSDSLTFESLNLAINLAYIKKNCWNLDEPSVTFPGTQKSKARRSEAPSTSAASTPPTSAPSTSALPSPPAAPVLPGPFAQSLELFMSMLQSLHQGQLLIIQSLQDVVQQRPVMSLEEFVQKMAWPGVQPSPLGGGEASAAQEPQPDQEDDILEASKSTPLEPFIF

SEQ ID NO: 167787 - protein, 73 aa, Glycine max
  Coding DNA Sequence Number=SeqID_51009
MSLRMGVCGDGGGGGGNLRGLPWRVGVRVKSNGRREARKNEKRMDGGDIGTKGLEILVFPKTRSAMDGGRPEK

SEQ ID NO: 167788 - protein, 142 aa, Glycine max
  Coding DNA Sequence Number=SeqID_51010
  Homolog annotation: Hit_ID=Q1S4X7; Match level="QueryCoverage=39%, HitCoverage=17%, E-value=1e-16, Identity=81%"; Hit description =Berberine and berberine like, putative
MAAPDNNDPRNMVSISRIMFVHAKLVQPQRVLTVSNLDRKLYNYMTPYVSKFLMKAYVNYRDLDLGMNKKNNTKHSTTPSFKYEAKRQEVQDLGMRHYVAGAIGYNCVIVELAGVRGHETLCSVHNLGGRSNNCISKGGDYR

SEQ ID NO: 167789 - protein, 347 aa, Glycine max
  Coding DNA Sequence Number=SeqID_51011
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=99%, HitCoverage=16%, E-value=0.0, Identity=92%"; Hit description=Protein ycf2
MKKKSCDGGDSYLYKWYFELGTSMKKLTILLYLLSCSAGSVAQDLWSLPGPDEKNGITSYGLVENNSDLVHGLLEVEGALVGSSRTEKDCSQFFFGSSDIASSRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLV

SEQ ID NO: 167790 - protein, 116 aa, Glycine max
  Coding DNA Sequence Number=SeqID_51012
  Homolog annotation: Hit_ID=Q1RST0; Match level="QueryCoverage=73%, HitCoverage=6%, E-value=2e-11, Identity=53%"; Hit description =Peptidase S1 and S6, chymotrypsin/Hap; Immunoglobulin/major histocompatibility complex; ...
  Homolog annotation: Hit description=AAA ATPase, central region
MRIPLFLIWVFDFKLNSRWVSKDSFVAAPVNKSGEPELRPSDLPDTASLKAVDVCDAVLPDKSPSEGEALVPPRCAGETAEKSKVAGLPPRSVKKRAAKSCPKTAWGKLLSQCSKE

SEQ ID NO: 167791 - protein, 131 aa, Glycine max
  Coding DNA Sequence Number=SeqID_51013
IFRKVIDLIQHQVVAAQKRTLLYKHEGCTSSVPSPGLKSYFVSLGLECFVSHLDATLTSSVGPECVELISIKHNLQRDVVTSCTTSVPSIRISETPPFLTIMPNINDSHDVDGVHTNRNDHDEGLWENIAT

SEQ ID NO: 167792 - protein, 53 aa, Glycine max
  Coding DNA Sequence Number=SeqID_51014
MVAVGRWGPVSVVVRAKRDEEDDWSRVCERKRQAANHADAVIQRRLKMESSSQ

SEQ ID NO: 167793 - protein, 78 aa, Glycine max
  Coding DNA Sequence Number=SeqID_51015
MIVNEFENEREKNGSWGSKVAKLVVVARGGGGEGVAARGGGGGKENEMQIGFGLANGKLGMDKWFPWAWLTFKLSEYE

SEQ ID NO: 167794 - protein, 569 aa, Glycine max
  Coding DNA Sequence Number=SeqID_51016
  Gene Ontology: Mol. function=ligase activity; Cellular component =cytoplasm; Biological process=response to auxin stimulus
  Homolog annotation: Hit_ID=O82243; Match level="QueryCoverage=98%, HitCoverage=100%, E-value=0.0, Identity=62%"; Hit description =Putative indole-3-acetic acid-amido synthetase GH3.9
  Pfam annotation: Domain name=GH3; Domain location=12-545; Score =1014.7; E_value=3.1e-302; Accession=PF03321.4; Description=GH3 auxin- responsive promoter
MDGKKLEYKGEEALKEIERLTMKAAEVQEGLLKQILTQNRETEYLNKYMRGEKNTTDIAEFKSSGTSSGEPKMMPSIAEDLERRTFVYNLITPIINQYVPDLDEGKAMYLYFVKAEMCTPCGLPARTVLTSYYKSKHFKCRTHDPWNDYTSPDQSILCNDSNQSMHCQLLAGLVHRRHVLRLGAVFASALLRAISFLERNWRHLCEDICSGQLSSFITDPSCRSRMSTFLSSPNPRLADEITRICSQKSWKGILCQLWPKAKFIEAVVTGSMAQYVPALKHYSEGKLPLVCTMYASSECYFGVNLKPLCDPSDVAFTLLPNMGYFEFLPLRHNGTLLMDFDEGEQVPNDKLVDLVHVKLGCFYEPVVTTFAGLYRYRVGDVLQVVGFYNNAPQVRFICRRNVVISVDTEKTNEEDLHRGVTMAKKLLEPYDSLLVEYTSYPDTSSVPGHYVLYWEILHCGIKTESSPQLQLDANVLEECCIAVEEQLDYVYRRCRSYDKSVGPLEIRVVEPGTFDALMDLFICQGASINQYKTPRCIKSKKALKLLKSKVTASFFSPRDPKWAPKMCSS

SEQ ID NO: 167795 - protein, 75 aa, Glycine max
  Coding DNA Sequence Number=SeqID_51017
  Subcellular localization annotation: CTP_CleavageSite=24; ConfidenceScore=5.19e-01
PSSPRPAFGLPGPPNNFKAKGLARLGKLQPPQGGLLPINRHPRGVLKGFKVQKLRELREERNKRKRGRGATKSRP

SEQ ID NO: 167796 - protein, 147 aa, Glycine max
  Coding DNA Sequence Number=SeqID_51018
  Gene Ontology: Mol. function=nucleic acid binding; Biological process= DNA integration
  Homolog annotation: Hit_ID=Q1SJY4; Match level="QueryCoverage=97%, HitCoverage=38%, E-value=1e-12, Identity=28%"; Hit description=Zinc finger, CCHC-type
MEMYIESIQYRIWLIITNGDIPIPIPEAKRTNVGLTIMKINTKTRYTLTCMEDVRLKKAITLTSHYESFSTKEGESMEDMFERLQVLLNNLEALGLTYTKAQINLKVVNNFPKVWEPKKIAIQEARDFKNLAWDELLGILRVHEVHL

SEQ ID NO: 167797 - protein, 157 aa, Glycine max
  Coding DNA Sequence Number=SeqID_51019
  Gene Ontology: Mol. function=transferase activity; Biological process= auxin mediated signaling pathway
  Homolog annotation: Hit_ID=Q948X4; Match level="QueryCoverage=93%, HitCoverage=68%, E-value=2e-56, Identity=71%"; Hit description =Glutathione S-transferase
  Pfam annotation: Domain name=GST_C; Domain location=47-142; Score =67.7; E_value=3.9e-17; Accession=PF00043.15; Description=Glutathione S-transferase, C-terminal domain
MYSELESRAITQYIVHEYADKGTQLISKESKKMAKLRLWLEVESQHYDQPASKLVWELMVKPMYGLPTDPAAVEENEGKLGTVLDFYEKTLSQSKYVAGECFTLADLHHLPTIHYLMKTQSKKLFESRPHVGAWVADITARTAWSKVLAMQPLLSSK

SEQ ID NO: 167798 - protein, 66 aa, Glycine max
  Coding DNA Sequence Number=SeqID_51020
  Gene Ontology: Mol. function=transferase activity; Biological process= auxin mediated signaling pathway
  Homolog annotation: Hit_ID=Q948X4; Match level="QueryCoverage=99%, HitCoverage=30%, E-value=2e-25, Identity=80%"; Hit description =Glutathione S-transferase
  Pfam annotation: Domain name=GST_N; Domain location=2-66; Score=42.7; E_value=1.2e-09; Accession=PF02798.10; Description=Glutathione S -transferase, N-terminal domain
MATIRLHGNPFSTATMRAAASLHEKQLEFEFVLIDMKNGEHKKEPFISLNPFGQVPAFEDGDLKLF

SEQ ID NO: 167799 - protein, 64 aa, Glycine max
  Coding DNA Sequence Number=SeqID_51021
MAHHNLVRNTINFLDRSRELNPITIHLEINQCVYFGTSEPAIPSRVRGAFRLAKQMQTEYDVNK

SEQ ID NO: 167800 - protein, 114 aa, Glycine max
  Coding DNA Sequence Number=SeqID_51022
  Gene Ontology: Mol. function=potassium ion transporter activity; Cellular component=membrane; Biological process=potassium ion transport
  Homolog annotation: Hit_ID=Q06XL9; Match level="QueryCoverage=71%, HitCoverage=11%, E-value=7e-25, Identity=68%"; Hit description=KUP1
MPSEVMVESMESNGGNVENTEQHHHLPVSDPHGLMGKKLSWQKFPRNDSLDMESRSFPTSSHASIMPVIMHLAFQSLGIVYGDMGTSPLYVYASTFVDGIKHNDDILGVLSLIF

SEQ ID NO: 167801 - protein, 176 aa, Glycine max
  Coding DNA Sequence Number=SeqID_51023
  Gene Ontology: Mol. function=potassium ion transporter activity; Cellular component=membrane; Biological process=potassium ion transport
  Homolog annotation: Hit_ID=Q06XL9; Match level="QueryCoverage=99%, HitCoverage=27%, E-value=1e-74, Identity=69%"; Hit description=KUP1
  Pfam annotation: Domain name=K_trans; Domain location=1-176; Score= -352.3; E_value=2.3e-08; Accession=PF02705.7; Description=K+ potassium transporter
MVQRFGTDKVGYSFAPIIYYFRRNKKDAWISLGGVVLSITGTEALFADVGHFTVRSMQISMCSVTYPALLLAYTGQASFLRQNNDLVSDTFYKSLYWPMFVVAVMASIIASQAMISGTFSIIQQSLALGCFPCVKIVHTSAKYEGQVYIPEINFILLIACVAVTAGFKTTTKIGNA

SEQ ID NO: 167802 - protein, 130 aa, Glycine max
  Coding DNA Sequence Number=SeqID_51024
MVEHGTRKPTTDRLEETLARLPVHHESLVAQHFDLASKVAISSTVPCFDGHNPLGWIFKISQFFEYQATPKEECITLASFYLNGPALSWFEWSYRKAFITTWPGFLQVLESRFAPMYCDDPKGALFKLTQ

SEQ ID NO: 167803 - protein, 500 aa, Glycine max
  Coding DNA Sequence Number=SeqID_51025
  Gene Ontology: Mol. function=nucleic acid binding; Cellular component= intracellular; Biological process=chromatin modification
  Homolog annotation: Hit_ID=Q1RSK1; Match level="QueryCoverage=92%, HitCoverage=93%, E-value=6e-84, Identity=40%"; Hit description=Zinc finger, C2H2-type
  Pfam annotation: Domain name=RS4NT; Domain location=159-196; Score =14.8; E_value=0.034; Accession=PF08071.2; Description=RS4NT (NUC023) domain
  Pfam annotation: Domain name=zf-C2H2; Domain location=174-196; Score =24.2; E_value=0.00046; Accession=PF00096.16; Description=Zinc finger, C2H2 type
  Pfam annotation: Domain name=zf-C2H2; Domain location=98-120; Score =26.4; E_value=0.0001; Accession=PF00096.16; Description=Zinc finger, C2H2 type
  Pfam module annotation: Pfam domain module=RS4NT::zf-C2H2::zf-C2H2; Domain location=159-196::174-196::98-120
MSNISGDEGSFSTANTGEEVHQENKLQQPLNHPHGSSSGVRNSNSSTNQQQQQANKKNRNLPGTPESVGDDMDEIHVTDPNAEVIALSPTTLMATNRFVCEICNKGFQRDQNLQLHRRGHNLPWKLRQRGSNEVKKRVYVCPEPSCIHHNPARALGDLTGIKKHYSRKHGEKKWKCDKCSKRYAVQSDWKAHQKTCGTREYKCDCGTIFSSGMAPTTTLENELPDLIATTMPLSASSNNSTVSEFNNNYDTKSPLQEHIVPMPFKSTSMGGGMFSNTTFSAGTLFGGPKNMSHPSSSTLQLSSNNSTAFNYFQDSKNASASSHMSATALLQKATQMGATASNNNSIINSPTMMQKSFISAMTGPDHNHISSYDHFHHPNPDDQSHNMAGISNAGAFTNLFFHKGQQEMSLIFDSNTSDMGMFGPILMKNVEQEIGTGSSLVHDFLGVGDATSRVYEPQKQQQQRLELEALTHQRLQIMNHFHHHLPHGDSATMEKSIWDI

SEQ ID NO: 167804 - protein, 418 aa, Glycine max
  Coding DNA Sequence Number=SeqID_51026
  Gene Ontology: Mol. function=chromatin binding; Cellular component =chromatin; Biological process=chromatin assembly or disassembly
  Homolog annotation: Hit_ID=Q1SAV4; Match level="QueryCoverage=79%, HitCoverage=99%, E-value=2e-93, Identity=46%"; Hit description =Integrase, catalytic region
  Pfam annotation: Domain name=Chromo; Domain location=299-349; Score =20.9; E_value=0.0034; Accession=PF00385.14; Description='chromo' (CHRromatin Organisation MOdifier
  Pfam annotation: Domain name=rve; Domain location=52-208; Score =105.0; E_value=2.2e-28; Accession=PF00665.16; Description=Integrase core domain
  Pfam module annotation: Pfam domain module=Chromo::rve; Domain location=299-349::52-208
MGIQKTLHRLQESFTWDSIRTDTLAFVTSCLTCQYTKYDNRKPAGLLCPLPVPVQPWEDLSMDFIVGLPAYKGNTCILVILDRFSKGLGLGMLPTHHNARTVTELFMEIVGRLHGMPRSIVSDRDPLFVSRFWKELFSLSGTKLRLSSAYHPQSNGQTEVANRIVEQYLRAFVHQKPSRWGRFLLWAEWSYNTSCHSATGVTPFKVTFGRKPPSFPHYILGTAKVDAVKLSKAQARMKMMADKHRREEELKVAYQLQLPEQSCIHNVFHVSLLKPFVSTDPPQDSVALPPTAMDNDPIIVPLAIVATKTILSEEGPKRMVLVQWKDLPLEEASWEEWTPFKKLHHLEDKVFFEGQGSVTPIEDRVQVAGGVVKEEQGLRLVREQQHGGRPIRKMKIPARLDDYKVLEVVKLVTDSVRV

SEQ ID NO: 167805 - protein, 240 aa, Glycine max
  Coding DNA Sequence Number=SeqID_51027
  Gene Ontology: Mol. function=DNA binding
  Homolog annotation: Hit_ID=Q1SWX1; Match level="QueryCoverage=71%, HitCoverage=42%, E-value=6e-13, Identity=26%"; Hit description=IMP dehydrogenase/GMP reductase
MGTNQTGKRFYQVKVKSLDTTSIKELGRLMKPLQMQAFRKTYGKILELTIAEVSIEAIASLTQYYDQPLREILGCPLGGKKTISFIRVSPLFEQKLHKDSARGDWVPFMDVLALLIFGVVLFPNVDGLVDLAAIDAFLAYHHSKESPVVAVLVDLIDTFDRRCEKSSAQIICCLPALCVWLVSHLFQQDTRHPCPLLSHRSCTEKRRIDWDQLLAGIGGRTINWFPRWKEGKEGVLFSCG

SEQ ID NO: 167806 - protein, 81 aa, Glycine max
  Coding DNA Sequence Number=SeqID_51028
MENLGLNLGLSDRWDFKNNNFWLRLSENGALSAIPTEGNCAKWPKAALSLIPTEGNCTEQPKGALSEPYFRGGCAKTKFLR

SEQ ID NO: 167807 - protein, 66 aa, Glycine max
  Coding DNA Sequence Number=SeqID_51029
MPRHLLGQRVHGPPNELVINKVAHDEQNSKIFTFGVALRIFKLDDYGVLWDFSTKSLDDSYALSQS

SEQ ID NO: 167808 - protein, 80 aa, Glycine max
  Coding DNA Sequence Number=SeqID_51030
GEGEEAQTSDDARVRRTRCSTLDKTMVRWRTYNFKEKKQRLVTMLECDEYDAGVRRTRCSDADRDLEGRRRLEEEESVKA

SEQ ID NO: 167809 - protein, 129 aa, Glycine max
  Coding DNA Sequence Number=SeqID_51031
MFLLTNAFKGFNNIQGSKSKSCAKWILVKCNKQRGNTECGYYVMHWMSMIVLGGFKDIWEMIFRIASEDREYQNDKPTTKFRETRLALGPMQLIQRCKSWSWKSLIFLSSRRKVSQGLALSPINLGTPY

SEQ ID NO: 167810 - protein, 630 aa, Glycine max
  Coding DNA Sequence Number=SeqID_51032
  Gene Ontology: Mol. function=signal transducer activity; Cellular component=membrane; Biological process=response to light stimulus
  Pfam annotation: Domain name=BTB; Domain location=33-142; Score=8.0; E_value=0.00077; Accession=PF00651.21; Description=BTBPOZ domain
  Pfam annotation: Domain name=NPH3; Domain location=210-479; Score =462.8; E_value=4.3e-136; Accession=PF03000.5; Description=NPH3 family
  Pfam module annotation: Pfam domain module=BTB::NPH3; Domain location= 33-142::210-479
MGVVTVGELKPSISGKRTFRPSSSIRHATEWPISDVSSDLTIEVGASSFALHKFPLVSRSGRIRKMLLETKDSKVSRISLPNLPGGAEAFELAAKFCYGINVEFSLSNVAMLKCVAHFLKMTEEFADKNLETRAEAYLKETVLPNISNTISVLHRCESLVPISEEISLVSRLINAIANNACKEQLTTGLQKLDHSFPSKTTSNMEPETPSEWWGKSLNVLSLDFFQRVLSAVKSKGLKQDMISKILINYAHNSLQGIVRDHQAVKGCFPDLELQKKQRVIVEAIAGLLPTQSRKSLVPMAFLSSLLKAAISASASTSCRSDLERRIGLQLDQAILEDILIPTNSHQNTHGTIYDTDSILRIFSNFLNLDEEDEDDNSHLRDESEMVYDFDSPGSPKQSSILKVSKLMDNYLAEVALDPNLLPSKFISLAELLPDHARIVSDGLYRAIDIFLKVHPNIKDSERYRLCKTIDCQKMSQEACSHAAQNERLPVQMAVQVLYFEQIRLRNAMSGGHSHVFFGGGAGLNGQFPQRSGSGAGSGAISPRDNYASVRRENRELKLEVARMRMRLTDLEKDHVNMKQELVKSHPANKLFKSFTKKLSKLNAMFRINSIKPNGSESRFPFPKRRRHSVS

SEQ ID NO: 167811 - protein, 488 aa, Glycine max
  Coding DNA Sequence Number=SeqID_51033
  Gene Ontology: Mol. function=nucleic acid binding; Cellular component= nucleus
  Homolog annotation: Hit_ID=Q84W91; Match level="QueryCoverage=99%, HitCoverage=99%, E-value=1e-159, Identity=57%"; Hit description=Zinc finger CCCH domain-containing protein ZFN-like 1
  Pfam annotation: Domain name=zf-CCCH; Domain location=140-166; Score =44.5; E_value=3.6e-10; Accession=PF00642.15; Description=Zinc finger C-x8-C-x5-C-x3-H type (and similar)
  Pfam annotation: Domain name=zf-CCCH; Domain location=297-323; Score =43.5; E_value=7.3e-10; Accession=PF00642.15; Description=Zinc finger C-x8-C-x5-C-x3-H type (and similar)
  Pfam annotation: Domain name=zf-CCCH; Domain location=358-384; Score =37.7; E_value=4.1e-08; Accession=PF00642.15; Description=Zinc finger C-x8-C-x5-C-x3-H type (and similar)
  Pfam annotation: Domain name=zf-CCCH; Domain location=49-75; Score =40.6; E_value=5.2e-09; Accession=PF00642.15; Description=Zinc finger C-x8-C-x5-C-x3-H type (and similar)
  Pfam annotation: Domain name=zf-CCCH; Domain location=94-120; Score =44.8; E_value=2.9e-10; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH::zf-CCCH; Domain location=140-166::297-323::358 -384::49-75::94-120
MDLYGRSPARNGPNPVNQPEWSSPGTDTALEESMWHLTLGGGESYPERSGVPNCVYYMRTGVCGYGGRCRYNHPRDRAAVAAAVRATGDYPERVGEPPCQYYLKTGTCKFGASCKFHHPKNGGGYLSQAPLNVYGYPLRPGEKECSYYLKTGQCKFGISCKFHHPQPAGTSLPASAPQFYQQVQSPTVPLPEQYGGASSSLRVARPPILPGSYVQGAYGPVLLSPGVVQFPGWSHYSAPVSPVPSPGAQPAVGATSLYGVTQLSSPTSAFARPYTPLPSTTDPSRSNPKEQLYPERPGEPECQYYLRTGDCKFGLACRYHHPRDHIVARPLLSPVGLPLRPVALHGFQMQHRIQLCTLGLQPCAFYLQNGHCKFGSTCKFDHPLGSMRYSPSASSLIDVPVTPYPVGSLLSQLAPSTTSSDLRPELMSGSKKESFSARIPSSGNSSGTSVGLIFSQGGSVSLSDVQLSSQSNAPPNSSRSTRQSGEIR

SEQ ID NO: 167812 - protein, 373 aa, Glycine max
  Coding DNA Sequence Number=SeqID_51034
  Gene Ontology: Mol. function=nucleic acid binding; Cellular component= nucleus
  Homolog annotation: Hit_ID=Q84W91; Match level="QueryCoverage=91%, HitCoverage=81%, E-value=1e-132, Identity=60%"; Hit description=Zinc finger CCCH domain-containing protein ZFN-like 1
  Pfam annotation: Domain name=zf-CCCH; Domain location=137-163; Score =42.5; E_value=1.5e-09; Accession=PF00642.15; Description=Zinc finger C-x8-C-x5-C-x3-H type (and similar)
  Pfam annotation: Domain name=zf-CCCH; Domain location=294-320; Score =43.5; E_value=7.3e-10; Accession=PF00642.15; Description=Zinc finger C-x8-C-x5-C-x3-H type (and similar)
  Pfam annotation: Domain name=zf-CCCH; Domain location=46-72; Score =46.9; E_value=7e-11; Accession=PF00642.15; Description=Zinc finger C- x8-C-x5-C-x3-H type (and similar)
  Pfam annotation: Domain name=zf-CCCH; Domain location=91-117; Score =44.8; E_value=2.9e-10; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=137-163::294-320::46-72::91-117
MDLYGRAPARNGSNPLNQPEWGTDTALEESMWHLTLGGVESYPERPGVPNCVYYMRTGVCGYGDRCRFNHPRDRAAVAAAVRATGDYPERVGEPPCQYYLKTGTCKFGASCKFHHPKNGGGYLSQAPLNIYGYPLRLGEKECSYYLKTGQCKFGISCKFHHPQPAGTSLPTSAPQFYQQVQSPTVPLPEQYGGASTSLRVARPPVLPGSYVQGAYGPVLLSPGVVQFPGWSHYSAPVSPVLSPGTQPAVGATSLYGVTQLSSPTSAFARPYTPLSSTTGPSGSSLKDRFFPERPGEPECQYYLRTGDCKFGLACRYHHPRDHIVAPLLSPVGLPLRPSGFRCTRINMDSNQSGVRDNIQLLLFTIAELALDST

SEQ ID NO: 167813 - protein, 59 aa, Glycine max
  Coding DNA Sequence Number=SeqID_51035
MVTIGESGYNGDDYGGGYNNHGGYNFDNYITILDHGGGGGDSSSGDSDNNNNHVGCDNG

SEQ ID NO: 167814 - protein, 102 aa, Glycine max
  Coding DNA Sequence Number=SeqID_51036
  Gene Ontology: Mol. function=protein disulfide oxidoreductase activity; Cellular component=chloroplast; Biological process=cell redox homeostasis
  Homolog annotation: Hit_ID=Q9LYC8; Match level="QueryCoverage=99%, HitCoverage=100%, E-value=3e-32, Identity=61%"; Hit description =Glutaredoxin-like protein
  Pfam annotation: Domain name=Glutaredoxin; Domain location=13-75; Score=60.6; E_value=5.2e-15; Accession=PF00462.14; Description =Glutaredoxin
MDLITSMVAERPVVIFSKSTCCLSHSMTTLIRSFGANPTIYELDEMTNGQQIESALLQMGCQPSVPAVFIGQQFIGGSKRVMSLHLRNELVPKLINARAIWI

SEQ ID NO: 167815 - protein, 176 aa, Glycine max
  Coding DNA Sequence Number=SeqID_51037
MDMNIGALTSGQISSIAQSNSSRLGFPTLITALYRAIGVTSDSLTYKSLIPTINLAYIKKSCWNVDDLTTNFRGARKARARPADVPSSSAPPAPSTFATPTPAPPGPSAQESQRFEAMLHSLHQGQILLMQSLQVVAPPGSIMLVEQFMEKVSWPEILPSIVREGGGPSAQVEDRR

SEQ ID NO: 167816 - protein, 168 aa, Glycine max
  Coding DNA Sequence Number=SeqID_51038
  Subcellular localization annotation: CTP_CleavageSite=85; ConfidenceScore=5.68e-01
MAQPLITLQPPMMPNTVLCIGNGARKMLSNHVSFSAAPLRALSGGTLPSNSSYNSFQCRKLGLHRSTNAVINAKSILHCLVRAICWNLVDDNNGTICRSDSVFRSDKTKSISLNPTMTLPNIITTIQSSIKDDDVTPIITALWYHCPIYQFNAHVEYRAIQIIDEEGV

SEQ ID NO: 167817 - protein, 57 aa, Glycine max
  Coding DNA Sequence Number=SeqID_51039
MNKIYLGQFALSRNLLYPHEHLGIWVSQPTLRLEGDAGLKGVSSKKGKCAELPPMFI

SEQ ID NO: 167818 - protein, 98 aa, Glycine max
  Coding DNA Sequence Number=SeqID_51040
  Homolog annotation: Hit_ID=Q2QMW0; Match level="QueryCoverage=58%, HitCoverage=12%, E-value=1e-11, Identity=55%"; Hit description =Expressed protein
MVKLVTLAKGNTTWQKGRFGENTIISNIDTGFVGNVGSCTKINRPVDIITVVGGQGYSLHADIQYLDARWEVLVVLPLRDCFAQDINMLCHLDGFVVL

SEQ ID NO: 167819 - protein, 122 aa, Glycine max
  Coding DNA Sequence Number=SeqID_51041
  Subcellular localization annotation: CTP_CleavageSite=36; ConfidenceScore=5.19e-01
MFHTPDNSAKPSEAVKYASFQALHESRSHVDDKKVTSMLSPSPSRLMLRPRSSRVTLDLLSIMEEPVTTIRILGIEIQPYLPPPPGSVRILGVELRPYLPPPRPLLEIDAPVSNANMKPQPS

SEQ ID NO: 167820 - protein, 296 aa, Glycine max
  Coding DNA Sequence Number=SeqID_51042
MPLPLAECSGVASAISDLAMQGFQPTVSMDIASGVGEIMQYGYSHWVYEENDGVIFEGSKKAIQIKLSGKYVALQICDDEDVETILESFQQQDQMSDLELYIEKDVAGGSMFHSANSLTSCGNNLSNNEAQPPRNVSNLHGDEDDDDDYLVSNSYVEESLDKDDSVDGISDTDDEVTDMIQPVRIVHPAEAPNKSPISAIALGTFHCVPNGALGVGIGASCCCEGDTNTSVLDTKKMLVVCNTFHGHAPLFVGNILPLQQPPFACLSLEFQHLTGECETLVLEIDALMLDHVTQAQ

SEQ ID NO: 167821 - protein, 88 aa, Glycine max
  Coding DNA Sequence Number=SeqID_51043
MTLDLLFVMDRPVTCNILDQGVEPQYNLLHVDGWAVGQEGEAPLPRSLLTLGLHVSDAEVELTTLILGPPGSEKEAIEKAKLDLHLKI

SEQ ID NO: 167822 - protein, 80 aa, Glycine max
  Coding DNA Sequence Number=SeqID_51044
MDTKEFNFPRISHTCAHNIDSLPLWNLSPATSPNPYYEGNKRGENECFGAKLVAPEAHRKSFSYASQEKCDEEYPYHHIL

SEQ ID NO: 167823 - protein, 117 aa, Glycine max
  Coding DNA Sequence Number=SeqID_51045
  Gene Ontology: Mol. function=DNA-directed RNA polymerase activity; Cellular component=mitochondrion; Biological process=transcription
  Homolog annotation: Hit_ID=O47884; Match level="QueryCoverage=91%, HitCoverage=12%, E-value=4e-28, Identity=63%"; Hit description=RNA polymerase
MDAADKGTKASKTRAYPFGTALVEFLVSRGLLRLVTYNVDLLNFSDDSGPKTVVKNVVKKGHNYYRSSLVYAECLFNPALLPIKLNLPMVFPPKDWEPHKPEQKPTLRAKSTALNGV

SEQ ID NO: 167824 - protein, 44 aa, Glycine max
  Coding DNA Sequence Number=SeqID_51046
MINTHALKVATVPHCHFQFCSLYFFVIVKWDESVVDVEKEILPG

SEQ ID NO: 167825 - protein, 308 aa, Glycine max
  Coding DNA Sequence Number=SeqID_51047
  Gene Ontology: Mol. function=nucleoside-triphosphatase activity; Cellular component=membrane; Biological process=cobalt ion transport
  Homolog annotation: Hit_ID=Q9A947; Match level="QueryCoverage=94%, HitCoverage=89%, E-value=2e-60, Identity=46%"; Hit description=ABC transporter, ATP-binding protein
  Pfam annotation: Domain name=ABC_tran; Domain location=44-218; Score =165.5; E_value=1.4e-46; Accession=PF00005.17; Description=ABC transporter
MATSPLPVPPMDPIAPSLARLQQVQVRYRDHTALHGIDLQVRAGQVLALLGRNGAGKSTAISVLLGQRRADAGLVELLGGDPQQRASRLGLGVMLQSTNLPPMLQVDELVAQASACYPDPMPLPEVLQRAGLQALARRRYGQLSGGQQRAVQFAIALCGRPRVLFLDEPTTGLDIQARQAMWQAVRQLVAEGCGVLLTTHYLEEAEALAQRVVVLEGGRVLADAPLAELRLADRPRRIRCRSVLTVEDVQQWPGVQQVQRDGEHLQLLASPAEPVVARLLAADAQLRELEVQGAALADAFLDMTREAA

SEQ ID NO: 167826 - protein, 351 aa, Glycine max
  Coding DNA Sequence Number=SeqID_51048
  Gene Ontology: Mol. function=motor activity; Cellular component =myosin complex; Biological process=negative regulation of actin filament polymerization
  Homolog annotation: Hit_ID=Q1T0L3; Match level="QueryCoverage=97%, HitCoverage=37%, E-value=1e-81, Identity=76%"; Hit description=IQ calmodulin-binding region; Myosin head, motor region; Myosin, N- terminal, SH3-like
  Pfam annotation: Domain name=Myosin_head; Domain location=58-351; Score=-88.0; E_value=8.6e-12; Accession=PF00063.11; Description =Myosin head (motor domain)
ATEREVGAGNNTVNFRRGSLCFTLKWKREFLSLFCFSKVIKVAISELLPANPDILEGVEDLIQLSYLNEPSVLHNLQSIYSHDMIYSKSGPTLIALNPFKDVQIYGDDYISAYRQKLMDRPHVYAMADAAYNEMMRDEANQSIIISGESGSGKTETAKIVMQYLAALGGGCSGIENEVLLTNFILEAFGNAKTSKNDNSSRFGKLIEIHFSTMGKICGAKIQTSVTNAALVMGCSSHELMEALSTHKIQAGKDTITKTLTLWQAIDARHALAKFIYASLFDWLIEQVNKSLEVGKRRTGRSISILDIYGFESFQNNNFEQFCINYANERLQQNFNWHLFKLEQEVINYVKL

SEQ ID NO: 167827 - protein, 40 aa, Glycine max
  Coding DNA Sequence Number=SeqID_51049
MGKAKGPFGVVVARPGEMELTQASWFLHHEAIWWPRRARG

SEQ ID NO: 167828 - protein, 49 aa, Glycine max
  Coding DNA Sequence Number=SeqID_51050
MVVQRIVLEGYSSKMVLANNRLRRRFLAKNRLRKDPRKERVCDSVTVWH

SEQ ID NO: 167829 - protein, 56 aa, Glycine max
  Coding DNA Sequence Number=SeqID_51051
DQGVPTEPKRIKIFPDWPTPPCVEGRSPKYEEPRDLRSNHFQDGGDDAILALKGIG

SEQ ID NO: 167830 - protein, 176 aa, Glycine max
  Coding DNA Sequence Number=SeqID_51052
MDMNLGSFISSQITLRAQHDSSRLGFPTLITALCKARGVRSDFLTLESLSPAINLAYIKKNCWNLDDPIVTFRGPRKARGKRSEAPSTAPSEALAPSSSTLPPSSSIEIPVIPPAPTQIPLPTPISTGPANSLFTPQMLHSMLQSIHRGQSIVMQSLQGLGLPSIMSMEEFDSQVA

SEQ ID NO: 167831 - protein, 220 aa, Glycine max
  Coding DNA Sequence Number=SeqID_51053
  Homolog annotation: Hit_ID=Q2QVB3; Match level="QueryCoverage=68%, HitCoverage=35%, E-value=2e-29, Identity=44%"; Hit description =Expressed protein
  Subcellular localization annotation: CTP_CleavageSite=18; ConfidenceScore=5.04e-01
MQNPNPKDDDDLLTFSLSCNRPKRETHSFPTNPPPLTMQTPFINPMLYPLRHVLAAAPRETIPPPFPWATNHRATVHTRKYLLENKIVKIKGSVECKRCKNKFEMVLDLEGKFSELWSFIQKKKDSMHDREPKVWMQPVLPKCQHCGQENSVQPSLAGTKKKAINWLFLLLGQMLGCCTLKQLKYFLKHTNIHRAGAKDRNLYSTYMGLCKQLVPEWFGS

SEQ ID NO: 167832 - protein, 56 aa, Glycine max
  Coding DNA Sequence Number=SeqID_51054
MENINSKLRGMRDHKDISLAHPQVAAAAHESLAVACKKLGRTYKTDYDADIYILEY

SEQ ID NO: 167833 - protein, 205 aa, Glycine max
  Coding DNA Sequence Number=SeqID_51055
  Gene Ontology: Mol. function=structural constituent of ribosome; Cellular component=ribonucleoprotein complex; Biological process =translation
  Homolog annotation: Hit_ID=Q9LX88; Match level="QueryCoverage=60%, HitCoverage=96%, E-value=1e-63, Identity=96%"; Hit description=40S ribosomal protein S15a-4
  Pfam annotation: Domain name=Ribosomal_S8; Domain location=5-132; Score=198.1; E_value=2.1e-56; Accession=PF00410.9; Description =Ribosomal protein S8
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQFGYIVLTTSAGIMDHEEARRKNVGGKVLDPTQISDLDVLLMVELNSGVDEDLVKDPEDLRKIYDHSCFTKAQPWLLCGSITIASTSRNSSAINLYDGKGLFRWPKMG

SEQ ID NO: 167834 - protein, 194 aa, Glycine max
  Coding DNA Sequence Number=SeqID_51056
  Gene Ontology: Mol. function=translation elongation factor activity; Cellular component=mitochondrion; Biological process=translational elongation
  Homolog annotation: Hit_ID=Q9ZT91; Match level="QueryCoverage=98%, HitCoverage=38%, E-value=6e-78, Identity=77%"; Hit description =Elongation factor Tu, mitochondrial precursor
  Pfam annotation: Domain name=GTP_EFTU_D2; Domain location=4-94; Score= 78.4; E_value=2.3e-20; Accession=PF03144.15; Description=Elongation factor Tu domain 2
  Pfam annotation: Domain name=GTP_EFTU_D3; Domain location=99-193; Score=190.4; E_value=4.3e-54; Accession=PF03143.7; Description =Elongation factor Tu C-terminal domain
  Pfam module annotation: Pfam domain module=GTP_EFTU_D2::GTP_EFTU_D3; Domain location=4-94::99-193
MGRGTVVTGRVEQGTIKVGEEVEVLGLTQVDMEVKYVLSCHVNECFALCGPLKTTVTGVEMFKKILDRGEAGDNVGLLLRGLKRDDVQRGMVVTKPGAFKTYKKFEAEIYVLSKDEGGRHTAFSSNYKPQFYLRTADVTGKVELPESVKMVMPGDNVTATFELISPVPLEIGQRFALREGGRTVGAGVVSKVMA

SEQ ID NO: 167835 - protein, 285 aa, Glycine max
  Coding DNA Sequence Number=SeqID_51057
  Gene Ontology: Mol. function=translation elongation factor activity; Cellular component=intracellular; Biological process=translational elongation
  Homolog annotation: Hit_ID=Q8W2C4; Match level="QueryCoverage=71%, HitCoverage=43%, E-value=3e-81, Identity=76%"; Hit description =Translational elongation factor Tu
  Pfam annotation: Domain name=GTP_EFTU; Domain location=54-253; Score =205.0; E_value=1.8e-58; Accession=PF00009.17; Description=Elongation factor Tu GTP binding domain
MASTAFRNLNSKRLSSFSLCISQVLTSHSLVEFAPPYPKTCIYRDHWPLSLERKDPPFLGTTLLFLSPFPSLFYVLAEESKAKAAFEDIDKAPEEKKRGITVATAHVEYETAKRHYAHVDCPGHADYVKNMITGAEQMDGGILVVSAPDGPMPQTKEHILLARQANSSFCQCVGVPSLFCFLNKVDAVDDPELLELVEMELRELLNFYKFPGDEIPIVRGSALSASQGTNEELGKKAILKLMDALDEYISDPVRQLDKPFLMPVDDVFSILVSTKIITDVYQNNS

SEQ ID NO: 167836 - protein, 849 aa, Glycine max
  Coding DNA Sequence Number=SeqID_51058
  Gene Ontology: Mol. function=binding
  Homolog annotation: Hit_ID=Q10L20; Match level="QueryCoverage=93%, HitCoverage=93%, E-value=1e-170, Identity=43%"; Hit description =Expressed protein
  Pfam annotation: Domain name=Arm; Domain location=372-415; Score=7.9; E_value=1.3; Accession=PF00514.13; Description=Armadillobeta-catenin -like repeat
  Pfam annotation: Domain name=Arm; Domain location=632-670; Score =11.9; E_value=0.39; Accession=PF00514.13; Description=Armadillobeta -catenin-like repeat
  Pfam module annotation: Pfam domain module=Arm::Arm; Domain location =372-415::632-670
MDHRLSVKKEGEGIVHIQVAELHRLSETSKTSTMFEPRGLSSIEKRDSDADNSFSAATARAPEKKLTLFALRLAVLEKAATSLGTLGFIWATVVLLGGFAITLDITDFWFITIILLIEGTRIFSRSHELEWQHQATWSITDAGINSFRMLRSSPNLLLQSIESLFRPIVTKKQRRDMMESNVTPRYRDNTTISIWTPTRMWISSDVPLLPYARWFFLSRHISKLLYWLQLFSATACVVLSSMKLVKHNYGEVDKGDTDKRNRESALNIFYALALAEALLFLMEKAYWEWKISYCKLLDEVSKECGLGPSGMVSIRRFFYDAYSRCVNGSIFDGLKMDIVCFAMDLLASNSPDEQLIGGRILRQFAVSERFSDDTLQKLGISISVVERLVEMLNWTDHKEEEIRLSAAEILSALAGKKQNSLRIAGIPGAMESISSLLQTNRNCIHAADEIGEKKLIFDHPNYGYWTFNHLGLLILKKLARDHDNCGKIGNTRGLLPKIIDFAHAEERLLKNENATPSQILTVKRSLQLVKMLASTTGTYGKHLRREISEIVFTISNIRDILRHGEKHPLLQKLSIEILTSLALEEEATERIGGTGGVLKELFNIFFKDYIAENRKDVTTVAGEALAMLVLESKSNCHRILKLKVLERLIEALKVPPLHINAARILRNLCTYSGSECFKQLWGVTAAAPTVLQAIMSQENKLQEVMIGLAASVFSFMTSSESSTVFEESGITEAELANKLIHILKKHRYPPTKVPRIRRFVIELAIWMMKEREENIHTFKDLGMEEVLEGVLETTSELESFNVFSGTVGLNRHNLTIHSLVETALKFLEDSNYSKFFRKVAMFAGAGKIA

SEQ ID NO: 167837 - protein, 497 aa, Glycine max
  Coding DNA Sequence Number=SeqID_51059
  Homolog annotation: Hit_ID=UPI00005DC23F; Match level="QueryCoverage =66%, HitCoverage=71%, E-value=1e-119, Identity=60%"; Hit description= catalytic
MRTGEVTNKTFYQIGCRVDASEAALILLPSNITVFTLDFSGSGISGGEHVTLGWNEKDDLRAVVNYLRADGNVSLIGLWGRSMGAVTSLPLGVVDPSIAGMVLDSPFSDLVDLMMELVDKYRVRLPKFAVKFAIQYMRKTIQKKAKFDIMNLNTVKVAKSCFVPALLGHAIDDDFIRPHHSDFILEAYMGDKNIIKFEGDHNSSRPQYYFDSVNIFLHNVLQPPEDELGESFFDIMNDYFEPSTSSTVEDIKQVCLKRPMSMREAQKCDGLSSSSSTIISFELSNGRLYSPLIPTDLDDDHYVEFQLDDFTGCPSSAKKEQKMFMEAVVDSLKDREIRIPEVEQPPVSSASTMSIEPSDEDDSHASSHKISKPMETEPSLLNQSVKTISTASDALEPLKTEPNSISVIPSPVPSLSSSKIPLPQPPPLDTSSVADSSNTESTTACNDNSASLQSSSDTDISHNTKATLTVIKNPAGHVLNCLLGRWDFNFFRNSHNR

SEQ ID NO: 167838 - protein, 107 aa, Glycine max
  Coding DNA Sequence Number=SeqID_51060
MLKSIRSISKHPDENVKKKRTLTEKVDPSTERERGKRREDGVPGKLTYKTFEFCNEKKEKGVEGRRERNLVRQDNCETKKNSRRHVADVAGRMNSKISVIRHSTVQQ

SEQ ID NO: 167839 - protein, 182 aa, Glycine max
  Coding DNA Sequence Number=SeqID_51061
  Gene Ontology: Mol. function=cobalt ion transporter activity; Cellular component=integral to membrane; Biological process =cobalamin biosynthetic process
  Homolog annotation: Hit_ID=Q00SK4; Match level="QueryCoverage=98%, HitCoverage=16%, E-value=7e-26, Identity=37%"; Hit description =Homology to unknown gene
  Pfam annotation: Domain name=CbiQ; Domain location=1-179; Score= -47.0; E_value=0.071; Accession=PF02361.7; Description=Cobalt transport protein
MAFSSGCSTGKVTHNYEICISSVPDFAFNLGSTKKCLDGLGSDGAPALVQLRTPPPAMMGLPNLPVSLTGYAYTIMKLGPLTFTRKGLSVASTIACLTFTVFQSASLCLTTTSPEQLAFALRWFMLPLKYIGVSVSEIVLTLLLSLRFISLVFDEVRNIALGIVSRRLNWKQLTVMETIDSK

SEQ ID NO: 167840 - protein, 158 aa, Glycine max
  Coding DNA Sequence Number=SeqID_51062
MEETLTHFMQNPKEEWKAVMTRSKRFVEAEDEDSVVSKKKAAEKKGIDERKNENEERSRSGQAREKKREKAVIEGPEVPYPVVPSKKKKDHHLARFLDIFRKLEITMPFGQMPLYSKFLKDMLKRKHKYIHQENIVVEGNCSVVIQKILPPKHKDPGS

SEQ ID NO: 167841 - protein, 83 aa, Glycine max
  Coding DNA Sequence Number=SeqID_51063
  Gene Ontology: Mol. function=RNA-directed DNA polymerase activity; Biological process=RNA-dependent DNA replication
MGCVLGQHDEFEKRERVVYYLSKKFTACEMNYYLLERTCCALVWAAHHLRQNMLNYTTWLVSKMDPVKYIFENPALTGRIARW

SEQ ID NO: 167842 - protein, 71 aa, Glycine max
  Coding DNA Sequence Number=SeqID_51064
MRFLTSHVQSFEFGMTEPFNESISCFLNGVDPWVLVPSPSDDYMSSPLEDYTSSPSEDYTSSPSEGCTPSP

SEQ ID NO: 167843 - protein, 59 aa, Glycine max
  Coding DNA Sequence Number=SeqID_51065
MIQSQSKSSFPEPSAFRRDIYWAKRAPLAKLPYLVYFVNCMVPLSSTYEELSAYPCDIC

SEQ ID NO: 167844 - protein, 147 aa, Glycine max
  Coding DNA Sequence Number=SeqID_51066
MSCLVIITPTFLCRSVSWCMPPTRHPLDPDKSNRALGFPALITGLCQSFGVPVTPSKVIRLPITRAFIEKYCTPRQVQGDAPQAADAPPPHQADPTGSLGMERYLQHLVRQQAANHRGQGQGFAPIACPTPDQFRVEVVWPGDWPEA

SEQ ID NO: 167845 - protein, 242 aa, Glycine max
  Coding DNA Sequence Number=SeqID_51067
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=1e-27, Identity=30%"; Hit description= UPI00006A17C9 related cluster
RATRPRHQRAARPNLQRVAHPRLHRATCPHLHRATCPHLQRTACPHLQRTARPHLRRTTRPRLERATRPRHQRAARPNLQRVAHPRLHRATCPHLHRATCPHLQRNACPHLQRTARPHLRRTTRPRLKRATRPCHQRAARPNLQRVAHPRHQRVTSPNFRGLHVLAFIGLHALTFRGLHVLAFIGLHALTFRGLHVLAFIGLHALTFKNVTRPHLQRTARPHLRRTTRPHLERATYPHLKII

SEQ ID NO: 167846 - protein, 88 aa, Glycine max
  Coding DNA Sequence Number=SeqID_51068
MSGRHRPIDTSAGGDRHYVVMLVRMIHTHLFAAARVKSCPGMHSSCVMASLSGCARIVGPPPISGGGPGKRTDKGKLLAPEGGSATLG

SEQ ID NO: 167847 - protein, 90 aa, Glycine max
  Coding DNA Sequence Number=SeqID_51069
MRITKIPKEVIHNSGHAKYPLPPTAFNLETEHRLLARHLILNKNIRVVLPTLVLDDCWEYTFLPRYNGRLSPTENCSYLVRLDMVAKLAQ

SEQ ID NO: 167848 - protein, 127 aa, Glycine max
  Coding DNA Sequence Number=SeqID_51070
  Subcellular localization annotation: CTP_CleavageSite=32; ConfidenceScore=5.71e-01
MGSPPASTTPPPPPPPPSPPSPPPPPLTSDTSASTSVVKRTRKADGPHKKKLRTYLGIVARDKVDITYKNWKEVPTAQKDLIWEDIQDVRMKAQAIQKQNTAPHILSRGGYDYLEHKLLAEKTKKKM

SEQ ID NO: 167849 - protein, 86 aa, Glycine max
  Coding DNA Sequence Number=SeqID_51071
MAVKHCEVVKRKSHANKKWSSDKIRCCNYFSLNIGKFGGSADFEPVAKPILWLSDVVVHGLAYRRSWKWMSCHDALSENQLAKCTA

SEQ ID NO: 167850 - protein, 361 aa, Glycine max
  Coding DNA Sequence Number=SeqID_51072
  Homolog annotation: Hit_ID=Q2PT28; Match level="QueryCoverage=52%, HitCoverage=84%, E-value=6e-69, Identity=63%"; Hit description=QnrB3
GLELKAFAEAQPGWQLLGRGSGRTDAGPGRTDTGSAEVARAAAGRLHRRCTRSALRRCHLPVDPALPRRRAAPAHVARAAPAPAARRAAGGGAPQRAAGSGRQAALVAALRGVRRSLGGCPRRCAARDRGHCRAAAAAGARAGGRPAAGGRLRRRGAVLCRLQLQGLGGVRQRHLLHVQRGAAQVGPAQVQLAQLGVGQIAVGEVGAVPVDALELAAGQVRAGEAGATHVRTVPTVFPKLALLQRHPREVRVAQVRLLDEGTAEPAPRGDLVHEAGVAEIRALRAALADLQAQCLDEVEVAHADVAAAEAGFLQRGAVEATAGTAVGIVETAVDELGAGHVRAGEIALVELLVDHLLAGVL

SEQ ID NO: 167851 - protein, 48 aa, Glycine max
  Coding DNA Sequence Number=SeqID_51073
MTARPGELMLHPEVSLAFLIKTLNDHLFRIVTDVQHHQSISKDQKISK

SEQ ID NO: 167852 - protein, 169 aa, Glycine max
  Coding DNA Sequence Number=SeqID_51074
PYGEVSRSFVVRWKDELEPTWHLLHSSGNMHFVTYSQDLVSSTLLVGWTELREFYGLTGNHQLTLNNTPCTTKFLTQPLKVLLTEYKVTCNSLDVLSTMYSLMKATRFTHLKLEGTTECRIVYNHHRKIAKNGNRWRNFSQPQNLLPGTQIIFVFADATSNFVLFWLCL

SEQ ID NO: 167853 - protein, 103 aa, Glycine max
  Coding DNA Sequence Number=SeqID_51075
  Subcellular localization annotation: CTP_CleavageSite=18; ConfidenceScore=5.13e-01
MGVRLAIIGGVELSSSFSSQGAPSPSFLSKALCWWQNSFFHGLFPSGWRLLSPLLLCLPLHLHGGKSPLKDLIETQRSSLHRSSTSKLPSSGIIAQELQVGAP

SEQ ID NO: 167854 - protein, 130 aa, Glycine max
  Coding DNA Sequence Number=SeqID_51076
MGTTTVEDRRKRRMNAKYRRTVENLRIITHENITEAPRLGFSSRKQFSLAILREYEVPRRLAPFLFTPPIYSKIGEELATQLAQASKVASSRSNRLLRKKLEGPSGPDGYSHPPFLLNAPPVLFLVILFP

SEQ ID NO: 167855 - protein, 51 aa, Glycine max
  Coding DNA Sequence Number=SeqID_51077
MVIPRTFEEGDFVLRKAGTSGNGFLNWGKILQSPTCSATCKHIGKRVPKPG

SEQ ID NO: 167856 - protein, 122 aa, Glycine max
  Coding DNA Sequence Number=SeqID_51078
MSDNYNSGDTNSSRSFKTNIDIGSSNEPLFNISFQGFDKPINHYIIRSSQIVNLLRNKILIYSTRGPRMSQTKLTIIPHVEFSINNFTKGTAKRLLDTDHWMELLNLPQSVVKRVSRDKRIT

SEQ ID NO: 167857 - protein, 121 aa, Glycine max
  Coding DNA Sequence Number=SeqID_51079
MVILVTFITNHHACTLTSRKKETKRERRMKDRKKTLKQRELLCAPSTQQLCDRTKLSLLKNHNFELRKNFLTCHLAEELLSQKTTKEDSFAVENNNSGRTFFRGFLRKNFFRQITRKKVLP

SEQ ID NO: 167858 - protein, 90 aa, Glycine max
  Coding DNA Sequence Number=SeqID_51080
  Subcellular localization annotation: CTP_CleavageSite=53; ConfidenceScore=5.41e-01
MAYTHIPGHLTTAFKIAPCVASLANVGIYTQFSSNFSQPASIRPCTLRLRVIQCSMECPRAPPRYAHVAFESYPQKSGGLREPSRGYGYH

SEQ ID NO: 167859 - protein, 80 aa, Glycine max
  Coding DNA Sequence Number=SeqID_51081
MTKLGLCLSSGPPPLDDKRVWITVRYLRVSSGPPPLDDTKVSPRATSSWVMATKGGVVDKSEALAPTYPPMRNSDLRSSG

SEQ ID NO: 167860 - protein, 86 aa, Glycine max
  Coding DNA Sequence Number=SeqID_51082
MHAKARVMSEIEEVQEQMKADMEAMKEKMTTMMEAMMSMRKMMEASTTTVTAASTTTEVDPAHPSSLNQVNSPVSDMVGQGGITLG

SEQ ID NO: 167861 - protein, 149 aa, Glycine max
  Coding DNA Sequence Number=SeqID_51083
  Gene Ontology: Mol. function=GTPase activity; Cellular component =intracellular; Biological process=tRNA modification
  Homolog annotation: Hit_ID=Q2KTI2; Match level="QueryCoverage=59%, HitCoverage=19%, E-value=3e-34, Identity=77%"; Hit description =Probable tRNA modification GTPase
MYDSLYKTPPKDVAFLETKSTHIELPAPKGGGPLYVTVMPFDKHGESVGRRWQKRVTLLPYAKAGKDLAQQIIAGELPGDARQAVMRQPQFLGEQVQHADVLFHVIHVQRQVIGGILQRVQVPFARHPGRLGAGIPAGDAYHLGAQSEQ

SEQ ID NO: 167862 - protein, 82 aa, Glycine max
  Coding DNA Sequence Number=SeqID_51084
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=100%, HitCoverage=8%, E-value=1e-34, Identity=81%"; Hit description =Putative receptor-like protein kinase 2
MHEESRLKVVHRDLKTSNVLLDEDLNPKISDFGLARLREGDNTHISTRIAGTWGYMAPEYAMHGYLTEKADVYSFGVITIEI

SEQ ID NO: 167863 - protein, 282 aa, Glycine max
  Coding DNA Sequence Number=SeqID_51085
  Gene Ontology: Mol. function=dTDP-4-dehydrorhamnose reductase activity; Cellular component=intracellular; Biological process =extracellular polysaccharide biosynthetic process
  Homolog annotation: Hit_ID=Q1GZQ9; Match level="QueryCoverage=95%, HitCoverage=88%, E-value=5e-83, Identity=59%"; Hit description=DTDP -4-dehydrorhamnose reductase
  Pfam annotation: Domain name=Epimerase; Domain location=5-196; Score =9.5; E_value=7.7e-07; Accession=PF01370.11; Description=NAD dependent epimerasedehydratase family
  Pfam annotation: Domain name=NAD_binding_4; Domain location=1-173; Score=-99.5; E_value=0.034; Accession=PF07993.2; Description=Male sterility protein
  Pfam annotation: Domain name=RmlD_sub_bind; Domain location=2-277; Score=409.0; E_value=6.9e-120; Accession=PF04321.7; Description=RmlD substrate binding domain
  Pfam module annotation: Pfam domain module=Epimerase::NAD_binding _4::RmlD_sub_bind; Domain location=5-196::1-173::2-277
MDAFEVVACGRQQLDLTEPEQIRHVARTVQPDLIINPAAYTAVDKAEAERELAYAVNATAVQVLAEEAARLNTGLIHFSTDYVYDGTKSSWYVETDAVNPVSVYGASKLAGEEAIRKAGVPHLILRTSWVYGSYGKNFMKTIIRLAQERELLRIVADQHGAPTSDISIAQAVLQLLSHWQPDDSAQSGVYHLVNAGEATWYGFAKAIEAQYRALAGQAGWPALALKEMQPITTDEYPTPAKRPANSRLSTEKLAQQFGVTLPEWPQALNQVMAELDFRSANT

SEQ ID NO: 167864 - protein, 92 aa, Glycine max
  Coding DNA Sequence Number=SeqID_51086
MDSLKQSWHIDSGFSKHMAGDASKFIHIFPKDSEYVIYGDNKQSFKVLMMLERIYLIMIVIIKKFFKMVLMMLKRIHLVMIVIIKKGENVNV

SEQ ID NO: 167865 - protein, 167 aa, Glycine max
  Coding DNA Sequence Number=SeqID_51087
  Subcellular localization annotation: CTP_CleavageSite=57; ConfidenceScore=5.07e-01
MGSASRHSSSPFSALAEDLKKTSHLLQIIGLFVNSISTLSSMHVHRGGGILGFLSVSLKVVAGGFEVGTTVVVDDCRKRIRKGRYLGTPICALLRDPQAWRLNRKMKERFRLDKEDEGWAEMIMAMHKRVGQRQRLAKVNRPQRGRWGQRGVSGLRERQKKSHLRHG

SEQ ID NO: 167866 - protein, 249 aa, Glycine max
  Coding DNA Sequence Number=SeqID_51088
  Gene Ontology: Cellular component=integral to membrane; Biological process=defense response to bacterium
  Homolog annotation: Hit_ID=Q8RZQ8; Match level="QueryCoverage=84%, HitCoverage=77%, E-value=9e-74, Identity=66%"; Hit description =Putative MtN3
  Pfam annotation: Domain name=MtN3_slv; Domain location=128-214; Score= 120.7; E_value=4.1e-33; Accession=PF03083.6; Description=MtN3saliva family
  Pfam annotation: Domain name=MtN3_slv; Domain location=6-95; Score =86.9; E_value=6.1e-23; Accession=PF03083.6; Description=MtN3saliva family
  Pfam module annotation: Pfam domain module=MtN3_slv::MtN3_slv; Domain location=128-214::6-95
MDVAHFIFGIFGNVSGLFLFLAPIVTFWRIIKNKSTEKFSGVPYPMTLLNCLLSAWYGLPFVSPNNILVTIINGTGAGIEIIYVFIFIYFAPKKEKAKILGLFSFVVAVFSVVVLVSLFALHGNARKLFCGFAAAIFSIIMYGSPLSIMRLVIKTKSVEFMPFFLSLFVFLCGTSWFIYGLLGRDPFVAVPNGVGSALGTAQLILYFIYRDKKGDQKKKPRTEEEEAMEMGTANKNPISNSKGAQEGHV

SEQ ID NO: 167867 - protein, 241 aa, Glycine max
  Coding DNA Sequence Number=SeqID_51089
  Homolog annotation: Hit_ID=Q9M508; Match level="QueryCoverage=36%, HitCoverage=17%, E-value=4e-13, Identity=64%"; Hit description=Beta -ketoacyl-ACP synthetase I
MMLYAIGGDKKFNSRDDKGVTTFPRRINGISGNWDNWGDGNRGWVVTRMNIIRTRWVKTRIRGAIKTPTNNLAFRDHHPPRFSLGPSSGPQQCHRQATHLLATHLLCEVRVLRVRHGGAKGVHPAAVEGPKEARDYHGMRLASVFGNDMEGYYEKLLAGESGITAHAHRHRESVVLCNNLNSHALQLHLNTSFSAFYHDYDGYYEFDEEAYRRWSFGGAISPCLADLKHLNYLDLSGNDFE

SEQ ID NO: 167868 - protein, 298 aa, Glycine max
  Coding DNA Sequence Number=SeqID_51090
  Gene Ontology: Mol. function=DNA binding; Cellular component =chromatin; Biological process=DNA integration
  Homolog annotation: Hit_ID=Q1SDN3; Match level="QueryCoverage=89%, HitCoverage=33%, E-value=2e-66, Identity=40%"; Hit description =Polynucleotidyl transferase, Ribonuclease H fold
MKSLKMIHLAKLKHGLYHLQINKDVNQAIPKIWDIVQTPPHVRPIGCKWVYKIKHGPDGSVERYKQLDVSNAFLYGDLNEDVYMTIPQGVSGYQPFQCCKLKWSLYGLKQANCQWFAKLSNMLKHYGFTHTITVLIIYVDDIILTGLLNSKPCSTTMDTSLRLHHDFSEALTDPLSYKRLVGRLIYLTNTHLDIATPGKGYSSAKILLSNYLVLVIQTGPPVLTIVDLSLDIVSSLRLNIEPLPQPLVNCNGYFTYIETHGFFIQNVLHYTVIAKAYSTLQQIQCFMNGLNTWKLTAI

SEQ ID NO: 167869 - protein, 199 aa, Glycine max
  Coding DNA Sequence Number=SeqID_51091
  Gene Ontology: Mol. function=RNA-directed DNA polymerase activity
METATQPFESICGKFAMNPRPEKEGFRSHKQKPNEFGPRTRAGPRAYQCVGPALPRTNRFRRMRKLKSIFKRQQSIQRMFPNQGIRERINRQHCNLDLRDQSKINMKMHVWNLLMGVLNKVLHRGNEISVNSRSDERLILTKYEWQRNGERERERRRHFKEKMSLEEAHHHRRPWIRAWRKKEMNEGRGREEHEILCSK

SEQ ID NO: 167870 - protein, 104 aa, Glycine max
  Coding DNA Sequence Number=SeqID_51092
  Subcellular localization annotation: CTP_CleavageSite=20; ConfidenceScore=5.49e-01
MATPVPAVASTTKSSFPPAICMIRVRTRELCQTLGRVLGRTLGRQHRRLTTFARRQRATATIAEDVDHMDHAADKVHEQPQEPVTDHVGADTKDFPRDPMIHQC

SEQ ID NO: 167871 - protein, 123 aa, Glycine max
  Coding DNA Sequence Number=SeqID_51093
  Gene Ontology: Mol. function=structural constituent of ribosome; Cellular component=intracellular; Biological process=translation
  Homolog annotation: Hit_ID=Q2HVB5; Match level="QueryCoverage=62%, HitCoverage=31%, E-value=8e-18, Identity=60%"; Hit description =Ribosomal protein L25
MRERIFKSSTPSSSISTSNRVGQDAYGQDEVSLGVKVGVDLEVEEAGEEEGAAEVVDEFSDLVGADEDEALVVAVLAIFLLELDAPKSGKWLRSLTCSLSVLTILFIFAKIGMKEIGENRWQL

SEQ ID NO: 167872 - protein, 77 aa, Glycine max
  Coding DNA Sequence Number=SeqID_51094
MTPHTSSNTETFPVEQEDLHKKWKLVAYLVDSVGITQFSSSDWLVVGSFHVDGRIMHKRTFGSKLVFYDLHSGGFKV

SEQ ID NO: 167873 - protein, 127 aa, Glycine max
  Coding DNA Sequence Number=SeqID_51095
MSFCVVALQCNWTIYQGDGNFIKSKSKSPTWFKDSKSEQSKSVLQRRLKRSHCSSEEEVETPEESEEVQALKAELERVQAVKEKFKTTAIKVRKECDELRDVNVAIAEALEWETKRAQKEEWGRNKF

SEQ ID NO: 167874 - protein, 112 aa, Glycine max
  Coding DNA Sequence Number=SeqID_51096
MEENMWAIIDQYKEKLSLAATHEQRLEDEYAKVSVLQTEREARERVIDSLHREAMMWMDRFTFTLNGSQELPRLLAKAKAMADVYSAPEEVHGLLDYCQHMIDLMDHIIRNR

SEQ ID NO: 167875 - protein, 66 aa, Glycine max
  Coding DNA Sequence Number=SeqID_51097
MKMEPLTNSTVAHDYIILFCIDANSFDSREKIRPEKELQRARKILPLDGSIYHEHGYFEFCVFSLL

SEQ ID NO: 167876 - protein, 105 aa, Glycine max
  Coding DNA Sequence Number=SeqID_51098
MANWARTGVSVWPWVENGGCLIVVEAMVKLSNQSARSRLWYLMEYARLGFSRMPSTLKVAVNSSAHAAKEELVIRGNSEEGNYAAKWRLGSEEFGPLSGKECGAH

SEQ ID NO: 167877 - protein, 259 aa, Glycine max
  Coding DNA Sequence Number=SeqID_51099
  Gene Ontology: Mol. function=nucleic acid binding; Cellular component= nucleus; Biological process=translation
  Homolog annotation: Hit_ID=Q2QNI2; Match level="QueryCoverage=97%, HitCoverage=31%, E-value=6e-76, Identity=47%"; Hit description=Zinc knuckle family protein, putative, expressed
MTFIRAPSNALLKGLGYGHALSEHILLDAGLISSTKVPKDRMWDDVTIQPLVQAIVRDYTKFETFDAALDEFYGKIESQRSEQQQKAKENSAFQKLNKIRQDQDDLARMVKEEKKAGNPVTSLIDKLHLDRNCMTLLLSNNLDEMNDDEKTLPVDKVEVDLALLAHANARRWYEQKKKKESKQEKTIIAHEKAFKAAERKTRLQLNQKKTVASISHMRKVYWFEKFIWIISSENYLVISGRDAQQNEMIVKRYMSKGDL

SEQ ID NO: 167878 - protein, 220 aa, Glycine max
  Coding DNA Sequence Number=SeqID_51100
MATLFTMVVMTYSILSLDDQSTQVVFMREVEEENKRSLETLKQELKKAIKIELSQMASQHSPPVEADIQLLAAFVSTKGNCAKTTTNPSREEHATNVVPLMGLYIQCHHSTCLVTLGKVYDKASTIHNVDDVDSQIPPKKLIEPVQRSNTLGGDDPLSDLIKNLFMDEWSARLGHGSVYGFLEPQSIHNAKDRCAECQQYIETWEKESQREVYLGAYLNK

SEQ ID NO: 167879 - protein, 217 aa, Glycine max
  Coding DNA Sequence Number=SeqID_51101
  Pfam annotation: Domain name=Hin1; Domain location=33-179; Score =26.0; E_value=9.6e-06; Accession=PF07320.4; Description=Harpin -induced protein 1 (Hin1)
  Subcellular localization annotation: CTP_CleavageSite=58; ConfidenceScore=5.38e-01
MPRLNTDVNILFYPTIAAACSAFFFLILFLVLWVIFSTTTSSFTVTSVIVSKFNIITTHSTKSELTATFNVEGILQNHNIAYSIRYESLDLVLWFDNFTIASAPIRQPPFSTQAQTITPVQAQFAMARRPLPSGLASEITAERNYHGSVDFGATLVAGFRYKFGVLHSKKLGKIKDQRCTKHPQPPSCHWESKQLAKGNSQPSKENPGSHYDTPPEK

SEQ ID NO: 167880 - protein, 114 aa, Glycine max
  Coding DNA Sequence Number=SeqID_51102
MLEYLKEICEEGVTLRSGYGRVWKFATLSGNECGVDRQSSIVREQKLEHLTNRVNKLESAKKKLLESMKAVVEACDEIEASYNILRAKYMEFTNELHVLKMVDEKLSDEILDLN

SEQ ID NO: 167881 - protein, 49 aa, Glycine max
  Coding DNA Sequence Number=SeqID_51103
MVVDRGSGDCHLKVGDEVIFFYNIDQHLWEVLHRKQVKWDDKEDEADSP

SEQ ID NO: 167882 - protein, 62 aa, Glycine max
  Coding DNA Sequence Number=SeqID_51104
MVKTWSHNVHTESSIFVPSNETHDNTFMNVMGSPKFLQFIAKKESVTIFMKLYKVFVSFVVE

SEQ ID NO: 167883 - protein, 243 aa, Glycine max
  Coding DNA Sequence Number=SeqID_51105
MASRKRKATTTLSQASYDSSRFVSRDAWDRYADNILGRNILSERNVKLYINEFDDFRREVERRNWHRELTIFSEGSIDVVIVKEFYANLYVPEDKEPNQVRVRGYLIKFNANSLNTFLKTPVVLEQGDSLPSYSRFCRLRPDPQELVAWLCILGREFVLNTEGLPWKLLRKDLSTLVQTWSVLSYSNLAPTSHTSDLNLDRARSTYIQTDLAHCSVQLLEAWISSPHHCLVQGPRIHLRFSHL

SEQ ID NO: 167884 - protein, 148 aa, Glycine max
  Coding DNA Sequence Number=SeqID_51106
MAYHASSTTNQNSMKNHEIHFEIQVGELAEAVTQFMSRQEKSFVEAEVQEKSLEKDEEQAQQQWEKYSTVENQQENILQSNNLPHQLIDKKGRQGEHEETLSGVLSLITNTFLEMIWNVLPDYMKFMEFLARRRNFKEDVFFVTFKPP

SEQ ID NO: 167885 - protein, 272 aa, Glycine max
  Coding DNA Sequence Number=SeqID_51107
  Homolog annotation: Hit_ID=Q2HTB8; Match level="QueryCoverage=56%, HitCoverage=66%, E-value=7e-07, Identity=26%"; Hit description =Harpin-induced 1
  Pfam annotation: Domain name=Hin1; Domain location=32-172; Score =49.4; E_value=1.2e-11; Accession=PF07320.4; Description=Harpin -induced protein 1 (Hin1)
MPRENRDPDYSLRLIAATSSILLFLLTLMVIWMVFSPHTPAVKVTYLTVNKFNITPREELTAVFNVEGILRNPNIALSLTYERLTLALWFGNFTISSVVVEPPPFSIRGHTHAPIRARFEVVGMQIPNWVASEIAVQQRFHGGMDFGAMLDARFRYKFGMESSKVFSITLQCYPLRVELPLNDTMNNGRLHDRQKGTQLAKANTQPSKVNPGPHDITSPKRNPESRTYTMRISVGVMVGLLSCDLKFMDIVSSNRFSACGGKAAKYILPRIH

SEQ ID NO: 167886 - protein, 134 aa, Glycine max
  Coding DNA Sequence Number=SeqID_51108
  Subcellular localization annotation: CTP_CleavageSite=18; ConfidenceScore=5.09e-01
MRNQRRWFVAKRCSGVVVAAAAGARPSATAEGLMRPLGTETGSRRFTRERGVTLQAQLGCRREGWVLWDSAMCGGDKWNVAFVQHITTPKSQRIRYKSLPVCGPAEDVVAVTEAWPQQRRQRDDGVNDRLRRSD

SEQ ID NO: 167887 - protein, 255 aa, Glycine max
  Coding DNA Sequence Number=SeqID_51109
  Homolog annotation: Hit_ID=Q2HTB8; Match level="QueryCoverage=59%, HitCoverage=65%, E-value=3e-07, Identity=26%"; Hit description =Harpin-induced 1
  Pfam annotation: Domain name=Hin1; Domain location=32-172; Score =53.5; E_value=7e-13; Accession=PF07320.4; Description=Harpin-induced protein 1 (Hin1)
MPRENCDPDYSLRLIAATSNILLFLLTLMVIWMVFSPHTPAVKVTYLTVNKFNITPREELTAVFNVEGILRNPNIALSLTYERLTLALWFGNFTISSVVVEPPPFSIRGHTHAPIRARFEVAGMQIPNWVASEIAVQQRFHGGMDFGAMLDARFRYKFGMESSKVFSITLQCYPLRVELPLNDIMNNGRLHDRQKKAHPAAYCIAVRRRRSNQCNLPGTQLAKANTQPSKVNPGPHDITSPKRNPESRTYTMVIL

SEQ ID NO: 167888 - protein, 67 aa, Glycine max
  Coding DNA Sequence Number=SeqID_51110
ENVQEKDDVEDEEEKEDEAEEKEKEKGLTSGLELGLRLNGAEEIKAELKRLKRMKEHEKVVAHFLPF

SEQ ID NO: 167889 - protein, 56 aa, Glycine max
  Coding DNA Sequence Number=SeqID_51111
MENGSSLITRALPTPSSKWILSDNEKKNDEGEGKWVLKVDVDGEEEKRDHERFRFN

SEQ ID NO: 167890 - protein, 59 aa, Glycine max
  Coding DNA Sequence Number=SeqID_51112
MTWVCAVCAVGGDDAAIAGNWLVVLIATVVFEGGEGYLGIGIDGRGVVETVEAGSRGGG

SEQ ID NO: 167891 - protein, 104 aa, Glycine max
  Coding DNA Sequence Number=SeqID_51113
  Subcellular localization annotation: CTP_CleavageSite=72; ConfidenceScore=5.10e-01
MNCVFVHVSATFEFGAMHSDCLVKFSILNLFRNHKKFVFVHVSSTFEFGAMRSDCLVQFSVLNLFWSPMNCVFVHVSSTFEFGAMRSDCLVPFSILNLFRSPMN

SEQ ID NO: 167892 - protein, 129 aa, Glycine max
  Coding DNA Sequence Number=SeqID_51114
  Gene Ontology: Mol. function=transferase activity; Cellular component= mitochondrion; Biological process=RNA-dependent DNA replication
MDASPVKALPLPQVDDPDRVSWKFTTSDVLSTDHLQAEGNWKSIWNLKVPPKLKHFLWRVTRGCLPTRTNLRRRGIDCTTGCVFCQEHFESEWHVFVACSKAREMWTAAGIHYLLEQKFNEAEGIKELM

SEQ ID NO: 167893 - protein, 98 aa, Glycine max
  Coding DNA Sequence Number=SeqID_51115
  Gene Ontology: Mol. function=structural constituent of ribosome; Cellular component=intracellular; Biological process=translation
  Homolog annotation: Hit_ID=O22165; Match level="QueryCoverage=94%, HitCoverage=69%, E-value=8e-40, Identity=71%"; Hit description =Probable ribosome biogenesis protein RLP24
  Pfam annotation: Domain name=Ribosomal_L24e; Domain location=1-58; Score=88.5; E_value=2e-23; Accession=PF01246.10; Description =Ribosomal protein L24e
MRLEKCWFCSSTIYPGHGIQFVRNDAKIFRFCRSKCHKNFKMKRNPRKDSTFEFERKRNRPERYDRNLAENVLKAIPKIDKIRVSREERHHKNKSFLT

SEQ ID NO: 167894 - protein, 73 aa, Glycine max
  Coding DNA Sequence Number=SeqID_51116
  Homolog annotation: Hit_ID=Q2R1R7; Match level="QueryCoverage=91%, HitCoverage=4%, E-value=2e-11, Identity=53%"; Hit description=AT hook motif-containing protein, putative
MLDEYNVHAKTFRMARDRLQDAQVDNIKLKLIANREKDGRTYNVPTVPEVVALIVGDFDANSKRDIIIETQHG

SEQ ID NO: 167895 - protein, 89 aa, Glycine max
  Coding DNA Sequence Number=SeqID_51117
  Homolog annotation: Hit_ID=Q1T010; Match level="QueryCoverage=99%, HitCoverage=8%, E-value=2e-07, Identity=37%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEDNVLEVYDNKKRLVLKAHLSKNKIFKVGIDVMEHECLTTAVNKRIIWCMAYHTFKCQVKYTRNAWSESKLETPSSNWFQPGQVTSLR

SEQ ID NO: 167896 - protein, 341 aa, Glycine max
  Coding DNA Sequence Number=SeqID_51118
  Gene Ontology: Mol. function=nucleoside-triphosphatase activity; Cellular component=membrane; Biological process=transport
  Homolog annotation: Hit_ID=Q8H0V6; Match level="QueryCoverage=67%, HitCoverage=55%, E-value=1e-121, Identity=70%"; Hit description=ABC transporter protein, putative
  Pfam annotation: Domain name=ABC_tran; Domain location=157-322; Score= 137.2; E_value=4.6e-38; Accession=PF00005.17; Description=ABC transporter
MQQSTSIYLVKIPKGCLEAETCNEESQQECSVLLVFKCSEELLLSNRCSGKGFVGKDRLKLGLIIKRKPNQNLLYLVLVKSFSDATLSSFYEKPSLTSSVIMRRGHHLFNLESSYKFDFPTPEDRPGAPIISFSDASFGYPGGPILFKNLNFGIDLDSRIAMVGPNGIGKSTILKLIAGDLQPSSGTVFRSAKVRIAVFSQHHVDGLDLSSNPLLYMMRCYPGVPEQKLRAHLGSFGVTGNLALQPMYTLSGGQKSRVAFAKITFKKPHIILLDEPSNHLDLDAVEALIQGLVLFQGGILMVSHDEHLISGSVEELWVVSDGRVAPFHGTFQDYKKILQSS

SEQ ID NO: 167897 - protein, 56 aa, Glycine max
  Coding DNA Sequence Number=SeqID_51119
MAEWSIALDPGLENRKGGSRAESQNTEKKRDGSSQKSHQGRPEMGGSAGDESQNRD

SEQ ID NO: 167898 - protein, 107 aa, Glycine max
  Coding DNA Sequence Number=SeqID_51120
  Homolog annotation: Hit_ID=Q1SP03; Match level="QueryCoverage=84%, HitCoverage=16%, E-value=2e-10, Identity=38%"; Hit description=IMP dehydrogenase/GMP reductase
MGTNQNDKRFYQVKVKSLDVTSLKELGRLMGPLQRQAFRKVYGKILDLTAAEVFTEAVVSLAQYYDQPLRCFTFGDFQMVPTIEEFEEILGCPLGGWSGIRQESWIA

SEQ ID NO: 167899 - protein, 89 aa, Glycine max
  Coding DNA Sequence Number=SeqID_51121
MVGYTPSSFADLVFAGERIEVGLKRGKFDYPALMNEKAGANEENEKEGGTHVVTAKPLRIPLNPMVAFTSRSARVIKFQRDRQTLGITL

SEQ ID NO: 167900 - protein, 107 aa, Glycine max
  Coding DNA Sequence Number=SeqID_51122
MNRSSRLMNKELLNNVRERHTSSSIPTPRNDNFPFVNSSLLRREVTESENTTDSECEWDASFRRLSASASASASASASVGEKKEESERHGSEIFRPRLGVRVGARRG

SEQ ID NO: 167901 - protein, 288 aa, Glycine max
  Coding DNA Sequence Number=SeqID_51123
  Gene Ontology: Mol. function=catalytic activity; Cellular component =fatty acid beta-oxidation multienzyme complex; Biological process =metabolic process
  Homolog annotation: Hit_ID=UPI00005F7512; Match level="QueryCoverage =99%, HitCoverage=99%, E-value=1e-124, Identity=72%"; Hit description= COG1024: Enoyl-CoA hydratase/carnithine racemase
  Pfam annotation: Domain name=ECH; Domain location=34-208; Score=35.4; E_value=6.2e-11; Accession=PF00378.10; Description=Enoyl-CoA hydrataseisomerase family
MTVINQPTCRLFTEVGQTTQLAAYYEEGRHTMWMMLRAQPRPSFNHELIEEIMNLSYAAQRSGLPIDFWVTGSLVPQMFNAGGDLRFFVECIRNNRREALRAYARACVDCIHSAARGFDTGAVTLAMIEGSALGGGFEAALAHHFILAQNSARMGFPEIAFNLFPGMGGYSLVARRSGMKLAEELICEGESHSAEWYETRGLVDKVFQPGDSYRTTRTFIDTLRPKLNGVRAMLKARQRVLQLSRAELMDITEDWVDYAFTLEPKDIAYMERLVQLQNRHSASLRKAG

SEQ ID NO: 167902 - protein, 58 aa, Glycine max
  Coding DNA Sequence Number=SeqID_51124
MSEHILINEGGKIQEFQHPLAIYGANRYRKDTFNTIGLDANGILRLLVEIHPSSFILL

SEQ ID NO: 167903 - protein, 66 aa, Glycine max
  Coding DNA Sequence Number=SeqID_51125
MLREGLKGSEVGKRKGKRDIREKRKKSEVEVLPNHDHDYSLHRSLVLCPSCNNLHWSEFFIAPEDT

SEQ ID NO: 167904 - protein, 59 aa, Glycine max
  Coding DNA Sequence Number=SeqID_51126
MSSARRAGCLGTKPFHGPGDPDASQAEQGSRKIQKRPFCPLPWFQALYSWVRVHFFRYG

SEQ ID NO: 167905 - protein, 53 aa, Glycine max
  Coding DNA Sequence Number=SeqID_51127
MRRCILARGQKIMTDYACPVSGLAELIGCAWRISYSLSNEEHRESSSHSHDAA

SEQ ID NO: 167906 - protein, 102 aa, Glycine max
  Coding DNA Sequence Number=SeqID_51128
MNQGKKGETIGHDTWKIIWQNDLSKQQAWSPSSRSNPPRSWTGTAIPCEQYKQFLPISSLADKPNSEHYLNAASVLSVATVDERRTNARDEVSDRDCVGDDA

SEQ ID NO: 167907 - protein, 82 aa, Glycine max
  Coding DNA Sequence Number=SeqID_51129
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=93%, HitCoverage=10%, E-value=1e-22, Identity=58%"; Hit description=Xylem serine proteinase 1 precursor
MDEVLLVFQNQYCQLHTTRSWNFIGLPTIAKRRLKSNSDIIVALFDTGFTPESKSFKDDGFGPPPARWKGSCDHYGLFLRLQ

SEQ ID NO: 167908 - protein, 132 aa, Glycine max
  Coding DNA Sequence Number=SeqID_51130
MSRLCMGSYDKFEEGFGKLNQYRAYQSRIGENVPVCFLVYESGGWDLECMNFDLPMNVIQHIQSIKPPCGSSCSDYVEWDDVKEDKFTTKDAYLTLSLACDLDIVQEYLEVGWSQKNQVSPMEDWAGCASYR

SEQ ID NO: 167909 - protein, 100 aa, Glycine max
  Coding DNA Sequence Number=SeqID_51131
  Gene Ontology: Mol. function=serine-type endopeptidase activity; Cellular component=cytoplasm; Biological process=negative regulation of enzyme activity
  Homolog annotation: Hit_ID=Q9LLL8; Match level="QueryCoverage=93%, HitCoverage=15%, E-value=8e-21, Identity=47%"; Hit description=Xylem serine proteinase 1 precursor
MDILAAFDAAIHDGVDVISISIGGGNPSYVEDSISIGAFHAMRKGIITVASAGNSCPSPGTVTNIAPWIGVGVNCFDPKGKQYPLINGVDAAKDQWFIDG

SEQ ID NO: 167910 - protein, 78 aa, Glycine max
  Coding DNA Sequence Number=SeqID_51132
MSSGIVASSELGSKRVGSVKATVNFYDDKKPSSRTKELHRARRDIGREIEEANEEQVLGEVARIEALKELTDIETMRK

SEQ ID NO: 167911 - protein, 83 aa, Glycine max
  Coding DNA Sequence Number=SeqID_51133
MGGTGCRHWLLPNQREDFEMLLKDLLSEPNLLSEAHPLSEEACSLRENKTLKNVEPESRTISAQPAHLARTLFLLALSASKPA

SEQ ID NO: 167912 - protein, 100 aa, Glycine max
  Coding DNA Sequence Number=SeqID_51134
  Gene Ontology: Mol. function=nucleic acid binding; Cellular component= nucleus; Biological process=regulation of transcription
  Homolog annotation: Hit_ID=Q1SFN1; Match level="QueryCoverage=99%, HitCoverage=29%, E-value=9e-44, Identity=89%"; Hit description=CENP -B protein
MDIDNLMNYSGENEACSEVQSLEDIVGTIIKNNAEDDHKDDMVSLEPVTRKETLMASNTLHNFMIQYKNTTPELLDAIRKVRDELQIDLNFKEKQTTIKS

SEQ ID NO: 167913 - protein, 90 aa, Glycine max
  Coding DNA Sequence Number=SeqID_51135
MSIVGKFTVGGSFIYVGAAIVTGVKLVTSLAMAGAWMPPLTAAEQGCQRAQSRHWVLRHTLEELLEDDARRRMWWILLLCCEWKMHKREL

SEQ ID NO: 167914 - protein, 648 aa, Glycine max
  Coding DNA Sequence Number=SeqID_51136
  Gene Ontology: Mol. function=metal ion binding
  Pfam annotation: Domain name=PHD; Domain location=110-158; Score=2.3; E_value=0.034; Accession=PF00628.19; Description=PHD-finger
  Pfam annotation: Domain name=VWA; Domain location=279-430; Score =11.9; E_value=0.00048; Accession=PF00092.18; Description=von Willebrand factor type A domain
  Pfam annotation: Domain name=zf-C3HC4; Domain location=111-155; Score= 35.9; E_value=1.4e-07; Accession=PF00097.15; Description=Zinc finger, C3HC4 type (RING finger)
  Pfam module annotation: Pfam domain module=PHD::VWA::zf-C3HC4; Domain location=110-158::279-430::111-155
MVSGWRRTFRTSNTIPQNTHEPEICDYYNNINSSPKITSNFSFFSTPSLIPTRTNSPLSKHQCNYNNNARTPSPTKRYSPTSFHQSTPSSPNSPSAFSLLKSTLRLSKSSCKICTRSVKTGEGKAIFTAECSHVFHFPCIAAHVKKQRLVTCPVCNANWKQLLQNADENKPHAELKTTKSFKPHNYNDDEPLMSPTSVSRFNPIPESNENEEEEDEEEQNDEQIKFNLSSSLVKTRNIEAFFSPEAAIVASNWSSETYVTVLNVKVQPRNAAANRPPVDLVMVIDVRGSVTGEELWMLKRSMQVVISSLGSADRLSVVAFSGGSKRLFPLRRMTRCGQTAARRVVDALASVELRREGTPARNDALKKAAKVLEDRRQKNTVAKIILLTNSHEDHRLTTTRFTVHSLIFSHDDNEFAKRVGNLLSVAAQDFKLELKLASRSAQAEITAVYSLAKGFTDALSPDSVALGDLCAAEERELLVEFKVPAGTASRGSHHRFISVRCSHRDPFTQELVNSKERELIVPGPHTVRSCDLRIEQLRRRHVSARAVAESRKCVARNDVSGALQLLSSARASVSREQGDECLRWLEAKQAELRNQKLRSSNNNCLEEKGEPLTPMSAWRVAERLAKVAIMRKSMNRVSDLHGFEDARF

SEQ ID NO: 167915 - protein, 55 aa, Glycine max
  Coding DNA Sequence Number=SeqID_51137
VSHGELEDEVVAKNVGGAIELCEYHIGDMELERARLDYVVTEFGMPLPEKEDKLG

SEQ ID NO: 167916 - protein, 148 aa, Glycine max
  Coding DNA Sequence Number=SeqID_51138
  Homolog annotation: Hit_ID=Q9SK32; Match level="QueryCoverage=57%, HitCoverage=16%, E-value=1e-10, Identity=43%"; Hit description =Expressed protein
  Pfam annotation: Domain name=DUF1723; Domain location=91-140; Score =50.1; E_value=7.6e-12; Accession=PF08330.1; Description=Protein of unknown function (DUF1723)
MMKLMNDKLKNPKGYTFNKKQTYEILHIQLTITMCHKIVYMKSNQEDEERMIGPRCNSIWASTHLDHIDNHMKNLTNEAGFGCVITIGQIDINQHLFIALVERWRPETHILHFPHWKATITLEDVALQLGLKINKLSITGVVPGVVSC

SEQ ID NO: 167917 - protein, 36 aa, Glycine max
  Coding DNA Sequence Number=SeqID_51139
MGTVTYMGMGMGMKNSTSKNLKIHVRLGTDKEMMVQ

SEQ ID NO: 167918 - protein, 303 aa, Glycine max
  Coding DNA Sequence Number=SeqID_51140
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=89%, E-value=1e-39, Identity=51%"; Hit description =Integrase, catalytic region
  Pfam annotation: Domain name=Chromo; Domain location=220-268; Score =17.1; E_value=0.0094; Accession=PF00385.14; Description='chromo' (CHRromatin Organisation MOdifier
MGGLSLRLHHRPTSDSRKYCHIGCSRSIFKRHTPRHAANSALSLLNRHPVHGHRQKASWHATQLGLRQRPIIHKQFSGKTCSSKVETVDEFLSDRESIFAELKKKLQKAQLAMKHTPDRKCRDVHFDIGDLVMVRLQPQRQSSIIGQQRGSFKLNKKYYGPFKVLDQIGPATYKLQLPVGTRIHLVFHYSMLKPFHQPPLPDNNPALSLPSVVINNQPLVSPLAIVETRYNLESSKPRLQVLMQWDGFLPGDTTWEDWEQLQASYHLEDKVILEGPGDDSKQDYAVTKPKRRSNAPAYLKDYI

SEQ ID NO: 167919 - protein, 42 aa, Glycine max
  Coding DNA Sequence Number=SeqID_51141
MAYYCTRRGRQIGGFALQQATWSKLMHTRHLSLASHFERLKS

SEQ ID NO: 167920 - protein, 307 aa, Glycine max
  Coding DNA Sequence Number=SeqID_51142
MDLKENCTYVMHNFKVLKYRFAGFADVVAGQFEPGLLVDVIGVVEEVVFRQVSGKGRRVVLKLKDLSQQSLSCTLWDDYCLQFLKFLDDYEGDGPIIVLLSHCRIKEAQGLQSWALRPGQVLNPMVKGVHSFQEIVCVTVGTITRIVLDNHSWCYTACIQCHKKSDAEMVPFTCACGKYNKEVVLRYRLEDGDVDLNASPQALDKLLGYELAFKIKVQPKFRNSVVLKCSDDSSLINAVMDMLADAEVMFNASYLTLNIVKNHDPLLGLPLTPTKQQAFQDCDDEAGTSQISPVQLSSNKLKKHGAI

SEQ ID NO: 167921 - protein, 128 aa, Glycine max
  Coding DNA Sequence Number=SeqID_51143
  Homolog annotation: Hit_ID=O65047; Match level="QueryCoverage=96%, HitCoverage=61%, E-value=7e-14, Identity=35%"; Hit description =Hypothetical protein Sb07
MDEASKGLRTQGQTVTKVDGSEDFWSSSTFKLDHSAAHSQRSISSIGMPNNPSDPQSSGGSQTGPPEFVNHGKERERRKYPSLLGCSTAVLLEGSRMKRLLLWNHIRQQWIGNKRSESITEIQEPRIR

SEQ ID NO: 167922 - protein, 152 aa, Glycine max
  Coding DNA Sequence Number=SeqID_51144
MCYEVQNKAKKVYSNDVCRLYNVITTKLENMNMHMYLGKLDCLVNDYNNLMPSPHDVETFHWQHNQYFMTSALSPLLSLTQPPYEVGIDASPNNNNRLIIDGSCNVLTKVKNKTDNSRLWIRCWMDILYLFGPIVGDNRGLARKLHQEPHCN

SEQ ID NO: 167923 - protein, 80 aa, Glycine max
  Coding DNA Sequence Number=SeqID_51145
MDILVPHPLTNACLLIQLSPECGCKPLVYLLKRPALLSVDFQDCSIRDYSSCTLVGVPKFVFLEKRVVKNRMLDKWPQLP

SEQ ID NO: 167924 - protein, 177 aa, Glycine max
  Coding DNA Sequence Number=SeqID_51146
YDGETYEIQVRQHKGKLYFADGLTRLRTELQIYESVTINFLACDHPSKFDFHFTPPLDQQKCKRHRATGKHIWTYEITQSMLGTPYPLQLPASVTQCLIHCGDHMTILRRFGPPLQWNVVVLDKGIGDKYVTLPWYKFLQEGDFSHGDELSFYYRCAEKIWEVVIRRAIDWDDSDID

SEQ ID NO: 167925 - protein, 83 aa, Glycine max
  Coding DNA Sequence Number=SeqID_51147
MSVHRRRTTIRYTPFSESTSTTRAVGNQQLCGKGLFVATTEKKKQEYEKTILAYNKKLEGKNLEEYESDKLKSEVNGDEVDGY

SEQ ID NO: 167926 - protein, 71 aa, Glycine max
  Coding DNA Sequence Number=SeqID_51148
MRKPQWGTFDAASDVKEAVKALGDEGVDVDRELALGGEEHDVSGEQSRERDEKEAKEGGELGEQGGDGEAF

SEQ ID NO: 167927 - protein, 150 aa, Glycine max
  Coding DNA Sequence Number=SeqID_51149
  Homolog annotation: Hit_ID=UPI00005DC2DD; Match level="QueryCoverage =37%, HitCoverage=7%, E-value=3e-19, Identity=73%"; Hit description =nucleic acid binding / ubiquitin-protein ligase/ zinc ion binding
  Subcellular localization annotation: CTP_CleavageSite=41; ConfidenceScore=5.09e-01
MNKKIRVNRGLGIVYTLVAKTRLHSVLQMQQRRSSQMKRRRATHVEHTSRCKQGPYTTHSKGSTQMTQQSSISSPLSFSLLSILDYGSQKVQTLIPVPGSRHEVRDGGAEGQGFGERVEDKGPGEGQGEVVGGGGEEDEAVGGGDGLCEG

SEQ ID NO: 167928 - protein, 103 aa, Glycine max
  Coding DNA Sequence Number=SeqID_51150
MRILKLAKYRLKAQVEKDEGPSGEGQSLRVEKDDGPSSLLNQSQTYQGNPCGVYSDLSSFTGSGIYPDLSSFTGSGVIQKTLQPISNVPSRKVHIIWYQSFGS

SEQ ID NO: 167929 - protein, 137 aa, Glycine max
  Coding DNA Sequence Number=SeqID_51151
MQSLEDKEHEIRIMTENASQLVIMIVKECINRNPVRSVILIVRETTNIGHLAKKLTLCINELIPCTQFELKPEISEEKENLEGEFLERIITTESFGVWTAKNEEAEQGAKFSTFKEIREFLSDYEVPRGRGGIPPLL

SEQ ID NO: 167930 - protein, 271 aa, Glycine max
  Coding DNA Sequence Number=SeqID_51152
MMDNEPLQQLQARIVEIERCHKEEHRKMKTDHDELKAHIRRPQEDEHCAHMINKYTQADDSSTSFHRPNHGGRPTSRLETAQPDGKLARFKGWTMVNFLGLNKVDLGIKGMNEMVKTASFAFLALALVIGPPSPSSGSLPLLLVMSSSTDLDEHLDAFLTKANLYTNGDMILYQFFPMSLKRAALTWYGGILPRAKVDVSLSELNALSECHPLSETSTRLADMRNLEGNLSYRHALIASSACSASRLSPSRLSASLVLSENSLTHAKRDIE

SEQ ID NO: 167931 - protein, 114 aa, Glycine max
  Coding DNA Sequence Number=SeqID_51153
  Gene Ontology: Mol. function=chromatin binding; Cellular component =chromatin; Biological process=chromatin assembly or disassembly
  Homolog annotation: Hit_ID=Q1SAV4; Match level="QueryCoverage=59%, HitCoverage=17%, E-value=3e-13, Identity=55%"; Hit description =Integrase, catalytic region
  Pfam annotation: Domain name=Chromo; Domain location=21-77; Score =28.7; E_value=2.1e-05; Accession=PF00385.14; Description='chromo' (CHRromatin Organisation MOdifier
MTHQVQTMDLPPVAIDNQPVPIPLAILAHKTIPSDTGPRQLVLVQWRGLHPDETSWEEWTTLKNIHHLEDKVLFEARGNDTSNNEELQVAKPNVSNSKELQTARPKGKATLPVI

SEQ ID NO: 167932 - protein, 862 aa, Glycine max
  Coding DNA Sequence Number=SeqID_51154
  Gene Ontology: Mol. function=zinc ion binding
  Homolog annotation: Hit_ID=Q1SUW3; Match level="QueryCoverage=96%, HitCoverage=78%, E-value=0.0, Identity=56%"; Hit description=Zinc finger, RING-type; Zinc finger, CHY-type; RINGv
  Pfam annotation: Domain name=Hemerythrin; Domain location=16-82; Score=11.2; E_value=1.2; Accession=PF01814.13; Description =Hemerythrin
  Pfam annotation: Domain name=Hemerythrin; Domain location=294-355; Score=22.5; E_value=0.0015; Accession=PF01814.13; Description =Hemerythrin
  Pfam annotation: Domain name=Hemerythrin; Domain location=365-457; Score=20.0; E_value=0.0085; Accession=PF01814.13; Description =Hemerythrin
  Pfam annotation: Domain name=zf-C3HC4; Domain location=766-807; Score= 16.2; E_value=0.0033; Accession=PF00097.15; Description=Zinc finger, C3HC4 type (RING finger)
  Pfam annotation: Domain name=zf-CHY; Domain location=637-714; Score =143.0; E_value=7.8e-40; Accession=PF05495.3; Description=CHY zinc finger
  Pfam annotation: Domain name=zf-MIZ; Domain location=762-810; Score= -2.9; E_value=0.0029; Accession=PF02891.10; Description=MIZ zinc finger
  Pfam module annotation: Pfam domain module=Hemerythrin::Hemerythrin::H emerythrin::zf-C3HC4::zf-CHY::zf-MIZ; Domain location=16-82::294 -355::365-457::766-807::637-714::762-810
MYVIAEDRVIFPAIKAELHFLQDHTDEELQFDKLRCLIDSIQSAGADSSSAEFYFKLSSHTEQITDTILKHFEDEEAQVLPLARKLFSPQRQRELLYESLCSMPLKLIECVLPWLVGSLNQTEVRSFLQNMYMAAPATDHALVTLFSGWACNGYSRNSCFYSSTTGLCPDRRLMEIPFCMCEPSFGLNEKSSAIQQEDENGCIGPVKHGKPESKQDNDVANLMVTGKTLSSSLNQSCCVPELRVNASNLGLGSLALTKSLRELSDYPSAPSLNSSLFMWETNLVSADNQCIARPIDNIFKFHKAIRKDLEYLDVESVKLNDCDEIFIQQFTGRFCLLWGLYRAHSNAEDDIVFPALESKDNLHNVSHSYTLDHQQEEKLFLDISSGLTQLTQLHELLYKKNWSDHITNCFSNYAGCYDIDTVQNYNELSTKIQGMCKSIRVTLDQHILREELELWPLFDRHFSLEEQDKIVGHIIGTTGAEVLQSMLPWVTSALAQDEQNKMIDTLKQATKNTMFCEWLNEWWKGPASSLNITTPGDYSLGTDAYEDSEHSFLAFRPGWKDIFRMNQNELESEIRKVSQDSTLDPRRKAYLIQNLMTSRWIASQQKSSQSLGVESSKGDILETSLSFHDPEKKIFGCEHYKRNCKLRAACCGKLFTCQFCHDKVSDHLMDRKATTEMMCMQCQKIQPAGPVCATPSCGSLLMAKYYCSICKLFDDERTVYHCPFCNLCRLGKGLGVDFFHCMQCNCCMSKKLVDHICREKGLETNCPICCDFLFTSSESVRALPCGHFMHSACFQAYTCSHYICPICSKSMGDMSVYFGMLDALLASEELPEEYRNQCQVKNIYSSTTSTALEAESKLLKPF

SEQ ID NO: 167933 - protein, 109 aa, Glycine max
  Coding DNA Sequence Number=SeqID_51155
  Homolog annotation: Hit_ID=Q6L4G5; Match level="QueryCoverage=99%, HitCoverage=8%, E-value=3e-08, Identity=36%"; Hit description =Putative zinc finger protein
  Subcellular localization annotation: CTP_CleavageSite=14; ConfidenceScore=5.17e-01
MATAGGGGGGGCVAVMAGSCTVSTPSSSYGGGACSSNSKDTLIESPILIFCLFHKAISSELQSLHATAFDFVSNRRHSQPHSPLKIMSFSHRCHFLRTLYKHHCNAEDQ

SEQ ID NO: 167934 - protein, 94 aa, Glycine max
  Coding DNA Sequence Number=SeqID_51156
MLQLKQGWNEGFKYVSASSSDEDEPSNIEEDGYQHDVLHRAERCFNVSNRNKLTIIGRLCFRIQSRENEAQTFFRSRRLFQQFSIDGYTMVESE

SEQ ID NO: 167935 - protein, 43 aa, Glycine max
  Coding DNA Sequence Number=SeqID_51157
MDIIYIIIIFVKDGVGLEDGNAISQPRAFSHGLEKAKDSPSAS

SEQ ID NO: 167936 - protein, 160 aa, Glycine max
  Coding DNA Sequence Number=SeqID_51158
MGIWLSSPCLGEPSNVSQPLSIRQYSQGSDFSELDCFLYKSKVLNILEICDALDGTNLCMIGTTTKLIVGKGRWFYYSCGRCKYQCKFNSSSMMKMSNDVDIIKNITKQIYAQQGVADITEPSCYKTQASKLELSQIEDFGQFDKSLPHMRPNFTYIYQV

SEQ ID NO: 167937 - protein, 135 aa, Glycine max
  Coding DNA Sequence Number=SeqID_51159
MLPLCDTKIASEMAEPRQQKTTSHMQENQDEYLEHRKQQQPRQTQTCTTVHLELQKQRNKKKTAKRIKPGMTNPKAQPHTKNKISRARGNSKEIYHGRVKKIATGKIGTAISEPTQHKAAIHVPENQAQSWRGIK

SEQ ID NO: 167938 - protein, 235 aa, Glycine max
  Coding DNA Sequence Number=SeqID_51160
MGEVEEVQEQMKAGMEAMKEQMATMMEAIMSMKKIMEANAVAVVVTSAVAKVNLMPPSSLNQMNHPTSSMVGKDLGSTSGPYYVKIQNKHAFPPYGLPPNYTPPNVVYTPNEDVNNSAPILIESRQPQTDHAHVSQPMGETHEMPHHNLVDFEPCLGYATEGQVVGPSIFAPNHNPCISQQVKSLLLWMEWKKLDHLEERLRAIEGGEDYAFANLEEFVPSTQYHHPSQVQGAGL

SEQ ID NO: 167939 - protein, 84 aa, Glycine max; identical to SEQ ID NO: 139389
  Coding DNA Sequence Number=SeqID_51161

SEQ ID NO: 167940 - protein, 147 aa, Glycine max
  Coding DNA Sequence Number=SeqID_51162
MCRASVVGAQKGWYVENVYRLQVMRILKLAKYRLKAQVEKGEGPMEKDKAPEWRRMKAQRLINVILVASTLTYLPSPEVASTLTYLPSSEVASFKISVACIKRSAPSQTYQGNPCGVYPDLSSFTGSGVYLDFPSQDHIIWYQSFSS

SEQ ID NO: 167941 - protein, 79 aa, Glycine max
  Coding DNA Sequence Number=SeqID_51163
MVRDTYFTFLFFLQRKPTFTEVAGNKLRNRKILLCKAKQSNLYLALGEGIGNVALTPHPIGHRSALEIQPSWKQKCISN

SEQ ID NO: 167942 - protein, 256 aa, Glycine max
  Coding DNA Sequence Number=SeqID_51164
  Gene Ontology: Mol. function=transferase activity, transferring glycosyl groups; Biological process=response to oxidative stress
  Homolog annotation: Hit_ID=Q7XZZ4; Match level="QueryCoverage=65%, HitCoverage=16%, E-value=7e-18, Identity=39%"; Hit description =Putative phosphoribosyltransferase
MEANKGERVKILKRPNGDYLPKDISGKKTGNESERVHPFYLVEPMQYLFVKIREAHGLTPPSEGPIIRVGMSSQFRRSKPTSYRPIMEPDILPGIPLVALASTFLTFRYEILRTIPWRRNGIASKEAPPIRIARVYYDIQLSMRIGTQFNNTFPEAWISYAPYVTHTQSKVYQSPKLWYLCVTVVDAQDLNIAPIQPPLTEPEVRVKVRLGFQLQQMRRGSTNHRSLSFHWSEGKKRLPYLIKMSHLYIDEPKCDT

SEQ ID NO: 167943 - protein, 110 aa, Glycine max
  Coding DNA Sequence Number=SeqID_51165
  Homolog annotation: Hit_ID=Q00M75; Match level="QueryCoverage=27%, HitCoverage=5%, E-value=4e-08, Identity=90%"; Hit description=PPR -repeat containing protein
MHKTSYPIVQRLFAMRRYGGGIYCTQPYPCIYKEVVSGFEPMTNKSPRHNFTAAPGIALKKKQLMTPMPTLTSWGSLLNQWLIIQVLSIMRVHLTSTYLAAPRPAVQHHL

SEQ ID NO: 167944 - protein, 307 aa, Glycine max
  Coding DNA Sequence Number=SeqID_51166
  Gene Ontology: Mol. function=DNA binding
  Pfam annotation: Domain name=Transposase_24; Domain location=143-280; Score=22.3; E_value=4.8e-06; Accession=PF03004.5; Description=Plant transposase (PttaEnSpm family)
MAEWLGNITHTPPVQPISPIGIRAEDPHNDEEVDNIDDHIRKDDIPEVEVKYDDAGRVIIEPLGIGWTPNRHAVKALGLAIRSHFEGPYHHYEAVPEDVQTRVTWTAQDEWQIKKVYETKVKKRLSDMLTKARDKRKRPHWIGEQAWVDLLIYWVTDKKFKDQCAQNKINRTSSRGGAVHTTGRKSHLDIAVGLERKYGKPVDPDVLFLATHKNKDGRWVDDRARDTYEKYHERLRVAQSQNAKGSTDDTGAMKLQCWKDAAGGKTRGRCYGTEDLASNIRRVMHTNIQLRPRHCANRFSKQLSELM

SEQ ID NO: 167945 - protein, 137 aa, Glycine max
  Coding DNA Sequence Number=SeqID_51167
  Subcellular localization annotation: CTP_CleavageSite=45; ConfidenceScore=5.45e-01
MTSLHFSLPLPANLLSRTTPSRSSTHIMMNVRPLMPNCNLFFSPRDASLVETVCGGRTSYDGRCYKEALCWPHFPHVTIMITLTTSFRPKCFVPTRFTVSPAVVVLMMVAAEWGGDGKLREHCCCSSQKDLVEVMQF

SEQ ID NO: 167946 - protein, 610 aa, Glycine max
  Coding DNA Sequence Number=SeqID_51168
  Gene Ontology: Mol. function=phosphoinositide phospholipase C activity; Biological process=intracellular signaling cascade
  Homolog annotation: Hit_ID=Q2QUQ6; Match level="QueryCoverage=73%, HitCoverage=39%, E-value=7e-52, Identity=32%"; Hit description =Expressed protein
  Pfam annotation: Domain name=DUF1723; Domain location=105-154; Score =84.8; E_value=2.7e-22; Accession=PF08330.1; Description=Protein of unknown function (DUF1723)
MEVREDFMVSATGDSEPTSRSAYFLKPLANSLDGPVSEVISSSMAMPLPPVFDPKQWPMVVRYNGWHHPKPKWVEWVDTLQVRYQSLWKKVGIFDAIMSTKCSIAKNQNLCVGIAERWCPDTNTFLFPWGEATITLEDVMVLGGFPVVGDPVFTTLQSQEMRKVEEKLSLARMEPWREKKHKVTTSAWMDAFVNSGTRSEIEHEAFLSTWLTMVGFSHNGLVNECVFPIAILLARGYPIALGPAVLASIYHDLTLLKKTIVRLAEKSVLDDKLELVTTLQSPFYLIQIWVWERFKNLQPQPKLINHEDPVLFRWHKVKALEIDNVRLAVESAMDHFRWRPYVQYAGTGKFKVYYPENETLVILDTDLDKEPTGILASFVACLKVSLLVGIQSNIELYLPHRVAMQFGMDQDVPSCVPIFRGTKENAWKNYCRPISDTHLYFPARLFEGDVTTRYATWWKQLVPSCHRDFVKNIVRRKRSLMSHVSKANKNSGNDADVPPGFSPSKTLPSGNSGQDDLQANENIDADIPTRFKSLSNPISSASTADYEKAKRISSLTKPAAEDTPEPLMSGLDEQFEDANGRKESRPSESCSCASRENLMDLEERINRLEE

SEQ ID NO: 167947 - protein, 57 aa, Glycine max
  Coding DNA Sequence Number=SeqID_51169
MVVLKFAFGTIRTKYSWLELHHSCLLEEGWLELDLSNAARKFAPSIIFIEGLDVVRG

SEQ ID NO: 167948 - protein, 84 aa, Glycine max
  Coding DNA Sequence Number=SeqID_51170
MSLASNGFFGEVLIIWEWAGTYEARTLQSLAVSGVRYTSVSVSVLHRLELVGPKHCWDHTLVFGVPNEIKSSSSSNKVVSELEF

SEQ ID NO: 167949 - protein, 57 aa, Glycine max
  Coding DNA Sequence Number=SeqID_51171
MPQRTLIKHLAWVNKYGKGEDDGGAVVVGGEDVGKVARYDDIDNALVDDRCWEIARQ

SEQ ID NO: 167950 - protein, 90 aa, Glycine max
  Coding DNA Sequence Number=SeqID_51172
  Subcellular localization annotation: CTP_CleavageSite=42; ConfidenceScore=5.43e-01
MGKWLTTESSGRPVRGSSGSSGRTNQTSSGRTLLPEDFRKTSSGNFPEEVVHPEEFRKTPTSGRSFKLPEDLSGRTLLPECFRKNHFFRK

SEQ ID NO: 167951 - protein, 49 aa, Glycine max
  Coding DNA Sequence Number=SeqID_51173
MASNRSSSWARGEGEGSRKSFNKLLGAPAILLGAPSISLNEGVDVGSGL

SEQ ID NO: 167952 - protein, 96 aa, Glycine max
  Coding DNA Sequence Number=SeqID_51174
  Subcellular localization annotation: CTP_CleavageSite=58; ConfidenceScore=5.12e-01
MVGQAGPIFQDSIVSGSRWADRPVLISTLSSLVMSLLHQRSDSSTGLNTLLHGILLLMQSYSARALDRRLQVDWARDPREGPRVLMSLRIDFEPMG

SEQ ID NO: 167953 - protein, 129 aa, Glycine max
  Coding DNA Sequence Number=SeqID_51175
  Subcellular localization annotation: CTP_CleavageSite=45; ConfidenceScore=5.17e-01
MPDASRTVDLNVVSRLVLGFYASVRSVLTAGFLCKCQVRFGFLCKCQVGVGFLFKCQVGTGFGLKMVARLVPGLVWGGNVGSGLEGDGVGSGLVQGGDVGSRLEDGCLLVSSWELLRAPSIIAGAPSKQ

SEQ ID NO: 167954 - protein, 226 aa, Glycine max
  Coding DNA Sequence Number=SeqID_51176
  Gene Ontology: Mol. function=DNA binding; Biological process=DNA integration
  Homolog annotation: Hit_ID=Q1SS72; Match level="QueryCoverage=62%, HitCoverage=11%, E-value=5e-15, Identity=40%"; Hit description =Integrase, catalytic region
MVSKVAGTYFPRNLMMGLWDLSLCKSMLVRTSRGSLWTQARITHCNRLLHKTKVNLGGTQQLPSHDSMHAPAQPKSTTTRISLFDSLKDLLSIFLFLMEPLPSTNRVFSMVIQYERQQLPGQAIVEEQNSFANAAEKRHFSNKGKGVSYDGAKGNPTHNSGNQGSNKDKHGQPLRHPRYPERPGYHNHASSGAAANNITANAVHEATKNNGNEEDSFGLSLNVAPA

SEQ ID NO: 167955 - protein, 121 aa, Glycine max
  Coding DNA Sequence Number=SeqID_51177
  Gene Ontology: Mol. function=DNA binding; Cellular component =mitochondrion; Biological process=DNA integration
MSVFGAFNSSLCKEFSSFMEKELEMSLMRELTFFLGLQVNQMKHGTYLYQEKYYAELIKNFNMEKCKEETIPMATSIYLDLDEKGKSVDESKYRGMIGYLLYLTTSQLDIMLSVCICERYK

SEQ ID NO: 167956 - protein, 64 aa, Glycine max
  Coding DNA Sequence Number=SeqID_51178
MAELKFSRDLESNWTPLALHRAVIKVGNPSLDVTLFGFRQVHRIAQVYKLSMQKERKSGKRNDV

SEQ ID NO: 167957 - protein, 77 aa, Glycine max
  Coding DNA Sequence Number=SeqID_51179
MEREEKRFVYRIRCSSDENNDPEGVEEGIGVTRNVVDSDSKCPFASSMVPPFEELFEISISSNEREWKKKKFGLCGE

SEQ ID NO: 167958 - protein, 83 aa, Glycine max
  Coding DNA Sequence Number=SeqID_51180
MAINSWGSGLNGGGCMNDIQFMGLRIRFDDRECMNSAWQSIHGAPDSMAINSWGSGLNAGGSMNDNQFKGVIFRTYKICHTDF

SEQ ID NO: 167959 - protein, 94 aa, Glycine max
  Coding DNA Sequence Number=SeqID_51181
  Homolog annotation: Hit_ID=Q1T254; Match level="QueryCoverage=71%, HitCoverage=17%, E-value=5e-07, Identity=41%"; Hit description =Peptidase aspartic, catalytic
MVGIGYFSCSDQKSTESAIKNLEVQVGQLAKQLADRSSSSFTANTEKNPKEECKAVMTRSRMAIQRDDSEAGKKMEEHKQQLAPKPALEPVSDF

SEQ ID NO: 167960 - protein, 544 aa, Glycine max
  Coding DNA Sequence Number=SeqID_51182
  Gene Ontology: Mol. function=histone-lysine N-methyltransferase activity; Cellular component=nucleus; Biological process=chromatin modification
  Homolog annotation: Hit_ID=O82175; Match level="QueryCoverage=77%, HitCoverage=50%, E-value=5e-75, Identity=41%"; Hit description =Histone-lysine N-methyltransferase, H3 lysine-9 specific SUVH5 (EC 2.1.1.43) (Histone ...
  Homolog annotation: Hit description=H3-K9 methyltransferase 5) (H3-K9- HMTase 5) (Suppressor of variegation 3-9 homolog protein 5) (Su(var)3- 9 homolog protein 5)
  Pfam annotation: Domain name=Pre-SET; Domain location=267-368; Score =62.7; E_value=1.2e-15; Accession=PF05033.6; Description=Pre-SET motif
  Pfam annotation: Domain name=SET; Domain location=370-498; Score =140.8; E_value=3.8e-39; Accession=PF00856.18; Description=SET domain
  Pfam annotation: Domain name=YDG_SRA; Domain location=83-221; Score =81.4; E_value=2.9e-21; Accession=PF02182.8; Description=YDGSRA domain
  Pfam module annotation: Pfam domain module=Pre-SET::SET::YDG_SRA; Domain location=267-368::370-498::83-221
MDNSKSSGRRHEEWSPTPLSDKKRMEVSVKHRKVKQALATFRNLVDKLNHQYKASQPVNLMAKTKAMMEAAMMMRQKHQWENDKKHVGHVVGIEFWNGIDYMGTGKNSLATSIVVTNRYDNARKSNGTLVYSGHGGNPNVKSNVSIQDQKLQGGNLALKNSMDTKSPVRVILKFCKKFEVGSNFDYLYVYDGLYLVDKMTEERGKLGKLVFKFTLNRISEQPQSCVALKDDVMGNDDSSRQLASSRPRNRHKSRGSVVQKDVVRVNDLSKGKEKFPIRVVTLTNCVHIPKSFYYIVKSIYSDKFNQATIPCGCDCEDGCVNCDKCVCIIKNGGIMAYDCKKRLASPMGSLLIYECGPSCKCSSSCINRVSQHGIQFQLEIFMTELKGWGVRTRSFIPSGSFVCEYIGEVRDSRQSGLSIDVDDDYLFHTGVGKGFIDATKCGNIGRFINHSCSPNLHVKDVMYDHDDKNLPHKMLFAAKDIPAGRELSFDYNSKGKFINDRSNSCYCGSQECNGQIYIKGGADDAEYVKDAHVIKNTFTSVKGG

SEQ ID NO: 167961 - protein, 100 aa, Glycine max
  Coding DNA Sequence Number=SeqID_51183
MAQGWWPEMMHPVPIEVPGQDTFSMNCSTDRMDPGGATTYEPGGAGVGVAEVEGASRVEEKGTLVGLTLAFLPPLKLTVTPLALHRVVIKAGNLSLEELL

SEQ ID NO: 167962 - protein, 130 aa, Glycine max
  Coding DNA Sequence Number=SeqID_51184
MRSYGGHSSTGEGDDRWMHFAEHVLPMGKLCLVLGQVGDQPRDAPAADPEEYIQPPSPQVPVAFDPSPHAVDDYDGYEVIAQRLERVLNLRMVTAGTELYDIMQDCLTIARGGSSADGSVRARQRRHTEH

SEQ ID NO: 167963 - protein, 144 aa, Glycine max
  Coding DNA Sequence Number=SeqID_51185
  Gene Ontology: Mol. function=RNA-directed DNA polymerase activity; Cellular component=intracellular; Biological process=RNA-dependent DNA replication
MSRINELVDGVSRVMPFGLKNTSATYQQLMDRVFKQVGRNVEVYVDDMVIKGKFLGFMISHQGIEASPDKCATILEMHNPTNVQEVQKLNGRLASLSRFLLKLVENAKPLYKLLKKAEPFLWDENYEQAFSAFKKIIATPPVLS

SEQ ID NO: 167964 - protein, 379 aa, Glycine max
  Coding DNA Sequence Number=SeqID_51186
MADYAGMDSWHHVGDESVLMTGEVSSRGSMFQGSDLRPFIDAHDLRAFSRYKSVLTVTIYPIRISYGEAPGELALTKGVHQVHDINGTSLIDKDPGQHEVGNNGGYNHEVVLVCGVDTCESDRRETLLWWCVDKVNVDVPNGMEMVVAHTVVANVFVYLDLSLYLLFCLLHGSYVASLGVLRVLLLLGGLSSLLCYDQYYGDTYSIWLCLIPSLGGFVGGSLMDTSKLKAPSKIVERLAIKVGLGTSFLLITLMFNLSDFIPKYGYFFHLDVALGSFVQLIHGEEHGMQHYLRTGQGGRGHTMKFASCVLRIESFDEGVKAVYGPRGSPESGRHPNAHLDLLSLISLEVEWFPPHGYVFLHNVVDRRMSTSSPSARQCI

SEQ ID NO: 167965 - protein, 61 aa, Glycine max
  Coding DNA Sequence Number=SeqID_51187
MYRICVIASRCGGRFVGCDDHGNRLEVTVVMKKKETKGKKVTNCNQVRCSEKKMRVEILIS

SEQ ID NO: 167966 - protein, 244 aa, Glycine max
  Coding DNA Sequence Number=SeqID_51188
  Gene Ontology: Cellular component=cellulose and pectin-containing cell wall; Biological process=protein transport
  Homolog annotation: Hit_ID=Q1SCB9; Match level="QueryCoverage=97%, HitCoverage=96%, E-value=8e-54, Identity=43%"; Hit description =Harpin-induced 1
  Pfam annotation: Domain name=Hin1; Domain location=71-209; Score =186.2; E_value=7.8e-53; Accession=PF07320.4; Description=Harpin -induced protein 1 (Hin1)
MSHLNGAYYGPAVPPPKSYHRPSHGGGGRDGCCCGCLSCFCGCIFDCILGLICKILTTIIIILAVLAFLFWFIVRPNVIKFHVTDASLTRFDYTTNNTLHYDLTLNVSIRNPNRRVGVYYDQIEALALYEDVLFGNLTLGSFYQHHKNTTFVSPIFKGQRVTPLAKVQVSEFDKEKGSGVYTIDLKLFMTVRFKFLLFKSGSLKPKIRCALHVPLKSRNATTSPDAAFQPTECDWDYGKKWWIH

SEQ ID NO: 167967 - protein, 69 aa, Glycine max
  Coding DNA Sequence Number=SeqID_51189
  Subcellular localization annotation: CTP_CleavageSite=27; ConfidenceScore=5.17e-01
MSSATASNTFFLHSCFLLFCLLSAPSCVSMFSDFDATAPQQSPEKAHLTETKRHLSVVTVEILPFMASP

SEQ ID NO: 167968 - protein, 285 aa, Glycine max
  Coding DNA Sequence Number=SeqID_51190
  Gene Ontology: Mol. function=protein dimerization activity; Biological process=DNA integration
  Homolog annotation: Hit_ID=Q2R1C3; Match level="QueryCoverage=63%, HitCoverage=39%, E-value=2e-30, Identity=57%"; Hit description=HAT family dimerisation domain containing protein
  Pfam annotation: Domain name=DUF659; Domain location=105-233; Score= -46.2; E_value=0.0013; Accession=PF04937.6; Description=Protein of unknown function (DUF 659)
  Pfam annotation: Domain name=zf-C2HC_plant; Domain location=16-76; Score=-2.0; E_value=0.072; Accession=PF07567.3; Description=Protein of unknown function, DUF1544
  Pfam module annotation: Pfam domain module=DUF659::zf-C2HC_plant; Domain location=105-233::16-76
MSTSNQVKEQCDDTKPLWNYVSKIKGLSVDDENFEVRCSFCEIVFNGSYTGVRAHLLKIIGREVRSCQKITPSRLAKLTKMHNEAALRIERPKKKLSFYLWYQPPGYNKLRTTLFANERRHVENLLQPIKNTWKEKGVSIVNDGWSDPQRIPLINFMVVIESGPMFLKALNCSVELLALAPIRFASTIVMLKRFKHLKKGFQEIVISEQWSSYKEDDINKEKFVKETILDDIWWDKVDCILSFTTPIYDVLRKTVTDAACLHLVYEMWDSMIENVKKVIYRHKRM

SEQ ID NO: 167969 - protein, 225 aa, Glycine max
  Coding DNA Sequence Number=SeqID_51191
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=O49434; Match level="QueryCoverage=96%, HitCoverage=38%, E-value=4e-81, Identity=69%"; Hit description=HyuC -like protein
  Pfam annotation: Domain name=Peptidase_M20; Domain location=58-220; Score=-7.1; E_value=0.0044; Accession=PF01546.18; Description =Peptidase family M20M25M40
VSDASGYLERTFLSPASMRAINLIRKWMEDAGLRTWVDQMGNVHGRVDGANANAEALLIGSHMDTVVDAGMFDGSLGIVSAISALKAMHVNGKLQKLKRPVEVIAFSDEEGVRFQTTFLGSGAIAGILPGTTLEISDKRFHLATFWLHFMTSFREVMIKDFLKENSIDITEESLLKLKYDPKSVWGYVEVHIEQGPVLEQVGFPLGVVKGIAGQTRLKLWLFPMM

SEQ ID NO: 167970 - protein, 48 aa, Glycine max
  Coding DNA Sequence Number=SeqID_51192
MHFYFGNMINGRVPPSLLLCTKSGKERVTVKLADVVAVDVIQPIQDDA

SEQ ID NO: 167971 - protein, 585 aa, Glycine max
  Coding DNA Sequence Number=SeqID_51193
  Gene Ontology: Mol. function=amino acid transporter activity; Cellular component=membrane; Biological process=amino acid transport
  Homolog annotation: Hit_ID=O64759; Match level="QueryCoverage=95%, HitCoverage=98%, E-value=0.0, Identity=72%"; Hit description =Putative amino acid transporter
  Pfam annotation: Domain name=AA_permease; Domain location=80-515; Score=12.4; E_value=4.6e-06; Accession=PF00324.11; Description=Amino acid permease
  Pfam annotation: Domain name=Aa_trans; Domain location=74-475; Score=- 127.9; E_value=0.0058; Accession=PF01490.8; Description=Transmembrane amino acid transporter protein
  Pfam module annotation: Pfam domain module=AA_permease::Aa_trans; Domain location=80-515::74-475
MASTRDKDEAEPQRGYWRWSKQDFLPEESFQSWNNYVSALSQTRLRFKDRLLARSDDATETEELKKQSEHDMKRCLNWWDLIWFGFGAVIGAGIFVLTGQQAHDSAGPAIVLSYVASGFSAMLSVFCYTEFAVEVPSAGGSFAYLRVELGDFVAFITAGNILLESVIGSAAVARSWTSYFTSLLNRPKNSLCIKTNLKEGYNLLDPIASVVLVIASAITIISTRKTSVLNWIASAINTAVIIFVIVAGFLHADTSNLTPFLPYGAKGVFKAAAILYFAYGGFDSIATMAEETKNPSRDIPIGLVGSMSMITVIYCLMALSLSMMQKYTEIDTGAAFSVAFQNVGMKWAKYVVAFGALKGMTTVLLVARLSQARYITHIARCHMIPPWFALVHPKTGTPINATLLITIASATIAFFTGLDVLSSLISVSALFVFMMISAALLVRRYYVRGVTPRENLIKLVIFLVLIIASSIGISAYWGLRPNGWIGYTVTVPIWFLATLGMQLFLTQQRVPRVWGVPLVPWVPSLSIATNVFLMGSLEYDAFIRFGVCTVVMLIYYFFFGLHATYDMAHPQEKLPSKVEYTEHKK

SEQ ID NO: 167972 - protein, 589 aa, Glycine max
  Coding DNA Sequence Number=SeqID_51194
  Gene Ontology: Mol. function=transferase activity; Cellular component= mitochondrion; Biological process=embryonic development ending in seed dormancy
  Homolog annotation: Hit_ID=O49436; Match level="QueryCoverage=99%, HitCoverage=89%, E-value=0.0, Identity=62%"; Hit description =Membrane-associated salt-inducible-like protein
  Pfam annotation: Domain name=PPR; Domain location=118-152; Score =38.4; E_value=2.4e-08; Accession=PF01535.11; Description=PPR repeat
  Pfam annotation: Domain name=PPR; Domain location=153-187; Score =46.6; E_value=8.1e-11; Accession=PF01535.11; Description=PPR repeat
  Pfam annotation: Domain name=PPR; Domain location=188-222; Score =40.2; E_value=7e-09; Accession=PF01535.11; Description=PPR repeat
  Pfam annotation: Domain name=PPR; Domain location=223-257; Score =49.9; E_value=8.4e-12; Accession=PF01535.11; Description=PPR repeat
  Pfam annotation: Domain name=PPR; Domain location=258-292; Score =20.2; E_value=0.0076; Accession=PF01535.11; Description=PPR repeat
  Pfam annotation: Domain name=PPR; Domain location=293-327; Score =50.2; E_value=7.1e-12; Accession=PF01535.11; Description=PPR repeat
  Pfam annotation: Domain name=PPR; Domain location=328-362; Score =48.5; E_value=2.3e-11; Accession=PF01535.11; Description=PPR repeat
  Pfam annotation: Domain name=PPR; Domain location=363-397; Score =32.0; E_value=2.1e-06; Accession=PF01535.11; Description=PPR repeat
  Pfam annotation: Domain name=PPR; Domain location=398-432; Score =48.8; E_value=1.9e-11; Accession=PF01535.11; Description=PPR repeat
  Pfam annotation: Domain name=PPR; Domain location=433-467; Score =31.4; E_value=3.1e-06; Accession=PF01535.11; Description=PPR repeat
  Pfam annotation: Domain name=PPR; Domain location=44-78; Score=4.9; E_ value=2; Accession=PF01535.11; Description=PPR repeat
  Pfam annotation: Domain name=PPR; Domain location=470-504; Score =31.7; E_value=2.6e-06; Accession=PF01535.11; Description=PPR repeat
  Pfam annotation: Domain name=PPR; Domain location=80-113; Score=5.8; E_value=1.6; Accession=PF01535.11; Description=PPR repeat
  Pfam annotation: Domain name=PPR; Domain location=9-43; Score=3.6; E _value=2.8; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=118 -152::153-187::188-222::223-257::258-292::293-327::328-362::363 -397::398-432::433-467::...
  Pfam module annotation: Domain location=44-78::470-504::80-113::9-43
MGSYKLGDLSFYSLIESHASSLDFRSLEEVLHQMKRERRVFLEKNFIVMFKAYGKAHLPEKAVDLFHRMWGEFQCKQTVKSFNSVLNVIVQEGLFNRALEFYNHVVASKSLNIHPNALTFNLVIKAMCRLGLVDKAIEVFREIPLRNCAPDNYTYSTLMHGLCKEERIDEAVSLLDEMQVEGTFPNLVAFNVLISALCKKGDLGRAAKLVDNMFLKGCVPNEVTYNALVHGLCLKGKLEKAVSLLNQMVSNKCVPNDVTFGTLINGFVMQGRASDGTRVLVSLEARGHRGNEYVYSSLISGLCKEGKFNQAMELWKEMVGKGCGPNTIVYSALIDGLCREGKLDEARGFLSEMKNKGYLPNSFTYSSLMRGYFEAGDSHKAILVWKEMANNNCIHNEVCYSILINGLCKDGKFMEALMVWKQMLSRGIKLDVVAYSSMIHGFCNANLVEQGLKLFNQMLCQGPVVQPDVITYNILLNAFCIQKSIFRAIDILNIMLDQGCDPDFITCDIFLKTLRENMNPPQDGREFLDELVVRLVKRQRTIGASKIIEVMMHKFLLPKASTWAMVVQQVCKPKNVRKAISECWSRLSC

SEQ ID NO: 167973 - protein, 919 aa, Glycine max
  Coding DNA Sequence Number=SeqID_51195
  Gene Ontology: Mol. function=protein serine/threonine kinase activity; Cellular component=integral to membrane; Biological process=protein amino acid phosphorylation
  Homolog annotation: Hit_ID=Q9SD64; Match level="QueryCoverage=99%, HitCoverage=92%, E-value=0.0, Identity=38%"; Hit description =Receptor kinase-like protein
  Pfam annotation: Domain name=LRR_1; Domain location=120-142; Score =10.5; E_value=3.1; Accession=PF00560.23; Description=Leucine Rich Repeat
  Pfam annotation: Domain name=LRR_1; Domain location=144-167; Score =7.8; E_value=9.9; Accession=PF00560.23; Description=Leucine Rich Repeat
  Pfam annotation: Domain name=LRR_1; Domain location=169-191; Score =17.7; E_value=0.041; Accession=PF00560.23; Description=Leucine Rich Repeat
  Pfam annotation: Domain name=LRR_1; Domain location=193-214; Score =9.0; E_value=5.8; Accession=PF00560.23; Description=Leucine Rich Repeat
  Pfam annotation: Domain name=LRR_1; Domain location=216-241; Score =0.9; E_value=1.9e+02; Accession=PF00560.23; Description=Leucine Rich Repeat
  Pfam annotation: Domain name=LRR_1; Domain location=24-46; Score =11.7; E_value=1.8; Accession=PF00560.23; Description=Leucine Rich Repeat
  Pfam annotation: Domain name=LRR_1; Domain location=246-268; Score =9.5; E_value=4.8; Accession=PF00560.23; Description=Leucine Rich Repeat
  Pfam annotation: Domain name=LRR_1; Domain location=271-293; Score =13.2; E_value=0.96; Accession=PF00560.23; Description=Leucine Rich Repeat
  Pfam annotation: Domain name=LRR_1; Domain location=295-317; Score =5.4; E_value=28; Accession=PF00560.23; Description=Leucine Rich Repeat
  Pfam annotation: Domain name=LRR_1; Domain location=319-341; Score =8.6; E_value=7.1; Accession=PF00560.23; Description=Leucine Rich Repeat
  Pfam annotation: Domain name=LRR_1; Domain location=343-365; Score =11.3; E_value=2.2; Accession=PF00560.23; Description=Leucine Rich Repeat
  Pfam annotation: Domain name=LRR_1; Domain location=367-389; Score =10.5; E_value=3.1; Accession=PF00560.23; Description=Leucine Rich Repeat
  Pfam annotation: Domain name=LRR_1; Domain location=392-414; Score =5.5; E_value=27; Accession=PF00560.23; Description=Leucine Rich Repeat
  Pfam annotation: Domain name=LRR_1; Domain location=416-438; Score =10.4; E_value=3.2; Accession=PF00560.23; Description=Leucine Rich Repeat
  Pfam annotation: Domain name=LRR_1; Domain location=440-462; Score =13.1; E_value=1; Accession=PF00560.23; Description=Leucine Rich Repeat
  Pfam annotation: Domain name=LRR_1; Domain location=464-486; Score =15.0; E_value=0.26; Accession=PF00560.23; Description=Leucine Rich Repeat
  Pfam annotation: Domain name=LRR_1; Domain location=48-70; Score =16.6; E_value=0.091; Accession=PF00560.23; Description=Leucine Rich Repeat
  Pfam annotation: Domain name=LRR_1; Domain location=488-511; Score =1.5; E_value=1.5e+02; Accession=PF00560.23; Description=Leucine Rich Repeat
  Pfam annotation: Domain name=LRR_1; Domain location=72-94; Score =10.4; E_value=3.3; Accession=PF00560.23; Description=Leucine Rich Repeat
  Pfam annotation: Domain name=LRR_1; Domain location=96-118; Score =8.0; E_value=9.2; Accession=PF00560.23; Description=Leucine Rich Repeat
  Pfam annotation: Domain name=Pkinase; Domain location=605-900; Score =115.8; E_value=1.2e-31; Accession=PF00069.15; Description=Protein kinase domain
  Pfam annotation: Domain name=Pkinase_Tyr; Domain location=605-904; Score=50.3; E_value=1.5e-15; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::Pkinase::Pkinase_ Tyr; Domain location=...
  Pfam module annotation: Domain location=120-142::144-167::169 -191::193-214::216-241::24-46::246-268::271-293::295-317::319 -341::343-365::367-389::392-414::416-438::440-462::464-486::48 -70::488-511::72-94::96-118::605-900::605-904
MTNFNLEGNNFYEKIPKELGRLSRLQKLSIENNSLGGEIPTNLTGCTHLKLLNLGGNNLTGKIPIEIGSLQKLTYLSLYMNQLTGGIPSFIGNLSSLIVFSVDTNNLEGDIPQEICHLKNLTEVELGINKLSGTLPSCLYNMSSLTTISASVNQLRGSLPPNMFHTLPNLQELYIGGNHISGPIPPSITNASALLVLDINSNNFIGQVPSLRKLQDLQRLSLPVNNLGNNSTNGLEFIKSLANCSKLQMLAISYNDFGGHLPNSLGNLSTQLSQLYLGGNWISGEIPASIGNLIGLTLLGIEDNLIDGIIPITFGKLQKMQKLDLGTNKLSGEIGTFLRNLSQLFYLGLGDNMLEGNIPPSIGNCQKLQYLGLWQNNLKGTIPLEIFNLSSLTNVLDLSQNSLSGIIPEEVGILKHVDLLNLSENHLSGRIPETIGECIMLEYLYLQGNSLYGIIPSSLASLIGLIELDLSKNRLSGTIPDVLQNISVLELLNVSFNMLDGEVPTEGVFQNASGLGVIGNSKLCGGISELHLPPCRIKGKKLAKHHKFRMIAILVSVVAFLVILSIILTIYWMRKRSNKPSMDSPTIDQLAKVSYQILHNGTNGFSTTQLIGSGNFSSVYKGTLELEDKVVAIKVLNLQKKGAHKSFIVECNALKNIKHRNLVQILTCCSSTDYKGQEFKALIFEYMKNGSLDQWLHPRTLSAEHPRTLNLDQRLNIMIDVAFAIHYLHYECEQSIIHCDLKPSNVLLDDDMIAHVSDFGIARLLSTINGTTSKETSTIGIRGTVGYAPPEYGVSSEVSMNGDMYSLGILILEMLTGRRPTDEIFEDGKNLHNFVENSFPDNLLQILDPSLVPKHEEATIEEENIQNLTPTVEKCLVSLFKIGLACSVQSPRERMNMVYVTRELSKIRKFFLAGKINGE

SEQ ID NO: 167974 - protein, 79 aa, Glycine max
  Coding DNA Sequence Number=SeqID_51196
MVSHVGSLLEKIETHKSKPSSLILSGDYNGDNTSGGNGSSGDNDGDNDDEGRQWQLWLRLFTINSNKKTKLKNNSKELS

SEQ ID NO: 167975 - protein, 81 aa, Glycine max
  Coding DNA Sequence Number=SeqID_51197
MAGYLVQKLQIDCTFTRQAHEVGARMEMHFCASEPTFGGGVVWLLLSSYKENILGNKIAFYDPGKPNVNKVKSNMNNNMSQ

SEQ ID NO: 167976 - protein, 155 aa, Glycine max
  Coding DNA Sequence Number=SeqID_51198
MLTRLEAEMLNIDLVTLFIKNLNLFSVISVELFIADCSTLHRISSMRTTSVRGASYVWCSIVKSVDKLRDGFGPCLGVGQSLILLVLQLGECTKEFGKAARSTSREFSIMGYRKWHCGLARLLMRLSQPTVKNMRGTWECIQRVLDAHLTGRMFA

SEQ ID NO: 167977 - protein, 93 aa, Glycine max
  Coding DNA Sequence Number=SeqID_51199
  Gene Ontology: Mol. function=pyridoxal phosphate binding
  Homolog annotation: Hit_ID=Q0MRQ7; Match level="QueryCoverage=85%, HitCoverage=24%, E-value=2e-16, Identity=53%"; Hit description =Molybdenum cofactor sulfurase-like protein 1
MVLDFDSSELSKHIPTINQETAIAAPEPNETLMKTRSGELIRPNDKNKKRIYFGQNMTWNWMGFSAEGSGKIIKVGDSVYVLQKVSSTAEAAA

SEQ ID NO: 167978 - protein, 66 aa, Glycine max
  Coding DNA Sequence Number=SeqID_51200
MLLSSNVIYICVKVVMLARMIHTRLFAAARELIKGNYWPLNRERKSRLRIKGKGPYILLRCGYGAY

SEQ ID NO: 167979 - protein, 73 aa, Glycine max
  Coding DNA Sequence Number=SeqID_51201
MSSIVYWDRARKTPSGPGEVQQGPGVSSSDYEPLSVLRDARSPQQGITPAKHPVDPEKSNRGLGFLALITGLC

SEQ ID NO: 167980 - protein, 75 aa, Glycine max
  Coding DNA Sequence Number=SeqID_51202
VVFVIGSAVDRLCGRFRDGLCGYLGGGHSMGFSLILTLFICPSFLSRPSRMIKFASFRTHIDPFTGEDQICKALR

SEQ ID NO: 167981 - protein, 176 aa, Glycine max
  Coding DNA Sequence Number=SeqID_51203
  Gene Ontology: Cellular component=integral to membrane
  Homolog annotation: Hit_ID=Q5PDI2; Match level="QueryCoverage=99%, HitCoverage=61%, E-value=2e-60, Identity=64%"; Hit description=AmpE protein
MAAELTLIHGVPVDCSEREFLQALQNALIWINFRFYLAPLFWIVVGGPYGPVLLVGYAFLRAWQSWLAKHRSPLERAQSGIDRILHVLDWIPVRLAGVAYALLGHGERALPAWFAALSDVHRPQYQVLTSLAQFSLARDPHLDKVETPRVAVALAKRVSLVLVVVVALLTIYGTLV

SEQ ID NO: 167982 - protein, 64 aa, Glycine max
  Coding DNA Sequence Number=SeqID_51204
MVSLDWRGKQKGFNSRFYGLRFQHNNRTSNTLLLKYTISGDARKNLKILKNNLNLIMCMEITIK

SEQ ID NO: 167983 - protein, 225 aa, Glycine max
  Coding DNA Sequence Number=SeqID_51205
  Gene Ontology: Mol. function=pyridoxal phosphate binding; Cellular component=mitochondrial inner membrane; Biological process=Mo -molybdopterin cofactor biosynthetic process
  Homolog annotation: Hit_ID=Q0MRQ7; Match level="QueryCoverage=98%, HitCoverage=61%, E-value=2e-66, Identity=57%"; Hit description =Molybdenum cofactor sulfurase-like protein 1
  Pfam annotation: Domain name=MOSC_N; Domain location=12-141; Score =222.7; E_value=8.3e-64; Accession=PF03476.6; Description=MOSC N -terminal beta barrel domain
  Subcellular localization annotation: CTP_CleavageSite=27; ConfidenceScore=5.53e-01
MADGSSTPATPSAKVSAIFIYPIKSCRAISVSRAPLTPTGFRWDRQWMVVNSQGRMYTQRVEPRLALVEVELPSEAFLENWEPTQDSYMVVNAPGMQPLKICLSQQGKEVANAVSVWEWTGSALDEGAEASQWFSDYLGKPCQLVRFNSESSLTEQNLTTEFVVPNSHESYTSEVRPVDPDYVKGQHQTTFTDGYPFLLASQESLDELNEHLKEPVSINRFRPKY

SEQ ID NO: 167984 - protein, 109 aa, Glycine max
  Coding DNA Sequence Number=SeqID_51206
GQLSYPNFILELSFADVLILANRKVLFDTNFSTRREIIRRFGQGCGKYPRGVAKGEAEEGVGHSALRGFLREIKEKKKKKEKKEAKALPNCDCNQLLHRSSFGVLRSSP

SEQ ID NO: 167985 - protein, 73 aa, Glycine max
  Coding DNA Sequence Number=SeqID_51207
MVKKRVSFELQKVAVGLSSAIKRLSIAKRSFNALSAKENLAEHQHQNRALSVEGAISQAQRKTGAKPNSTYLS

SEQ ID NO: 167986 - protein, 101 aa, Glycine max
  Coding DNA Sequence Number=SeqID_51208
MSFLTPSRKTLLFLYNKRCCSTPVSAQDMRSFDVLVKDTENTQREGQKGHFKKFLDPGLPGPPNCLRLKEPARLGEPISSGLSISLPGRATTIPNALISYK

SEQ ID NO: 167987 - protein, 60 aa, Glycine max
  Coding DNA Sequence Number=SeqID_51209
MKAGMMALEMPLEWVVTPNIIKRRALLWQTYSNATKVVSCRSAQHESLREWFSSMKRTCI

SEQ ID NO: 167988 - protein, 167 aa, Glycine max
  Coding DNA Sequence Number=SeqID_51210
MLQPYEISIGLKEHSNPVTPKAYTPKSPSGPLPPDSATYFLCSHTNPRGGLWLKLSSLVPHIFQGIVVQWIFRWINQGKDHMGGDKNHLSCSAKTKKKSMLPTSKASLISTPKSSKPASKTPTKIVTPASSTRKGTSPSLTRRKITSSGESRKFANKPLDMSLTLPP

SEQ ID NO: 167989 - protein, 56 aa, Glycine max
  Coding DNA Sequence Number=SeqID_51211
MARSRRSNFHCPCISHKAPKRKTLFLLRFSSANGIEASSLCPVYPAGEEPSPLERG

SEQ ID NO: 167990 - protein, 50 aa, Glycine max
  Coding DNA Sequence Number=SeqID_51212
MGIRRGSWGWGVERGREILECIYNDKFEFVTLVVASSAKRSSNYLILPHT

SEQ ID NO: 167991 - protein, 97 aa, Glycine max
  Coding DNA Sequence Number=SeqID_51213
MATSMKLRQFVLLLIVFTLLVVSSEARLVPEFSTLISKKINRKLGLRELINNVRNGDEWHQKRSMLGGSDLIVDNEGSDCTVIIKGSTLLIEYDVNV

SEQ ID NO: 167992 - protein, 106 aa, Glycine max
  Coding DNA Sequence Number=SeqID_51214
MEIRLRTKIQFWRLAKKEEEMDVAREARRKFGDESSGDGAEVVIGGGHGDGLGGAVLLPQLAHLHTLKSSITHTRWKMKVKEKKERRGIKIRHFIATKVEDAETLP

SEQ ID NO: 167993 - protein, 161 aa, Glycine max
  Coding DNA Sequence Number=SeqID_51215
  Subcellular localization annotation: CTP_CleavageSite=35; ConfidenceScore=5.60e-01
MMSKKAGGKYISNWHSIIAASFSRSSNLTRSRTLLHMALKKKHRRVMANLTLLGKMSRMTSTKDQRNVEAKLHGESKVIQRCFDDNNDDDKGDDKKLKDQSKNNSSESRTIQEFKNHEEFKTQEESLESRIKIQGSRSQESRSRFKTQDSRMKKRLNQDKY

SEQ ID NO: 167994 - protein, 223 aa, Glycine max
  Coding DNA Sequence Number=SeqID_51216
  Homolog annotation: Hit_ID=Q5S1T9; Match level="QueryCoverage=75%, HitCoverage=94%, E-value=2e-13, Identity=30%"; Hit description =Prenylated Rab acceptor protein 1
MVGMVAAVTAAVEEGEESDSLRILLIVEEQILRHAERVVEENDSGVEHENQNEDRSDAGEEKNEDGEEVEEGPRGEEANVEDEREMISECWTNGLNNLRRGEVFADTKGGFGGLGFRERGAVCELRPGATLVEAVVEGGGKVVDEGTEGQVVRRSLDGAAACTGGSCSGLGVGDGEDRRRSGGHDAYSKTVKMKKPSLYYQYNYDGLCQPIVVLLKVIIEGGY

SEQ ID NO: 167995 - protein, 120 aa, Glycine max
  Coding DNA Sequence Number=SeqID_51217
PIPLKLLRPLFQQVALMFNGEGYHYWKIRMQIFKEAIDLKIWEAIKFDSFIPTMKNEKSDKKNFKEKKEKKGYITWEDNVINSSSDSENKIISLGIMMKDYENGEEQSQYIDSNFSKHMA

SEQ ID NO: 167996 - protein, 175 aa, Glycine max
  Coding DNA Sequence Number=SeqID_51218
SFPGDMPQPFSTDTEISGYLFDFLFAAQDASTSSLLWAVALLELHAELLAKVIGVKLVVHIHPCRPLPERENDKEKGRYKATMREENERRDKAATYQFTITPRVKSVLDKIVEDGRYCVVTHGGNDEYQVDLEKQEKRFMLRDLQEHKRLRDQTLSGVPLVMSLHKTLGFVKGLQ

SEQ ID NO: 167997 - protein, 281 aa, Glycine max
  Coding DNA Sequence Number=SeqID_51219
  Homolog annotation: Hit_ID=Q2MIZ9; Match level="QueryCoverage=35%, HitCoverage=19%, E-value=2e-30, Identity=69%"; Hit description =Cytochrome P450 monooxygenase CYP710A15
MVGEMLVAKAISLESSRKILQLYNDEIAWRLWELARVLDLEGSHLNGFVGLCVVWNLNGNNCDLINIHSSCSLNELEKKIVGRFGDVKMRIWRRLEKGWHVEVFDGLGANINSKVEELEVVNTRLCVRVEDVGGRRLILSKEFWRLLKKWPKNIGWDGFMRKYLHCTKIVISEREARRGPACRSPRHVHQDEQNEDADISGRAFVPHRLLDARHAQGNQGGQARRRHAAAVLHQHRDQWLPLRLPLRGARCIHFVTSVGSGVARIARRVRDMTLRRWHVRW

SEQ ID NO: 167998 - protein, 77 aa, Glycine max
  Coding DNA Sequence Number=SeqID_51220
MTKKDAKKMADRVPGNGHFDDGDGGHQCRFWVREEVAAIGFGRRDCGNGGVWLEGFEQLREGTKVFEGARGRNDQIE

SEQ ID NO: 167999 - protein, 55 aa, Glycine max
  Coding DNA Sequence Number=SeqID_51221
MQAKSPCTLAISRGKGLGRHRGAGGAGVAEGITIVTSDLRFGYRHCCWRFALREL

SEQ ID NO: 168000 - protein, 111 aa, Glycine max
  Coding DNA Sequence Number=SeqID_51222
  Homolog annotation: Hit_ID=Q2QMW0; Match level="QueryCoverage=94%, HitCoverage=19%, E-value=8e-13, Identity=39%"; Hit description =Expressed protein
MVGTQHGKREDLVKIQSSVTLIQLAYGADSAAVAITTIDLVSKSFVGNVGSCTKINRPVDIITVVGGQGYSLPADIQYLDARWDVLVVLPLRDCFAQEINMLCPLDGFVVL

SEQ ID NO: 168001 - protein, 72 aa, Glycine max
  Coding DNA Sequence Number=SeqID_51223
MIGDRTKYNSNDIPVFGVTCNSLSGVRSPYETVVATTESPREAMTKKDAKKMADRVPGNGHFDDGDGGHQCR

SEQ ID NO: 168002 - protein, 142 aa, Glycine max
  Coding DNA Sequence Number=SeqID_51224
MVPTRHPLDPEKSNRALGFSALITGLCQSYGVPDIPSKAAGTPPPPRQVDSAGPLGVERYLQHLVHQQVANHHGQPQSAGAEFHPFCMPYPRAVWAEVALPGDWPDAQTGEEPAGSPRGADESLMDEDMTDLLGFLGGSGAT

SEQ ID NO: 168003 - protein, 45 aa, Glycine max
  Coding DNA Sequence Number=SeqID_51225
MVPHTLLLDLAIVLHQFEGGPGGGPDFGRGSGGYGSPCNFGCHWS

SEQ ID NO: 168004 - protein, 70 aa, Glycine max
  Coding DNA Sequence Number=SeqID_51226
MIGDRTKYNSNDIPGVTCNSLSGARSPYETVVATTESPREAMTKKDAKKMADRVPGNGHFDDGDGGHQCR

SEQ ID NO: 168005 - protein, 469 aa, Glycine max
  Coding DNA Sequence Number=SeqID_51227
  Gene Ontology: Mol. function=hydrolase activity; Cellular component =nucleus; Biological process=metabolic process
  Homolog annotation: Hit_ID=Q9LK21; Match level="QueryCoverage=99%, HitCoverage=100%, E-value=1e-177, Identity=67%"; Hit description =Arabidopsis thaliana genomic DNA, chromosome 3, TAC clone:K17E12
  Pfam annotation: Domain name=Abhydrolase_3; Domain location=155-435; Score=237.5; E_value=2.9e-68; Accession=PF07859.3; Description =alphabeta hydrolase fold
MPSVAVKLYSVFFKFLLKHRLQNRIQGRPEDSDPFGVTTRPDESVAPANPSFSDGVATKDIHIDPLTSLSIRIFLPDSALEPNSQPSSKPEPGSVNHETSSLRAVRRNSYEPAIFSPREEERRNSGGDSGGCGGAYRGYAPSPAGNGRRKKLPVVLQFHGGGWVSGSNDSVANDVFCRRVARLCEAVVVAVGYRLAPENRYPAAFEDGLKVLNWLAKQANLAECTKSMGGRRRLEGQHKHIVETFGASVVEPWLAAHGNPSRGLYTLLTILEPCLSGSLLLAVVMLSLFLMCVLLGVSCGANIADYVARKAVETGTLLDPVKVVAQVLMYPFFIGSVPTRSEIKLANSYFYDKAMCMLAWKLFLPEEEFSLDHPAANPLAPGHGPPLKKMPPTLTVVAEHDWMRDRAIAYSEELRKVNVDAPVYEYKDAVHEFATLDVLLKSPQAQVCAEDIAIWVKKYISLRGHEFSY

SEQ ID NO: 168006 - protein, 293 aa, Glycine max
  Coding DNA Sequence Number=SeqID_51228
  Homolog annotation: Hit_ID=Q1S9P8; Match level="QueryCoverage=37%, HitCoverage=34%, E-value=1e-45, Identity=80%"; Hit description =Endonuclease/exonuclease/phosphatase
  Pfam annotation: Domain name=H_PPase; Domain location=1-239; Score= -516.6; E_value=0.00016; Accession=PF03030.7; Description=Inorganic H+ pyrophosphatase
MANKFVVSRGLEKKMDPDLCKATNVIFGLALGYKSIIIPIFAIAISIFVSFTFAAMYGIAMAALGMLSTIATGLAIDAYGPISDNAGGIAEMAGMSHCIRERTDALDAAGNTTAAIRKKAELGFYIAHSVVAAAELVSVAASPTVATMIIPEKNRKEICKYLFQGDSAVTVMDTVVVHAGLIFQVVARKQRAVWLEYSVKRARAAASPPGCSEKRIRFGTWNIGTLTGKSMEIVDVMVMRKINFMCLQETKWTSEKAKELDNSGFKLWYTGKIRSRNGVGIIVDKEWKKDVVD

SEQ ID NO: 168007 - protein, 73 aa, Glycine max
  Coding DNA Sequence Number=SeqID_51229
MERIQKSPSSDNSKGWFHVTLLASRDIILLATMHHQKRKTLDEASLLLSESETQHDHRSTSTPYGSHIPGYRA

SEQ ID NO: 168008 - protein, 105 aa, Glycine max
  Coding DNA Sequence Number=SeqID_51230
MVEKTKGRKEEVVTLKYTINLAPQAPPWLGRNQGRVTEALTYMTSPQHCSAGGDDRQHVDRVAKGNIKGGVKGTCVLLHIRGNVVCDKLFKIRIGNLKIHYFVKG

SEQ ID NO: 168009 - protein, 58 aa, Glycine max
  Coding DNA Sequence Number=SeqID_51231
MVVQCLFLLSRESVERNEEKGYVRLRELNLKVGNWGWCAYAWACGSGIFVLRHRPIAT

SEQ ID NO: 168010 - protein, 869 aa, Glycine max
  Coding DNA Sequence Number=SeqID_51232
  Gene Ontology: Mol. function=protein binding; Biological process =protein metabolic process
  Homolog annotation: Hit_ID=Q6ER93; Match level="QueryCoverage=99%, HitCoverage=99%, E-value=1e-133, Identity=35%"; Hit description=Heat shock protein-related-like
  Subcellular localization annotation: CTP_CleavageSite=81; ConfidenceScore=5.06e-01
MRTGSCAVQQGLTPEAASIVKQAVTLAKRRGHAQVTPLHVANTMLSITNGLLRTACLQSHSHPLQCKALELCFNVALNRLPASTSSSPMLQGSHHHHSHACPSISNALVAAFKRAQAHQRRGSVENQQQPLLAVKIELEQLIISILDDPSVSRVMREADFNSTQVKSNVEQAVSLEICSQNNGSGNNNNNNNNKAEENNSSSGEKGLVLDPIRVEDVASVIENLGCERKRSVVIVGECVTSLEGVVRGVMEKIDKGDVGDECTLRGVKFISLSLSSFGNVSRVEVEQKVEELRGLVKASEHSKGYVLYLGDLKWVLDFRASGSQGRGCYCPVDHMVGEIGKLVNGTEENGGRFWVMGVATFQAYMRCKNGQPSLETLWCLHPITIPAGSLRLSLITDSGLQDQPTNKKADNRTSWLLLEGVGDDQKQQACFAEPSTKNETITEVRSLQSSSTCNSDSSSSTLPAWLQQYKNENKGINYNDQNSVPVGELCKKWKFMCSSIQKQPYPSDKTITLSSVSPSSSTSNFSYGQQHPNLHQTHNEWQVAEPPKDSLNNHHFWISNNGSNNTNEPTLRVYIPENNKQPFSSPNPSSNPNSTSSSDIMEVEHVSKFKELNSENLKTLCNALEKKLPWQKDIIPEIASTLLQCRSGMVRRKGKVMINSEEVKEETWLFFQGVDVEAKEKIARELARLVFGSQNHVVSIALSTFASTRADSTEDYSRNKRSREETSCSYIERFVEAMASNPHRVFLVEDIEQADYCSQLGFKRAIERGRVVDSKGEEVALRDAIIILSCESISSRSRACSPSVKQKSLTEVEMNGDINNATLEETSPFVSLDLNISIDDENNVEDRSEDEIGLLESVDGKVIFNFEEL

SEQ ID NO: 168011 - protein, 139 aa, Glycine max
  Coding DNA Sequence Number=SeqID_51233
  Gene Ontology: Mol. function=actin binding; Cellular component =chromatin; Biological process=cytoskeleton organization and biogenesis
  Pfam annotation: Domain name=Transposase_21; Domain location=41-139; Score=-21.6; E_value=9.1e-13; Accession=PF02992.5; Description =Transposase family tnp2
DDDECSSDGSTKKGPLAKVLWYLSIIQRFKSSLFANLDDAKDLTWHANGRNYDGMLCHPVDSSQWKKINSHYPEFDKEARNLRLGLTNDGMNLQPGNDIDVYLSPLIEDLTKLWDKRVIVLDGAIVHALSMKKTRAKYN

SEQ ID NO: 168012 - protein, 53 aa, Glycine max
  Coding DNA Sequence Number=SeqID_51234
  Gene Ontology: Mol. function=RNA binding; Cellular component=nucleus; Biological process=rRNA processing
MYLEIVLGCVVLEFGARSGYLTASHARAIAPSGLVYTFDFHEQRASSARYKDI

SEQ ID NO: 168013 - protein, 54 aa, Glycine max
  Coding DNA Sequence Number=SeqID_51235
MDLYIGKIVQELHAIRGMRIRGVEIDNAKSIWNMIEPNSESLHETDHMKSADGN

SEQ ID NO: 168014 - protein, 68 aa, Glycine max
  Coding DNA Sequence Number=SeqID_51236
HATSKEAGGVGAQPNRMVKGWHSDGKGRNAKGIITVGHRGGGAIIGDTIVSGTEVPIKMKNVLHLSAV

SEQ ID NO: 168015 - protein, 74 aa, Glycine max
  Coding DNA Sequence Number=SeqID_51237
MATTTTTMIIVTITIHHHYHRPMIIVTNMITVVVTATTIGDSVGMATATIMLMATMVVMTAIIVEVVVVTTILT

SEQ ID NO: 168016 - protein, 202 aa, Glycine max
  Coding DNA Sequence Number=SeqID_51238
  Gene Ontology: Mol. function=identical protein binding; Cellular component=cellulose and pectin-containing cell wall; Biological process=negative regulation of enzyme activity
  Homolog annotation: Hit_ID=Q1SX73; Match level="QueryCoverage=65%, HitCoverage=16%, E-value=3e-51, Identity=75%"; Hit description =Protease-associated PA; Proteinase inhibitor I9, subtilisin propeptide
  Pfam annotation: Domain name=Subtilisin_N; Domain location=31-117; Score=60.8; E_value=4.5e-15; Accession=PF05922.7; Description =Subtilisin N-terminal Region
MDHSIFYLYLLVSSFFFIFPLFLNVVYASKKCYIVYLGAHSHGPTPSSIDLETATHFHYDFLGSILGSHEKAKEAIIYSYNKQINGFAAAFEEEEAADIAENPNTVSVFLSKEHKLHTTRSWEFLGLQRNGRNTTWQKGRFGENTIISNIDTNSAAVAITTTDLVSKSVAIESLVGGTKLKVGGMAKGSGMIRFNNPFLELN

SEQ ID NO: 168017 - protein, 74 aa, Glycine max
  Coding DNA Sequence Number=SeqID_51239
MTKKDAKKMADRVPGNGHFDDDDGGQQCRLQVNHTRVEVRGKLVSRIKGEVLGERRGSRHRIWEKRLWQQRGLV

SEQ ID NO: 168018 - protein, 1021 aa, Glycine max
  Coding DNA Sequence Number=SeqID_51240
  Gene Ontology: Mol. function=nucleic acid binding; Cellular component= intracellular; Biological process=DNA integration
  Homolog annotation: Hit_ID=Q1RWN2; Match level="QueryCoverage=96%, HitCoverage=92%, E-value=0.0, Identity=39%"; Hit description =Peptidase S8 and S53, subtilisin, kexin, sedolisin; Integrase, catalytic region; Zinc finger, CCHC-type
  Pfam annotation: Domain name=rve; Domain location=396-519; Score =10.3; E_value=0.00082; Accession=PF00665.16; Description=Integrase core domain
  Pfam annotation: Domain name=zf-CCHC; Domain location=208-225; Score =24.7; E_value=8.2e-05; Accession=PF00098.13; Description=Zinc knuckle
  Pfam module annotation: Pfam domain module=RVT_2::rve::zf-CCHC; Domain location=660-863::396-519::208-225
MATESSFVQAAIPCFDGHYDHWSMLMQNFLRSKEFWSVIESGIQESPRAQLQALRRDFETLAMKDGESVTNYFARTMEISNKMWFHGEKMTDVTIVEKILRSLTTNFNYVVCSIEESKEIDVLSIDELPSSLLVHEQKMHRSSTTEERALKASTATNTYSSDFRGRGRGRGRGRGRGRGECGSREDNKNPRANTTSKGRGQYSDRSKLECFRCHKFGHYASECYSRLPNDREKGESSNFTENKEVETLHMVIQEGRKTESGIWYVDTGCSNHMSGLMGKGDVKIKTKNGFVETTSNVLYAPDLKSNLLSAGQLHEKCYVITIQKGACEIYDPVRGAIAIVQMSSNRLFPLKIESIQTCFKTDMVDPSWLWHFRYGHLNFSGLKTLQQKNMVTGLPQITIPSQVCEECVVGKQHRSQFPKGKSWRAKDVLELEKSEAFSTFKSFKASVENEAGKSIKTLRTDRGDEYCSKEFEIFCAEHGIRRELTTAYAPQQNVNWSIHVLNRSPTFSIQNMTPEEAWKGRRPTVDHFRIFGCIAYAHVPEKIVTSRDVVFDEENTWEWERQQPSQVIYDNDTEHEQISAPYMPENSTNSTPIATVTSPTTTSINEEEAQSHSRVRRRPVWMKDYEVTGIQNPITHFALFVDCDPTTFDSAVKEEKWRKAMNDEIDAIERNDTWELCDLPRGQKTIGVKWVFKTKLNENGEVDKYKARLVAKGYKQQYGTDYTELDVKSAFLHGYLEEQVYVNQPPSYVKIGTEEKVYKLKKALYGLKQAPQAWDEGKILIVCLYVDDLIFTGNCDAMFKEFRKSMMDEFGMSDLGLMHYFLGIEVVQSNAGIFISQKKYVGEILDRFHMQNCNSAITPAAFGCKLHKDHEGKKVDNTFFKQIVGSLMYLTATRPDIMYYVSLVSRYMEYPTEEHLLAAKRILRYLQGTRDFGTKAEFVATTACACQAIWLRRILEELSKHIDVRYYFLRELTKEKIVELIHCKSEDQVADLFTKPLKLASFQKLRALLGVCTMEEAVQGT

SEQ ID NO: 168019 - protein, 96 aa, Glycine max
  Coding DNA Sequence Number=SeqID_51241
  Gene Ontology: Mol. function=helicase activity
  Homolog annotation: Hit_ID=Q1SRJ5; Match level="QueryCoverage=97%, HitCoverage=11%, E-value=1e-20, Identity=46%"; Hit description =Probable helicase [imported]-Arabidopsis thaliana-related
MMISTAKGAQSYSDIRTVNGVVYGTFKETCFAKGFLGSDQEFISALQEANNWGTAHYLRKLFVKILFMNTMDRPEYVWQQTWQWMADDITFDHRKQ

SEQ ID NO: 168020 - protein, 177 aa, Glycine max
  Coding DNA Sequence Number=SeqID_51242
MDIIRFTAPFRVQKNLLQVPYSYHRQWMRNYLKYVLFHFDGNKHFIRVRTHHSKCFIADGLNEFRKAHNLNESVILRFVAVDKNTTFTILPAAASRFVYGSKKSITIQRDLPKCTQWHITIHNDIPAIAKPWFNFIHEKKLIPGDAVAFYYRFDEHAWELLIRKDIEWDNNEINFDD

SEQ ID NO: 168021 - protein, 267 aa, Glycine max
  Coding DNA Sequence Number=SeqID_51243
  Gene Ontology: Mol. function=iron ion transporter activity; Cellular component=periplasmic space; Biological process=high affinity iron ion transport
  Homolog annotation: Hit_ID=Q1IW95; Match level="QueryCoverage=55%, HitCoverage=50%, E-value=2e-28, Identity=46%"; Hit description =Periplasmic binding protein precursor
  Pfam annotation: Domain name=Peripla_BP_2; Domain location=6-174; Score=0.4; E_value=0.0001; Accession=PF01497.9; Description =Periplasmic binding protein
STLEDPTLNGGITEIVSALGHGKEIVGTDVTSTYPETLKATAKDLGHVAKAIGNTDYQKLNDKIDADLKQVQPIAKKPKVLFIYARGNMLMVSGTKTPMDALIGLAGGQNAVTEFEDFKPLTPEAVVKANPDVLFFFSSGLQGAGGNEGALKMPGVSQTNAGKNKKIIAMDGGLVSGFGPRLGEAAVVKGNGNISPSDTYVIWDVRAARIVMAILIGSMLAVSGTGLQGLFKNPLATGDLIGLTSGATLLAAIAIVLGGHFKQYLPE

SEQ ID NO: 168022 - protein, 141 aa, Glycine max
  Coding DNA Sequence Number=SeqID_51244
  Gene Ontology: Mol. function=zinc ion binding; Cellular component =mitochondrial outer membrane translocase complex; Biological process= intracellular protein transport
  Homolog annotation: Hit_ID=Q9LIQ6; Match level="QueryCoverage=70%, HitCoverage=42%, E-value=2e-27, Identity=63%"; Hit description =Arabidopsis thaliana genomic DNA, chromosome 3, BAC clone:F14O13
MPIFVLKKENENNQLCISVFYYIKRQNEQRCEQEIEDIKRGVRSGNITPDTSAIRFSDEALDEQKHSIRVADEKVALAVQAYDLVDTNIQQLDQYLKKFDEEIRRERENAAITGVPASGPEGNTKSGRGNESGTGRGGRKN

SEQ ID NO: 168023 - protein, 240 aa, Glycine max
  Coding DNA Sequence Number=SeqID_51245
MELHQLVQMKGTFYPELVKVFYTCTRADLEGNIFSTINGVDMFIHVVVWKEVVGLDMGRVHKFDETTNGYHKMQNYKGMLLDPTRRLRNRLRVGGLTVEDRMLVYLITYILTPRFIDYFKVDFSNEIVDYTKDSSEITERHLKKLGMRYVDHEWIMARKLVAGNIEEMEEDDKDEAQHEPTPQWSLFESLMIQKMDVVLHLYQEHLDEVHSSLENINSRLENLETRLSLSNLHNHNEDDA

SEQ ID NO: 168024 - protein, 206 aa, Glycine max
  Coding DNA Sequence Number=SeqID_51246
  Gene Ontology: Mol. function=ribonuclease H activity; Biological process=RNA-dependent DNA replication
  Homolog annotation: Hit_ID=Q1T1H6; Match level="QueryCoverage=63%, HitCoverage=49%, E-value=2e-13, Identity=26%"; Hit description =Ribonuclease H
  Subcellular localization annotation: CTP_CleavageSite=26; ConfidenceScore=5.22e-01
MMTWGPSGNVVYSSFAFKWLKAKNPSSNSAQSVNWSWVWSLKLPENILHFLWLTFHESLPTIQVWRFLRLDTNVAFYSGDLQHWLTDNIKSTRGMLFTATCWVIWKTCNAFIFGANTWSLWSIINQIQNLHMDIIKVIAANQLVTKLELSAILHGLQKAWDNDHRSFGYETDSKICLELATNTLEPHISSSFAHHQQNSRPSSSRL

SEQ ID NO: 168025 - protein, 247 aa, Glycine max
  Coding DNA Sequence Number=SeqID_51247
  Homolog annotation: Hit_ID=Q8H042; Match level="QueryCoverage=84%, HitCoverage=76%, E-value=4e-81, Identity=69%"; Hit description =Putative disease resistance response protein
  Pfam annotation: Domain name=Dirigent; Domain location=73-247; Score =180.3; E_value=4.7e-51; Accession=PF03018.5; Description=Dirigent -like protein
MSLGSSATVFGVAMLLAFALMTMPMCMADTEPINIVELYMHDILGGSNPTARPVTGLLGSIYSGQVPFATPVGFNTPQGGIPIPNANGAIPKVNGVTGIPLGTGLAGTTFAPNNNNQNNAQLEIGPDGLGLGFGTITVIDDVLTSQIELGSQVVGKAQGVYVASSSDGTRQMMAFTALFEEGEYGDSLNFYGLYKIGSSMSQLSVLGGTGKFKNAKGFAELRPLIPPGQVSTDGAETLLRITVHLNY

SEQ ID NO: 168026 - protein, 189 aa, Glycine max
  Coding DNA Sequence Number=SeqID_51248
MDCATQMRSRKRMWENVRNMESILPLDYKKGPGRPKKLRRRELDEVPNPTKLKGKNNIVPMECDLPPPPPPSPVAKEVANKDNTWENNKSQQVENDVHNNMVNEQNARKVQKRKTPSQLKKAKPTPPVKKTKSTPPIKNAKSAICQECKSSRIHKIHVTSNMVLRDTCQPSTSVLQHEHGHPALSNWDP

SEQ ID NO: 168027 - protein, 126 aa, Glycine max
  Coding DNA Sequence Number=SeqID_51249
MAVDKKEVQKLLFLFLSGCVTLNYALILIRDAEGFVGGIIAGAYLQGVCMIKVVIKSPRLSFVFTWLTRNDTTLMLLACLEIDVVIYGHFGAGLRGGRCGTWIFSNTHPALLGLAAWITMVGGPLD

SEQ ID NO: 168028 - protein, 154 aa, Glycine max
  Coding DNA Sequence Number=SeqID_51250
  Gene Ontology: Mol. function=RNA-directed DNA polymerase activity; Cellular component=chromatin; Biological process=chromatin assembly or disassembly
MGGHSDMHATYHKLHVVLFWKGMWKDVKEYIRHYDVCQRYKYENMSSLGLLQPLPKPQGIFFPDITMDFIEGLPKSNGSSVIFVVVDRMIKYAHFMPFSHPYNAATVARAFLDNVYKLHDFPSSILSDRDVVFVRLQGVSLRASTVYRPQMDGQ

SEQ ID NO: 168029 - protein, 200 aa, Glycine max
  Coding DNA Sequence Number=SeqID_51251
  Gene Ontology: Mol. function=RNA-directed DNA polymerase activity; Cellular component=chromatin; Biological process=chromatin assembly or disassembly
MVAAPSPRKENVYMAKLAEQDEHYEEMVEFMGKYNHLGQTIELHADVTNGPELVSAPQVKRLIRTGSTSTLFHLCLLPTTRPDPPQHHLPHPVPAIEALLHHYQHIFQTPPTLPSPPPPKRSNSSYQSPSFDFPGEHTALQVPALLENRDRKASLRSPFSWPDTTKHEPVFLPNSSGKEEGRHLADVRELDVGLYVHSIT

SEQ ID NO: 168030 - protein, 118 aa, Glycine max
  Coding DNA Sequence Number=SeqID_51252
  Homolog annotation: Hit_ID=Q1SAK3; Match level="QueryCoverage=82%, HitCoverage=8%, E-value=5e-09, Identity=31%"; Hit description =Integrase, catalytic region; Zinc finger, CCHC-type
MVDSTDDSSTMKKLRKMNKQKSDLNHLLSVQRHTTDKTSLGYNKKIDLPKKTKFAPLKKVCLEAKYSLWYLDNGCFRHMTGDKSKLTDLVLRKCGYVAYGDNTKIRIMREGNITQDSK

SEQ ID NO: 168031 - protein, 79 aa, Glycine max
  Coding DNA Sequence Number=SeqID_51253
  Homolog annotation: Hit_ID=Q10CV6; Match level="QueryCoverage=98%, HitCoverage=7%, E-value=1e-10, Identity=44%"; Hit description =Helicase associated domain family protein, expressed
RSRFVSSYDDTVSEEGSDREFQPPSLPNASPIDNTDEWKRKFTMLLRDKSKQELVSREKKDRRDFDRIAVLASRMGLYR

SEQ ID NO: 168032 - protein, 100 aa, Glycine max
  Coding DNA Sequence Number=SeqID_51254
MASNPSRVQKKENPKQPSIAWTLGSLMKEIRGFNFPNLLKVQGLTKQVQMKGTFYLELVKVFYTFTRAGLEGNLFSTVNGVDMEIDVIVWKEVASLVMGE

SEQ ID NO: 168033 - protein, 94 aa, Glycine max
  Coding DNA Sequence Number=SeqID_51255
MRYANHEWIIPREPTARNIDEMEEDDGAGAQHELAPQWSPFESLMIQKMDAMLHLHQEHLVKVHISLENINTRLKNRETKLSLRNLPKLNKDDA

SEQ ID NO: 168034 - protein, 67 aa, Glycine max
  Coding DNA Sequence Number=SeqID_51256
MRGRCAMYPYLEITLDCHPHDFVRSPRPRRIGGSDWAQWIRGLTLATTNFKGRSWSYRYCYTMKEEA

SEQ ID NO: 168035 - protein, 94 aa, Glycine max
  Coding DNA Sequence Number=SeqID_51257
MAGIFFLKKKNSLEFFGHNVNGRPTRSTFHQDTIVEVYEDAGDFSDDEDLTLSKIAYYRDVIDEEILEGEMLSSDEEHDSSGDESDPSKDMTSS

SEQ ID NO: 168036 - protein, 85 aa, Glycine max
  Coding DNA Sequence Number=SeqID_51258
MKVQELFTHGEGISTPRTRHKGRQPLIECAKHDFKIIPLDLRTSFPSLPSRLFIAKQGIWDEGSSPRRAGYFTMKLFWWPRRARG

SEQ ID NO: 168037 - protein, 111 aa, Glycine max
  Coding DNA Sequence Number=SeqID_51259
MAQLISDAIYCLQGLCPQDTQSTQRKCLLPPARSSGPLLNRVSIEKYCAPRQVQGEAPQQPGDDQQRATDAPPPLPESTSAHLQRLERCLQHMADQQAANHRGRYEQILGS

SEQ ID NO: 168038 - protein, 64 aa, Glycine max
  Coding DNA Sequence Number=SeqID_51260
MAEVDKVQVRMKADMEAMKEQMATMVEAMMSMKKIMERPVLLSFSTSKTIQSEITRATHLVRVP

SEQ ID NO: 168039 - protein, 64 aa, Glycine max
  Coding DNA Sequence Number=SeqID_51261
MLATGNRLLPSGNQLPESKTLGVEGRSPEYQEPLDLRSNPFQGGWDDAILHPKGIRLKTPRVLG

SEQ ID NO: 168040 - protein, 266 aa, Glycine max
  Coding DNA Sequence Number=SeqID_51262
  Gene Ontology: Mol. function=DNA binding
  Homolog annotation: Hit_ID=Q1S0F5; Match level="QueryCoverage=83%, HitCoverage=44%, E-value=1e-27, Identity=34%"; Hit description=IMP dehydrogenase/GMP reductase
MGQLQRQAFRKAYGKIWDLARVEVSTESIASLAQYYDHPLRCFTFGDFQLSPMVEEFEEILGCPLGGRKPYLFSGFYPSLARISKIVQISAQELDHQKQVENGVVGIPRKCLEAKARILAGRSEWAPFIDVLALLIFGGVLFPNVDGLVDLAAIDAFLAYHNHKESPVDAILADLYDTFDRRYEKSGARIVCCTPALYVWLVSHLFLQEGRPVYPLQGHRSCIEKGKANWDQLLASMEGRLLIGSLARRKEESGFYLHAKDVQMFP

SEQ ID NO: 168041 - protein, 209 aa, Glycine max
  Coding DNA Sequence Number=SeqID_51263
MATELEQLAEKHRRHHTEAAVGDGQRMLGLVGAGQPQAFGPVTESSVGKTGCQERGAKNVEPFPEPAPQDQAHQRDGQGRAHVRVKQHGGRRHASAGKDRNALGCLGVGQQAGEQCQKRCGCQGLRQPSHCRIRWPVPPAAFGGIVLGVDQGADWLMWRAPMHARRQGQCMGVHVCGRHCAPAAVAGKRCRVSADACRVPQCNRPPHCG

SEQ ID NO: 168042 - protein, 261 aa, Glycine max
  Coding DNA Sequence Number=SeqID_51264
  Gene Ontology: Mol. function=amino acid-polyamine transporter activity; Cellular component=integral to membrane; Biological process=amino acid transport
  Homolog annotation: Hit_ID=P25737; Match level="QueryCoverage=96%, HitCoverage=51%, E-value=7e-99, Identity=69%"; Hit description =Lysine-specific permease
MGAGRASVDVGAQLHVLVLHDVRALDQAVAAPDQQEQRQADIGGDHAGPVDAVCHEGLVVLAQRDHHAQHEGEDGAEREPRCTVGQPVQVQALGLVALAEAVVADGDAQPGDEARHARQIQQPDVDQLGAEDVGQKAQRSHDRGGQQGHRGHAALVDVREHARRHALAGQRIEHARGGVHARVAGRQHRGQHHGVHHGGGRQQARALEDQGEGAHADVAQVVLEQLRIGVGDQQADDQDGQDVEQQNAPEHLAHGAGHVLG

SEQ ID NO: 168043 - protein, 118 aa, Glycine max
  Coding DNA Sequence Number=SeqID_51265
  Gene Ontology: Mol. function=dihydropteroate synthase activity; Cellular component=cytoplasm; Biological process=folic acid and derivative biosynthetic process
  Homolog annotation: Hit_ID=Q1H385; Match level="QueryCoverage=99%, HitCoverage=41%, E-value=7e-39, Identity=67%"; Hit description =Dihydropteroate synthase
  Pfam annotation: Domain name=Pterin_bind; Domain location=3-118; Score=78.4; E_value=2.3e-20; Accession=PF00809.12; Description =Pterin binding enzyme
MGIVNVTPDSFSDGGQFNQVDAAVAHALELIAQGADVLDIGGESTRPNATPVTLDEELRRVIPVIEALVAHDIPVPISIDTYKPAVMRAAIAAGASIVNDVRGLQEDGALEAIVNSEA

SEQ ID NO: 168044 - protein, 137 aa, Glycine max
  Coding DNA Sequence Number=SeqID_51266
  Gene Ontology: Mol. function=nucleoside-triphosphatase activity; Cellular component=integral to membrane; Biological process=protein catabolic process
  Homolog annotation: Hit_ID=Q1H386; Match level="QueryCoverage=93%, HitCoverage=20%, E-value=2e-41, Identity=66%"; Hit description=ATP -dependent metalloprotease FtsH
  Pfam annotation: Domain name=Peptidase_M41; Domain location=1-92; Score=-45.0; E_value=7.3e-08; Accession=PF01434.8; Description =Peptidase family M41
MARDMVTKFGMSDTLGTMVYAGSEQDSWMGSMSSRTVSEATQQKVDAEIRRILDEQYGIARKLLEDNRDKVEAMTKALMEYETIDADQINDIMAGLPVRAPKQKNGPTMTSGGSGTGTIVNPTPQPTAKGDETESHA

SEQ ID NO: 168045 - protein, 264 aa, Glycine max
  Coding DNA Sequence Number=SeqID_51267
  Gene Ontology: Mol. function=RNA-directed DNA polymerase activity; Biological process=RNA-dependent DNA replication
  Homolog annotation: Hit_ID=Q8H6Q8; Match level="QueryCoverage=99%, HitCoverage=48%, E-value=1e-30, Identity=36%"; Hit description=CTV.20
  Pfam annotation: Domain name=zf-CCHC; Domain location=163-180; Score =30.4; E_value=6.5e-06; Accession=PF00098.13; Description=Zinc knuckle
MEKTLADFRWYRDTFLTRVYTREDSQQPFWKEKFLAGLPRSLGDKVRDKIRSQSVNGDIPYESLSYCQLISYVQKVALKICQDDKVQRELAKEKAQTKRDLGSFCEQFGLPVCRKQKKKQNLRKESHENKTFNKKRFPRRRYSHKPMTSKESDTPKPKIKPKITCYNCGKQGHISKYCRLKRKLRNLNLEPTIEEQINNLLIETLEEETKTSSSTFSEENLNIIKQDDQPSSTDDDEREINTLTREQDLLFEANNSIPDPQEKK

SEQ ID NO: 168046 - protein, 242 aa, Glycine max
  Coding DNA Sequence Number=SeqID_51268
  Gene Ontology: Mol. function=peptidase activity; Cellular component =outer membrane-bounded periplasmic space; Biological process =proteolysis
  Homolog annotation: Hit_ID=Q9PF62; Match level="QueryCoverage=91%, HitCoverage=22%, E-value=2e-55, Identity=48%"; Hit description=Zinc protease
  Pfam annotation: Domain name=Peptidase_M16; Domain location=56-201; Score=-21.6; E_value=0.013; Accession=PF00675.10; Description =Insulinase (Peptidase family M16)
EDPSQAPKPFNVPAVDPKYSTLPEQVDRKAGVPQTREFPQLKFPALQRATLKNGTQVILAERHEIPVVQFSYQFPGGFSADQGRKPGTGNFTMSLMTEGAGKLGSLAFADAADALGASLDASAGLDSMSVDLSALKENLAPSLALYRDLLREPRFEQGEIDRVKATWIAGIQQEKVNPGAVAMRVLPPLLYGKGHPYAIPFTGSGDEAAINGLTREDLVDFHHDWLRPQNGTLIVVGDTTLA

SEQ ID NO: 168047 - protein, 86 aa, Glycine max
  Coding DNA Sequence Number=SeqID_51269
MTPARKLHVLMWPPSTREKKSLLWTLMVRENERSIVHGFGVGLNPNAIESDLGKADLRVILVDEEGATVRGVRFCYLIFGFGSLNF

SEQ ID NO: 168048 - protein, 226 aa, Glycine max
  Coding DNA Sequence Number=SeqID_51270
  Homolog annotation: Hit_ID=Q1SPB9; Match level="QueryCoverage=63%, HitCoverage=27%, E-value=2e-10, Identity=30%"; Hit description =Transposase
MDKAEEWQNIMDAWELLLHSLDEESYNECLKIFTNCLEDTGDSWGNLTLTHEVNALLKRLSPLDVCGKITLKTKFYELAFLNTTSMCPPPEKAKTKGALKSVKCTKREPSMWENVNEMSTMVGSFGTPSVAHKVGRDKKKRKMDHYMDEFLDELQQYIMNTKDVTPDENCGYRTIVALLGQGIIVPCLLLYPNGQNIAHRSPFMEKSLHEIHSSFQLNTFQPARGS

SEQ ID NO: 168049 - protein, 81 aa, Glycine max
  Coding DNA Sequence Number=SeqID_51271
MKNESEQNKNELQASDSETYRLKTEERQRMAKNFHGIAHGNVSEALRKHLGLDFFLLSLPLTNFKRKGEVVAAHRLLEEDF

SEQ ID NO: 168050 - protein, 195 aa, Glycine max
  Coding DNA Sequence Number=SeqID_51272
  Gene Ontology: Mol. function=transcription factor activity; Cellular component=intracellular; Biological process=regulation of transcription, DNA-dependent
  Homolog annotation: Hit_ID=Q2NVE2; Match level="QueryCoverage=98%, HitCoverage=58%, E-value=2e-80, Identity=74%"; Hit description =Xylitol repressor
MANPFFGGLTRLMTLEAQKMGYDTLVFDSYESQESEDRIIDKLIGYNVDAIILSVISNDHLYQPSYLKRLETLNIPVVLIDRELDNRHCSGVYIDNLDCGLQAGRWLLEQKAQRVVVVSGPENSNVARDRVTGLQAALQGKVASLEVLYADFFMDVAWQETSRWLANNRAPDFFVGCNNQISLGIIKACIEHRLP

SEQ ID NO: 168051 - protein, 255 aa, Glycine max
  Coding DNA Sequence Number=SeqID_51273
  Gene Ontology: Mol. function=DNA binding; Cellular component=oxygen evolving complex; Biological process=DNA integration
  Homolog annotation: Hit_ID=Q1SAZ0; Match level="QueryCoverage=99%, HitCoverage=25%, E-value=2e-34, Identity=54%"; Hit description =Integrase, catalytic region
MVQNQFQTNIQVFRSDNGREYFNTILGNFFLENGIVHHSSCANTPQQNGIAKRKNKHLLEVARALLFSTKVPKYLWGEAVLTDAYLINYSETCIAAPKQKGQDSLVEPTLIMSEVLAESRATSSKQNCNKQSLDTGNKEELTLMPQQDNPCKEIANRLIDCDRIWKGKGYMRRNKEVEDAQTLQHNHESEPRKNLISGKGKPSSSNSNDQDNPSKMNIAMVLRKGVRSCTKHPLSKFMSYSNLSSSFAAFTSRLS

SEQ ID NO: 168052 - protein, 89 aa, Glycine max
  Coding DNA Sequence Number=SeqID_51274
MDEVCCPICLNYDNDAGHLFFGCTKIMPLWWETLSWINTLTVFPERPKEHFLQHSQCNLNGLIQHIWNHRNKIVFSGDSFDGVQKRHAV

SEQ ID NO: 168053 - protein, 201 aa, Glycine max
  Coding DNA Sequence Number=SeqID_51275
  Gene Ontology: Mol. function=oxidoreductase activity; Biological process=electron transport
  Homolog annotation: Hit_ID=Q8PGC9; Match level="QueryCoverage=43%, HitCoverage=20%, E-value=6e-34, Identity=77%"; Hit description=D -amino acid dehydrogenase small subunit
AGLHRGRVEVGVVAGDHPFALEPAYTLGAWRGRQADPLAQFGEGDAALGLQDAQDLAVDLVQFAGTGGHGRQPWGMNCRRTSCRLISKQANQLGMAVYTSPIMVPARSSVGNDRAGFEVTVIDRQPGPALETSFANAGQLSFGYTSPWAAPGVPKKAIGWLFEKHAPLAIKPGMDLAQYRWLWQMLRNCTHERYAINKARM

SEQ ID NO: 168054 - protein, 91 aa, Glycine max
  Coding DNA Sequence Number=SeqID_51276
  Gene Ontology: Mol. function=pyruvate kinase activity; Biological process=glycolysis
  Homolog annotation: Hit_ID=Q1S8N3; Match level="QueryCoverage=79%, HitCoverage=13%, E-value=8e-29, Identity=84%"; Hit description =Pyruvate kinase
MESIVLQAVKNGDTIFIGQYLFTGSETTSVWLEVSEVNGDDVTCVIKNSATLAGSLYTLHVSQIHIDLPTLDNKDKESIVQIAAVFNCTLC

SEQ ID NO: 168055 - protein, 93 aa, Glycine max
  Coding DNA Sequence Number=SeqID_51277
  Homolog annotation: Hit_ID=Q1SMF0; Match level="QueryCoverage=78%, HitCoverage=14%, E-value=8e-10, Identity=44%"; Hit description =Tetratricopeptide-like helical
MWVSLQASLQASGWRRRLDGQLTKAEKTVIADMTKSMVKPRNILLTLKEHNANSCTTIKHIYNARSAFRSSIRGSDIEMQHLMKLLKRDQYIH

SEQ ID NO: 168056 - protein, 123 aa, Glycine max
  Coding DNA Sequence Number=SeqID_51278
MVPTKQRLTHSTTNSQANSLSTLPITSENTSYSLIGFGPALIHPEGFIPHSSPVPINFARCKIGLDLKAKGRKFGAEGLRSCIFYWLSFPKDELFLDCAAPLLTLTIHFNQWSSSIRQGFLYQ

SEQ ID NO: 168057 - protein, 118 aa, Glycine max
  Coding DNA Sequence Number=SeqID_51279
  Gene Ontology: Mol. function=DNA binding; Cellular component =mitochondrion; Biological process=DNA integration
  Homolog annotation: Hit_ID=Q1T4S3; Match level="QueryCoverage=98%, HitCoverage=7%, E-value=7e-38, Identity=63%"; Hit description=Zinc finger, CCHC-type
MQLDYEALMKNHTWYLVHLQSNRKAIGCKWDFRVKENADGSINKFKARLVAKGFTQVQGFDFSETFSPVVKPVTIRIILTLAITNQWILAQLDVNNGLLNETVYMSQSLVFQKSNPSM

SEQ ID NO: 168058 - protein, 76 aa, Glycine max
  Coding DNA Sequence Number=SeqID_51280
MVNNLSYLSLPLDSDYLVIECDGCEQGWGAILKKKNNKYEKIHDEDICRYASGKYHTKPQITKEFLSLQKPLLLEK

SEQ ID NO: 168059 - protein, 369 aa, Glycine max
  Coding DNA Sequence Number=SeqID_51281
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=7e-51, Identity=31%"; Hit description= UPI00006A17C9 related cluster
TFRGLHVLTFRGLHALTFRGLHVLTFRGLHALAFRGLYILTIRELNVLAFRGLQALAFRGLHVLTFRGLHVLTFRGLHALTFRGLHVLAFRGLHTLTFRGQHFHSFRVLHVVTFRGLHALTFRRLHVLAFKGLHSLAFRGLHILTFRGLHVLAFRGLQALAFRGLHILTFRGLQGLTIRGLHVLAFRGPHILAFRGLYVLPFRGPHVLTFRGPHAFTFRGLHVLAFRGLRALAFRGLHVLTFKGVHVLAYRGLHNLAFRGLHVLTFRGLQVLTFRGLHALTFRGLHVLAFKGLHALAFIGLYVLIFKGLLVLTFRGLHALIFRGLHVLAFRGLHAFAFRGLYILTFRGLHVLAFRGLHALAFRGLHVLT

SEQ ID NO: 168060 - protein, 80 aa, Glycine max; identical to SEQ ID NO: 167923
  Coding DNA Sequence Number=SeqID_51282

SEQ ID NO: 168061 - protein, 177 aa, Glycine max
  Coding DNA Sequence Number=SeqID_51283
  Gene Ontology: Mol. function=binding; Cellular component=membrane
  Homolog annotation: Hit_ID=Q4KKC5; Match level="QueryCoverage=81%, HitCoverage=17%, E-value=4e-33, Identity=48%"; Hit description =Heamin storage system, HmsH protein
  Subcellular localization annotation: CTP_CleavageSite=16; ConfidenceScore=5.17e-01
MSLAQAVSARMASSSRAASRSRMGSLSNMAVSEAVGKVEHDAQFALALAVVRAADAGDHRAHVQHVVGAVALAIAQGDDAAGAVALLGVGAGADRADLFPGGFVAAVQRVRDARAGQHHQVRARVVVGRVVAAVALGRQVQRQVGLQVRRGVDALAPVQPQFPALVAVGKARRRQRQ

SEQ ID NO: 168062 - protein, 86 aa, Glycine max
  Coding DNA Sequence Number=SeqID_51284
METKVVSADRPKVADDHNLSPRVNGLACLWLTKRNARNGNQRNGTQTEVGFWHFKRSDFSLHVAEHESHQEKKVGPFAPFKWRHVA

SEQ ID NO: 168063 - protein, 93 aa, Glycine max
  Coding DNA Sequence Number=SeqID_51285
MGLNQTHVLKKGSSRQSQVWKKERALWLPYRTCARVRVMGETDEVQERIKADLEAMKEQMAIMMKTMKEKMAIMMKAMKEKMAIMMEAMMSTY

SEQ ID NO: 168064 - protein, 206 aa, Glycine max
  Coding DNA Sequence Number=SeqID_51286
MATPMHPSTINDKDEKGNDTPEKEYKGYCGADVASDKNENRSNQKPSTSSTSKYEISHSPSPKTQDKGKANAIHISFGLDSEATRTIIALRAKGIVIGFPKRKCSVKIKKSVRKRQQAKYEAPALFQDKKLQEKIDVGWVSKKVVNGRGVISLSNDPLHLHGTGGPMTRSKTKRMKCFESDLMNLFGNKKHPWAELINFGGLLILG

SEQ ID NO: 168065 - protein, 157 aa, Glycine max
  Coding DNA Sequence Number=SeqID_51287
MACEDDDGHPFLIVFEIVVVPFAIQRQASPMACGDHHDNLFFCHFQGTKAFADAPYVFYALSFDRFRSLSYWSPWANLECSGGSKSSPGQACCFRWKLPALLGELGGNHLPHFFYKMAWRAKGKRISTFGTQNSLKISEKKKKGGKDPSRDASVMLP

SEQ ID NO: 168066 - protein, 134 aa, Glycine max
  Coding DNA Sequence Number=SeqID_51288
MSPKDLQQLIQQIRDQLEESIIEKVTRQVMASFSQMQSQFQSQIHSQGLALPPEPEVGPSGNDPETGKIYEGSTTVHNFPLLHGQVKVGVEEVKDAEASVPVPTDEVTLVGQTLNTFLAWPTHLVKHLSEHLCL

SEQ ID NO: 168067 - protein, 199 aa, Glycine max
  Coding DNA Sequence Number=SeqID_51289
  Homolog annotation: Hit_ID=Q2P666; Match level="QueryCoverage=48%, HitCoverage=19%, E-value=6e-39, Identity=75%"; Hit description =Succinyl-diaminopimelate desuccinylase
MAVEQDGVVAGFGAGSRNFQEDQRGTAFQAHHFNLQAGQLLGLGPVLHQRDRLFHVAVLHPIGVEHRRLVGNADVVDQLRDDLAVPLVIDELAELGAKSRKPIGCVHVVTDTVPTDGIAGRDGQNHKEIHVVPWFVVLRALVLVVGIAGAHAAEPIDINRADAQALQQGLTMVGAAKAEAIVEHRRRHGPFHRVEDLTQ

SEQ ID NO: 168068 - protein, 45 aa, Glycine max
  Coding DNA Sequence Number=SeqID_51290
MALSAPSRNFSIDRCIVSLELDRAGQDNCSARHSVQGSSFYYDAV

SEQ ID NO: 168069 - protein, 167 aa, Glycine max
  Coding DNA Sequence Number=SeqID_51291
  Gene Ontology: Mol. function=chitin binding; Cellular component =extracellular region; Biological process=chitin metabolic process
  Homolog annotation: Hit_ID=UPI0000612705; Match level="QueryCoverage =65%, HitCoverage=92%, E-value=9e-12, Identity=28%"; Hit description =UPI0000612705 related cluster
GLQVFTFRELHVLTFRELHVLALRGLHILAFRGLHVLDFRGLHFLALRGFHALAFKGLHAFAIRGLHAFAIRGLHALAFRGLHTLAFRGLHVLTFRGLHVLAFIGLHVVATYPSAGGRREAHGCIFQGRKARGVATNVYLRKTSKKPERVFPSLRRILNCNEEIEPT

SEQ ID NO: 168070 - protein, 200 aa, Glycine max
  Coding DNA Sequence Number=SeqID_51292
QQKVYTDNHSGISASQRDSKVSMTDLVSAEDDGAEDDVSLCVLSGFSSYRQQKVYTDNHSGISASQRDSKVSMTDLVSAEDDGAEDDVSLCVLSGFSSYRQQKVYTDNHSGISARQRDSKVSMTDLVSAEDEGAEVDVSLCVLSGFSSYRHQKVYTDNHSGISASQRDPKVSMTDLVSAEDDVNLLVSMGLSAAIDEGRR

SEQ ID NO: 168071 - protein, 399 aa, Glycine max
  Coding DNA Sequence Number=SeqID_51293
QMHNLGCSQIHDFKTSSQEAVGPMQLELDDIWASLDGSRNGIREILGRSNSIDGCHSIPRDDQEYAEELLVAWEHYKQNVHSRNILLERNVTLSVMEYDEFRRERYKALTRQLDDRIDVALVKEFYANLFDPENKSLRQVRVRGKLIKFDAETLNILGDPGGFGAKGEVLRLLQVLPFTPRPLGARHQIVYSRARARLVNGLVMKMDMDLGSIISGEISQMAQSNSSRLGFPALITALCIARGVVPNSLTFESLSPAINLAYILKNYWNPDDPTIIFLGTHKTWARGPDAFSFAPPAPALAPPTPTPAPPAHSGTSAQSTKILVSADVVESSPWLMPGDSSPLGGGEAPTAQEPHPEPEASPKATMEETPEVTPTASPLVEATEKEDGTADTNYAADIE

SEQ ID NO: 168072 - protein, 67 aa, Glycine max
  Coding DNA Sequence Number=SeqID_51294
MKVGYVLRNAIAHTFTVGICEIIFVEGEKESHEDSTSGGFNPFSVSLTFGNSIGAVGGKIGGISRKR

SEQ ID NO: 168073 - protein, 320 aa, Glycine max
  Coding DNA Sequence Number=SeqID_51295
  Gene Ontology: Mol. function=sugar binding; Cellular component =intracellular; Biological process=regulation of transcription, DNA -dependent
  Homolog annotation: Hit_ID=Q1RZN7; Match level="QueryCoverage=99%, HitCoverage=75%, E-value=1e-115, Identity=61%"; Hit description=C -type lectin; Tetratricopeptide-like helical
  Pfam annotation: Domain name=PPR; Domain location=104-138; Score=0.2; E_value=7; Accession=PF01535.11; Description=PPR repeat
  Pfam annotation: Domain name=PPR; Domain location=156-190; Score =25.1; E_value=0.00024; Accession=PF01535.11; Description=PPR repeat
  Pfam annotation: Domain name=PPR; Domain location=228-262; Score =12.9; E_value=0.22; Accession=PF01535.11; Description=PPR repeat
  Pfam annotation: Domain name=PPR; Domain location=263-297; Score=5.5; E_value=1.7; Accession=PF01535.11; Description=PPR repeat
  Pfam module annotation: Pfam domain module=PPR::PPR::PPR::PPR; Domain location=104-138::156-190::228-262::263-297
MVRHPLSKRGNKYLRKFMKWPHSPYKTSWHHNFGEEQAMKNLKQATLEMGSSQHPQRPNLPYPFLLSTLLDSFKAYSIDPTPKAYTLTPQNPNQHLPKFETPESILVYLIRFYGLADRVQDAVDLFFRIPRKRECLEMVPRILLKSQHMNIHVEESTFRVLIRALFRIKKVGYAVKMLNCMIEDGCGLDEKICSLIISALCEQKDLTSVEALVVWRDMRKLGFCPGVMDYTNMIRFLVKEGRGMDSFHILNQQKQDGINPDIVSYTMVLSGIVAEGEYVMLGELFDEMLNKVDKALQIVASMEELECKSNVVTYNTILGA

SEQ ID NO: 168074 - protein, 320 aa, Glycine max
  Coding DNA Sequence Number=SeqID_51296
  Homolog annotation: Hit_ID=Q10BI2; Match level="QueryCoverage=57%, HitCoverage=71%, E-value=4e-09, Identity=27%"; Hit description =Expressed protein
  Pfam annotation: Domain name=DUF567; Domain location=5-149; Score =39.5; E_value=1.1e-08; Accession=PF04525.3; Description=Protein of unknown function (DUF567)
MENQFPVISDSYCVPYLINLRINTEKGITYDANNVRHFYIKDKLFTLHKRRVLCDNQGNPIVTLYKKRMTLHGRCQVFRGYKSKDFSQLLFSVKRSAMIPSGMINLEVFLANNQRESACDFRVNVCRDKRSCTVYAGESPRIVATNILYNLAYTIYTTKGSVSHSTLPSPMENHQFPVISVIPTVFLILSIYKSIQKKMDNNDGFNVLVYPHADYAFIVALLMIVSEMKHYFDEMVYLAAGMAPLGVVSQPTIRQEGDTRAHGCVFHGRKMRGVATNVYSRKTSEKSKRCDLRTLSVKGSRVVFTHGEGISTPRVRHKGR

SEQ ID NO: 168075 - protein, 126 aa, Glycine max
  Coding DNA Sequence Number=SeqID_51297
  Gene Ontology: Mol. function=DNA-directed RNA polymerase activity; Cellular component=nucleus; Biological process=transcription
  Homolog annotation: Hit_ID=P18616; Match level="QueryCoverage=89%, HitCoverage=6%, E-value=4e-35, Identity=61%"; Hit description=DNA -directed RNA polymerase II largest subunit
MSVVQIEHREVWLAECPGHFGHLELAKPMFHIGFLKTGLMFPCQSVLAIMRCACFNCSKILANEFKLALRIRNPKNRMRKILDACKNKSKCEGGDDIDIHGKDIGELVKKSRGGCGAQQPKITIEG

SEQ ID NO: 168076 - protein, 260 aa, Glycine max
  Coding DNA Sequence Number=SeqID_51298
  Pfam annotation: Domain name=DUF567; Domain location=3-128; Score =20.1; E_value=3.7e-06; Accession=PF04525.3; Description=Protein of unknown function (DUF567)
MAFPVISSDYCAPYAINLQINTKTGFTYDANNACRFYIEDKLFTLHKRRVLCDNQGNPIVTLYKKRMTLHGRCQVFRGYKSKDFSQLLFSVKRSSMIPSGMVNLEVFLANNQREKIKDHALFMPVNLLELLPRDYNDDDNDVNNNNYDDSGDSSGDDISGGDDVDDGISQWCGGDMGNGDREVVLVVVVVVTMLVTMVVVALLMMVVVAALVIDVILLVMIMVVSITATVTLMVVVGIIMLVMMVMSVVTMEAMTIFCLE

SEQ ID NO: 168077 - protein, 98 aa, Glycine max
  Coding DNA Sequence Number=SeqID_51299
  Homolog annotation: Hit_ID=Q1RZK3; Match level="QueryCoverage=82%, HitCoverage=6%, E-value=1e-25, Identity=72%"; Hit description=WD40 -like
MMFFDRHLAASQVHGRQFKAGVVDGSVRLYDVRTPEMLASELSLHRQRVKEVVGLALIQPGLDQGKAGDIQFLDIRNHSSAYLTIEAHRVFTHSFSGR

SEQ ID NO: 168078 - protein, 98 aa, Glycine max
  Coding DNA Sequence Number=SeqID_51300
MEFYSHNITATSALSHVPKVLAVDFGASFPVGLNILQLNSVGIFDFGGGGRGQGEFHDLAVSDEKDEIEPGTCRVESELQVLVCKDCYDFVTILTDNY

SEQ ID NO: 168079 - protein, 389 aa, Glycine max
  Coding DNA Sequence Number=SeqID_51301
  Gene Ontology: Mol. function=nucleic acid binding; Biological process= DNA integration
MVNSSITNIVGIGDVCIQTNNGGTLRLKGMQHVPDLRLNMIFVHALDLDGYPNSFGDGKWKLTKGSLMVAKGIVYSTLYKTQVKLIRDGLNAVEDHALPDLVSCKKTSKLKENVLDMVYFDVCGPMKVETLGGSKYFVTFIDDASQKIWVSPSIPLVFDIPESVWSGRDINYYHLKVFRCKAFAHVSKEQRQKLDDKAIPCIYLGYEDEEFDYSVQGGKVDLTLVTRVRRIATEWGKLDDEHRVIDEPAIEDGDDKGVEEPKTFAEVKTHKDKVQWRKVMQEKIDSLHKNDTDELVKLHEGRKALKNKWVFELKKDGDKLVKYKASLVVKGFGQKRGINFDEIFSPVVKMSSIRVILTLVASLDLELEQMDVKAAFLHGDFDEEIYMDK

SEQ ID NO: 168080 - protein, 107 aa, Glycine max
  Coding DNA Sequence Number=SeqID_51302
MVQVGDRLRRVCKYRRWPEWLAAQRAPQVERGGQMASGQGKYRGDVLGYKCEVKSHIGSPYVMTRGPQVYPSNLPNKSNTTSPSITRVVVTFFTIVITLKVSSRLRL

SEQ ID NO: 168081 - protein, 225 aa, Glycine max
  Coding DNA Sequence Number=SeqID_51303
  Gene Ontology: Mol. function=aspartic-type endopeptidase activity; Cellular component=intracellular; Biological process=transposition, DNA-mediated
MKNVKPVSTPLANHFKLSKMSCPTIIVEKEVMVAILYSSAIGSLMHAMVCTRLDIAYVVEVVSRFLSNLGNGHWEAMKWILRYLKGTCNKCLCFGGAEPTLEGYTNVDMASDMDGGAISRQSKLQKCVALLTTKAGKKDALVEEISSIVGNEARKLCYHCDRQSALDLSKNVMYHSCIKHIDVRYRWLWQEVEEQHFKLKKIHTDKNLANMMIKVVEHEKLQLYA

SEQ ID NO: 168082 - protein, 100 aa, Glycine max
  Coding DNA Sequence Number=SeqID_51304
MKGKKRCIRRNEASLLNLGSNNLVSALGLDNIRERVTSLLKLHCNYQDLQDLMPPEQYQYLSTSQSMKTSMEFASSSWQGCWGRDGNDKVVVDVEVGDGG

SEQ ID NO: 168083 - protein, 181 aa, Glycine max
  Coding DNA Sequence Number=SeqID_51305
  Homolog annotation: Hit_ID=Q1RZK3; Match level="QueryCoverage=23%, HitCoverage=3%, E-value=2e-11, Identity=72%"; Hit description=WD40 -like
MFPTDFQTHPKPFSRHCIYLNALFFYNFHIPITQNTPYSVLRPPLGDEAAVGGASGDGGLEGVVAELAEENGVGKVGHAGGGITGIVAAAAAGDGSFGVTAVRKIGVVVATAVVNSGDGGGGGGIVEVAVDGGNDKNGDGDDDDDGYGVGIDDGRDGDDDEGGRIEQWRQALSLPEGKTET

SEQ ID NO: 168084 - protein, 122 aa, Glycine max
  Coding DNA Sequence Number=SeqID_51306
  Homolog annotation: Hit_ID=Q2R5G9; Match level="QueryCoverage=67%, HitCoverage=29%, E-value=9e-07, Identity=35%"; Hit description =Uncharacterized plant-specific domain TIGR01615 family protein, expressed
  Pfam annotation: Domain name=DUF506; Domain location=1-83; Score= -73.3; E_value=0.00086; Accession=PF04720.3; Description=Protein of unknown function (DUF506)
MEYFESSWTSTSERSSRLRAMRRFSKALAAIPGVFVGGTEEMKHTVSTTHDAARRCFRSRGLPVLPWRKNRFMQNKWLGPCHRTARDISIGFSGGVSCRVVEFDDVVSEAGCGGGNDIVVRR

SEQ ID NO: 168085 - protein, 43 aa, Glycine max
  Coding DNA Sequence Number=SeqID_51307
MDLDPLKCDEWNASACIRKWLVYINWRLLACHIGSMVEIGCDT

SEQ ID NO: 168086 - protein, 1135 aa, Glycine max
  Coding DNA Sequence Number=SeqID_51308
  Gene Ontology: Mol. function=binding; Cellular component=cytoplasm; Biological process=embryonic development ending in seed dormancy
  Homolog annotation: Hit_ID=Q1RZK3; Match level="QueryCoverage=99%, HitCoverage=88%, E-value=0.0, Identity=78%"; Hit description=WD40 -like
  Pfam annotation: Domain name=HEAT; Domain location=443-479; Score =20.1; E_value=0.0079; Accession=PF02985.12; Description=HEAT repeat
  Pfam annotation: Domain name=HEAT; Domain location=498-534; Score =9.8; E_value=2.7; Accession=PF02985.12; Description=HEAT repeat
  Pfam annotation: Domain name=WD40; Domain location=1090-1128; Score =7.7; E_value=4.6; Accession=PF00400.22; Description=WD domain, G -beta repeat
  Pfam annotation: Domain name=WD40; Domain location=881-921; Score =13.2; E_value=0.92; Accession=PF00400.22; Description=WD domain, G -beta repeat
  Pfam annotation: Domain name=WD40; Domain location=932-974; Score =8.9; E_value=3.3; Accession=PF00400.22; Description=WD domain, G -beta repeat
  Pfam annotation: Domain name=WD40; Domain location=979-1018; Score =8.8; E_value=3.4; Accession=PF00400.22; Description=WD domain, G -beta repeat
  Pfam module annotation: Pfam domain module=HEAT::HEAT::WD40::WD40::WD4 0::WD40; Domain location=443-479::498-534::1090-1128::881-921::932 -974::979-1018
MAPQKALESIGKTLSSQYERWQPKARYKCQLDPTVDEVKKLCTTCRKYAKSERVLFHYNGHGVPKPTANGEIWVFNKTPSIYVIDCSAAGMIVNFFIELHEWSPSNSSVSQRDCILLAACEAHETLPQSAEFPADVFTSCLTTPIKMALRWFCTRSLLRESLVNSLIDKIPGRPNDRKTLLGELNWIFTAVTDTIAWNVLPHDLFQRLFRQDLLVASLFRNFLLAERIMRSANCSPVSHPMLPPTHQHHMWDAWDMAAELCLSQLPSLVEDPNSEFQRSTFFTEQLTAFEVWLDHGSEHKKPPEQLPIVLQALSVGIFPYVLKLLQTTTPELRQILVFIWTKILALDKVDLVKDGGHIYFIKFLDSMEAYPEQRAMAAFVLAVIVDGHRRGQEACIEAGLIHVCLKHLQSSCPNDSQTEPLFLQWLCLCLGKLWEDFSEAQTIGLQEDATTIFAPLLSEPQPEVRASAVFALGTILDVGFDSCRSVGGDEECDDDDKFRAEVSIVKSMLGVASDGSPLVRAEVAVALARFAFGHNKHLKSIAAAYWKPQANSLINSLPSLANIKGSVGGYAKQNQHMPYGSIVSPQIGPIRVGNDNSPVIRDGRVSSSSPLAGSGIMHGSPLSDDSSHHSDSGILNDGFSNGVVNHTGPKPLDNALYSQCVLAMCTLAKDPSPRIANLGRRVLSIIGIEQVVAKPLKFSGVRTAESTASPLARSSSWFDMNGGHLPLTFRTPPVSPPRPSYITRMRRVCSLEFRPHLMDSPDSGLADPLLGSGGASGTSDRSFLPQSTIYSWSCGHFSKPLLTAADDSEEASARREEREKFALEHIGKCQHSAVSRLINPIAKWDIKGTQTALLQPFSPIVIAADENERIRIWNHEEATLLNSFDNHDFPDKGISKLCLVNELDDSLLLAASSDGNIRIWKDYTLKGKQKLVTAFSSIHGHKPGVRSLNAVVDWQQQCGYLYASGEISSIMLWDVDKEQLVNSKSSSSDCSVSVLAASQVHGGQFAAGFVDGSVRLYDVRTPDMPHTQRVEKVVGIGFQPGLDQGKIVSASQAGDIQFLDIRNHSSAYLTIEAHRGSLTALAGDQLGTIKYYPTLMAQKIGSVSCLNFHPYQVLLAAGAADACVCIYADDNTQAR

SEQ ID NO: 168087 - protein, 450 aa, Glycine max
  Coding DNA Sequence Number=SeqID_51309
  Gene Ontology: Mol. function=transferase activity; Biological process= UDP-N-acetylgalactosamine biosynthetic process
  Homolog annotation: Hit_ID=Q1H4S0; Match level="QueryCoverage=63%, HitCoverage=67%, E-value=1e-105, Identity=68%"; Hit description=UDP -N-acetylglucosamine 1-carboxyvinyltransferase
  Pfam annotation: Domain name=EPSP_synthase; Domain location=1-278; Score=174.1; E_value=3.5e-49; Accession=PF00275.10; Description=EPSP synthase (3-phosphoshikimate 1-carboxyvinyltransferase)
  Pfam annotation: Domain name=HisG; Domain location=307-450; Score =142.4; E_value=1.2e-39; Accession=PF01634.9; Description=ATP phosphoribosyltransferase
  Pfam module annotation: Pfam domain module=EPSP_synthase::HisG; Domain location=1-278::307-450
MGAAMHITHGYIQASTLHLPNRRLQGAKYYMDLVTVTGTENLMMAAALAQGITVLENAAKEPEVVDLAECLNKMGAKITGAGTDTITIEGVERLTGAEHHIVCDRIEAGTYMVAAAMTGGEVTLKNARADLLEAVIEKLREAGASISHDSHSITVKSDGKLKAVNVRTAPHPAFPTDMQAQFMAMNTVAEGVSTVIETIFENRFMHVQELQRMGANIDVQGNTALVQGVPALEGASVMATDLRASAGLVLAGLVADGETVIDRIYHLDRGYEKLEEKLNQLGAKEDPESSRKLILPTNRDDVRLVIVRATDVPTYVQYGAADIGIAGKDVLDEHGGEGLYQPLDLNIARCKMMVAVRDDFDYEASIRQGARLKVVTKYVKTAREHFAAKGMHVDLIKLYGSMELGPLVGLADAIVDLVSTGGTLRANKLKAVEDIGAISSRLVVNQASYK

SEQ ID NO: 168088 - protein, 1025 aa, Glycine max
  Coding DNA Sequence Number=SeqID_51310
  Gene Ontology: Mol. function=zinc ion binding; Cellular component =membrane; Biological process=defense response
  Homolog annotation: Hit_ID=Q9LTC2; Match level="QueryCoverage=99%, HitCoverage=97%, E-value=0.0, Identity=50%"; Hit description =Chromosome condensation regulator-like protein protein
  Pfam annotation: Domain name=DZC; Domain location=959-994; Score =62.1; E_value=1.9e-15; Accession=PF08381.1; Description=Disease resistancezinc fingerchromo
  Pfam annotation: Domain name=FYVE; Domain location=552-620; Score =41.9; E_value=2.2e-09; Accession=PF01363.12; Description=FYVE zinc finger
  Pfam annotation: Domain name=RCC1; Domain location=226-275; Score =16.3; E_value=0.012; Accession=PF00415.9; Description=Regulator of chromosome condensation (RCC1)
  Pfam annotation: Domain name=RCC1; Domain location=280-331; Score =16.4; E_value=0.012; Accession=PF00415.9; Description=Regulator of chromosome condensation (RCC1)
  Pfam annotation: Domain name=RCC1; Domain location=334-383; Score =31.8; E_value=2.5e-06; Accession=PF00415.9; Description=Regulator of chromosome condensation (RCC1)
  Pfam annotation: Domain name=RCC1; Domain location=396-445; Score =16.6; E_value=0.011; Accession=PF00415.9; Description=Regulator of chromosome condensation (RCC1)
  Pfam annotation: Domain name=RCC1; Domain location=448-497; Score =24.8; E_value=0.0003; Accession=PF00415.9; Description=Regulator of chromosome condensation (RCC1)
  Pfam annotation: Domain name=RCC1; Domain location=502-549; Score =27.9; E_value=3.6e-05; Accession=PF00415.9; Description=Regulator of chromosome condensation (RCC1)
  Pfam module annotation: Pfam domain module=DZC::FYVE::RCC1::RCC1::RCC1 ::RCC1::RCC1::RCC1; Domain location=959-994::552-620::226-275::280 -331::334-383::396-445::448-497::502-549
MADPASYGSLERDIEQDETTLIWISHKKERNLKLSSVSRIIPGQRTICKDQDEAEVWFTGLKTLISTGKLRRIGSELFNDGADFIPNGGPFGAALEFAISISHNKKVSFDFASREPSLNLATTDVGLERRANNMQPRTSIGDGFRVSVSSTPSVLSTGSGPDDIESLGDVYIWGEVWASGVSPDGFSTQAPSTTDVLIPKPLESSVVLDVQQIASGVRHIALVTRQGEVFTWGEECGGRLGHGIDRDFGRPQLVEFLAVTSMDFVACGENHTCAVSTYDDIFSWGDGTYNVGLLGHGTDVSHWIPKRISTGPLEGLQVISIACGTWHSALATSNGKLFTFGDGTFGVLGHGNRESIPYPKEVKFLNGSKTIKVACGVWHTAAIVEVTFQSNSNVSSRKLFTWGDGDKYRLGHGNKGTYLQPTCVSALIKYNFHQIACGHTMTVALTTSGHVFTMGSNENGQLGNRLADEKVPILVQDKLVGEFVEEIACGSHHVAALTSRSELYTWGKGANGRLGHGDIEDRKSPTLVESLRDRHVKNISCGSNFTSCICIHKWVSGVDQSVCTGCRQPFGFTRKRHNCYNCGLVHCHGCSSKKVLKASLAPTPGKPHRVCDSCYNKLKAVEACASSNLHRKMTTTPRYSIDGRERFGQGEVKSSRLILPPITEPMKFHQIMANKMGNKHDYSSMSPTSQVPSLLQLNDIAFGNSISSTQNVLKSAIAPSPTPTPPVNQRPASPYSRRASPPRSRASGFSRSLVDSLRKTNELLNQEVSKMQNQIRSSKLRNDMEIQKLQKTITEATSFAVEESSKHKAMKEFFESTVDQMKEMIEKLPPDVLDSENWKIMLTRAEDFLKEKSEFETPSNVKSQQQHELNTPNSYSSSSKLQEHGIEENNETVGVDPSSQDEGNVQVSNSSSLSNNEASMPSQNDSKSQHSSRPGKEGEMQVMEQFEPGVHVTLIVKPGGVRIFKRVKFSKRRFHEHQAEEWWSKNKDRVLRKYSTPQATNFEGIRSSNTLPPPPTEENIEAMSS

SEQ ID NO: 168089 - protein, 256 aa, Glycine max
  Coding DNA Sequence Number=SeqID_51311
MERCHEEELEKLKVDHDQLEAHRTQGESHPRSIINTQEGPSLSHIHRPARQTTRQHLFVDRIMEVDIPLGWKLVNLERSFDTLVERFQCVICNQPVTPYDIAAVANLRQADDESLRKFMDRFGRIVVQICNLNPEATSRWRRCPSSGIRSNKPNKSATSKIDSHKLNKRHKPDKHQPFPKGFKYEHYTPLIVNHTTILRRVSTSRVDNEGEKGFQVTVDLDNPFANEILIVEVDKDAGAMEHTLLIVLLVHNNNYP

SEQ ID NO: 168090 - protein, 80 aa, Glycine max
  Coding DNA Sequence Number=SeqID_51312
MFYHNLTVGTKCTYQNLELSHAKVDVAKVSSLTSHVGLGVAFVKRTKRGTCKTKDFDAQLKVRLLKAHRPCSYTRAGMEG

SEQ ID NO: 168091 - protein, 275 aa, Glycine max
  Coding DNA Sequence Number=SeqID_51313
  Homolog annotation: Hit_ID=Q9C6W3; Match level="QueryCoverage=36%, HitCoverage=10%, E-value=8e-32, Identity=67%"; Hit description =Epsilon-adaptin, putative
  Pfam annotation: Domain name=HEAT; Domain location=60-96; Score=21.0; E_value=0.0044; Accession=PF02985.12; Description=HEAT repeat
MTHHDSLLLKRTDYLALTLFLSGDNHIIILIINTIQKDLTSDNYLVICAALNTVCSLINEETIPAMLPRVIELLNHSKDVVRKKAVMVLHRFYLKSPSSIVPMKLKHEESSSSSCSSPIKFQMLRHQCNTNIFGLSFSFIFSLWCLLFFYIKLRLVHGIGGQLLYTCVDSITPSEVVDAGVAAAALALLSSFFNLIPHALHSEGRGSEGRIVINVIGIIIGWWFVVGHGEEHGEGAGGLAVFSATCAETCHMGLDKDLPHRHMTNSGNWILTVGT

SEQ ID NO: 168092 - protein, 117 aa, Glycine max
  Coding DNA Sequence Number=SeqID_51314
MLTDQVIRKTHNNFQIAFYAIADNIGGKKEKVHGVYLDCGRSRSSLDGGRRRCSLRKPPKMHHDTFLLIMATMAAMAAISSTKKKKKSSEKKKKQKREEEEKNEEEAERSEEQEAES

SEQ ID NO: 168093 - protein, 406 aa, Glycine max
  Coding DNA Sequence Number=SeqID_51315
  Gene Ontology: Mol. function=D-alanine-D-alanine ligase activity; Cellular component=cell wall; Biological process=peptidoglycan biosynthetic process
  Homolog annotation: Hit_ID=Q3LHI3; Match level="QueryCoverage=84%, HitCoverage=37%, E-value=1e-84, Identity=47%"; Hit description=D -alanine-D-alanine ligase precursor
  Pfam annotation: Domain name=Dala_Dala_lig_C; Domain location=187 -333; Score=-109.8; E_value=0.017; Accession=PF07478.3; Description=D- ala D-ala ligase C-terminus
  Pfam annotation: Domain name=Dala_Dala_lig_N; Domain location=17-99; Score=0.2; E_value=2.3e-07; Accession=PF01820.11; Description=D-ala D-ala ligase N-terminus
  Pfam module annotation: Pfam domain module=Dala_Dala_lig_C::Dala_Dala_ lig_N; Domain location=187-333::17-99
MEAIEPERAAITSDLRKKVMNDLMEGLKDHNWFTGFDIADDLPAKFSLRQWIKLAKEVQATIFIAVHGGIGEDGTLQSLLDAEGVPYTGPGAMASKICMDKVATSVAIKHEATVPNIMCQTSKRWMLNWGRKTMKIRGIMFYNLLILFSFSCSEDLAIYVRALEDCLLRIPPNSLSKAHGMIEMPNPPPEYLIFEPFIETDEIIVTSKFEDATGHGLTWKGHSRWVEITVGVIGKRGSMHSLSPSVTVKESGDILSLEEKFQGGTGINLTPPPLSIMSENALKRCKQHIELIANTLQLEGFSRIDAFVNVDSGEVNTVPGMTPSTVLIHQALVEQPPLYPHQFFRKLLDLASESLYLLKLTLKKDSKCVFNKAGEPLKGSEVVWQEAHVRGSSTIDEIRLNSHFSP

SEQ ID NO: 168094 - protein, 199 aa, Glycine max
  Coding DNA Sequence Number=SeqID_51316
MENVFMQFMETSHASFKANQNSTQNLEIEVGKNYSMENCWREQELQPCNQYEDERIYNLDNLLMQLMKTSEATQHAIQNIEIQVEVESHKESLVEEYDSREKDKEKSEQRTQQQREKCSQVEIQQESILQVNTPPHQLIGKEERHGERDKSFSVILSLNTNTSLAIVWKAFSGYMSFMESLAKKRKCKEDVFYVTFMPP

SEQ ID NO: 168095 - protein, 238 aa, Glycine max
  Coding DNA Sequence Number=SeqID_51317
  Gene Ontology: Mol. function=D-alanine-D-alanine ligase activity; Cellular component=cell wall; Biological process=peptidoglycan biosynthetic process
  Homolog annotation: Hit_ID=Q3LHI3; Match level="QueryCoverage=64%, HitCoverage=18%, E-value=5e-31, Identity=41%"; Hit description=D -alanine-D-alanine ligase precursor
  Pfam annotation: Domain name=Dala_Dala_lig_N; Domain location=16-133; Score=-18.6; E_value=2.2e-05; Accession=PF01820.11; Description=D-ala D-ala ligase N-terminus
  Subcellular localization annotation: CTP_CleavageSite=55; ConfidenceScore=5.32e-01
MATSSLAGNCTLLRHSETQSCSLLSSPGGSSVKLFWSKKHEASTCHAARVAAVPRASAREVAVVGGGVVEKGREKGRVLKTLSDLAKHLATAVDIVFPVIHGQFGEDGGIQELLEKYNVPFVGTGSKECCQAFDKGYETKKSELSEWFEKHQLDPDLGKVVVKPTRGGSSIGVRVAYGVNDSLVKANEIMSEGIDNKVLIEIYLEGGSEFTAIVLDVGSASDSFPVVLLPTEETEYLY

SEQ ID NO: 168096 - protein, 740 aa, Glycine max
  Coding DNA Sequence Number=SeqID_51318
  Gene Ontology: Mol. function=RNA-directed DNA polymerase activity; Cellular component=chromatin; Biological process=chromatin assembly or disassembly
  Pfam annotation: Domain name=RVP; Domain location=323-429; Score= -13.9; E_value=0.091; Accession=PF00077.10; Description=Retroviral aspartyl protease
  Pfam annotation: Domain name=RVP_2; Domain location=335-443; Score= -31.7; E_value=0.0003; Accession=PF08284.2; Description=Retroviral aspartyl protease
  Pfam module annotation: Pfam domain module=RVP::RVP_2::Retrotrans _gag; Domain location=323-429::335-443::104-194
MADHGTRKTTTDRLEDAITRLTNSQASINERYADLSSKVDSILDHLRLRDSGQPTTATANNHNHQRNIVKLDIPRFDGRDPLRWIFKITQLFQYQNTPEEERITVASLYLDGVALSWYQWMYSNGLITSWDSFLQALESRFAPTFYDDPKGALFKLMQRGSVNEYLTEFERLVNRVIGLPPPFLLSCFISGLNPDIRREVLALQPISLLQATTLAKLQEEKLHDRFRHLALILSHRHSRVKSPKPRTSQNRPTCVGLCYNCDEKWNANHRCKGRIMLLIADEQSSPIPVDLGPEEEPITVVPDPPEPPPDTDCSHISLHALSGLPSSETFRIFGMIKHARLTFLIDSGSTHNFLQPRIAHFLRLSVQATHPLHVLVGNGSMLECGQTCPDIPVTIQGHSFTVTFHLLQISGTDAVLGIDWLKKLGPVTTDYTTFIMQFNHLGQDISLKANVTLGPELTSAAQLKRLIHTGSASAFFHLRVVPDNPPEPPTAQHSIPSITNLLQRYSHLFQTPSQLPPPRSVVHRIPLQPSSAPINVRPYRYPHFQKNEIEKQISDLLSAGLIHPSTSPYSSPVLLVKKKDGTWRLCVDYRALNAITIRDRFPIPTIEELLDELGHAHWFSKLDLRQGHTCAVSPPYSLMIYWCIVTHCKHTSSTWRPSSMHYYKESIDYLGHIVSGKGVAPEPSKVQAITNWPPPSSAKALRSFLGLTDFYRKFVKGYASIAAPLTSLLCKDTFSWTPEA

SEQ ID NO: 168097 - protein, 144 aa, Glycine max
  Coding DNA Sequence Number=SeqID_51319
  Homolog annotation: Hit_ID=Q1S2Y9; Match level="QueryCoverage=99%, HitCoverage=96%, E-value=1e-66, Identity=82%"; Hit description=Wound- induced protein WI12, putative
  Pfam annotation: Domain name=WI12; Domain location=45-144; Score =133.8; E_value=4.8e-37; Accession=PF07107.2; Description=Wound -induced protein WI12
MQNKATVEMLYMALLGQETMDNVAKLLASDLEWWFHGPPQCHHMMKVLTGETDHTKGFRFEPKQVTAIGDCVIAEGWEGKAYWVHVWTLKNGLITQFREYFNTWLVVRDLRTPRREDSKDSMTLWESQPRDLYHRSLPGLVLTI

SEQ ID NO: 168098 - protein, 49 aa, Glycine max
  Coding DNA Sequence Number=SeqID_51320
MELEDLVLENLVAQCKLSTSTSSHLGTLEGSRRVKMQSAREYRELDIKY

SEQ ID NO: 168099 - protein, 105 aa, Glycine max
  Coding DNA Sequence Number=SeqID_51321
GSSGRIPEDSHFRKKFQTSGRPFWKNPSSGVFPEEPLLPEVIMARTRGLGRAIGRFVGRDRVADEDAGDVPERRRPTASARRLRVHQMTTEGRDMAEDVADMTDD

SEQ ID NO: 168100 - protein, 271 aa, Glycine max
  Coding DNA Sequence Number=SeqID_51322
  Gene Ontology: Mol. function=aminoacyl-tRNA ligase activity; Cellular component=membrane fraction; Biological process=tRNA aminoacylation for protein translation
  Homolog annotation: Hit_ID=Q6AGC2; Match level="QueryCoverage=99%, HitCoverage=61%, E-value=7e-97, Identity=67%"; Hit description =Tyrosyl-tRNA synthetase
  Pfam annotation: Domain name=S4; Domain location=206-256; Score=24.2; E_value=0.00048; Accession=PF01479.15; Description=S4 domain
  Pfam annotation: Domain name=tRNA-synt_1b; Domain location=1-178; Score=16.0; E_value=4.6e-10; Accession=PF00579.15; Description=tRNA synthetases class I (W and Y)
  Pfam module annotation: Pfam domain module=S4::tRNA-synt_1b; Domain location=206-256::1-178
MLKKDAVAARLNSDEGISYTEFSYQILQGMDFLELYRQYDCVLQTGGSDQWGNLTSGTDLIRRAEGVAVHAIGTPLITNSDGTKFGKSEGNAIWLDAEMCSPYRMYQFWLGTADSDVIERLKVFTFLTRAEIEEYAQLVADEPFRRAAQKRLALEVVATVHGLEATAAVIAASEALFGQGDLTALDADTLRTALEELPNASVTAGTPVIDALVSTGLVSSLSEARRAIAQGGVSLDGSRVEDEAATVQGTLPGGVSVLRRGKKTLAGLFVD

SEQ ID NO: 168101 - protein, 39 aa, Glycine max
  Coding DNA Sequence Number=SeqID_51323
MMPYTVFGQKGFGIELIKDICGLGKEELAANSGFGMLVA

SEQ ID NO: 168102 - protein, 217 aa, Glycine max
  Coding DNA Sequence Number=SeqID_51324
  Homolog annotation: Hit_ID=Q1STK9; Match level="QueryCoverage=27%, HitCoverage=73%, E-value=1e-07, Identity=33%"; Hit description =Gonadotropin, beta chain; Peptidase aspartic, active site
MKWRLLSLSSFFIPLPFIFQEAKESIDEEDPRPTSSNEAYIMWYQSMKDKRWHPLRVFYPIPLWQDLKGAILLIQDQFQDSPLSVLRCHEASHGPEIYPKTHENPRVFSCISGTIYLESSIQCPCRESLGMEKSAEIRPKELSHSIPKTRSTLSMGKRWCAILGCKILCELPESTRIVIGRLLTRPIHFKVFGEGEPVKAWGKYGNGQGQHHFGDPL

SEQ ID NO: 168103 - protein, 346 aa, Glycine max
  Coding DNA Sequence Number=SeqID_51325
MQRLDRARVLVRTPWTPTVEHIVIAHIDGDAHKISIVEENCNAGIVCARHHQSVWGSSEEILSDSDDTGTLQSWPIDNSPPSTTFVMHGDNTFWQSLVKSNGQTGTCSPLGITRSRKKRGLCKAISHSGAEKGKEINLEECNPTLLVVEYEELESQLAGAEGQFTQKGEDIPQRFLANTGENQKGEPDALDQGLVGENFQKHSNGPLEEFLNKSRDITVDLFGPNPNMGLHRPTTPTNQQINQQKKTCKCFAEKPSNHKHNAASCGSDEVLESPKQHNFHQSPSPSSILNINDMEVKDDAYRNLAKELGVSFADDKSNGAKLMTDMDNTENPPKSAAVLGNEDNAS

SEQ ID NO: 168104 - protein, 207 aa, Glycine max
  Coding DNA Sequence Number=SeqID_51326
MALPIQEKIGVAPIEDKMTKLAKVALGAPDRVPPPLLAASSAAAASSAASTASSAATGGGGGTPAAASLVVGAVGHDGGGDSKGGRGSEAFIGGTAGSGSTYTSASCNVWGCQSLACEGEIEFDGYNSNDGKFEEVDIEDDFLEDDGVAFEDDGFDDEEGCDNEVSDEEGYDETVLEDDDIARLNFVDLDVAYEFYKWYARTNEFSI

SEQ ID NO: 168105 - protein, 188 aa, Glycine max
  Coding DNA Sequence Number=SeqID_51327
  Subcellular localization annotation: CTP_CleavageSite=56; ConfidenceScore=5.27e-01
MPRCLFRPTFYTAHHRLTLTFLHPPASKLFPTDLRISSPVMAYRPNYQGGGRRGASSSAGRGGGRRGGGGGRGGGGGRGEQRWWDPVWRAERLRQQQAEKEVLDENEWWDKIEKMKRGGEQEMVIKRNFSIADQKTLADMAYQHELYLEKTGRLCSEESRPDGEKANNSRQRKTQKDYKRGYQEGSRT

SEQ ID NO: 168106 - protein, 278 aa, Glycine max
  Coding DNA Sequence Number=SeqID_51328
  Homolog annotation: Hit_ID=Q1RVN3; Match level="QueryCoverage=64%, HitCoverage=24%, E-value=5e-07, Identity=24%"; Hit description =Nucleotide-binding, alpha-beta plait
  Pfam annotation: Domain name=RRM_1; Domain location=85-155; Score =31.8; E_value=2.3e-06; Accession=PF00076.12; Description=RNA recognition motif. (a.k.a. RRM, R
MRERERENERQRERVKECERNTERDTIRDREWITVRNRKRERQRGWQHPTEGLRQHYGGQRQRRTGQQRNHYQVNWHDRPDVMTFYFTRFPEDTSEKELWYHFKQMGDVREIFIPKHRNKEGRRYGFVRYKGVSNASYMERKLDNMIVGGFKLHLNIPKYGRGKEEKELTAAKQRGHKEGDNPRCNVAVEQNTKRSYAEVVISHAENKERRSGTSSLTTTHGRTHSSITLEISEETKKRYADTWVGRLKRQQVFERVEDELSWTLGSEVSPKYLGDDL

SEQ ID NO: 168107 - protein, 877 aa, Glycine max
  Coding DNA Sequence Number=SeqID_51329
  Gene Ontology: Mol. function=ATP-dependent helicase activity; Cellular component=intracellular; Biological process=protein modification process
  Homolog annotation: Hit_ID=Q9FW67; Match level="QueryCoverage=99%, HitCoverage=93%, E-value=0.0, Identity=68%"; Hit description =Putative ATP-dependent RNA helicase
  Pfam annotation: Domain name=DEAD; Domain location=87-261; Score= -4.4; E_value=1.3e-05; Accession=PF00270.19; Description=DEADDEAH box helicase
  Pfam annotation: Domain name=DUF1605; Domain location=697-810; Score =102.3; E_value=1.5e-27; Accession=PF07717.6; Description=Domain of unknown function (DUF1605)
  Pfam annotation: Domain name=HA2; Domain location=569-660; Score =115.1; E_value=2e-31; Accession=PF04408.13; Description=Helicase associated domain (HA2)
  Pfam annotation: Domain name=Helicase_C; Domain location=405-507; Score=61.0; E_value=3.9e-15; Accession=PF00271.21; Description =Helicase conserved C-terminal domain
  Pfam module annotation: Pfam domain module=DEAD::DUF1605::HA2::Helicas e_C; Domain location=87-261::697-810::569-660::405-507
  Subcellular localization annotation: CTP_CleavageSite=38; ConfidenceScore=5.24e-01
MSTDIERRVGNLLNSSQSTGAAPSSLPSVSADLGHKQSAATIKSVSSRQADSSKEKLSVALKEGQELVQASDSLKEMKSFREKLPAFKMKSEFLKAVQENQVLVVSGETGCGKTTQLPQFILEEEISCLRGADCNIICTQPRRVSAISVAARISAERGESLGEAVGYQIRLESKRSAETRLLFCTTGVLLRQLIVTGACIEHKIHTVQDPDLIGVSHLLVDEIHERGMNEDFLIIILRDLLPRRPDLRLILMSATINADMFSKYFANAPTMHIPGFTYPVAEHFLEDVLEKTRYSIKSDFDNFEGNSRRRKQQDSKKDPLTEMFEACIFDPSIHDIDVDTNYKNYSLGVRKSLEAWSGSQIDLGLVEATIEYICRNEAGGAILVFLTGWDEISKLLDKLKGNNLVGDSSKFLILPLHGSMPTVNQCEIFDRPPPNKRQMISKDEGKIVLATNIAESSITIDDVVYVIDCGKAKETSYDALNKLACLLPSWISKASAHQRRGRAGRVQPGVCYRLYPKLIHDAMPQYQLAEILRTPLQELCLHIKSLQLGTVGSFLEKALQPPDPLAVKNAIELLKTIGALDEQEELTPLGRHLCNIPLDPNIGKMLLMGSIFQCLNPALTIAAALAYRNPFVLPINRKEEADAAKQSFAGDSCSDHLALLKAFEGWKEAKRSGNEKQFGWDNFLSLATLRLIDDMRMQFLNLLSDIGFVDKSRGATAYNQYSHDLEMVCAILCAGLYPNVVQCKRRGKRTAFYTKEVGKVDIHPASVNAGVHLFPLPYMVYSEKVKTTSIYIRDSTNISDYALLLFGGNLVPSKSGEGIDMLGGYLHFSASKSVIELIRKLRGELDKLLNRKIEEPGFDVSSEGKGVVAAAVELLHS

SEQ ID NO: 168108 - protein, 48 aa, Glycine max
  Coding DNA Sequence Number=SeqID_51330
MEKDEEFNKWFIGKWRIMRVLDGVFDARQGAFIGGRNLLDGVVVAGWE

SEQ ID NO: 168109 - protein, 306 aa, Glycine max
  Coding DNA Sequence Number=SeqID_51331
  Gene Ontology: Mol. function=protein transporter activity; Cellular component=membrane; Biological process=intracellular protein transport
  Homolog annotation: Hit_ID=Q9ZSD5; Match level="QueryCoverage=92%, HitCoverage=92%, E-value=6e-93, Identity=62%"; Hit description =Syntaxin-related protein Nt-syr1
  Pfam annotation: Domain name=SNARE; Domain location=216-278; Score =91.0; E_value=3.5e-24; Accession=PF05739.9; Description=SNARE domain
  Pfam annotation: Domain name=Syntaxin; Domain location=40-147; Score =88.8; E_value=1.7e-23; Accession=PF00804.15; Description=Syntaxin
  Pfam module annotation: Pfam domain module=SNARE::Syntaxin; Domain location=216-278::40-147
MNDLFSGSFSRNNDQVLPDHHHHVIEMAAASSPTAEGSANLEKFFQEVEQVKEDLKELERLHENLRGNHEKSKTLHSAKAVKELRSRMDADVALALKKAKLVKVRLETLDRSNQVSRNLPGLEPGSSSDRTRTSVVSGLRKKLKDSMDSFNSLRQQISSEYRETVQRRYYTVTGENPDDKTIDLLISTGESETFLQKAIEQQGRASVMDTIQEIQERHDTVKEIERNLNELHQVFLDMAVLVQSQGEQLDDIESHVARANSYVRGGVQQLHVARKHQKNTRKWTCIAIILLIIIILIIVLPIVLRK

SEQ ID NO: 168110 - protein, 67 aa, Glycine max
  Coding DNA Sequence Number=SeqID_51332
MLQKGAMAAITLLIVTIAIEYCSCVRRPTTLEAYFVIVDYFASLTSFRIDLSLKIGLVQLKEIGCEV

SEQ ID NO: 168111 - protein, 64 aa, Glycine max
  Coding DNA Sequence Number=SeqID_51333
MMKREKEKNEKLTKQNCEVLRSDDYSVVAEAEQQLKDTNVVSVYDVLFCYSHKTISSSFLFQQK

SEQ ID NO: 168112 - protein, 92 aa, Glycine max
  Coding DNA Sequence Number=SeqID_51334
MEKRKDDTTKCASLEATRILRAWLVDGEPQERARIHGGRERRHDTEEEDVVQVAARRRRDGSWLRRRGWVMIGSCWCEVRDGGDWQIWARGY

SEQ ID NO: 168113 - protein, 318 aa, Glycine max
  Coding DNA Sequence Number=SeqID_51335
  Gene Ontology: Mol. function=nucleic acid binding; Cellular component= ribonucleoprotein complex; Biological process=mRNA processing
  Homolog annotation: Hit_ID=P19684; Match level="QueryCoverage=64%, HitCoverage=64%, E-value=1e-65, Identity=60%"; Hit description=33 kDa ribonucleoprotein, chloroplast precursor
  Pfam annotation: Domain name=RRM_1; Domain location=189-260; Score =91.8; E_value=2.1e-24; Accession=PF00076.12; Description=RNA recognition motif. (a.k.a. RRM, R
  Pfam annotation: Domain name=RRM_1; Domain location=90-161; Score =88.6; E_value=1.9e-23; Accession=PF00076.12; Description=RNA recognition motif. (a.k.a. RRM, R
  Pfam module annotation: Pfam domain module=RRM_1::RRM_1; Domain location=189-260::90-161
  Subcellular localization annotation: CTP_CleavageSite=19; ConfidenceScore=5.58e-01
MWFSMAASTSTATSSLICNISLTFNFPHTLIPSKPLNLNPQLFFASPLSLSLYHFPLSSLSFQDTQKPLQRETFQKPEPNASHTNQSSRLFVGNLPYSLLSSQLAQRFGEAGNVVSVEIVYDDIMDRSRGFAFVTMGSMEDAERAIRMFDGSEIGGRIMKVNFTAIPKRGKRLVMGSNYRGFVDSPHKIYAGNLGWGLTSQDLRDAFAEQPGFLSAKVIYERNSGRSRGYGFVSFETAEDVEAALNSMNGVEVQGRPLRLNLATDKNTSSPLLVLSHIGICQLHLQAIYCNGIEGNIDQNHKSQNITQIVIRKVMNAV

SEQ ID NO: 168114 - protein, 241 aa, Glycine max
  Coding DNA Sequence Number=SeqID_51336
  Gene Ontology: Mol. function=transcription factor activity; Cellular component=nucleus; Biological process=regulation of transcription, DNA-dependent
  Homolog annotation: Hit_ID=Q9M9X4; Match level="QueryCoverage=91%, HitCoverage=75%, E-value=3e-35, Identity=45%"; Hit description =Nuclear transcription factor Y subunit A-2
  Pfam annotation: Domain name=CBFB_NFYA; Domain location=61-117; Score= 123.6; E_value=5.7e-34; Accession=PF02045.6; Description=CCAAT -binding transcription factor (CBF-BNF-YA) subunit B
MSGDAENPQATLSLQSSLAEPHNRFEIGFNQPMVIYSNQPLDIKSGIVGRIMLPINLTSDDGPTYVNAKQYHGIIRRRLSRAKAVLENKMIKRRKPYMHESRHLHALRRPRGCGGRFLNTKGSTNGNGRNESKVNKTGGRQLQSSASQSSEVLHSEVGTLNSSKETNRSSPNISGSEVTSMYSREGFDGFSVNRLGSSVHSLVDMVLSRPLNGLQQYQHHPILARDQACHDMVIHANGFIS

SEQ ID NO: 168115 - protein, 102 aa, Glycine max
  Coding DNA Sequence Number=SeqID_51337
  Gene Ontology: Mol. function=hydrolase activity, acting on ester bonds
  Homolog annotation: Hit_ID=O81020; Match level="QueryCoverage=59%, HitCoverage=12%, E-value=2e-07, Identity=63%"; Hit description =Putative phospholipase C
MREESGKKWRERKKRTNPLLALDVEVVEGDIFAHGWPGRSGQDRRRCRAVDVSEGDCGGGGGGDEEGIGFVVDVGPGGFEPAQDVVEGAVLHELAAQAQVGR

SEQ ID NO: 168116 - protein, 123 aa, Glycine max
  Coding DNA Sequence Number=SeqID_51338
MHACTTQTANGTGEFVVSEGIASYNGDIAMHREPPVKLASSKLQKLQSYIMNSVITVLYFNARVYEGNDGVIFEGSKKAIQIKRGISFNALKKKIGDKVQPPRNVSNLHGDEDDDDYLVSNSY

SEQ ID NO: 168117 - protein, 88 aa, Glycine max
  Coding DNA Sequence Number=SeqID_51339
MAMQTVYLKEHEGLVYNSVGQLSSVTSAPWWSALGSQPVYGEYCGQIKPFSFEISNYVDQFPAGKQAVRGVEQLLDKGHTTTQFTIFP

SEQ ID NO: 168118 - protein, 63 aa, Glycine max
  Coding DNA Sequence Number=SeqID_51340
MATLGLEILVESASSVILKMILSFDLAFALIPLLKFSSSKVTSSTSIEEGSGRFCTKVKFCLA

SEQ ID NO: 168119 - protein, 130 aa, Glycine max
  Coding DNA Sequence Number=SeqID_51341
MTCGDKLWPFHTSLPFNTVVSDGTQRQIMVILHPFCHPEAASPMTCRDKLWSFRTPLPFRHSRVRWHAETNYGHSAPLLSSRGGGPDDMRRQIMVIPYPFAIQTQSCPMARRDKLWSFCAPFAIQRRRAR

SEQ ID NO: 168120 - protein, 144 aa, Glycine max
  Coding DNA Sequence Number=SeqID_51342
MVSFARVLEKGDEGVSMEEEDLFMRSMKKVKEDQKEKGSGDDVSYADNEGCSPYVQSKGGNMEDVVFMYEVKDNSVLEEVPKESLNTMDQKLDEHVIPLSDVELIRALDDGKLMRILKLVKYRLKAQVEKDKAPEWRVSGKRQE

SEQ ID NO: 168121 - protein, 122 aa, Glycine max
  Coding DNA Sequence Number=SeqID_51343
  Gene Ontology: Mol. function=nucleic acid binding; Cellular component= intracellular; Biological process=chromatin modification
  Homolog annotation: Hit_ID=Q9LRW7; Match level="QueryCoverage=55%, HitCoverage=13%, E-value=5e-30, Identity=85%"; Hit description =Similarity to zinc finger protein
  Pfam annotation: Domain name=zf-C2H2; Domain location=60-82; Score =24.4; E_value=0.00041; Accession=PF00096.16; Description=Zinc finger, C2H2 type
MEFVESNPLFQNPKSMSYFVLLLQLGVGLAFGGLILKEKSLLPLVVRRWSPKTLLATNRFICEICNKGFQRHHNLQLHRIGHNLPWKLKQRSSNEIIRKKVYVCPEARCVYHDPSRASKLLD

SEQ ID NO: 168122 - protein, 102 aa, Glycine max
  Coding DNA Sequence Number=SeqID_51344
MEAMMSMRSMMEVNMATVVAASTATEVVPTHPPSFNQGGEALGGPGSPYFVQVQNKHSFPPSGFPPNYTPLNVVHAPDENVDNSAPIPIESQQPQSDHEHVS

SEQ ID NO: 168123 - protein, 135 aa, Glycine max
  Coding DNA Sequence Number=SeqID_51345
MAISTLHREPPVKMTSSKQERAQAGSAIGASGLQGRTRHQYWRVACSKKNLPIKQRKTAAPLCMHSFLLFGSLHCIPFFSYSCFQCTSFFSSYYGFVFLVKFLILLALHCLVAFLSACLRLDFCLVRMLKNALSF

SEQ ID NO: 168124 - protein, 67 aa, Glycine max
  Coding DNA Sequence Number=SeqID_51346
MTGNYRGAREGGEGENEVIDSKSVVCEAMDLSDDGEGNGSLRHVGAATRTDEDLDIIVLRIVGMCGC

SEQ ID NO: 168125 - protein, 231 aa, Glycine max
  Coding DNA Sequence Number=SeqID_51347
  Gene Ontology: Mol. function=protein dimerization activity; Cellular component=nucleus; Biological process=regulation of transcription
  Homolog annotation: Hit_ID=O22465; Match level="QueryCoverage=56%, HitCoverage=38%, E-value=5e-46, Identity=69%"; Hit description=GH1 protein
  Pfam annotation: Domain name=AUX_IAA; Domain location=7-208; Score =198.1; E_value=2e-56; Accession=PF02309.7; Description=AUXIAA family
  Subcellular localization annotation: CTP_CleavageSite=26; ConfidenceScore=5.20e-01
MENGMVVDLKKDVATLFCPTSRGVVPVSVAKSVTFTATDCTNQPTALGASVLRETIPHSPKPLHENKPQISVATAKAQVVGWPPIRSFRKNSMASQPQKNDVAANAEAKSGCLYVKVNMEGSPYLRKVDLNSFTTYKDLSLALEKMFSCFTLSQCGSYGVSSRENLSESRLMDLLHGSKYVLIYEDKDGDWMLVGDVLWESQGSAAYISWHMASWFGEFTLGRIKEGMAEC

SEQ ID NO: 168126 - protein, 412 aa, Glycine max
  Coding DNA Sequence Number=SeqID_51348
  Subcellular localization annotation: CTP_CleavageSite=70; ConfidenceScore=5.07e-01
TYGFARVYPPLTPSTSPLHLSASMDPICSWSFLSFDWPLAPPPKQPSQPPSFAEALCNTLDIPLSQLCKPCLKGESISIKISEEKKKYKKGLYGCKNSFYELLSIAKGIVFVKISEPKPRYLAYPMLGLTLRSSFGILEAPLQSLRFPLFALATIANITQGTANPLKAPRISPAKALKEETQEPGPSNQNQKQAPKLSARHMPTKACKDATQQNLENAYHISDAESDSNPGHIVPTPPLGASSPPTSRQGVQMSSSGKADIVDEEHDESGQEEEDENRGFIEAVVSLFPLPMIISRLGRMPVPLTTLIPLVLSMPSQMVVILIGTLKLTWIGPSITMIAWIVGTPYPVATLPENHCVENDLIATLILSLASSDNKCMLTNLPIKEEVRLVFAMNGYRASSLDGFGGSFFQAF

SEQ ID NO: 168127 - protein, 89 aa, Glycine max
  Coding DNA Sequence Number=SeqID_51349
MAGPRNFKYPSYAFYMDYLTIFCKGDANNLKSLMDLFLRFGDASGQHLGLHKCRFFVGNLSRARLHISTRLVFVQGQLLLTTLGSLSSK

SEQ ID NO: 168128 - protein, 127 aa, Glycine max
  Coding DNA Sequence Number=SeqID_51350
  Gene Ontology: Mol. function=ATPase activity, coupled to transmembrane movement of substances; Cellular component=integral to membrane; Biological process=transport
  Homolog annotation: Hit_ID=Q9CAB3; Match level="QueryCoverage=71%, HitCoverage=13%, E-value=1e-36, Identity=75%"; Hit description =Putative ABC transporter; 82503-78258
MLSICICKYKWWLEKLANISLRQSAAYEVWNFSFNILYHSTQVIAVLFGGMSILAGHITVEKLTKFILYSEWLIYSTWWVGDNISNLMQSVGASEKLFFVYAVRDNIIDPVKDKVPGPLNFSRKIII

SEQ ID NO: 168129 - protein, 97 aa, Glycine max
  Coding DNA Sequence Number=SeqID_51351
  Homolog annotation: Hit_ID=Q1SFC1; Match level="QueryCoverage=46%, HitCoverage=8%, E-value=5e-07, Identity=50%"; Hit description=RNA -directed DNA polymerase
MASEVMPIHSVMFLPYMKPYCSSEMILGATEASLIRSPNYPGNHRYRWPYPGIESTNGINVVKGTGIRPSLEIIIGSGKRETTASTLMLPKYSIKVP

SEQ ID NO: 168130 - protein, 118 aa, Glycine max
  Coding DNA Sequence Number=SeqID_51352
  Subcellular localization annotation: CTP_CleavageSite=59; ConfidenceScore=5.13e-01
MSVKNLIGHLGVHDKTNNTLVSQVTLIWLQGTFKLSVFTPKAYTLKSLSGSLPLDSGFSSVRKKEKELKPSFHCLHAKDVSLSKDLISQIPTIGVCGNKFQTCCSNFMMIQWLTSPRL

SEQ ID NO: 168131 - protein, 41 aa, Glycine max
  Coding DNA Sequence Number=SeqID_51353
MLEELKAYANENRKKLFQPLPNTSMGIATLIFWDRAMLMIH

SEQ ID NO: 168132 - protein, 146 aa, Glycine max
  Coding DNA Sequence Number=SeqID_51354
  Gene Ontology: Mol. function=nucleic acid binding; Cellular component= mitochondrion; Biological process=DNA integration
MEIKEVRVQVPLTCASNSKVSIPLDVVPNNNEEEQHNNESMIQNELILEEPQEVALRRSQRERRSTISNDYVWLEAMTKELRSMEHNSVWNLVELPKGCKKVDCKWIFKTKRDSRGNLEHYKVRLIAKGFTQRYDVDYKETFSSIS

SEQ ID NO: 168133 - protein, 1221 aa, Glycine max
  Coding DNA Sequence Number=SeqID_51355
  Gene Ontology: Mol. function=transmembrane receptor activity; Cellular component=membrane; Biological process=defense response
  Homolog annotation: Hit_ID=Q19D50; Match level="QueryCoverage=39%, HitCoverage=99%, E-value=1e-117, Identity=48%"; Hit description =Disease resistance protein
  Pfam annotation: Domain name=Arch_ATPase; Domain location=36-236; Score=-73.7; E_value=0.0015; Accession=PF01637.9; Description =Archaeal ATPase
  Pfam annotation: Domain name=LRR_1; Domain location=1003-1024; Score =10.3; E_value=3.4; Accession=PF00560.23; Description=Leucine Rich Repeat
  Pfam annotation: Domain name=LRR_1; Domain location=1026-1049; Score =0.6; E_value=2.2e+02; Accession=PF00560.23; Description=Leucine Rich Repeat
  Pfam annotation: Domain name=LRR_1; Domain location=451-473; Score =5.1; E_value=32; Accession=PF00560.23; Description=Leucine Rich Repeat
  Pfam annotation: Domain name=LRR_1; Domain location=519-540; Score =8.1; E_value=8.6; Accession=PF00560.23; Description=Leucine Rich Repeat
  Pfam annotation: Domain name=LRR_1; Domain location=542-564; Score =8.4; E_value=7.5; Accession=PF00560.23; Description=Leucine Rich Repeat
  Pfam annotation: Domain name=LRR_1; Domain location=566-588; Score =11.8; E_value=1.7; Accession=PF00560.23; Description=Leucine Rich Repeat
  Pfam annotation: Domain name=LRR_1; Domain location=590-612; Score =10.8; E_value=2.7; Accession=PF00560.23; Description=Leucine Rich Repeat
  Pfam annotation: Domain name=LRR_1; Domain location=614-635; Score =6.1; E_value=20; Accession=PF00560.23; Description=Leucine Rich Repeat
  Pfam annotation: Domain name=LRR_1; Domain location=637-659; Score =7.7; E_value=11; Accession=PF00560.23; Description=Leucine Rich Repeat
  Pfam annotation: Domain name=LRR_1; Domain location=661-682; Score =11.0; E_value=2.5; Accession=PF00560.23; Description=Leucine Rich Repeat
  Pfam annotation: Domain name=LRR_1; Domain location=684-706; Score =14.3; E_value=0.45; Accession=PF00560.23; Description=Leucine Rich Repeat
  Pfam annotation: Domain name=LRR_1; Domain location=708-729; Score =4.4; E_value=43; Accession=PF00560.23; Description=Leucine Rich Repeat
  Pfam annotation: Domain name=LRR_1; Domain location=731-753; Score =10.0; E_value=3.9; Accession=PF00560.23; Description=Leucine Rich Repeat
  Pfam annotation: Domain name=LRR_1; Domain location=755-776; Score =9.5; E_value=4.8; Accession=PF00560.23; Description=Leucine Rich Repeat
  Pfam annotation: Domain name=LRR_1; Domain location=778-800; Score =9.5; E_value=4.7; Accession=PF00560.23; Description=Leucine Rich Repeat
  Pfam annotation: Domain name=LRR_1; Domain location=802-823; Score =11.3; E_value=2.2; Accession=PF00560.23; Description=Leucine Rich Repeat
  Pfam annotation: Domain name=LRR_1; Domain location=825-847; Score =8.8; E_value=6.3; Accession=PF00560.23; Description=Leucine Rich Repeat
  Pfam annotation: Domain name=LRR_1; Domain location=849-870; Score =8.2; E_value=8.2; Accession=PF00560.23; Description=Leucine Rich Repeat
  Pfam annotation: Domain name=LRR_1; Domain location=936-957; Score =13.9; E_value=0.6; Accession=PF00560.23; Description=Leucine Rich Repeat
  Pfam annotation: Domain name=LRR_1; Domain location=959-978; Score =4.0; E_value=51; Accession=PF00560.23; Description=Leucine Rich Repeat
  Pfam annotation: Domain name=LRR_1; Domain location=980-1001; Score =9.3; E_value=5.3; Accession=PF00560.23; Description=Leucine Rich Repeat
  Pfam annotation: Domain name=NACHT; Domain location=53-208; Score =22.1; E_value=1.1e-06; Accession=PF05729.3; Description=NACHT domain
  Pfam annotation: Domain name=NB-ARC; Domain location=20-314; Score =169.9; E_value=6.4e-48; Accession=PF00931.13; Description=NB-ARC domain
  Pfam module annotation: Pfam domain module=Arch_ATPase::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::NACHT::NB-ARC; ...
  Pfam module annotation: Pfam domain module=Domain location=36 -236::1003-1024::1026-1049::451-473::519-540::542-564::566-588::590 -612::614-635::637-659::661-682::684-706::708-729::731-753::755 -776::778-800::802-823::...
  Pfam module annotation: =825-847::849-870::936-957::959-978::980 -1001::53-208::20-314
DSEKSDKLIQHLVQILLKQMRNTPLNVAPYTVGLDDRVEELKKLLDVKSNDVRVLGLYGMGGVGKTTLAKSLFNSLVVHNFERRSFITNIRSQVSKHDGLVSLQNTIHGDLSGGKKDPINDVNDGISAIKRIVQENRVLLILDDVDEVEQLKFLMGEREWFYKGSRVVITTRDREVLTKAKSYVDKHYEVKELEFSPSMELFCYHAMRRKEPAEGFLDLAKQIVEKTGGLPLALEVFGSFLFDKRTMREWKDAVEKMKQISPSGIHDVLKISFDALDEQEKCIFLDIACLFVQMEMKREDVVDILNGCNFRGDIALTVLTARCLIKITGDGKLWMHDQVRDMGRQIVHSENLADPGLRSRLWDRDEILIVLKSMKGTRNVQGIVVDCVKRRMSTPRDRSADEITWENFRRKPSCKLALEYIKEKYKKYVRDREEKAKEVVLQAKNFESMVSLRLLQINYSRLEGQFRCLPPGLKWLQWKQCPLRYMPSSYSPLELAVMDLSESNIETLWSRSNNKVAEHLMVLNLSNCHRLTATPDLTGYLSLKKIVLEECSHLIRIHESLGNLSSLVHLNLRFCYNLVELPSDVSGMKHLEDLILSDCWKLKALPKDLSCMICLRQLLIDNTAVTELPESIFHLTKLENLSANGCNSLKRLPTCIGKLCSLQELSLNHTALEELPYSVGSLEKLEKLSLVGCKSLSVIPNSIGNLISLAQLFLDISGIKELPASIGSLSYLRKLSVGGCTSLDKLPVSIEALVSIVELQLDGTKITTLPDQIDAMQMLEKLEMKNCENLRFLPVSFGCLSALTSLDLHETNITELPESIGMLENLIRLRLDMCKQLQRLPDSFGNLKSLQWLQMKETTLTHLPDSFGMLTSLVKLDMERRLYLNGATGVIIPNKQEPNSKAILRSFCNLTLLEELNAHGWGMCGKIPDDFEKLSSLETLSLGHNNIFSLPASMIGLSYLKKLLLSDCRELIFLPPLPSSLEELNLANCIAVQYMHDISNLKLLEELNLTNCEKVVDIPGLEHLKSLRRLYMNGCIGCSHAVKRRFTKVLLKKLEILIMPGSRVPDWFTAEPVVFSKQRNRELKGIICSGVLSFNNIPENQREGLQLEDVQGKIFNLTDKVFSTTFRLLGVPRTNKDHIFLRRFGVNSSLVFQLQDKYTLHLKKRDPPLIERLELKNCRILLVFEGDDDYVGDEGSLDESQYSVSQKLAKFFNFAANDPCV

SEQ ID NO: 168134 - protein, 111 aa, Glycine max
  Coding DNA Sequence Number=SeqID_51356
MANRDEVQELSSKESNSWNVRIQSGEVQKRDVDLREGGLVALDQLDIHKNSNGERDSKGEIFEYETQEQEAQEEGEKYEEIREGEMEKIEDGYEIGLLGPNRSISYKSFPL

SEQ ID NO: 168135 - protein, 152 aa, Glycine max
  Coding DNA Sequence Number=SeqID_51357
DRAHKTRSGPGGAQQGLGVSSSGYGPLLVLQGARSPQQGIVLARHPVDLKKSNRVLELPALIIGLCQFYGVSIAPSKVIKPPINRTFIEKYCAPRQAQGETPQQPRNGRQQATDAPPPPPKPLSSSSKAGALPTTCGRQQATKSKAKDKQKY

SEQ ID NO: 168136 - protein, 159 aa, Glycine max
  Coding DNA Sequence Number=SeqID_51358
MGEVEEVQEKMKADMEAMKEQMATMMEAKMIMKKIMEASAVAVVATNTVAKYGRPHDVQIQNEHAFPPHGLPPNYTPPNVAYTPNEDVNKCSLRVDNLIIYMSLNPWGRHMKFPTTIKPTSGLASDMPLKGKQLDYKSSPSEDYTFSASEGYMPSPSED

SEQ ID NO: 168137 - protein, 95 aa, Glycine max
  Coding DNA Sequence Number=SeqID_51359
MTKDKVDTSKPYTRAMRGTVHELQANLGADQRDKPWDFNGLIKRQTASLSSLQNGQVTKSNRTYTLREFQERFAKDRIRLPELSPLSKGQSIWVF

SEQ ID NO: 168138 - protein, 166 aa, Glycine max
  Coding DNA Sequence Number=SeqID_51360
  Gene Ontology: Mol. function=helicase activity; Biological process =viral genome replication
  Homolog annotation: Hit_ID=Q2R0W4; Match level="QueryCoverage=98%, HitCoverage=14%, E-value=1e-21, Identity=29%"; Hit description=AT hook motif-containing protein, putative
MMLTACKGATSFEDIRTVENVLYPTYRETCFAMGFLQDDREFVEAIKEAKDQGVLTKPEELWNQTWNWLAEDIAYHYKKINFEHKDYPTMPYPEGGNPASCLENSLILSELNYNNDEARLEFENLFLSMTGTGKTYIWRTLASSLRAKNQIVIMVASSGTASLLLP

SEQ ID NO: 168139 - protein, 96 aa, Glycine max
  Coding DNA Sequence Number=SeqID_51361
MKQIQEALSTPIDAATDFDEDELEAELEDLEGVELEEQLLQPTTRAPAALVHVPAGCNPLALCLQSPLPRKMNWQLCRLRWHFEQLVLNRPEFCRH

SEQ ID NO: 168140 - protein, 579 aa, Glycine max
  Coding DNA Sequence Number=SeqID_51362
  Gene Ontology: Mol. function=transferase activity, transferring hexosyl groups; Biological process=carbohydrate biosynthetic process
  Homolog annotation: Hit_ID=Q48480; Match level="QueryCoverage=97%, HitCoverage=89%, E-value=0.0, Identity=78%"; Hit description=WbbM protein
  Pfam annotation: Domain name=Glyco_transf_8; Domain location=234-503; Score=275.2; E_value=1.3e-79; Accession=PF01501.10; Description =Glycosyl transferase family 8
DNISFKNPFYCELTAHYWVWKNESLADYVGFMHYRRHLNFSQNQNFSEDNWGVVNSPVIDVEYENQFGLTDAEIQKCILGFDLILPKKWSVTSAGSKNNLEHYKNGEFLHLQDYLTALEIVEELYPDYKTAIQEFNNATDGYYTNMFVMGKDMFIDYSEWLFEILAILESRISMSNYNSQEKRVIGHIAERLFNIYIIRQQQNRALKVKELQRTFVTNETFNGKLNPVFSNAAPIVISFDDNYAISGGALINSIVRHSDNNTNYDIVVLENKVSNLNKRRLNHLVSAHKNVSLRFFDVNAFTEMNGVHTRAHFSASTYARLFIPQLFREYDKVIFIDSDTVVKADLANLLSVDLGNHLVAAVKDIVMEGFVKFGAMSESDDGVMPAGEYLEKTLKMSNPDEYFQAGIILFNIAQMVKEDTFSELIKALKEKKYWFLDQDIMNKVFYGRVEFLPLEWNVYHGNGNTDDFFPNLKFATYMRFLKARQAPCMIHYAGENKPWNTDRVDFYDDFLENIINTPWEKEVYSRQLSIINLSSPAQAVSQPPILFQTKVKKMLMPYLNKYAPVGFSGAVIARELAEQ

SEQ ID NO: 168141 - protein, 271 aa, Glycine max
  Coding DNA Sequence Number=SeqID_51363
  Homolog annotation: Hit_ID=UPI00005FA37E; Match level="QueryCoverage =98%, HitCoverage=61%, E-value=1e-116, Identity=73%"; Hit description= COG0823: Periplasmic component of the Tol biopolymer transport system
MHECDPARDLRNVGVAVPLHGVNPPKQHPREYDGSHYCVLVSETVPQPQPGSDQINRAYEEGWIGREGYRKADGSRQRWALAFIGDTLSAAGEKLPEVFIVDLPENDADYARAGALPLQGTESELPAPPQGVRQRRVTFTGDRRFPGVAGAPRHWLRSSPDGSQIAFLMKDDGGVVQLWTVSPNGGEPRQVSHSEHDIQSAFSWHPQGGAIALVCDNSVMLCEVAGGRLQRLTQRSAQPPSGDAVVFSPDGKKVAFMREIAGFNQIFVVEV

SEQ ID NO: 168142 - protein, 61 aa, Glycine max
  Coding DNA Sequence Number=SeqID_51364
MSEIRRFGGLGMEERRKRKRGCAGISGKCDIYRAGRVAIYSSVIDYSIHVIDYQNKKIAFS

SEQ ID NO: 168143 - protein, 225 aa, Glycine max
  Coding DNA Sequence Number=SeqID_51365
  Gene Ontology: Mol. function=DNA binding; Biological process=DNA integration
  Homolog annotation: Hit_ID=Q1S1E0; Match level="QueryCoverage=73%, HitCoverage=16%, E-value=6e-21, Identity=36%"; Hit description =Integrase, catalytic region
MEGFEVEVFIKRFAENFIIAAGYGFYQTRKNGFPQNYASRRGRGSQSGFGRGNSIGRGNECYRKHGYPLGHKFYKSQGPNINNVSAENEEGDNSAQERKQETQNEDVKLTSQQYKALMALLQQKNTTHNNSHVNQIVAVSNIGSTLSITCSVSKTSQDRWILDSDDYSRFVWVFLMNSKAKTQSHLKNFVANVESSMMILALYINVLVLKLSNRMGLLKEDINIY

SEQ ID NO: 168144 - protein, 95 aa, Glycine max
  Coding DNA Sequence Number=SeqID_51366
MVHQQVVVVVGVVVNGAEELGVNEKNGEEASAHQHIDCSDAFNTSQVSATSDYVLHWAQSAAYDIGFVAVIMRSDTDTGIRGRISFVLIGCERSD

SEQ ID NO: 168145 - protein, 203 aa, Glycine max
  Coding DNA Sequence Number=SeqID_51367
MEVAQFSIVEAGKSTPMKYYSPTHGFILHMSSTSEVVRLSDIKAQARRIWGNGTHISVTYNGNQNIMVGRIVGLEERDQWEASKIGQTLGYWKEGEINVTFINIYSSCELKKRRIWEDLKNKKEYRNCATWCIMNDFNCIIRPNERQGEAMVEYDRRKSSEFNQSIQDLGIEDIPLIGRKFTCLGQMEMQEVGFIEYWCQETR

SEQ ID NO: 168146 - protein, 304 aa, Glycine max
  Coding DNA Sequence Number=SeqID_51368
  Gene Ontology: Mol. function=protein disulfide oxidoreductase activity; Biological process=cell redox homeostasis
  Homolog annotation: Hit_ID=Q8H558; Match level="QueryCoverage=74%, HitCoverage=92%, E-value=1e-30, Identity=40%"; Hit description =Peptide transporter-like
  Pfam annotation: Domain name=Glutaredoxin; Domain location=120-185; Score=54.3; E_value=4.1e-13; Accession=PF00462.14; Description =Glutaredoxin
MKSRFLRKLKHIPTITNLKQGPALQLNPPVYDDQDHKPHNLAELEIGLNGSEDDKHYELKEMRFEATPTKGSKEKELVEKNLLVVSSPSKSMHQQIQVKEYPSLTDFEEIHPPGGSQAVILYTTSLRGIRKTFQDCNTVRFLMRSFKITYHERDVSLHLEYREELWKILGCKVIPPRLFIKGRYIGGADEVVGLHEMGWLGKLLEGTPMDFADGPCKVAKCSPPMVTTRMNASSGVLNAMRMDLSNAPFAATRNWSKTKQKKTELDEENGTTNNDHSRVKRIKIEAGKFCGYVVGYLMIAGACT

SEQ ID NO: 168147 - protein, 287 aa, Glycine max
  Coding DNA Sequence Number=SeqID_51369
  Gene Ontology: Mol. function=lipoxygenase activity; Cellular component=chloroplast; Biological process=electron transport
  Homolog annotation: Hit_ID=Q3HLN3; Match level="QueryCoverage=48%, HitCoverage=13%, E-value=1e-33, Identity=54%"; Hit description =Sucrose-phosphate synthase isoform C
  Pfam annotation: Domain name=Lipoxygenase; Domain location=2-287; Score=-298.0; E_value=0.00052; Accession=PF00305.9; Description =Lipoxygenase
MELGRDFDTGGQPTQKGIYRVDLLTRQIASPVEVDSGYGKPIEICHAPLMAVTVAEHTSFVFHADLVIGNYHVRVSIRARGYIPKESLWPDLAEFVDGALGHIGNMARVLGEQVNGGKPTWPYVIHGHYADVGEESRRVAIEDSASPHGIRLLIEDYHYASDTELQAFSKELVEVGHANKKNEPWWPNMQTCEELIELCTTLIRQYPYEGYVLNRSTLSRCFIPEKGSPEYYEPLLTTLKRHFFRTITAKNQTLTLTEVLSFINASYVEEKSEYHSPLAKILFQANS

SEQ ID NO: 168148 - protein, 64 aa, Glycine max
  Coding DNA Sequence Number=SeqID_51370
MSLLPILDRKPCWQSLIQKFQGFEEKPRGVEVQKEARGKVSARKGKICFNQKLLTLGLEATTKA

SEQ ID NO: 168149 - protein, 113 aa, Glycine max
  Coding DNA Sequence Number=SeqID_51371
  Homolog annotation: Hit_ID=Q27IK6; Match level="QueryCoverage=47%, HitCoverage=1%, E-value=4e-09, Identity=57%"; Hit description =Kinesin POK2
MDTHFQYVQTTLKFLASLKCSTVWEQEDKKAEADLQVGEPSYLASFLYINSCTFLDEKEKSLNEALNHIQLLKRELAGKDAEIRQMKAHISELNLHAEAQAMEYKQKFSNSVE

SEQ ID NO: 168150 - protein, 103 aa, Glycine max
  Coding DNA Sequence Number=SeqID_51372
  Gene Ontology: Mol. function=hydrolase activity, hydrolyzing O -glycosyl compounds; Biological process=carbohydrate metabolic process
  Homolog annotation: Hit_ID=Q1SWW1; Match level="QueryCoverage=54%, HitCoverage=11%, E-value=7e-17, Identity=70%"; Hit description =Glycoside hydrolase, family 1
MAGSIDSAPARVQPSHYAAPFNRSVFPSGFLFGIGSTAYEIEGAATIDGKGPSISDTYTKQQPGYILCGTSRGYIYLGLTENKRGYISCGSVLGKGTSLVDQF

SEQ ID NO: 168151 - protein, 180 aa, Glycine max
  Coding DNA Sequence Number=SeqID_51373
MTRGPGSMQRLTSSSAPLSSRDGMSDDIQRYLMVIHTFCQLEGSELVDTQRLMSSSAPLSSRDGKSNDMRRYLMVIRTFCQLEASEPVDTQRLTSSSAPFPEMSVSSGRDCEKVSFAILTNVVICTFVIQRRQLEASEPVDTQRLTSSSASFPKMSASFSRDYEKVSFAIRQTQGSGIMQ

SEQ ID NO: 168152 - protein, 963 aa, Glycine max
  Coding DNA Sequence Number=SeqID_51374
MNVVEWSPELCTSAWRGAFVKRTRGKTCKTKNSDDQACCLGAECVMGLCKGPIRVIVILPSFCFWGVRRGSSGGDAKGLSFEIEVLSDFGGECRYALALAPSCPPFFFMYKCMFEVLGIILPLTTFQCALLEHLNVAFSQLHWNSWAMVQTFEIMCPFLNIQPRPFFQVLVTDVMADGMPLMLNKDGELRVLFYWQSDPTRFKSYDEDLVTLVERVDKGIWEHLSASLDARAILSLPSASDPLIALDCKVPNVALIYDTHEADGTMPPSIVAPSIGEEDQPGGKVGPVVVGAEAPMCLRALRQAAGLMPTTGHLLTAHDVPLAPPVVEALIATPATSTPLPPPVTFAAVEATVPATQADSVVVSSSTIVIPLLSAGVAITGAPIMLPPSSSAQLASLSTFLAAVASPSSFSRPRVFLDHLYTSSDANLLWGATYKLEQKTPVGFMSAFDKNFIRSAGVQNAIDFAKAFLQRSLEIMKENVAKWRATTQTLWQVEWPKVANATIVFAEVVRSNRQLSSKVGGVLAKLLRTQLDGDELFKHCKDMQAEKMDLGGKVESVAAERDEIAKVVAYLEALLKESESKLAEFELWVTKEKKANRELEEELLLYKKETSFFAKDLDLGLFDPFKDVNDGVLLDEDDIAVEDEVVDEEHGAAEQGEDNYCGIVKSRKTQSHCKFDFNMVKGLVAHLVLPNQCGDRSLNLLSFSSDGYEELMTHQGQTLSFPSPLNYGPGDCLTGFGHRALAYIPLVVGGTHWRRDNKLWIYVSLAVGDIYWSHDGSTLLHVCHLSWVIYTGVVIVIRSCMYATRRGCDTHLYKFLVQSGVYWRLSARRGAHQGRILDFKSLEAMSMDALVLIREMSAEVELQLSGVPHSWNCFAIQLLQSVRSIVKVGCDSEGTFLVGAKLSCSGIFSGFTSDLPHEVAGSLLVDGSSTSTKIMAFVPYGPEDDSVSYLCLSVSIRMLDRGD

SEQ ID NO: 168153 - protein, 193 aa, Glycine max
  Coding DNA Sequence Number=SeqID_51375
MVLIKPLICCASSYSAGGGVCNTYTQVSSDPCQAYASYPTCASRPWCWLALVRLLSDLVDFITKSEHFFHLDVALSSLTQLVHATGWFFAQTVCKLAETGQGNRGHVVRLGSGVLHTESFDKGAEDVYGPRWESTIPGQYCSLEGCRENTTYNPVIVGIEWFLPQGYVYLHDAVDKRISTDSLPWWTMHVEET

SEQ ID NO: 168154 - protein, 186 aa, Glycine max
  Coding DNA Sequence Number=SeqID_51376
MLLALHLSKFADSLCKKPPSSMDELRERAKGYIQMKEMFRFCNEVHQVRQKPDKREPTPRPTCTSRIRGISLTRVRRNLGIGSIQPRGTHSATPNKTSQARVKRNQILYISPWYWSQHRRLLSPKGQDRRTYTGWEQDLKDTKMSNIGTKKQTKEEQKTEADKDDSHKGMSDLLQLNRNSHNKSKA

SEQ ID NO: 168155 - protein, 56 aa, Glycine max
  Coding DNA Sequence Number=SeqID_51377
MYLNILSIGRSPSCPLDKGTSLSRRANFRIPLNHVHPDVSRFQILVRTFAAHHRLR

SEQ ID NO: 168156 - protein, 135 aa, Glycine max
  Coding DNA Sequence Number=SeqID_51378
  Gene Ontology: Mol. function=RNA-directed DNA polymerase activity; Cellular component=chromatin; Biological process=RNA-dependent DNA replication
MSGIHPSIIYYKLAICSQAKPLSQKKRKMREEWCKAVKEEVDKLLHANFIRKANGKWRMCTDYTDLNRACPKDTYFLPSIDELVNGTFGFHALNFLDAYSRYNQIRMHPPDEDKTTFITEDANFCYNVMGHAFRS

SEQ ID NO: 168157 - protein, 60 aa, Glycine max
  Coding DNA Sequence Number=SeqID_51379
MTKHLRHCRHAGGGEQARFGVAAGYMMNSVILMLCSCLKIELFVYDEFGYNSLVFQWKGI

SEQ ID NO: 168158 - protein, 96 aa, Glycine max
  Coding DNA Sequence Number=SeqID_51380
  Subcellular localization annotation: CTP_CleavageSite=88; ConfidenceScore=5.29e-01
MGKNKGRQLHSAAKQIMVKGITSGSGKSQTSATSGLAGCLDVVQANQNVHTASQDNLVGKVLVKQAGTSSAKTDDVTHQVSDNLSECSAEFESSPE

SEQ ID NO: 168159 - protein, 45 aa, Glycine max
  Coding DNA Sequence Number=SeqID_51381
RKRELGVLVNGEIEIGEEIEAEEWQLQISSRVRSEEPQRRLGFRN

SEQ ID NO: 168160 - protein, 465 aa, Glycine max
  Coding DNA Sequence Number=SeqID_51382
MEFKSQTCDMDKTPEKLVDKHDLGMHVNEVVTITNIDYNHILFNEENNQKSIFNRVQTDDIDSEPDNYVDTLNTIESKSENDIDYITKREVQQLSSCVTCGTIENGVIEALPNLLDNNLSDVVSKTDYVVPLNEEKGNLADSLQENHVLDLVSKSNASNLGYVSPSHDLDRENMTRDNASLNKEPFRDLFDSLQAIPPLTSKPHASNLGPVSPSDVPYKPHASNLGPGHPSDVPYGEEMTRDIACLNKETFRYLPDSMQEIPPLTIEPHTSNLGPVNSSNAPYSEEMTTNNVSLNKEMFGNLPNSLQETPALTLEPYASNLASVRPLDISVSKGIAKNIVDSYPSKTLSLCTDTYIGSSIVNDTMSAPIETNISFSSSNNSNLPNDEVDKNNKNIYKSEETSRESLANHFIRFWTNGGLLGLEPSKPSDFNKSTSLSQGSLSTKSETNGGSHHNSMQKSNGYKKE

SEQ ID NO: 168161 - protein, 96 aa, Glycine max
  Coding DNA Sequence Number=SeqID_51383
MNTTTTHNLIGNILSTPSATKNSLILKYVTKNDKDSKRENEMDKERESDDFMGTNWKGFGSKSECVWMENDEDNDGVQVELKAGLSLAIFRKQRKP

SEQ ID NO: 168162 - protein, 779 aa, Glycine max
  Coding DNA Sequence Number=SeqID_51384
  Gene Ontology: Cellular component=mitochondrion
  Homolog annotation: Hit_ID=Q10G00; Match level="QueryCoverage=95%, HitCoverage=94%, E-value=0.0, Identity=51%"; Hit description =Expressed protein
MVVKMMRWRPWPPLVSKKYEVKLVVKTLTLQGCDLVRASAEKGFMLQIKWKGPKLTLSSLRRNAVARNFTREAHPEQNDDVVLWDEEFHALCTLNAYKDNAFHPWEIAFSLFNGLNQRSKTKVPVVGTATLNLAEFASVVDQKDFDLNIPLTISGGSAESSSPSLSISISLVELRAVQESTELVHNKSIVPVASASSPLVQSGDTTLVEKDELSTIKAGLRKVKILTEFVSVRKAKKTCPEEEGSEGNFSARSEDGEYNYPFDSDSLDDFEEGDSDEVKEDSSVRKSFSYGKLAYANAGGAFYSSMRVNGEGEDWFYYSNHRSDVGVSHKEDSLTVSVTEPYVLQSSRRSILPWRKRKLSFRSPKSKGEPLLKKAYGEEGGDDIDYDRRQLSSDESLSLGYLLTSDLTFVKTEDDSGANRSSVSEFGDDNFAVGSWEQKEVMSRDGHMKLQTQVFFASIDQRSERAAGESACTALVAVMADWFQNNRDLMPIKSQFDSLIREGSLEWRNLCENQTYRERFPDKHFDLETVIQAKIRPLSVVPGKSFIGFFHPEGMDEGRFDFLHGAMSFDNIWDEISHAGRQCTNNDEPQIYIISWNDHFFILKVEADAYCIIDTLGERLYEGCNQAYVLKFDSNTVIYKMQDVAQGSGEKPASDLRTVAEVLEQNDRQIQPINGKEVDSVVDTEEHLKSDQEEEVVCRGKEACKEYIKSFLAAIPIRELQADVKKGLISSTQTPFHHRLQIEFHYTQVLQSCVAPPVVAEPSMTVPETLALAVTEVSA

SEQ ID NO: 168163 - protein, 149 aa, Glycine max
  Coding DNA Sequence Number=SeqID_51385
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=96%, HitCoverage=19%, E-value=8e-31, Identity=57%"; Hit description =Receptor kinase-like protein
MWTTPLGQQEYLILGRRPRHRDPVGSIGYIDPEHCDGLNVLTAKNDVYGFGVVIIELLTVKRAILKDAKDGITPLLSVVDLAVPAILALDLVKILDPKVSPPDPDEALAVELVAYSAVHCVSLEGKNIPTMADIVLNLERALAICNNSI

SEQ ID NO: 168164 - protein, 321 aa, Glycine max
  Coding DNA Sequence Number=SeqID_51386
  Gene Ontology: Mol. function=RNA-directed DNA polymerase activity; Cellular component=chromatin; Biological process=chromatin assembly or disassembly
  Pfam annotation: Domain name=rve; Domain location=125-286; Score =35.2; E_value=2.3e-07; Accession=PF00665.16; Description=Integrase core domain
MSQVIQTPEQQVYLYKLLEYDYSIQYKSKKSNIVADALSRASDTFKALAQQVQTDSSSQPDFKLHNGLLLFQGKIWLDSLNSFWSFSMEEYHPTPLGGHMGFAKTLHQLQQNFYWPDMRKEPLLVPSSIWEDLSLDFIISLPQSHGYTTILVVVDHFSKGADFSALHSHFTTFKVASLFMDMICKLHGFPRSLVLNWDQIFVSQFWRELFKLCGTKLCISTSYHPETDGKTEVLNRSLEQHFRSFVHNEPSDPLPPNSFDNHPLIEPLHIMDNKWDTDTSPLSLSILVQWSSLAPKDTSLEKWDDLKLTFHLEDKVFLLVT

SEQ ID NO: 168165 - protein, 361 aa, Glycine max
  Coding DNA Sequence Number=SeqID_51387
  Gene Ontology: Mol. function=RNA-directed DNA polymerase activity; Cellular component=chromatin; Biological process=RNA-dependent DNA replication
MAAKQEKGLCYNCEDKWNPNHRDTGLRILPTLRSAKFLALPTESTSALQVMVGNGTVLPCNQLCPNIVLCLHGCPFIVDLHVLPISGVDIVLGIQCLKQLGPIITDYDALTMMFVHAREIEKQVVEMLSVGLIKMSHNLLSSPALNSITVKNHFPMPTIDELLEELSNASWFSKLDLRQGFHQILMDENDTLKIAFHTHQGHYEYRVMPFRLCNAPSTFQETMNELLKPFLCKFDAVFFDDILVYSPSFATHLYHLQCVFETLIAAQSFLKASKCLFAQQQLEYLGNIVSHNNVAPDPSKIQAMVEWLGCTENSFKEAQFMFDNLKCAMTQALVLALLDFSVPFTLETDALGLAMGVVLMQ

SEQ ID NO: 168166 - protein, 114 aa, Glycine max
  Coding DNA Sequence Number=SeqID_51388
MVTIVTSEVTVTMSMVTTATAEDGDGSSNVGGHSDGGGDNNDGCDINVDSGGGNVSNNSGDSDGGSNNDNGRCSGDNDDVMSGVIVMVMVTIMVIVVTTTTMTMVVVVVTMTVL

SEQ ID NO: 168167 - protein, 108 aa, Glycine max
  Coding DNA Sequence Number=SeqID_51389
MMRFCITTEGGTCTAKNNFVGYAFTGINPKKFDIPKGCSIDQLKDLIKQVAPKGNPPHGIHESQVVRRLFYRQPSHLEYSEKVLEFKIVELKCDDDVLKVLVESNYWK

SEQ ID NO: 168168 - protein, 310 aa, Glycine max
  Coding DNA Sequence Number=SeqID_51390
  Gene Ontology: Mol. function=prenyltransferase activity; Cellular component=integral to membrane; Biological process=bacteriochlorophyl l biosynthetic process
  Homolog annotation: Hit_ID=Q58FG4; Match level="QueryCoverage=88%, HitCoverage=66%, E-value=1e-145, Identity=96%"; Hit description =Homogentisate phytylprenyltransferase
  Pfam annotation: Domain name=UbiA; Domain location=65-310; Score =11.7; E_value=0.00013; Accession=PF01040.9; Description=UbiA prenyltransferase family
  Subcellular localization annotation: CTP_CleavageSite=21; ConfidenceScore=5.01e-01
MDSMLLRSFPNINNASSLATTATSEKSFESEPQAFDPKSILDSVKNSLDAFYRFSRPHTVIGTALSIISVSLLAVEKISDISPLFFTGVLEAVVAALFMNIYIVGLNQLSDVEIDKINKPYLPLASGEYSFETGVTIVASFSILSFWLGWVVGSWPLFWALFVSFVLGTAYSINVPLLRWKRFAVLAAMCILAVRAVIVQLAFFLHIQTHVYKRPPVFSRSLIFATAFMSFFSVVIALFKDIPDIEGDKVFGIQSFSVRLGQKPVFWTCVILLEIAYGVALLVGAASPCLWSKIVTVYCILMLGNQYSLK

SEQ ID NO: 168169 - protein, 84 aa, Glycine max
  Coding DNA Sequence Number=SeqID_51391
MAVLARTDSICFRGKPHKVMGNTFGVLVQHYLLYYIKHATFSLTKNYIFSKNQILVLLNQKRGDYKKKSLQPSAYNHKPDLQSN

SEQ ID NO: 168170 - protein, 411 aa, Glycine max
  Coding DNA Sequence Number=SeqID_51392
  Gene Ontology: Mol. function=protein serine/threonine kinase activity; Cellular component=cytoplasm; Biological process=protein amino acid phosphorylation
  Homolog annotation: Hit_ID=Q1RSV7; Match level="QueryCoverage=91%, HitCoverage=99%, E-value=1e-164, Identity=76%"; Hit description =Protein kinase
  Pfam annotation: Domain name=Pkinase; Domain location=96-363; Score =115.9; E_value=1.2e-31; Accession=PF00069.15; Description=Protein kinase domain
  Pfam annotation: Domain name=Pkinase_Tyr; Domain location=96-363; Score=85.0; E_value=2.4e-22; Accession=PF07714.7; Description =Protein tyrosine kinase
  Pfam module annotation: Pfam domain module=Pkinase::Pkinase_Tyr; Domain location=96-363::96-363
  Subcellular localization annotation: CTP_CleavageSite=36; ConfidenceScore=5.44e-01
PNAVLLLPHLSSVLNFSALHATESLVRLFIAMRYIRSNSFKRLFSFRRRSSREQILSPNSKGEENYEIFPHEEEPSRRPSWKCFSYEELFDATNGFSSENLVGKGGYAEVYKGTMSGSEEIAVKRLTKTSRDERKEKEFLTEIGTIGHVNHSNVLPLLGCCIDNGLYLVFELSSTGSVASLLHDERLPPLDWKTRHKIAIGTARGLHYLHKGCKRRIIHRDIKASNILLTKDFEPQISDFGLAKWLPSQWTHHSIAPIEGTFGHLAPEYYLHGVVDEKTDVFAFGVFLLEVISGRKPVDGSHQSLHSWAKPILNKGEIEELVDPRLEGAYDVTQLKSFACAASLCIRASSTWRPTMSEVLEIMEEGETDIEKWKMPEEEKEQEEEFWGFEDLEYEYDSSFSMSLLDSIGST

SEQ ID NO: 168171 - protein, 758 aa, Glycine max
  Coding DNA Sequence Number=SeqID_51393
  Gene Ontology: Cellular component=nucleus
  Homolog annotation: Hit_ID=Q1RSV5; Match level="QueryCoverage=99%, HitCoverage=100%, E-value=0.0, Identity=63%"; Hit description =Quinonprotein alcohol dehydrogenase-like
  Pfam annotation: Domain name=WD40; Domain location=195-233; Score =18.3; E_value=0.027; Accession=PF00400.22; Description=WD domain, G -beta repeat
  Pfam annotation: Domain name=WD40; Domain location=38-79; Score=38.2; E_value=2.9e-08; Accession=PF00400.22; Description=WD domain, G-beta repeat
  Pfam annotation: Domain name=WD40; Domain location=424-463; Score =8.4; E_value=3.8; Accession=PF00400.22; Description=WD domain, G -beta repeat
  Pfam annotation: Domain name=WD40; Domain location=480-517; Score =12.4; E_value=1.3; Accession=PF00400.22; Description=WD domain, G -beta repeat
  Pfam module annotation: Pfam domain module=WD40::WD40::WD40::WD40; Domain location=195-233::38-79::424-463::480-517
  Subcellular localization annotation: CTP_CleavageSite=41; ConfidenceScore=5.46e-01
MIRGGENYVSSAPAFSNDGKRLLVCSGSTVSIFSTATGSLVSSLEGHTAAVTAVVVIPSSTGLSYCWTASVDGTIRHWDFSVPECVKIIDLCLPIFSMVVPSILSPREENGKKTANAIAYVSVQVINAPDNRPKPLYGQIRKCNLTHFRSVSQLILKETERPESLTISHLGNFLGIKDKRKLHIWAVPKKDSDSAVSKKITLHHTKTFTVLAFHPTERTVAAGDVTGRILIWHEFGAQKFLNSSGLVNGRSMDQENKDGVRQNDDAESSVTRHWHSSGVRCLSFSSDGAYLYSDNQVLILKKPSKPMEIISCISGIKPPLPSQDICEGLSSRVAFDCTSGLLAVQTENYAIQFYSLFANREVYEVQVCERNHQPVDEVTVVVSLVELSVDGSMMGTVDVKLPEDGIGGFICLKFWDLDDNKRFSLSTLIYEPHRDAHISAVAFHPTRPMAVSTSYGGDFKIWVCREEIQQKGQMVRSSGWRCHAVGSYKNKAMRAAAFSADGSVLAVAADTVITLWDPNNNVLIAVIGETQMPIMRLVFAGKSDYLLSVCHGSKPQLSVWSMSKLVASWSYRLQIEAVSSAIDLSYFAVLALLPESNEYTFKGDGIILLFNVTDPVPVASWSVTKAKGGRLAFLKGDPSEQAVIDGKPTQTLLAYINGDHEYAIFHPSGGKACELSMTKQEDLVFEETGQFGYTSIYGELPKFDLKRKMDSSISSAASSSKRPWVTIFSGLSQSLPPLTKLCSEFLESLLEKRTATVE

SEQ ID NO: 168172 - protein, 754 aa, Glycine max
  Coding DNA Sequence Number=SeqID_51394
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=92%, HitCoverage=69%, E-value=1e-129, Identity=44%"; Hit description =Chromo
  Pfam annotation: Domain name=rve; Domain location=382-579; Score= -11.0; E_value=0.05; Accession=PF00665.16; Description=Integrase core domain
  Pfam module annotation: Pfam domain module=RVT_1::rve; Domain location=183-383::382-579
MEDDNEDPISTIIPQGTQEDEIVESGDHHLSFNALKGGRGVGTIRFIAYIEKLPVTVLIDGGSSDNFLQPRVQAQGNTFELPVFLLPISGADLILRASWLKTIGSHIADYDALQLKFLWKGKFTTLQGDCELPDVVTKSMLDLPVTMKPELALLLHTYNVAFDTLSSLPPQRSHDYFIPLLSGSQPVKVKPYRYPHSQKEEIERLVLGMVCTDYRDLNAITIMDNFLIPAVDELIDELFGASFFSKLDLRSGYHQILLNLDDRHKTTFRTHHGHYEWLVMPFGLTNAPATFQSLMNDIFAGILRKFVLVFFDDILIDYLGHTLFGLGVAMEGNKLEAIQKWPKPTPLTDLLKKDSFKRSVAALEAFQQLKIVMTSAPVLVIPNFKEIFVLETDASGSGVGAVLSQNKHPIAYFSKKLSLRMQKQSAYIREFYAITQALAKFRHYLVGKIVLPCDVGFLNQIMVEFHNSKIGGHSGVNRTIAKLVVDRLSKVGYFILMKSEFNSKVVAGAFITNIVKIHGFPKTIFDDQTENLNKTLEMYLRCFVFEHPKSWVTMLPWAQFWYNTSFHQSLGMTPFQAVFGRPPPAMMHYEAQQYIKMQDDKKRRDLQFKVGDLVLVKLQPYRQHSVALRKNQKLGMHYFGLFPVIERIGTVAYKVQLPESAKIHPVFHIALLKPFHGKSPPPYLPFPLTSSELGPMLCPWKVLDVRVVKRLKATFNLEDKVAFDEEGNVTCIKKERDLARNSVRREGHVAHDPQ

SEQ ID NO: 168173 - protein, 102 aa, Glycine max
  Coding DNA Sequence Number=SeqID_51395
MDTISGTKLSIHPYNLYTNLNMGFCIQHFWRALRLEVRPYLMDELGKVDGALLELTHEHQLRVKDEIRNKISTLETTLAKLRAEEAKPKVGRKTIMEAKNRQ

SEQ ID NO: 168174 - protein, 41 aa, Glycine max
  Coding DNA Sequence Number=SeqID_51396
MSEIEAWQWEGWVLPKEDKVILECIKEDRFLAIRNLDECDS

SEQ ID NO: 168175 - protein, 265 aa, Glycine max
  Coding DNA Sequence Number=SeqID_51397
  Gene Ontology: Mol. function=nucleoside-triphosphatase activity; Cellular component=membrane; Biological process=defense response
  Homolog annotation: Hit_ID=Q850J4; Match level="QueryCoverage=37%, HitCoverage=47%, E-value=8e-34, Identity=70%"; Hit description=NBS -like putative resistance protein
MAKPPRANTWQWTRHCNRRERQTATADGEIAMQQFYRLIFHRFNWKFSSWHIKGKAAYNIPPPYLRIAKSLRAMGYEVFFLALGISNLKSAEHFCDLNLAGRYTRPQRKRHTELHQNDTGEGSLGFASFLLRGPSHVRHHKGSFGEALANHEKKFKHNIQKLEEWKKAMREAIVGRPNWFGLGSRVIITTWDQKLLAHHGVERMYEVKELNEEDALQLLSWKAFKLEKIDPHFKDVLNQAITYASGLPLAFEVISSNLFGGNIEK

SEQ ID NO: 168176 - protein, 126 aa, Glycine max
  Coding DNA Sequence Number=SeqID_51398
  Gene Ontology: Mol. function=DNA binding; Cellular component =endoplasmic reticulum membrane; Biological process=DNA integration
MVFTEDVPRKSETDNNPITGYVDADYAGDINKRRSIIVYIFTLYGNVVRWKANLQSVVALSTTESEYIALTEAINEAFWLKGFVEELEGKKLKTEVMCDSQSAICLSKNQPFHEMTKHIDARFHFI

SEQ ID NO: 168177 - protein, 436 aa, Glycine max
  Coding DNA Sequence Number=SeqID_51399
  Homolog annotation: Hit_ID=Q60DP5; Match level="QueryCoverage=29%, HitCoverage=27%, E-value=2e-16, Identity=31%"; Hit description =Expressed protein
MGDDSSPSLEKLRANWTPSQDRYFLELLLSHVHKGNKTGKVFSRQAWVDMIKQFNTKFGFKYDVEVLKNRHKRFRKQYNDMKMIVGQKGFQWDGTQNMIVADDKAWDECIKAHPDAQPFKKRVIPYYDDLCIIYGHAVADGRYSLSCFDVDFEYEEKDLDDKTMTSKGVDDQTPPAVVNQGRIDWSPMMDQFFVELMVDQVHHNFRLYKIKSMPFYSGMCIVCRNDVTAGCKSNLENESSGGNNSVPDTQLPNADKGASNLEKESSWGNNFVPDTHPLPNADKGASDIGGENNFTRETQPLPNADKEVLHIGGEENSARETQSLAIADNQALQHVGKNVPGHLKRHQPKMPPTLNESKKAREHIAVAVTSLTQKAKKEDNFSVDNVIRVLQAIPDLDDDLILDACDFLEDETRGRMFLALAAPLRKKWLLRKLRSQ

SEQ ID NO: 168178 - protein, 80 aa, Glycine max
  Coding DNA Sequence Number=SeqID_51400
MASPPHFDEDFDFGGGFSGTHSGNKRSSPDYDEDEYENDPFGHKKAKSKAEEAASGVTTGMILSLRERYFSVQLVWNVEY

SEQ ID NO: 168179 - protein, 43 aa, Glycine max
  Coding DNA Sequence Number=SeqID_51401
MLQLQCIIKAKGRLGTPTSNGNGVQPKEAAPGLAVKEKAHGRG

SEQ ID NO: 168180 - protein, 99 aa, Glycine max
  Coding DNA Sequence Number=SeqID_51402
  Gene Ontology: Mol. function=DNA binding; Cellular component =mitochondrion; Biological process=DNA integration
  Homolog annotation: Hit_ID=Q0KIN0; Match level="QueryCoverage=91%, HitCoverage=5%, E-value=7e-20, Identity=42%"; Hit description =Integrase core domain containing protein
MSSSANTQWEVLIRIVKYLKKAPNQGIVYQDHGHMQVGAFSDVDWAMSPTVRKSTTCYYVFLGGNLISWTRSSVEAEHRVMAQKIWELIWVTNFGDGIC

SEQ ID NO: 168181 - protein, 93 aa, Glycine max
  Coding DNA Sequence Number=SeqID_51403
  Gene Ontology: Mol. function=nucleotide binding
  Homolog annotation: Hit_ID=Q33AG5; Match level="QueryCoverage=81%, HitCoverage=12%, E-value=4e-16, Identity=58%"; Hit description =ATPase, histidine kinase, DNA gyrase B-, and HSP90-like domain containing protein, expressed
MLRDEANHGAEKNLRKKTVQLQSHISYRLRFSLRAYVSMLYLRKFSNFSIILRGKLVDQFNIADDLIYSKVIPYKPQLAMATNEVRSMMWSSN

SEQ ID NO: 168182 - protein, 82 aa, Glycine max
  Coding DNA Sequence Number=SeqID_51404
  Subcellular localization annotation: CTP_CleavageSite=73; ConfidenceScore=5.23e-01
MSLLSQDPKGCHWKHEKAAKQWQRAARPTTTGSRSSGIGVTRVRQLQSQSRDGEKMAWQRPNKFSGNIETSTMCLGKKAPIV

SEQ ID NO: 168183 - protein, 73 aa, Glycine max
  Coding DNA Sequence Number=SeqID_51405
MTSYSSTTRLGIPFADHHQIEDLPLAIVFLLELQVKLHGYDNFSCNNNLETPRTLSLFVIIKLLFTFIQSSLP

SEQ ID NO: 168184 - protein, 134 aa, Glycine max
  Coding DNA Sequence Number=SeqID_51406
MALAYARSIQRVTHHIIHAPSSKVLGVRGCIGKISSPTYPRDKTKIEYTSGGQPSFYELTFGVKSDPNPYSKMVLDYTIGPWSQSHSYKIELDEENEDTMEEKKGQTVNALLNIQMIKLKGRRSNRLEMRTKSI

SEQ ID NO: 168185 - protein, 60 aa, Glycine max
  Coding DNA Sequence Number=SeqID_51407
MAVSKLRMMQRKSTKVRPSFVLNRNREASLEDSASVEGLLSVRGFNGEQRRFVVATGGCG

SEQ ID NO: 168186 - protein, 208 aa, Glycine max
  Coding DNA Sequence Number=SeqID_51408
LEEDEEVQALKLELGKARLAKEKFKSVATNIRKECVELREENAATAKALEQETKRARKEEHGRDKFRGAMWGSNNELKLRREERDQSRVHGMILKEELAACSRSNRSLAQHLEATEQSMLAIIGQYKEELNQSLTHEQKLVEDFAQVYAEKEARGRVIDALHQEATMWMDRFALTLNGSQDLPRLLAKAKAIAEVCSAPEEIHGLIDY

SEQ ID NO: 168187 - protein, 139 aa, Glycine max
  Coding DNA Sequence Number=SeqID_51409
MKNVEERLKSCEIPHGKRYGNVSEAPRLRFSSRKQFFQANSKEREVPKGLDPFFFTSSPIYSKIGEVVAAQLAQASSARPGEQGCFLQKQPPSGGIFWRAQMGLALIAHTKNIEGYTTMYLKACLAMQMVIQNIYSNWE

SEQ ID NO: 168188 - protein, 98 aa, Glycine max
  Coding DNA Sequence Number=SeqID_51410
MPISPCRCIGIAPTSRPVDPEKSNRALGFPALVTGLCSPIGCPFPPARSRHHSSTEYLSPPARASGPLLIELSSRSTASPGRRRAKHHSSLGMASSGQ

SEQ ID NO: 168189 - protein, 189 aa, Glycine max
  Coding DNA Sequence Number=SeqID_51411
  Gene Ontology: Mol. function=transporter activity; Cellular component= integral to membrane; Biological process=transport
  Homolog annotation: Hit_ID=Q2XMA5; Match level="QueryCoverage=99%, HitCoverage=51%, E-value=2e-21, Identity=30%"; Hit description=4 -hydroxybenzoate transporter
VGNRKNLSGAGDERCFGRPRGGRVGRRAVGGSYRAQESAGDLAAAVRRLQFADRLRRLAVNADAVAFPDGAGIGGGHAQCRHADVGICASALPGSDGESDVLRFSSRLIAGRLFFRLADPAFRMAERDGAGWRHAAAAGAGRGADKGGLAAGDDFFPSLSAGHLDAVPDLLYGVDDFLSADQLAAPVDP

SEQ ID NO: 168190 - protein, 98 aa, Glycine max
  Coding DNA Sequence Number=SeqID_51412
MHGNVKETTHSMFAPCPYFRNLMGELKARYLVIISKVVAPNFQRSPVESPTVATDPSTGGRRETHGCVFQGRKTRGVATNVYLRKTLEKPKNKTVYEF

SEQ ID NO: 168191 - protein, 799 aa, Glycine max
  Coding DNA Sequence Number=SeqID_51413
  Gene Ontology: Mol. function=metalloendopeptidase activity; Cellular component=cytoplasm; Biological process=proteolysis
  Homolog annotation: Hit_ID=Q1T0S6; Match level="QueryCoverage=99%, HitCoverage=99%, E-value=0.0, Identity=79%"; Hit description =Peptidase M, neutral zinc metallopeptidases, zinc-binding site
  Pfam annotation: Domain name=Peptidase_M3; Domain location=320-793; Score=569.3; E_value=3.7e-168; Accession=PF01432.10; Description =Peptidase family M3
  Subcellular localization annotation: CTP_CleavageSite=73; ConfidenceScore=5.56e-01
MRRSSLVSALLIANILMATRLTLTLPFSRSISPLLSRSLSQLKQFPKSHPCPLWSSSFSFCLHTLRKSTSPIRASSSFSPSMAASSPLNDAVEGNPLLQNFDFPPFDVLEPKHVRPGIRALLGKLESELEELERNVEPSWPKLVEPLEKIVDRLSVVWGMINHLKSVKDSSELRSAIEDVQAEKVKFQLRLGQSKPIYNAFKAIQESPDWQTLSDARKRIVESQIKEAVLNGVSLEDDKRESFNKIEQELEKLSQKFGENVLDATKKFEKLITDKKEIEGLPATALGLAAQSAVSKGHENATAENGPWIITLDAPSFIAVMQHARNRSLREEIYRAYVTRASSGDLDNTGIIDQILKLRLEKAKLLNYNNYAEVSMATKMATVDKAEELLEKLRRASWDPAVQGNNLGVASFFLADIEDLKEFSKSQGALEAGDLTHWDITFWSERLRESKYDINEEELRPFFSLPKVMDGLFNLAKSLFGIEIEPADGLAPVWNNDVRFFCVKDSSGSPIAYFYFDPYSRPAEKRQGAWMDEVFARSRVLSRDGTSARLPVAHMVCNQTPPVGNKPSLMTFREVETVFHEFGHALQHMLTKQDEGLVAGIRGIEWDAVELPSQFMENWCYHRETLMGIAKHFETGESLPEEVYLKLVAARTFRAGSLSLRQLKFASVDLELHTKYVPGGPESIYDVDRRVSEKTQVIPPLPEDRFLCSFSHIFAGGYAAGYYSYKWAEVLSADAFSAFEDAGLDNDKAVKETGRKFRETILALGGGKPPLDVFVQFRGREPTPDALLRHNGLLQVAAS

SEQ ID NO: 168192 - protein, 714 aa, Glycine max
  Coding DNA Sequence Number=SeqID_51414
  Gene Ontology: Mol. function=nucleoside-triphosphatase activity; Cellular component=integral to membrane; Biological process=transport
  Homolog annotation: Hit_ID=Q1T0S3; Match level="QueryCoverage=96%, HitCoverage=94%, E-value=0.0, Identity=76%"; Hit description=AAA ATPase
  Pfam annotation: Domain name=ABC2_membrane; Domain location=459-666; Score=160.5; E_value=4.4e-45; Accession=PF01061.14; Description=ABC -2 type transporter
  Pfam annotation: Domain name=ABC_tran; Domain location=65-255; Score =119.2; E_value=1.2e-32; Accession=PF00005.17; Description=ABC transporter
  Pfam module annotation: Pfam domain module=ABC2_membrane::ABC_tran; Domain location=459-666::65-255
MTQANGHHRVDQTVIDIKKPPVSFTGGLVFECLTYTVTKKKKVEGKWSNEEVDLLHDITSYAPKGCITAVMGPSGAGKSTLLDGLAGRIASGSLKGRVSLDGATVSASLIKRTSAYIMQEDRLFPMLTVYETLMFAADFRLGPLSLADKKQRVEKLINQLGLSQSSQNTYIGDEGTRGVSGGERRRVSIGVDIIHGPSLLFLDEPTSGLDSTSAHSVIEKVHDIARSGSTVILTIHQPSSRIQLLLDHLIILARGQLMFQGSPQDVALHLSRMPRKIPKGESPIELLIDVIQEYDQSEVGVEALAEFARTGVKPPPLSEQLHSLSSVAPSPAPSSHLGHRYGEKSQDFSYSSQVSRRVVDDFDHSLRSPYNNNTSMSWSTGNSAAFLKFTPSRLKNDHKLQNTARSNASPGYYTYSSEILQATPTPHSSDYTVNENDYITASNATHEHLGPKFANSYIGEIWILMRRNFINIRRTPELFLSRLMVLTFMGIMMATMFFKPKETLQGITNRLSFFIFTVCLFFFSSNDAVPAFIQERFIFIRETSHNAYRASTYTIAGIITHMPFILLQATSYAVIVWFALKLRGPFLYFLLVLFVSLLSTNSFVVFVSSVVPNYILGYAVVIAFTALFFLFCGYFLNSQDIPHFWRWMNKISTMTYPYEGLLMNQYQTNDTFGFGYLDGAAITGFDILKSLHIDILERKSGADMGSRTIYPPEG

SEQ ID NO: 168193 - protein, 918 aa, Glycine max
  Coding DNA Sequence Number=SeqID_51415
  Gene Ontology: Mol. function=protein serine/threonine kinase activity; Cellular component=integral to membrane; Biological process=protein amino acid phosphorylation
  Homolog annotation: Hit_ID=Q5MKK9; Match level="QueryCoverage=99%, HitCoverage=99%, E-value=0.0, Identity=80%"; Hit description =Nodulation receptor kinase
  Pfam annotation: Domain name=LRRNT_2; Domain location=351-393; Score =26.1; E_value=0.00012; Accession=PF08263.3; Description=Leucine rich repeat N-terminal domain
  Pfam annotation: Domain name=LRR_1; Domain location=424-445; Score =12.4; E_value=1.4; Accession=PF00560.23; Description=Leucine Rich Repeat
  Pfam annotation: Domain name=LRR_1; Domain location=447-469; Score =9.4; E_value=5; Accession=PF00560.23; Description=Leucine Rich Repeat
  Pfam annotation: Domain name=Pkinase; Domain location=589-861; Score =113.2; E_value=7.8e-31; Accession=PF00069.15; Description=Protein kinase domain
  Pfam annotation: Domain name=Pkinase_Tyr; Domain location=588-861; Score=126.4; E_value=8.3e-35; Accession=PF07714.7; Description =Protein tyrosine kinase
  Pfam module annotation: Pfam domain module=LRRNT_2::LRR_1::LRR _1::Pkinase::Pkinase_Tyr; Domain location=351-393::424-445::447 -469::589-861::588-861
MELPDIWILRLVVACVFCLHIFIRSASGYATEGFENIACCADSNYTDPQTTLNYTTDYRWFPDKGSCRRTKDVLNEKVRLFFVDEGKRCYNLSTIKNKVYLIRGTFPFNGVNSSFNVSIGVTQLGAVRSSGLQDLEIEGVFRAAKDYIDICLVKGEVDPLISHIELRPLPEEYLHDLPASVLKLISRNSLWGSKDEIRFPTDPSDRIWKATSSPSSALLVSSNVSNFDLKSNVTPPLQVLQTALTHPERLQFMHSGIDTEDNEYRVFLYFLELNSTVKAGKRVFDIYVNGEIKKERFDILAEGSNYTYTVLNVSANGLLNLTLVKASGAEFGPLLNAYEILQMRSWIEETNHKDVEVIQKIKEEVLLQNQGNKALESWTGDPCFFPWQGITCDSSNGSSVITKLDLSAHNFKGPIPPSITEMINLKLLNLSHNNFDGYIPSFPLSSLLISIDLSYNNLMGSLPESIVSLPHLKSLYFGCNKRMSEGGPANLNSSLINTDYGRCKGKEPRFGQVFVIGAITCGSLLIALAVGIIFVCRYRQKLIPWEGFGGKNYIMETNVIFSLPSKDDFLIKSVSIQTFTLEDIEVATERYKTLIGEGGFGSVYRGTLNNSQEVAVKVRSATSTQGTREFDNELNLLSAIQHENLVPLLGYCNENDQQILVYPFMSNGSLQDRLYGEPAKRKILDWPTRLSIALGAARGLAYLHTFPGRSVIHRDVKSSNILLDHSMCAKVADFGFSKYAPQEGDSNVSLEVRGTAGYLDPEYYKTQQLSEKSDVFSFGVVLLEIVSGREPLDIKRPRNEWSLVEWAKPYVRASKMDEIVDPGIKGGYHAEAMWRVVEVALHCLEPFSAYRPNMVDIVRELEDALIIENNASEYMKSIDSLGGSNRYSIVIEKRVLPSTSSTAESTITTQALSHPQPR

SEQ ID NO: 168194 - protein, 200 aa, Glycine max
  Coding DNA Sequence Number=SeqID_51416
  Homolog annotation: Hit_ID=Q2PEP7; Match level="QueryCoverage=30%, HitCoverage=22%, E-value=8e-07, Identity=50%"; Hit description =Putative DNA-damage-repair/toleration protein DRT102
MLRVERLFKRAPKLKGWRIEDVLKEKGKECMWEKDFVKPVKMVLPKLFTMLSSLKNPFEVVSIERIFSWWWKNNEEKDIEEFMETVDDGATSDEIVGKGGFGDSTTDLDSGGVVGRGSKTFGFNVESVQVSDKGVFERSVEVNGNNDDFDRAWVFLHETPSELAERRSDVGVGEHVELHPPVMGASVVVYHVVKMLADME

SEQ ID NO: 168195 - protein, 639 aa, Glycine max
  Coding DNA Sequence Number=SeqID_51417
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LXA8; Match level="QueryCoverage=89%, HitCoverage=68%, E-value=0.0, Identity=58%"; Hit description=Beta -xylosidase-like protein
  Pfam annotation: Domain name=Glyco_hydro_3; Domain location=2-157; Score=-27.8; E_value=2.2e-07; Accession=PF00933.12; Description =Glycosyl hydrolase family 3 N terminal domain
  Pfam annotation: Domain name=Glyco_hydro_3_C; Domain location=229 -492; Score=223.4; E_value=5.1e-64; Accession=PF01915.12; Description= Glycosyl hydrolase family 3 C terminal domain
  Pfam module annotation: Pfam domain module=Glyco_hydro_3::Glyco_hydro_ 3_C; Domain location=2-157::229-492
MYPPDPPVDPELRHTLASLTFWAKLTLDIGYHVWFLSHQVEDHKGIKQSYWGITHDGMTTHQVSQQDLEDTYQPPFRSCIQQGKASCLMCSYNEVNGVPACASEELLGLARDKWGFKGYITSDCDAVATVYEYQKYAKSQEDAVADVLKAGMDINCGTFMLRHTESAIEQGKVKEEDLDRALLNLFSVQLRLGLFDGDPIRGRFGKLGPKDVCTQEHKTLALDAARQGIVLLKNDKKFLPLDRDIGASLAVIGPLATTTKLGGGYSGHHLLNVSLSFRRPLKTLTSNCMMLYLLPNNVGIPCSSSSLYEGLGEFAERISYAFGCYDVPCDSDDGFAEAIDTAKQADFVVIVAGLDATQETEDHDRVSLLLPGKQMNLVSSVADASKNPVILVLIGGGPLDVSFAEKNPQIASIIWLGYPGEAGGKALAEIIFGEFNPAGRLPMTWYPEAFTNVPMNEMSMRADPSRGYPGRTYRFYTGGRVYGFGHGLSFSDFSYNFLSAPSKISLSRTIKDGSRKRLLYQVENEVYGVDYVPVNQLQNCNKLSFSVHISVMNLGGLDGSHVVMLFSKGPKVVDGSPETQLVGFSRLHTISSKPTETSILVHPCEHLSFADKQGKRILPLGPHTLSVGDLEHVVSIEIY

SEQ ID NO: 168196 - protein, 601 aa, Glycine max
  Coding DNA Sequence Number=SeqID_51418
  Gene Ontology: Mol. function=transmembrane receptor activity; Cellular component=membrane; Biological process=defense response
  Homolog annotation: Hit_ID=Q1T1A2; Match level="QueryCoverage=94%, HitCoverage=71%, E-value=1e-180, Identity=54%"; Hit description=TIR; Disease resistance protein; AAA ATPase
  Pfam annotation: Domain name=LRR_3; Domain location=551-571; Score =17.6; E_value=0.045; Accession=PF07725.3; Description=Leucine Rich Repeat
  Pfam annotation: Domain name=NACHT; Domain location=212-360; Score= -37.6; E_value=0.049; Accession=PF05729.3; Description=NACHT domain
  Pfam annotation: Domain name=NB-ARC; Domain location=182-469; Score =68.2; E_value=2.7e-17; Accession=PF00931.13; Description=NB-ARC domain
  Pfam annotation: Domain name=TIR; Domain location=27-149; Score =118.8; E_value=1.5e-32; Accession=PF01582.10; Description=TIR domain
  Pfam module annotation: Pfam domain module=LRR_3::NACHT::NB-ARC::TIR; Domain location=551-571::212-360::182-469::27-149
MAFIYAAAVVGCASSSSSPAVSENHDVFISFRGEDTRGDFTSHLHAALCRNGIQTYIDYRIQKGYEVWPQLVKAIRESTLLLVIFSENYSSSSWCLNELVELMECKKQGEEDVHVRKQSGSYHTALAKHKKDWKVSKEKMQKWKDALFEAANLSGFHSQTYRTEPDLIEDIIIDVLQKLNHRYTNDFRGLFISDENYTSIESLLKTDSGEVRVIGIWGMGGIGKTTLTAAIFHKVSSQYEGTCFLENEAEESRRHGLNYICNRLFFQVTKGDLSIDTPKMIPSTVTRRLRHKKVFIVLDDVNTPRLLEYLIGVDCDWLGAGSRVIVTTRDKHVLIRGEVDKIHKVEEMNFQNSLKLFSLNAFGITYPKKEYVESSKRAMVYAKGIPLALKVLGSFLRSKTENEWDSALSKLKKIPNTEVQAVFRLSYDGLDDDEKNIFLDIAYIGIRSLLDKALITTTSYNNFIDMHDLLQEIEKLFVKNGTGAVEGIWLDMTQITNVNLSSNAFRKMPNLRLLAFQTLNRDFERINSVYLPNGIEFFPKNLRYFGWNGYALESLPSMRYSNVEKLWHGVQNLPNLETIDLHGSKLLVECPNLSLAPNLNL

SEQ ID NO: 168197 - protein, 83 aa, Glycine max
  Coding DNA Sequence Number=SeqID_51419
MSDPKYAYPYPAQGQGYYQGPPVMAPPQYYAAPPPRTRQTGFLEGWLMSAAVIPQSYVSSDVIKIAASRKNKMKKIQVHIYAV

SEQ ID NO: 168198 - protein, 827 aa, Glycine max
  Coding DNA Sequence Number=SeqID_51420
  Homolog annotation: Hit_ID=Q2R124; Match level="QueryCoverage=78%, HitCoverage=69%, E-value=1e-154, Identity=43%"; Hit description=Pg1, putative, expressed
  Pfam annotation: Domain name=DUF1399; Domain location=93-238; Score =275.7; E_value=8.9e-80; Accession=PF07173.3; Description=Protein of unknown function (DUF1399)
MEPQQEMEWNEAQKIPISVDLIVVAKKQLQFLAAVDRNRHLYDGPALERAIYRYNACWLPLLAKHSETPIFEGPLEVPLDCEWVWHCHRLNPVRYKSDCEELYGRVLDNFGVVSTVERICGRQTEEIWNNLYPDEPYNVDLVNLLPEDISERISNLEKCTNYDLISAAKRQSPFFYQVSRTHMKNDLFIKESVARYKGFLYLIKRNKEKGIKRFCVPTYDIDLIWHSHQLHPVAYGKDLNEALGKVLEHDDTDSDRTKGKKLDVGFSGTTKQWEVTFGTRYWKAGAMYRGNAPSPITSNPFSSSIICKKVVSSNEYPQEVLLPDRKVMEVFLEFIGVKNLSEGQEGDLSVLFSKSQPDAFFDAKRRLSILSVSREKQVASFRCEPTGELLFELMSSSSSKLSIRKSTKTLGSASFSMKDYLDPVSKLYVEKWLELVPSSDTTSSKPILLRVAISFTVPVPASYTLEMTQSRPFSKNTCLFNLPVRPQHAKIWTHVTDENGTRIISLQIRDLKNAMNIGNPGKEVVGLMKSGETHTLAEFMENGWSVLENLWLFHLPNKSTNDGHLFELTGAKTVRIFPGRKLDYELRHNGKRGNEMDFLTAVEFSIEEPYGKAVALLDLRSRHVTAKEKWMVLPGIILAFIASNIIKKGGYEGIIAESKDLKVNGPNEENEKTVLNGMGLSSTNMCNEDEGITNKSELSIGGCGNAMESGGCGGCGAGCGGGCGNMIKSGGCGSGCGGGCGNLIKGGGCGGCGGGCGGGCGNLIKSGGCGAGCGGGCGGGCGGCGGGCGNRLESSGCGGCGGGCGGDLMDSKCGIDEHFNEELKYVS

SEQ ID NO: 168199 - protein, 448 aa, Glycine max
  Coding DNA Sequence Number=SeqID_51421
  Gene Ontology: Mol. function=DNA binding; Cellular component=nucleus
  Homolog annotation: Hit_ID=Q2HRE9; Match level="QueryCoverage=95%, HitCoverage=96%, E-value=2e-92, Identity=44%"; Hit description=IMP dehydrogenase/GMP reductase
  Subcellular localization annotation: CTP_CleavageSite=77; ConfidenceScore=5.77e-01
MEVQDRNSSVHTQSITAVTPRRSPRFPPQQNNDTPTPKSAKRSVSSNKSDKCAVGSRRSPRLNNVEQRPPPLRRCPRLNNESSDKKLKDTRVKKGGEAETKENRVVSDEGFGGGRKKKRNRKRIEVETQENGVVSDKGFVGGRKKEENEERVKTKANCFVLDEGFDGGREKGVNGEKRKRGGEEISKGWTKEQELALQRAYLAAKPSPHFWKNVSKLVPGKSQQDCFDRIHCDYMTPPETQPRLRAKTFKSSPIHQFSISASKLLKPMDKTARRSNVLKPKNIITQKSVDKLLQRHLKVDLDREGDIFSVLEPNTDFSTNALQPSEALSTPKQQKENKGFPQNCTETSSSSHKKPPSRLSGSCVTELVSPPVLKKVKNRVMHEKYINQLRCRESRRRADATKIIEGTSIQKRDVVNAAKVALQVNFVDNTSSSGEDNDDGIEFEDESQ

SEQ ID NO: 168200 - protein, 682 aa, Glycine max
  Coding DNA Sequence Number=SeqID_51422
  Gene Ontology: Mol. function=metal ion binding
  Homolog annotation: Hit_ID=UPI0000196F38; Match level="QueryCoverage =99%, HitCoverage=100%, E-value=1e-122, Identity=39%"; Hit description=protein binding / ubiquitin-protein ligase/ zinc ion binding
  Pfam annotation: Domain name=PHD; Domain location=125-170; Score=4.7; E_value=0.019; Accession=PF00628.19; Description=PHD-finger
  Pfam annotation: Domain name=VWA; Domain location=294-468; Score =23.7; E_value=6.6e-05; Accession=PF00092.18; Description=von Willebrand factor type A domain
  Pfam annotation: Domain name=zf-C3HC4; Domain location=126-167; Score= 17.5; E_value=0.0024; Accession=PF00097.15; Description=Zinc finger, C3HC4 type (RING finger)
  Pfam module annotation: Pfam domain module=PHD::VWA::zf-C3HC4; Domain location=125-170::294-468::126-167
MVTGWRRAFCTSIPKDREPKVLTEKQQQHCENNSSNNNNSTTTNHSPKISSKFRFFSNPSTPRCESQLSSTPSLRCRTTCSVPNSPKLQCKTKTPRFFHNSNPSSPKSPSSFSLLKSTLRLSKSRCGICMQSARSGQGTAIFTAECSHTFHFPCIVKKHPIVTCPVCNTSWKELPVLSINNNNNDKSDKRGFKVYNDDEPLMSPTSLSRFNPIPESENEDEEQEQDNINTEFKGFHVNPLPNLHSTTVIRRNLQLSLLPEAAIVAANRNYESYVVVLKLKPPHVTKTSRRAPIDLIAVLDVGGAMSGSKLRLMKSSMRQVISSLRPTDRLSIVAFSAGSKRLLPLRRMTGGGQRSARRIVDALAAIDQTREGTPVKNDAVKKAAKVLEDRREKNAVASIVVLSDLNDSRAGNNMHKPSLVSTTRLAHLEVPVHAVRLGECSHALSDDALANFVGGLLNVVAQDVRIQLEVVSRSRAVEIAGVYSLSGRPVSLGSSDWIRLGDLYAEEEREFLVELKVPAASAGSHHVLTVRSSYRNPLTREPLIPVEQAMLVPRPHAVRSSCAKIERLRNLHVTARAVAESSRLAEHNDLSGAHHLLSSARALLLQSSKPEEEFLRWLEAEQAELQRRRQRQTQRNSRVEEKVEPLTPTSAWRAAERLAKVAIMRKSMNRVSDLHGFENARF

SEQ ID NO: 168201 - protein, 209 aa, Glycine max
  Coding DNA Sequence Number=SeqID_51423
  Gene Ontology: Mol. function=intramolecular transferase activity, phosphotransferases; Biological process=carbohydrate metabolic process
  Homolog annotation: Hit_ID=Q47HH9; Match level="QueryCoverage=99%, HitCoverage=46%, E-value=4e-81, Identity=67%"; Hit description =Phosphoglucosamine mutase
  Pfam annotation: Domain name=PGM_PMM_I; Domain location=3-145; Score =211.1; E_value=2.6e-60; Accession=PF02878.6; Description =Phosphoglucomutasephosphomannomutase, alphabetaalpha domain I
MSKQYFGTDGIRGRVGESVITPEFVMKLGYAAGRVLASHEQLPAGNRPTVLIGKDTRISGYMLEASLEAGLSAAGVDVLLTGPMPTPAVAYLTRALRAQAGIVISASHNPYYDNGIKFFSAQGTKLADDIEYAIEAELAKPIQVMESAQLGKAKRVDDAAGRYVEFCKSTFPNHLDLRGLKIVLDCAHGATYHVAPDVFHELGADVIAI

SEQ ID NO: 168202 - protein, 208 aa, Glycine max
  Coding DNA Sequence Number=SeqID_51424
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=4e-20, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSYPSKGYTPSPSEDYTSSSSEGYTPLPSEDYMSSPLQDYPSSPSDDCTGLPVLTFRGLNVLLLGGLHALAFRGLYVLLFRGLHVLPFRGLHILTIKGPHVLAFRGIHVLTFIGLHVLPFRGLHALAFRGLHVLTIRGIHSLTFRRIHILLFRGLHVHAFRGLHALAFIGLHVIAFRGLHALAFVGLHPLAFIGLHICAFRELEVLRP

SEQ ID NO: 168203 - protein, 204 aa, Glycine max
  Coding DNA Sequence Number=SeqID_51425
  Gene Ontology: Mol. function=RNA-directed DNA polymerase activity; Biological process=RNA-dependent DNA replication
  Homolog annotation: Hit_ID=Q0ZCD0; Match level="QueryCoverage=76%, HitCoverage=13%, E-value=1e-09, Identity=27%"; Hit description =Integrase
MERSMIDAASGGSLGDMTPAEARNLIEKMASNSQQFSARNDAIVLRGFHEVTIDSSPSTENKKLEGKLDALVNLVTQLAMNQKSTLVARVCGLCSSANHHTDLCPSLQQSGVNEQLEAYAANIYNRPPQQQNQQQQNNYDLSSNRYNPGWRNHPNLRWISPPQQQQPVPHFQNVAGPSNHMFLLQYSSSDNKDNQQLRLLLNLP

SEQ ID NO: 168204 - protein, 62 aa, Glycine max
  Coding DNA Sequence Number=SeqID_51426
MGESNKRKRILDQRSEEKRRNMQKGLRTRQYLNNTDLSPRNDLQDQVMTYLWFGTRTKHLPV

SEQ ID NO: 168205 - protein, 80 aa, Glycine max
  Coding DNA Sequence Number=SeqID_51427
MDKFDIFVPHPLVIRSLLPLECGRKPLVMKKDKVDTSKPYTGAIRGTVHKPRANLGKIKSSHPSMFLNEKRVTNSGFSMD

SEQ ID NO: 168206 - protein, 82 aa, Glycine max
  Coding DNA Sequence Number=SeqID_51428
MGCTHGPEIYPKAHKNPRAFSCISGPIYLEFSIQCPCGVGLHQQFNASFLAVAQYPEWVSNIVPIPKKEGKVQMCVDYRDLN

SEQ ID NO: 168207 - protein, 62 aa, Glycine max
  Coding DNA Sequence Number=SeqID_51429
MLVDRGLSERGAIKYNPAGLENVISSALESNLNAVNGQITQDKVKTNLREVQVTRRMTRYHC

SEQ ID NO: 168208 - protein, 291 aa, Glycine max
  Coding DNA Sequence Number=SeqID_51430
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-37, Identity=31%"; Hit description= UPI00006A17C9 related cluster
GLHALAFRGLHALTFRGLRTLTFRGLHALAFRGLHALTFRGLRVLAFRGLHVLAFRGLHVLTFTGLHALAFKGLHVLTFRGPHALAFKGLHALAFRGLYVFAFRGLYTLTFRELHILAFRGLNVLVFRGLHVLAFRGLHVLTFRGLQVLTFGGQNALTFRGLHVLTFRELHALAFRGLHALAFRGLHTLTFRGLDALAFRGLHGFTCRGLHALTFRGLHVLTFRGLHALAVRELHILTFRGLHALAFRGLRVLGLRGLHALAFKGLLVLAFRGPHALAFRGLHVLTFKGLQ

SEQ ID NO: 168209 - protein, 97 aa, Glycine max
  Coding DNA Sequence Number=SeqID_51431
  Subcellular localization annotation: CTP_CleavageSite=36; ConfidenceScore=5.53e-01
MRVHCNQASKRPSMITDSPPLLMFPRTRSPVESPTVATYPSAGGRRVTRGMCVPRKEYARSRHQCLFEENVGKTGKDAIYELLSERLGSCIYARGRY

SEQ ID NO: 168210 - protein, 39 aa, Glycine max
  Coding DNA Sequence Number=SeqID_51432
MQSQGLALPSKPEGMIQTRVTQTNAGCTSKKILPAWVPL

SEQ ID NO: 168211 - protein, 147 aa, Glycine max
  Coding DNA Sequence Number=SeqID_51433
  Gene Ontology: Mol. function=transposase activity; Biological process= transposition, DNA-mediated
  Homolog annotation: Hit_ID=Q1SC10; Match level="QueryCoverage=51%, HitCoverage=18%, E-value=2e-15, Identity=39%"; Hit description =Ubiquitin-activating enzyme, E1; Transposase, IS4
MDRVAFRKLCEMLKIIGGMHPSRHMRVEEQPQHIFENNKDDRWKYFKNCLGALHGTYIMVNVLQAEKVKTEQGRMAMHGATTTGAFDRDEPRGFGSAIPTSAQTQSPKLQRCRLQQVRDVATQGQQGRAIGYCELHEGGVIPSSDLL

SEQ ID NO: 168212 - protein, 148 aa, Glycine max; identical to SEQ ID NO: 160001
  Coding DNA Sequence Number=SeqID_51434
  Gene Ontology: Mol. function=DNA binding
  Homolog annotation: Hit_ID=Q1SFS3; Match level="QueryCoverage=95%, HitCoverage=27%, E-value=5e-50, Identity=68%"; Hit description =Lambda repressor-like, DNA-binding
  Pfam annotation: Domain name=DUF1723; Domain location=48-97; Score =11.5; E_value=0.022; Accession=PF08330.1; Description=Protein of unknown function (DUF1723)

SEQ ID NO: 168213 - protein, 257 aa, Glycine max
  Coding DNA Sequence Number=SeqID_51435
  Gene Ontology: Mol. function=succinate-CoA ligase (ADP-forming) activity; Cellular component=cytoplasm; Biological process =tricarboxylic acid cycle
  Homolog annotation: Hit_ID=Q8UC60; Match level="QueryCoverage=94%, HitCoverage=60%, E-value=1e-120, Identity=89%"; Hit description =Succinyl-CoA synthetase beta chain
  Pfam annotation: Domain name=ATP-grasp_2; Domain location=19-198; Score=193.2; E_value=6.1e-55; Accession=PF08442.1; Description=ATP -grasp domain
RRAGRKWRADPQGRGSRSGCKVASGPLYVVKSQIHAGGRGKGKFKELGPDAKGGVRLAKSIDEVVAHAKEMLGNTLVTAQTGEAGKQVNRLYIEDGADIARELYCSLLVDRSVGQVAFVVSTEGGMDIEAVAHDTPEKIHTIAINPETGVTAADVATISKALQLDGAAAEDAKSLFPALYKAFNEKDMALLEVNPLIVMKDGHLRVLDAKMSFDGNALFRHDDVKALRDETEEDAKEIEASKWDLAYVALDGNIGCM

SEQ ID NO: 168214 - protein, 152 aa, Glycine max
  Coding DNA Sequence Number=SeqID_51436
  Gene Ontology: Mol. function=RNA-directed DNA polymerase activity; Biological process=RNA-dependent DNA replication
EFKNVFPKEIPHGLPPSRGIEHQVDLLPGASFPNRPTYKGNHQETQRKDAHAKVEYVKTLYDQLKVQIAKKNESYAKQANKKRKEVVLEPDDDPGHLRTNVFQEGGNDENHETDQIQAKGPSGEGRRPQWRMIEGPEWRKMKAQRQRHYQDY

SEQ ID NO: 168215 - protein, 241 aa, Glycine max
  Coding DNA Sequence Number=SeqID_51437
  Homolog annotation: Hit_ID=Q1SKD7; Match level="QueryCoverage=86%, HitCoverage=54%, E-value=8e-22, Identity=30%"; Hit description =Ankyrin
MYEYPRRTRTLTCKHSFRNSYGCSCFVGKREMAPKKLSTKRSRRDAAAEGPSATPEFDSHHFRSAEHQQRFEAIKGWSFHRERRVQLREDEYMDFQEEIAHRRWTSLVTPMAKFDPEIVLEFYVNAWPIEEGVRDMRSWVRGQWIPFDVDALSQFLGDPLVLEEGQQCEFSQRRNKADGFDEEAITQLLSTLGQDFARTAIGRRVRIMRTSMTTLTQTWMALLLSNVLPSDHNSDLPLPKC

SEQ ID NO: 168216 - protein, 94 aa, Glycine max
  Coding DNA Sequence Number=SeqID_51438
MAPKKLSTKRSRRDTTGEGSSAALEFDSHHFRSAEHQQLFEAIRGWKATSVSSAKGGTGSMGSMRKPLPSCCAHRGRILPGPLQGGGCRSCTPA

SEQ ID NO: 168217 - protein, 229 aa, Glycine max
  Coding DNA Sequence Number=SeqID_51439
MQQPRAIEQPEAYAANIYNRPPQPQQQNQPQQSNYDLSSNRYNPGWRNYPNLRWSSPQQQQQQPAPSFQNASGPSRPYIPPPIQQQQQPQKQPTVEAPPQPSLEELVRQMTMQNMQFQQETRASIQSLTNKMGQLATQLNQQQSQNSDKLPSQAVQNPKNVSVISLRSGKQCQGPQPVAPSSSANEPAKLHSIPEKRSSTSLLFRSLQEQFPTKKWKRQRKRSWKHLEK

SEQ ID NO: 168218 - protein, 72 aa, Glycine max
  Coding DNA Sequence Number=SeqID_51440
MKSDDMRGYPILTCTIRQPGANETIEARRLTSSSTPFVVLAREVSQVTCGVTLWLPAPFVNQGQTIPLTCGE

SEQ ID NO: 168219 - protein, 383 aa, Glycine max
  Coding DNA Sequence Number=SeqID_51441
  Gene Ontology: Mol. function=transporter activity; Cellular component= integral to membrane; Biological process=transport
  Homolog annotation: Hit_ID=Q9ZNG8; Match level="QueryCoverage=99%, HitCoverage=39%, E-value=1e-148, Identity=71%"; Hit description=MexY
  Pfam annotation: Domain name=ACR_tran; Domain location=2-383; Score= -610.6; E_value=0.031; Accession=PF00873.9; Description=AcrBAcrDAcrF family
HLAGPGQAHRPVADAGRHRLGPAQPQRARHHRRTGQPGRAAGRAAERQHRGGGIAAHAGTIRQHSAAGATGRRHAAPEGRGAGGTGRHRLHVPVARQRHDGHRPGHQAGAGLERGRDHPPHPRNHARTGAVLPAGRELGHPNLRATLIPTLVVPVALLGTLGVMLGLGYSINVLTMFGMVLAIGILVDDAIVVVENVERIMAEEGLSPHDATVKAMGQISGAIVGITVVLVSVFVPMAFFDGAVGNIYRQFAVTLAVSIAFSAFLALSLTPALCASLLKPIPAGHHEKRGFFGWFNRAFARLTTRYTARVAGVLARPVRFGLAYALVIGVAALLFARLPSSFLPDEDQGSFMAMVILPQGSPQAETMAVVKDVERYMMEHEPV

SEQ ID NO: 168220 - protein, 70 aa, Glycine max
  Coding DNA Sequence Number=SeqID_51442
  Subcellular localization annotation: CTP_CleavageSite=25; ConfidenceScore=5.09e-01
MRHYFRIHPRPRPSLTTPQFNKNKQQFEDKSLTFLSKHMQFRAPKYINGKLESPRMRGGSPRRAQLAQAS

SEQ ID NO: 168221 - protein, 96 aa, Glycine max
  Coding DNA Sequence Number=SeqID_51443
MTKNRVLKEHNKTFLNWFYPNSPRLAFGSPGPWNYLLAKQPARLGELKPSQGDYFPINRHDGGCFKGLGGSALKGIERIEIKEEEKEKEERRKKRK

SEQ ID NO: 168222 - protein, 145 aa, Glycine max
  Coding DNA Sequence Number=SeqID_51444
VRGLLPAELKPYLPLVLKAQKWPQDFSEVAIASCVSTALFLLIRGSGVEVSDDSSSICYEGIEYGGRVEGAAKVRAGGGAADVEGASAELALTLLAPLIAVRSNPFGPTYSCDKSREPKLRGVRLGHRCDLARDESSYIHVQLRD

SEQ ID NO: 168223 - protein, 74 aa, Glycine max
  Coding DNA Sequence Number=SeqID_51445
  Gene Ontology: Mol. function=RNA-directed DNA polymerase activity; Biological process=RNA-dependent DNA replication
  Homolog annotation: Hit_ID=Q1SAS4; Match level="QueryCoverage=97%, HitCoverage=3%, E-value=7e-20, Identity=54%"; Hit description=RNase H, putative
MGPHQEETELVDLGIDSAKREVKIGTGMTAPIREELTALLKDYQDIFAWSYQDMPGLSSDIVQHRLPLNPECSP

SEQ ID NO: 168224 - protein, 70 aa, Glycine max
  Coding DNA Sequence Number=SeqID_51446
MPLKGKQLAVYPCKTLWRALNFAPNHNPCILKQERLSAIEGGRDYAFTDVEELFLVPKCGHCFEVQIARL

SEQ ID NO: 168225 - protein, 34 aa, Glycine max
  Coding DNA Sequence Number=SeqID_51447
GLWAFVGALSVTPPRSARVDPALSAHVAGLARAS

SEQ ID NO: 168226 - protein, 68 aa, Glycine max
  Coding DNA Sequence Number=SeqID_51448
MSTTSLGKRRHSYALNYEHATASPSKTVVYNRRGICDVECCFCSSVPMGIGGRREFHEGVGWGGFHTW

SEQ ID NO: 168227 - protein, 157 aa, Glycine max
  Coding DNA Sequence Number=SeqID_51449
GIIVDDWKFDYSSHDARRMALRANAPLPYPQLVILFLRHFQIPLDNEPFVQVKRSFAIGAGAVTSFGYHKDRNGQWLKKDELPLQDKHTPSPPLQRDDSALMTDFLSELRGLRSYVGQHFDSLDTRFAGMDIRIPQLEEDVGYIRQSFDLPPPPPPS

SEQ ID NO: 168228 - protein, 81 aa, Glycine max
  Coding DNA Sequence Number=SeqID_51450
MGFRIRFDGGGCTNSAMQSIRGASDSEVEDAINSWGSGLNGGGCMNENQFMGLRIRFDGGGCTNSAMHSIRGASDSEVVDV

SEQ ID NO: 168229 - protein, 125 aa, Glycine max
  Coding DNA Sequence Number=SeqID_51451
FVFVANWPALPSLQPHCGVRVCGVRLCHLSIEGVLLLSPSALSSSLSQTGLRFRDCNHIVELVFVEFVSATYRLRVGSDFGSPLWLVLRLPGKPSKSLSRFIVACVLCAAKSSVLIRNISATDDN

SEQ ID NO: 168230 - protein, 462 aa, Glycine max
  Coding DNA Sequence Number=SeqID_51452
  Homolog annotation: Hit_ID=Q1SR88; Match level="QueryCoverage=19%, HitCoverage=20%, E-value=2e-07, Identity=34%"; Hit description=IMP dehydrogenase/GMP reductase
  Pfam annotation: Domain name=DUF674; Domain location=1-430; Score =126.7; E_value=6.4e-35; Accession=PF05056.3; Description=Protein of unknown function (DUF674)
MATDEQVHKVSLKVLVNKEQNKVLFAEAGKDFVDALLSILTLPLGTIARLVAKESNIPPVKFGSLSSLYESVSHLEDKYLRTQKCKEMLLQPRNSMESYCQHVKLNIDDTEPTKYFLCADRTCSIVNGRQLSILRYKRCRCGKQMQKEVSGREAILENGFVNETATFIICDDLSVLPNVLGTSVSLLRKLGIKDMVTIDERNVDISKREVVDILKLSLLSKTPLTDFILVKKDDNFNPINQPQIGIGEKSSDEGRKMDVKVMVRKSDSKILFVEAEADFADLLFSLLTLPLGGVLHMLNGCSSLDSIDKLYNSTFELNTDRYFRPQELKDKLANPQCAPQFNLHNQILPIGAVRLPDITNSMQFEIVDPESSIGGSSSNGGFAKAQSMFMVTDDLVMTPMSSISGISFLNRSKVSLLDLEERVVNIGVKEALAILKASLTSTSALTNGLKQFIKKASIKREI

SEQ ID NO: 168231 - protein, 136 aa, Glycine max
  Coding DNA Sequence Number=SeqID_51453
MVDSTRSKSHLDRLEEAIAKLTMNHLSLTATPNSMTLKLVELLQKMVTLESHPSSLTSSMDPPSLHPPQLKLEPKHLTSAFFYMDGPTLAWFQWMSCNGQLVSWPTFTTKKKAFYIDQLTSLIAKTDVNESTVAFL

SEQ ID NO: 168232 - protein, 93 aa, Glycine max
  Coding DNA Sequence Number=SeqID_51454
MYMVTDDLVLTPKSPISAVSYLNTSQVPLSDLGQRVINIGSKYTEGFINLNNGLKQFVMPVKIDRKGKFVEGSRRLGVERSMSMEKRWKEYGH

SEQ ID NO: 168233 - protein, 264 aa, Glycine max
  Coding DNA Sequence Number=SeqID_51455
  Homolog annotation: Hit_ID=Q1SR88; Match level="QueryCoverage=48%, HitCoverage=28%, E-value=2e-08, Identity=28%"; Hit description=IMP dehydrogenase/GMP reductase
  Pfam annotation: Domain name=DUF674; Domain location=1-260; Score= -64.2; E_value=1.7e-16; Accession=PF05056.3; Description=Protein of unknown function (DUF674)
MLLRPRNWMEACCQKLKLNIDDTEPMKYFICDSWDCVRKERGNLLSTFKNKKCHCGKPMDREISLEERTSENGFVKETASFIICDDLRVMPNSLGTSVDLFHELGAKNMEAIEERTVEIGNKELLDLLKCSFLSKTPLTDFILNKKQFLYVYTKHQCQFEIGEVSSNVIRQMVLKVLIRKSDRKILFVEGQEDFADFIFGFLTLPLGGVLHMLGGPAMYMVTDDLVVTPILSISGVSYLNRSKVRLSDLEQRVINIGLKEISRF

SEQ ID NO: 168234 - protein, 70 aa, Glycine max
  Coding DNA Sequence Number=SeqID_51456
MSLLQSMSIPVSDLAEKVVSIGIKEGVRMLRASLTSTSALTIGLNHLLTKAKEENCNYKYYSVFRIHRGQ

SEQ ID NO: 168235 - protein, 131 aa, Glycine max
  Coding DNA Sequence Number=SeqID_51457
MCCPKVIAASLGVSQDSSRFFFVALLGFPSIRDKEKGLDLPFHGLHEKDISFITDPNGGGVWVNARKREFRARDISLTPNIILKISTVRMCKNKFQTDCSNFTTVQRKKESFGKGRRENEYERKRKCGDIS

SEQ ID NO: 168236 - protein, 86 aa, Glycine max
  Coding DNA Sequence Number=SeqID_51458
  Gene Ontology: Mol. function=nucleoside-triphosphatase activity; Cellular component=chloroplast; Biological process=protein folding
  Homolog annotation: Hit_ID=O67325; Match level="QueryCoverage=69%, HitCoverage=7%, E-value=2e-17, Identity=73%"; Hit description=ATP -dependent Clp protease
  Pfam annotation: Domain name=AAA_2; Domain location=1-80; Score= -12.8; E_value=8.4e-05; Accession=PF07724.4; Description=ATPase family associated with various
MARFDMSEYMENHTVSKLIGALPIGYIGYENGGQLTEVVLCRPPSLFLFDEVEKAHEDVFKSNDIQSKIPQVEMTSRPKRKNIYTK

SEQ ID NO: 168237 - protein, 199 aa, Glycine max
  Coding DNA Sequence Number=SeqID_51459
  Subcellular localization annotation: CTP_CleavageSite=32; ConfidenceScore=5.27e-01
MTHSVHSYFGSCYVHSALLLGHPANSEVAKLSFSNSSSGRRFFPETFRKISFWKNLLPEEEFVISGSTQKLLPEERHPECFRKKVLPETSGRRFFRSFHWWSREVFEDLVVPCSVFEVLLVVVLPISSERRKAVKTISGRNFRHSRRKVRNDHFQKTFFRKLLRPIPEEVLPENTSGRPSSGMGLSNFRKIISIFFISV

SEQ ID NO: 168238 - protein, 101 aa, Glycine max
  Coding DNA Sequence Number=SeqID_51460
NKDHPDVGSICVILSRFHSCLCGRESGRWLHEYMNLFDGTERFEQLKLSLLVDGFSKVWFIQVRAAKRSPVNNIFKQSVKCNQCPLVTKDFYPRYIKNYVP

SEQ ID NO: 168239 - protein, 45 aa, Glycine max
  Coding DNA Sequence Number=SeqID_51461
MADVNTEQQVTLKLVGVRILQASLTSTSALTIGLSYLLTKVKEGN

SEQ ID NO: 168240 - protein, 198 aa, Glycine max
  Coding DNA Sequence Number=SeqID_51462
  Subcellular localization annotation: CTP_CleavageSite=48; ConfidenceScore=5.52e-01
SSGKFFRKFESSSGRACLPEFFRKNHFFRKVSGKGFPGVFRKTFGYFRKNTSSGNFPENVLPELPEEPLTGLPEDSTVSLFRHFFRRTLVFSPLVFYPKVTILRFHCYANSAAHYKQRVRGRGTNLFAEKKKKALARLAEKKLHGEEKKKQVPGEKKKQVPGEKKKLFETVSSGNYIRTFYNFILKGKMHVKRPEVSL

SEQ ID NO: 168241 - protein, 123 aa, Glycine max
  Coding DNA Sequence Number=SeqID_51463
  Gene Ontology: Cellular component=extracellular region; Biological process=sexual reproduction
  Homolog annotation: Hit_ID=Q850K7; Match level="QueryCoverage=99%, HitCoverage=50%, E-value=7e-30, Identity=51%"; Hit description =Expansin-like B1 precursor
  Pfam annotation: Domain name=Pollen_allerg_1; Domain location=28-108; Score=27.8; E_value=8.5e-06; Accession=PF01357.11; Description=Pollen allergen
MAQTTDAAASLLALGVLDIDFNIDDKNITIKIDESNNNPYYFAFVIWYQQGRRDIIVVQLCETQNFVCKFLDRSHGAVWTTTSPPSGPLSLRMLFSDEEEGEETWVVPINNIPGDWKAGETYD

SEQ ID NO: 168242 - protein, 77 aa, Glycine max
  Coding DNA Sequence Number=SeqID_51464
TSQGPKKGRMSSSKGPRTKLGYDSVQAEDTMGVRGSGNGGAKAKGVEGATEEEEVEEEEEEKGKQKHDDGLEEEGKE

SEQ ID NO: 168243 - protein, 220 aa, Glycine max
  Coding DNA Sequence Number=SeqID_51465
  Homolog annotation: Hit_ID=Q66C87; Match level="QueryCoverage=86%, HitCoverage=58%, E-value=4e-45, Identity=47%"; Hit description =Possible MFS Superfamily transporter precursor
ASVFAGPGAGIALSGLLAVYIQAKSLSAGAAWQIYGVLALVLIALVARYLPRAGQLHRPGTAPESLRLTADLKRLFVWPIFGLAAVVGIALSIALRHISTANRRLAIVLWLQSAGVLAAWLLPGIGGLLTGGLLVGGGFLCAVQLSLLYGRELAPNHTRYMAGLLTTGYAIGQLIGPVTSALSTWLTHRLEPALGLAGVALFVGGALVWNRHAERQQQLQ

SEQ ID NO: 168244 - protein, 183 aa, Glycine max
  Coding DNA Sequence Number=SeqID_51466
  Pfam annotation: Domain name=Transposase_23; Domain location=98-168; Score=4.0; E_value=0.00042; Accession=PF03017.5; Description =TNP1ENSPM transposase
DILFHPFGYPGRVRAAGAGVTIKQYFGSAPRTNQLEESITEKVTRQVMASFSHMQSQLQSQMQSQGLAVPPEPLVGPSGPPVSTKGSGVDPSGNDLETGDSDRCGLYIEADPARLVAMGRVYEGSTVVHNTPLLSGQVKVSVEEVRDADAPIPVPTDEVSLVGQALHTFLAWPTHLVKSLSQQ

SEQ ID NO: 168245 - protein, 339 aa, Glycine max
  Coding DNA Sequence Number=SeqID_51467
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=49%, E-value=0.0, Identity=96%"; Hit description=DNA -directed RNA polymerase beta' chain
  Pfam annotation: Domain name=RNA_pol_Rpb1_1; Domain location=5-162; Score=-105.4; E_value=1.2e-05; Accession=PF04997.3; Description=RNA polymerase Rpb1, domain 1
  Pfam annotation: Domain name=RNA_pol_Rpb1_2; Domain location=164-306; Score=245.1; E_value=1.4e-70; Accession=PF00623.11; Description=RNA polymerase Rpb1, domain 2
  Pfam module annotation: Pfam domain module=RNA_pol_Rpb1_1::RNA_pol _Rpb1_2; Domain location=5-162::164-306
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRR

SEQ ID NO: 168246 - protein, 182 aa, Glycine max
  Coding DNA Sequence Number=SeqID_51468
  Gene Ontology: Mol. function=DNA binding
  Homolog annotation: Hit_ID=Q1SFS3; Match level="QueryCoverage=79%, HitCoverage=25%, E-value=1e-11, Identity=29%"; Hit description =Lambda repressor-like, DNA-binding
MAEVSTEAIASLAQYYDRPLRKQVENGVVRVPRKCLEAKARVWASQDEWAPFMDMLALLIFGVVLFPNVDGLVDRAAIDAFLAFYDCKESPVVAILADLYDTFNRRCEKNNARIVFCTPSPYVWLASHFFCQEMRHVCPLEGHRSCTEKKEANWDRLLASKEGASVNWFPRWKEGRTGILIS

SEQ ID NO: 168247 - protein, 73 aa, Glycine max
  Coding DNA Sequence Number=SeqID_51469
MSNEELKLQDPRCRIQCPDILPENTGVAAQCISQDKIFSGRMIDLLQHKPLQPRNAHCYINMEAARVLYQVRD

SEQ ID NO: 168248 - protein, 42 aa, Glycine max
  Coding DNA Sequence Number=SeqID_51470
MEGMGSAEVVADGWLCGEETTGRVNCFTMAAIATEEQIHEFQ

SEQ ID NO: 168249 - protein, 174 aa, Glycine max
  Coding DNA Sequence Number=SeqID_51471
  Subcellular localization annotation: CTP_CleavageSite=24; ConfidenceScore=5.67e-01
MKRTQHSPTFLPSCFSSLPSSSVRVSSLWLPFSFVFEAFSGAVAAFLPQGEAGFRVEDEVNSRDEHDAIDVPQRRRPTTSARRQQVHIAVDEGVPQVTEDVPHMAEDVPQMTEDVPHMADDVLQMSEDTPQMTADVDATVAEDLDRDGAEGSHADEGFPGGARDPSVLTSFAEH

SEQ ID NO: 168250 - protein, 172 aa, Glycine max
  Coding DNA Sequence Number=SeqID_51472
MVIIVRPERVLRQFGYIQSIPLSPVSASLSYDDIDDRWMHFSDHVVAMGELCVVPGQVSTDYMKWFFQISHPFMIPTQAGDQPRHTPAPYHKDYMQPDIPQVPVALDPPRLAVVIAKKLERVLNLRMVTVRTELHDIMQDCLKIARGVPAQMEVLGPDKDGAQSIDDVFNAL

SEQ ID NO: 168251 - protein, 388 aa, Glycine max
  Coding DNA Sequence Number=SeqID_51473
  Gene Ontology: Mol. function=phosphoinositide phospholipase C activity; Biological process=intracellular signaling cascade
  Homolog annotation: Hit_ID=Q1SP02; Match level="QueryCoverage=88%, HitCoverage=79%, E-value=2e-45, Identity=33%"; Hit description=IMP dehydrogenase/GMP reductase
  Pfam annotation: Domain name=DUF1723; Domain location=50-99; Score =49.1; E_value=1.5e-11; Accession=PF08330.1; Description=Protein of unknown function (DUF1723)
MIYTSIQECPELKLVSHGRKVALIGRPMPKIEGLVVATGLSPLIGCSVVTGDPGLIFAFVERWHRETSTIHLPVGKLTITLDDVSSLLHLPISGTFHSFEALSVDEAVFLLMELLEVSGEEARAEKIRARGAYVHLSWVREIYEAFRDLGQSGGYAWGAAALVHMYDQLDEASRTTTRQIGGYLTLLQCWIYEHFPSVHQCVTDDAYKETSPRASRWLMTKAHMKGITGASHRACCDALTVTDVCWLPYSDHRGVRGFELISSFQGQLRWGPMVIIVRPERVLRQFGYIQSIPLSPVSASLSYDDIDDRWMHFSDHVVAMGELCVVPGQVSTDYMKWFFQISHPFMIPTQAGDQPRHTPAPYHKDYMQPDIPQVPVALDPPRLAVAMR

SEQ ID NO: 168252 - protein, 462 aa, Glycine max
  Coding DNA Sequence Number=SeqID_51474
  Homolog annotation: Hit_ID=Q1SR88; Match level="QueryCoverage=19%, HitCoverage=19%, E-value=2e-07, Identity=34%"; Hit description=IMP dehydrogenase/GMP reductase
  Pfam annotation: Domain name=DUF674; Domain location=1-430; Score =129.3; E_value=1e-35; Accession=PF05056.3; Description=Protein of unknown function (DUF674)
MATDEQVHKVFLKVLVDNEKKKVLFAEAEKDFVDALMSILTLPLGTIARLVAKESNIPPVKFGSLSSLYESVSHLEDKYLRTQTCKEMLLQPRNSMESYCQQMKLNIDDTEPTKYFLCETVKCNLDGRRQLSIFRNQRCRCGNLMNKEVSPKGVILENGFVNESETFIICDDLSVLPNVLGTSVSLLGKHGIKDLATIDERNVGISKKEVVDILKLSLLSNTTLTDFILEKKDDNFNPIYHPEIGIGEKSSDEGRKMDVKVMVRKSDSKILFAEAEADFADLLFSLLTLPLGGVLHMLNGCSSLDCIDKLYNSTFELNTDRYFRSQELKDKLANPQCAPQFNLHNQILPIGAVRLPDITNSMQFEIVDPESSIGGSSSNGGFAKAQSMFMVTDDLVMTPMSSISGISFLNRSKVSLLDLEERVVNIGVKEALAILKASLTSTSALTNGLKQFTKKASIKKEI

SEQ ID NO: 168253 - protein, 353 aa, Glycine max
  Coding DNA Sequence Number=SeqID_51475
  Homolog annotation: Hit_ID=Q1SR88; Match level="QueryCoverage=25%, HitCoverage=20%, E-value=2e-08, Identity=35%"; Hit description=IMP dehydrogenase/GMP reductase
  Pfam annotation: Domain name=DUF674; Domain location=1-352; Score= -28.1; E_value=1.7e-18; Accession=PF05056.3; Description=Protein of unknown function (DUF674)
MATDEQVHKVSLKVLVDKEKNKVIFAEAGKDFVDALLSILTLPLGTIARLVAKESNIPPVKFGSLSSLYESVSHLEDKYLRTQTCKEMLLQPRNSMESYCKHVKLNIDDTEPTKYFLCANLNCSIVSGRQLSIFRYQRCRCGNLMNREVFPIEVIPGNGFVNEIATFIICDDLSVLPNVVGTSVSLLRKLGIKDMATIDERNVDISKREVVDILKLSLLSKTPLTDFILEKKDDNFNPINQPQIGIGEKSSYESRKMDVKVLELKDKLANPQCAPQFNLHDQILPIGAVCLPLYYYVTVESYQKSPRLTWRKGLLKIGVKEALAILKASLTSTSALTNGLKQFIKKASIKREI

SEQ ID NO: 168254 - protein, 122 aa, Glycine max
  Coding DNA Sequence Number=SeqID_51476
SEVPIEKQNCHKRRRSEYGGSSSAVGINNQGNVLENLFVGIGTIAVNFEKISNMMEKREKDRDRDRELEGIIWDVIKEIPNLDDITRFKTAELLNTKAKKDFFLKMSPEERSSWINFKLGNN

SEQ ID NO: 168255 - protein, 229 aa, Glycine max
  Coding DNA Sequence Number=SeqID_51477
MCGSQLNIVVMQSLQNPVEVPWEAHQFGLPEIGAKFYITHADLAEIISGDKCLNIAILQLWTIFMNECGRSKADQSLYGLLEPQSIQNAKERRQQCQQYIETWVKESQRQLYLGAYLHQAHWQLFVLHPRENTVVWFCSLRKKPDINIKGAINSAMKTITSSFEGMSNQGAPRWVEPKSNVQSGGFECGYYVMHLMWCIVTAGLKDDWHKWFSDGSSLDVEAITTVRQK

SEQ ID NO: 168256 - protein, 104 aa, Glycine max
  Coding DNA Sequence Number=SeqID_51478
MLTTCMTLIQRNLRLGRALGHDTGRDDEPVVSTTEVVGASVEAAVYADESMAGGDVHDIGADTPADTGAQAAEDEPKGFPGGPRDPSVLTKYANHVAGSVWMGE

SEQ ID NO: 168257 - protein, 282 aa, Glycine max
  Coding DNA Sequence Number=SeqID_51479
MVLKDKLKACQRAKRSLTEQLSKMEENMLTIIDQYKEKVNLAASHGLLARAKAMVDKYLALNEVHGLSDYCQHMHPYRTRAKAKIMSEIEEVQEQMKADIEAMKDQMTTMMSMRRMMKVNTAAVATTSAAAEVDPTHPSGVNQMSHPVPDVVGQGGEALGSTDGPHVVQSKNSFPPYGLPPNYAPPNVVHVPNENVDHSAPVPLESQQPQLGHAHFAQPIEGGGGYVKNPETMLWSTSSLTPDMPLRGQHLVACPSLTPSPAATLTFLGGKTASGHGGKREI

SEQ ID NO: 168258 - protein, 113 aa, Glycine max
  Coding DNA Sequence Number=SeqID_51480
MKLKHTIAMNTWKWHGPYSPRKNWNQAEDFGHSDVCVGDLAIIEHNHCLYLPWWNKHQVASLGYSGVYSEYLMTTGVDCCLHLPLGYKTRVMGLGYFDVDIEDLTLIEYDCYP

SEQ ID NO: 168259 - protein, 490 aa, Glycine max
  Coding DNA Sequence Number=SeqID_51481
  Gene Ontology: Mol. function=GTP binding; Cellular component =intracellular; Biological process=small GTPase mediated signal transduction
  Homolog annotation: Hit_ID=Q10C01; Match level="QueryCoverage=63%, HitCoverage=84%, E-value=1e-107, Identity=61%"; Hit description =GTP1/OBG family protein, expressed
  Pfam annotation: Domain name=Arf; Domain location=259-474; Score= -95.7; E_value=0.023; Accession=PF00025.11; Description=ADP -ribosylation factor family
  Pfam annotation: Domain name=GTP1_OBG; Domain location=72-263; Score=- 2.1; E_value=1e-09; Accession=PF01018.12; Description=GTP1OBG family
  Pfam annotation: Domain name=MMR_HSR1; Domain location=265-395; Score= 143.3; E_value=6.3e-40; Accession=PF01926.13; Description=GTPase of unknown function
  Pfam annotation: Domain name=Miro; Domain location=267-395; Score= -12.3; E_value=0.086; Accession=PF08477.3; Description=Miro-like protein
  Pfam module annotation: Pfam domain module=Arf::GTP1_OBG::MMR _HSR1::Miro; Domain location=259-474::72-263::265-395::267-395
  Subcellular localization annotation: CTP_CleavageSite=49; ConfidenceScore=5.43e-01
MVSLTSSFNIQLLHETRFFSPFFLPPRHRSVQFHHTRRNFVNYKRKTARCGVTSADASTPLSTSLAKEPHKYFDHVIITVRSGDGGHGAVLNQQQQEQEQQGKTKLKKGKGSLKRDFDGSLILPMGGHGGDVLLYADESKDTLLEFHNKSRYHAKRGGNVDAMGVLTSMLRDGLAAPTLRIPVPVGTVVKSKRGKMLADLAQPWDEVLVARGGQGGISLLEIPQHKRKKMMALTTNVMRDESDKVLIHGQPGEEVKLELILRVVADIGLIGLPNAGKSTLLAAITLAKPDIADYPFTTLMPNLGRLGGDPSLGAGMYSSEATLADLPGLIEGAHLGKGLGRNFLRHLRRTRLLVHVVDAATENPINDYRTVREELRMYNPEYLERPYVIILNKIDLPEAKDKLQSLTQEIMRIGNNGAASEPKPCSEVLDPLSDETDRKEKRLEDYPRPLSVVGVSVLKGIRINEMLKEIRSALRKCSDSKEALAFGVPP

SEQ ID NO: 168260 - protein, 283 aa, Glycine max
  Coding DNA Sequence Number=SeqID_51482
  Gene Ontology: Mol. function=transcription factor activity; Cellular component=nucleus; Biological process=regulation of transcription, DNA-dependent
  Homolog annotation: Hit_ID=Q9LQZ2; Match level="QueryCoverage=29%, HitCoverage=41%, E-value=2e-30, Identity=74%"; Hit description =Dehydration-responsive element-binding protein 2D
  Pfam annotation: Domain name=AP2; Domain location=32-96; Score=115.6; E_value=1.4e-31; Accession=PF00847.10; Description=AP2 domain
MGIQERKKVKKPAQASSRKGCMRGKGGPENAKCTYKGVRQRTWGKWVAEIREPNRGARLWLGTFDTAREAALAYDAAARKLYGPDAKLNLAELSVPAPALAAVNPSHMQQQPQVVPEMLIQQQQPLVHPTFDLVNVTSHPSGFNNILNNNPVVVSSMASSFLADAAVPVYTSCDSILSLPSATTNYTNTNTVPMEMENYSSSIPTVESNGDNMFRSFWGPTMDDTMPVFDQSIWTEAAMSLDLPIIADNGFYGRGVGGNKGGGNFFLDEVAAWDSLHTPSCCM

SEQ ID NO: 168261 - protein, 72 aa, Glycine max
  Coding DNA Sequence Number=SeqID_51483
MWYVLALPFKNPRLKWIFTCQCQEPASDLELLKDVISNTNGKTPNSEVYNGTLKVGYEIVVISLCIKEEHWT

SEQ ID NO: 168262 - protein, 141 aa, Glycine max
  Coding DNA Sequence Number=SeqID_51484
  Homolog annotation: Hit_ID=Q00VP3; Match level="QueryCoverage=61%, HitCoverage=43%, E-value=2e-12, Identity=42%"; Hit description =Homology to unknown gene
  Subcellular localization annotation: CTP_CleavageSite=53; ConfidenceScore=5.16e-01
MASMASSSSFCNLKFITKPNNGRRSSLRRIVFCQKHHDDTPTDQINRRELILRSSEIATIGAIFNFGGKKPDYLGVQKNPPALALCPPTKNCVSTSENISDRTHYAPPWNYNPEGRKKPVSREEAMEELIDVVINLAELKS

SEQ ID NO: 168263 - protein, 130 aa, Glycine max
  Coding DNA Sequence Number=SeqID_51485
MTEKHTILAEVVMKTLKENKMDYCYKSRRKKSRVKLRRGWIVREEEEETYNLFVLARINVHGRDTEERDETRKRERRRRKGIVISCYYYKSRVRICMFLESRSLSSTAERKGTNGMEIWNSRCRSAPSTS

SEQ ID NO: 168264 - protein, 62 aa, Glycine max
  Coding DNA Sequence Number=SeqID_51486
MVSVKSIKNEKFFKDMENVNKKFNEALKNLAESKKIITILNDQLMVKEEKGGVSKGFLDGII

SEQ ID NO: 168265 - protein, 86 aa, Glycine max
  Coding DNA Sequence Number=SeqID_51487
IRSVYQDWHANGRCRTKKIEQMLLANADLFACNAFDMLGIDLNFIFHKLTIFLEAKPAAQRKCKIEEEMGKFMEAEIEKLLKANFI

SEQ ID NO: 168266 - protein, 338 aa, Glycine max
  Coding DNA Sequence Number=SeqID_51488
  Gene Ontology: Mol. function=RNA-directed DNA polymerase activity; Cellular component=mitochondrion; Biological process=RNA-dependent DNA replication
  Pfam annotation: Domain name=RnaseH; Domain location=123-238; Score= -12.4; E_value=0.00082; Accession=PF00075.14; Description=RNase H
MVNSSSLNLYTDDLVEIFIELKKHNTRVTLRNAPSGFEEMEEKPKPFFKLLKNSQDEFDWNEECEEMFTKFKNFLATPPILTRPTLSEFGLKFEPRGPIKAQCLTDFIVELPPSLEPNNNDGGNWWMLYVDGSCNPMGSGVGITLEGPGDISHKKSLRFDFKTFNNQVECEALIAVLKLAKELVTGRVNGEFQAKDAHMQRYYLLMEPLLYCSEEYELIHIPHEDNNRDDILSRLVSSKRLEESWMNDIWNYLVNNHLLIVNNEARKDAQYFMEEIHRGIYGFHLGGRSMTTQETLFRLTYVTDAKILVEVGELSEGRAHSDETLNDKSLALELDMID

SEQ ID NO: 168267 - protein, 233 aa, Glycine max
  Coding DNA Sequence Number=SeqID_51489
  Homolog annotation: Hit_ID=Q13S79; Match level="QueryCoverage=80%, HitCoverage=14%, E-value=2e-10, Identity=24%"; Hit description =Putative membrane protein
  Pfam annotation: Domain name=DUF748; Domain location=108-232; Score= -24.9; E_value=0.012; Accession=PF05359.2; Description=Domain of Unknown Function (DUF748)
MVNDLNLQLVVDNTSGLALKNMQLDASQLSLQSDKKPAARLAKLAVSDMQLALDQQKADISAIQLIGLNTAVIRQADQQLNWQAMLARATGKQTAHAAPASHTATHTNPWSYRLKRLALQQADLHIEDQSTPRPVLLDITEGNIELADLSQDMSRLLPIKTIFKIKQGGQFKLQGKLAASPFKMEAQSTLTDVSLKPFAPYIEQVALLRLENGAASLQGKLQQTTSGATKFDG

SEQ ID NO: 168268 - protein, 69 aa, Glycine max
  Coding DNA Sequence Number=SeqID_51490
MRKRARWRVETNIIFYTIWRPDPGSQSGDMRGYLMVTHTIRQPWANEPIDARRLTSSSVPFVVLTSEVR

SEQ ID NO: 168269 - protein, 175 aa, Glycine max
  Coding DNA Sequence Number=SeqID_51491
  Gene Ontology: Mol. function=carbohydrate binding; Cellular component= chloroplast; Biological process=carbohydrate metabolic process
  Homolog annotation: Hit_ID=Q6ZY51; Match level="QueryCoverage=92%, HitCoverage=11%, E-value=1e-42, Identity=68%"; Hit description =Phosphoglucan, water dikinase, chloroplast precursor
  Subcellular localization annotation: CTP_CleavageSite=32; ConfidenceScore=5.10e-01
MGHFQVFKACLSSSFKPIKAQGIGGESWKSARGRSIGGSPILCYLSQGLVLSLSLHFQSSYLCSSYRISSSEPFLDHLVQWINTGQISCFEDGGHHRPNRHAEISRLIFRELERHTSRKDISPQEVLVIRKIHPCLPSFKAEFTASVPLTRIRDIAHRNDIPHDLKVVLFKVLEL

SEQ ID NO: 168270 - protein, 248 aa, Glycine max
  Coding DNA Sequence Number=SeqID_51492
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=5e-32, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LDVLAFRGLHILAFRGLHVLTFRGLQVLAIRGLNVLTFRGLHVLAIRGLNVHTFRGLHALVNRGLDVLAFKGLHVLGFRGLHVLAFGGLYTLAFRGLHVLAFRGQRVLSIRGLHVLTFRGLHALAFRGQHVILFRGLHIFSFIGLHLLALGGDTRPRLKGPHVLTFRGLHVLTISGMHVLAFRGLLHVLAFKGLHVPAFNGQHVLAFRGLHVVAFRGLHVLAIRGLHVLAFKGLHVPAFRGLHNLAFK

SEQ ID NO: 168271 - protein, 141 aa, Glycine max
  Coding DNA Sequence Number=SeqID_51493
  Gene Ontology: Mol. function=protein binding; Cellular component =integral to membrane; Biological process=protein amino acid phosphorylation
  Homolog annotation: Hit_ID=Q9SRL2; Match level="QueryCoverage=66%, HitCoverage=76%, E-value=2e-16, Identity=43%"; Hit description =Putative disease resistance protein
  Pfam annotation: Domain name=LRR_1; Domain location=27-49; Score=1.4; E_value=1.6e+02; Accession=PF00560.23; Description=Leucine Rich Repeat
  Pfam annotation: Domain name=LRR_1; Domain location=3-25; Score=14.9; E_value=0.29; Accession=PF00560.23; Description=Leucine Rich Repeat
  Pfam annotation: Domain name=LRR_1; Domain location=51-74; Score =13.9; E_value=0.57; Accession=PF00560.23; Description=Leucine Rich Repeat
  Pfam annotation: Domain name=LRR_1; Domain location=76-98; Score =13.0; E_value=1.1; Accession=PF00560.23; Description=Leucine Rich Repeat
  Pfam module annotation: Pfam domain module=LRR_1::LRR_1::LRR_1::LRR _1; Domain location=27-49::3-25::51-74::76-98
MTSLTHLNLSHTGFMGKIPPQIGNLSNLVYLDLSSVSANGTVPSQIGNLSKLRYLDLSDNYFEGMAIPSFLCAMTSLTHLHLSYTRFHGKIPSQIGNLSNLLYLGLGGHSVVEPLISLATHSPISSFFDPPIFVRLHTPSL

SEQ ID NO: 168272 - protein, 46 aa, Glycine max
  Coding DNA Sequence Number=SeqID_51494
MADQWATKSKAKGVNAVKIFPGRPKWTRDEMHKLIKEHILGNIGVD

SEQ ID NO: 168273 - protein, 465 aa, Glycine max
  Coding DNA Sequence Number=SeqID_51495
  Homolog annotation: Hit_ID=Q5YFS2; Match level="QueryCoverage=48%, HitCoverage=44%, E-value=1e-124, Identity=100%"; Hit description=Ana
QIGATAPDRAQRRGACRDRAQVGTALLLGQAHADQRAALAGQRRVGAVEFARIERGQPIAGVVDHARRLALQQRHGGKGHGGGTQRAGLDLTLHQVGRRPRHLRPRHRLDPGAAVQAARHDAAHQQLPGGMEIDMVDAMAGPIIGLQPRRIAVGVDAGGQGLGAAEPGPMRAEVAEPGASALVDRRLAQRRVGLEQRIVFQGRDLVEYGMGHERRHAGSSSLMRRACRRAPPGGLSGDGRHPLPGPQGLDLGGQFQQPGLAAQRAHDLDADRQAVGRQAERNGNGGHARQVGQRRERRIADHALLAQAIGQVIGVVHRIAADGRRQLRQHRRQEQVVALRALAMQEAADAARDLVAGIDASHVLRAGNRAGVLARAQRGRLQFVCGKTTIARADEAVDGIGGGAGDQRQHRRQHFLGTHRRRGHHQFVAQAGEQARGLVDRRRDLGMDRFAFVGGVDIGNAAARR

SEQ ID NO: 168274 - protein, 133 aa, Glycine max
  Coding DNA Sequence Number=SeqID_51496
MNNRLGLVVLLLAQILVLHVKAHESDQAQAPLTVLNPFEHKTQTGVQLHDDDQNSDHKVAVSGAIEESPSSSEEKSGESNEAAEAPQIRRMGKHHSSDRSVAGGGVIIGGLVTAIFAAVFCYIRVTRRRDTRY

SEQ ID NO: 168275 - protein, 693 aa, Glycine max
  Coding DNA Sequence Number=SeqID_51497
  Homolog annotation: Hit_ID=Q2R2E6; Match level="QueryCoverage=54%, HitCoverage=74%, E-value=2e-44, Identity=29%"; Hit description =Expressed protein
  Pfam annotation: Domain name=DnaJ; Domain location=542-605; Score= -2.9; E_value=0.0085; Accession=PF00226.21; Description=DnaJ domain
  Pfam annotation: Domain name=HSCB_C; Domain location=619-691; Score =40.8; E_value=4.8e-09; Accession=PF07743.4; Description=HSCB C -terminal oligomerisation domai
  Pfam module annotation: Pfam domain module=DnaJ::HSCB_C; Domain location=542-605::619-691
MEKKRKIVQYRERLDRTLASPDLANDEMLKKLVRSQLPPLEPEVEGFRDKLVENKTAEVSHFLDMLRSASSDDSGRSNTSHTDWKLKQDGEEFRVMYREGQEGTPFHTMLVEGFVDGPVDVSWPLSLREAIVHYYLFEYFQDDLVVVLTNSVSDSKNVTETLCGFNSEAIPEAKDVVRIDLVGGFALQKALGDPLYVRIRDALYNTSGSKAMNGEELRQVASVLPAEDLVESEQGGEKDASKEDMSNQYANDVMPMAMNIEVQDSSKTFNEIVEVDCEEIVQGEEKDASKEDISYRYANNVVPMAMNTKVLDGSKKFAEIVEVDIDEILQIEEANEEVKDIPNKEVDMSVLRGKRSTYIRSEVEHALETLDKAISMVREQRLHSRVASSSVADEESHFLKNDDRVDTYSLKLTQPSSKNEVSVEVPNGDIPEGASQEALGNNPGIQNSRCTGTNPNSKEVNSNKVVPTTSEQNLSTPILSSPVVSYPLENGAILDQTTISNKQLNTDSVEDASLDHADKSSRQKKLNTIVIPGRNSDAPKKERKYDIEGENLEGKYKDWQKKLHPDLVHSKSQGDGGGDFAAEQSARVIDAYRTLSKPLSRGIYLLKLYGEEVDEEQTISDSELLAEILEIREAVEEATNSETLNHILSEEKLHNWSNAFGHAFQSQNFEEAKMAIRRMTYYSRVIDEVVKKL

SEQ ID NO: 168276 - protein, 156 aa, Glycine max
  Coding DNA Sequence Number=SeqID_51498
  Homolog annotation: Hit_ID=Q8LF20; Match level="QueryCoverage=44%, HitCoverage=10%, E-value=3e-18, Identity=60%"; Hit description =Putative clathrin assembly protein At2g25430
MHVVFLDVFQDLTQSGCYAWGVAALVYMYDNLNNASKSSDRRLARYITLLHCWIYEHFPLVVEAITVEDYHERKPPPIQGSIFANNLAPNLEVLIVKAASHEQVPVDEKYIREIPTLTSLSRSYINASLVTISKRLNKTRDWIIAIKVVLLIHSSG

SEQ ID NO: 168277 - protein, 52 aa, Glycine max
  Coding DNA Sequence Number=SeqID_51499
MPFLSSRQREADVVAKDDHHVDDVVDEVFQQPQEAVVDAQGFSSGSCDISSN

SEQ ID NO: 168278 - protein, 78 aa, Glycine max; identical to SEQ ID NO: 143840
  Coding DNA Sequence Number=SeqID_51500

SEQ ID NO: 168279 - protein, 87 aa, Glycine max
  Coding DNA Sequence Number=SeqID_51501
MWRRWWCVCGWLLLLVLPRLLCLPWHAIFLSECPINGRLDKLCRCDQYSVELAETCNQCRKTQCTIGLLKVHRVSRWCNTYKLVDGI

SEQ ID NO: 168280 - protein, 71 aa, Glycine max
  Coding DNA Sequence Number=SeqID_51502
MIKTPSYYKNEVILKWVRDVATMVILQGMVANLVVAKASQSGHNHNDGASIKRVKTDSNEFNMLNNNNGGN

SEQ ID NO: 168281 - protein, 118 aa, Glycine max
  Coding DNA Sequence Number=SeqID_51503
MAKLAVPPLLSLRHLLVLSLALNVSLILRTVYYESEKGSKGFCLNKNMMADADSDDREGHLIHKSRLAMSSTSSLVNSTRADHPGGRETVINLDQARLLTSFVCALLPALVPGKDRDN

SEQ ID NO: 168282 - protein, 211 aa, Glycine max
  Coding DNA Sequence Number=SeqID_51504
  Homolog annotation: Hit_ID=Q1PFH3; Match level="QueryCoverage=48%, HitCoverage=31%, E-value=5e-08, Identity=30%"; Hit description =Pentatricopeptide repeat-containing protein
  Pfam annotation: Domain name=PPR; Domain location=133-167; Score =35.6; E_value=1.7e-07; Accession=PF01535.11; Description=PPR repeat
  Pfam annotation: Domain name=PPR; Domain location=74-108; Score=18.5; E_value=0.025; Accession=PF01535.11; Description=PPR repeat
  Pfam module annotation: Pfam domain module=PPR::PPR; Domain location =133-167::74-108
MKLCFYNKELIETYLGCLCEVGRVLEARRCMNSLKIFGYTVPFNYSLFIRAGRVEEALALLEEVGEEKSIIDQLTCGSIVHGLLRKGQLEEALAKEDAMKPKGITPTIHVGRPFDAWNILYRMKLKGPFPDFKTYSMFLTCLCKAGRYEEGMRLISEMLDGGIVPSRVLLGALGILLGHPTIKEVHCTASVEVKVLWRYMGGGCGSSWFGC

SEQ ID NO: 168283 - protein, 359 aa, Glycine max
  Coding DNA Sequence Number=SeqID_51505
  Gene Ontology: Mol. function=RNA-directed DNA polymerase activity; Cellular component=mitochondrion; Biological process=RNA-dependent DNA replication
  Pfam annotation: Domain name=RnaseH; Domain location=209-326; Score =10.1; E_value=6.7e-06; Accession=PF00075.14; Description=RNase H
MTFITVDANFCYRVMPFGLKNEVQKLNGRLTSLSCFLLKLAEKEKSFYKLLMKTEPFLLDEAYEQAFLAFKKTIAILPVLSRPKLGVPLLLYLTVDDEPVSSALVQEEGKHLLPIYFTHRILHDVEKLYQMIKKVMVTLITSTRHLKPYFQSYQVVVKTNYPIRKVLQKPKLKERMVAWFIELLEFDLQYMLCGLMKTQFMTDFLAKASNVKGSRAGIILEGPSNITLEQALKLNFKASNNQVEYEALIVGLKLAKEVGAKKLRCYIDSQLIQGQVANKYETKEIVLLRYYHIAKTLIDDFDCFGMYHIPRERNTRADLLSKLASSKKTGHIKTIIQETLQVLTIDPKEVMAGEKEEPD

SEQ ID NO: 168284 - protein, 241 aa, Glycine max
  Coding DNA Sequence Number=SeqID_51506
  Homolog annotation: Hit_ID=Q8H612; Match level="QueryCoverage=47%, HitCoverage=20%, E-value=5e-13, Identity=33%"; Hit description =Pentatricopeptide (PPR) repeat-containing protein-like
MGTSAGKAKVVGTVMGIGGAMMLTFYKNIEIHIWSTHVNLMPNIIKPHNVSPTKISGSFLAFGTCLSYSVWTRFVFIRASYHKYLDFKKDTLLYIIAIDGLFLLDFFHNYLNEEVSGSFMTRLQDQVQLSGVKLTKDVIIRDIIMVENQIPTYILVRILVLESSKPADSVLEFLGLMLLSFCKKHSPLKVTHIPTGSEAVSKDTASTEKAHELIMQTQLNKPANLHTNLTKDKLMKPCLLP

SEQ ID NO: 168285 - protein, 194 aa, Glycine max
  Coding DNA Sequence Number=SeqID_51507
MDELCERAKGYIEVVEMFTFKIEVRQAGQKRDKRKGGTMTDSHKLDKQQKLDKCQPLPKGPRMTPWSSPANFMVSKVLIDQGNSTDIPYWKTFQRLEVSSNTVQAHFGPLLDFVGERKTLNELRAILFTPYLKMKFLTLMGEIVTIKADQKQARQCYAKSLKVAPYPPTREQSRPHLTIGGNSQVMSMDEGSPI

SEQ ID NO: 168286 - protein, 1041 aa, Glycine max
  Coding DNA Sequence Number=SeqID_51508
  Homolog annotation: Hit_ID=Q2TCK8; Match level="QueryCoverage=17%, HitCoverage=74%, E-value=1e-09, Identity=31%"; Hit description=Foot protein 1 variant 1
MELINVRVDVAKEDKRGTCKTKDSDAQCHVICHVHFVNLGQYISLPSSEPACWRKRLFSVKGSSLDKVVTLTGARVASKVKRVRRVHHTHITLAYVSHQEWAHTGDVVCGLMGLHRGAQFKNRWRIERSFQLAVPLLRRHAMELLVASPLCVVLAEVLLTFIGWGYLLLLLWTGNPRSHSVGSPSSPPTIASYEWVWNDVLKYRSSITSATSVATLEHQLRLANPEDSCKMVVQAYRSDDFPFLRAVSDHFLKVLETDVVADRLPLMFNRDKEPCFLFYWQLDPTRLKSFDEDLLTLVEKVDKAILEQLLALLDARAILSLPSADDVLASLDGKVKPTGRTMPPSTANSPGPFAAGSLGPPLVVQVTVAASAPPSLPAQEVSISPPTMVTTPVSLVAFIIAAPSTIVTPLLSAGVTTTNALEMPPPSSSASSIPPLAILASASPSSSSHPNVSLDHVYSRDIDSMRSMGYRPEQRTPTSFMSSFDKNLIRSIGVQNETDSMTVFLQRSLVTLEENGQRHQEALSKMASLEAEVAKWRATARIVRRVKCPKVANAIVAFAEVVRSNHQLSSKVCDAFAKMLRIRPDGDKLVGRCWHLLRENNELVGKVESVAAEKDETSKVVADLQARLRENKSKLEEFELKASKERKTNKELEEELLDVKDGELLDEEEIVSTEEDAGEEQDLGGVGCKTDLGGFVGNGGVGDIRSSQCDFHLVEGLADQCAGISLCFVKPLIQGQGSPRENLGFNEFWTRDAFILGFDEAHQGRTLDLSSLWRCETHQGADHGFDDTLEKRDSPRVNLGFDESLEKQDSPRMDLGFNEPLEKRDSLRANLGFNKSLEKPDSPRSNLGFDEPLEMRDSPRIDLGADLGFDETFEKQNLPRSDLGFNEPLEKRDSPRVDLGFGEPLEMRDSPRTDLRFDEPLEMRDSLWANLGFDEPLEIRHSPRVDLRFGMPLEMQPGTSCYDPDQLGPSFPARGSFLTHFGLTTLGRQVEWFEYARKFFFSQTLGLVKPCAQGFKDDSVGCLYLIVGLGMFDKSHEVLDT

SEQ ID NO: 168287 - protein, 175 aa, Glycine max
  Coding DNA Sequence Number=SeqID_51509
MKKDNNRYLKALTGAMKGTMLEPQANLGADQKFSPKDAPLAFRLTLPLKVQVDFHDVNDKGASTSRPPFMVVYVGETRMVLGVNVLFPVMVVGGGLELFRGVSHLRPDHVLTIGGKRPRALGQWNDYNPYGVDYGHVEFVMTNIESCHYSEGMSSFFHGRTGYHSHDECTKTMIK

SEQ ID NO: 168288 - protein, 110 aa, Glycine max
  Coding DNA Sequence Number=SeqID_51510
MDLRIEGHVIWPVSSNMHHTFAIKHVLTTIAEYSVKPRLKRTTQKQLSNKPSDIDASRALFIEITEILGADTVIPDQSPSGFLFPLETPHSEGGLNDQPACTEGVCGNAA

SEQ ID NO: 168289 - protein, 101 aa, Glycine max
  Coding DNA Sequence Number=SeqID_51511
MLDESLEMKEAFELEEGMLAYVKTLSKEEHKKKLTEDAKLVSLVGALEQAMLRSLIEVFLVEVGDDVIEINPRSAPIRPRTKNTGCNKLGVELELKSQKCH

SEQ ID NO: 168290 - protein, 97 aa, Glycine max
  Coding DNA Sequence Number=SeqID_51512
MSQEVDMDYENKQECGVNQPPHVDCSEAFNTSQVFGTRDDVLLWAGSIAHENGFVAIIMRSGQYKCRKKEFVRRDTGSRKCGCPFKLRGKPVHGGEG

SEQ ID NO: 168291 - protein, 602 aa, Glycine max
  Coding DNA Sequence Number=SeqID_51513
  Gene Ontology: Mol. function=protein serine/threonine kinase activity; Cellular component=flagellin-based flagellum; Biological process=protein amino acid phosphorylation
  Homolog annotation: Hit_ID=Q93YF4; Match level="QueryCoverage=99%, HitCoverage=99%, E-value=0.0, Identity=72%"; Hit description=Calcium- dependent protein kinase 2
  Pfam annotation: Domain name=Pkinase; Domain location=127-383; Score =326.5; E_value=4.6e-95; Accession=PF00069.15; Description=Protein kinase domain
  Pfam annotation: Domain name=Pkinase_Tyr; Domain location=127-383; Score=-49.0; E_value=1.8e-09; Accession=PF07714.7; Description =Protein tyrosine kinase
  Pfam annotation: Domain name=efhand; Domain location=442-470; Score =42.1; E_value=1.8e-09; Accession=PF00036.22; Description=EF hand
  Pfam annotation: Domain name=efhand; Domain location=478-506; Score =26.0; E_value=0.00013; Accession=PF00036.22; Description=EF hand
  Pfam annotation: Domain name=efhand; Domain location=514-542; Score =33.2; E_value=8.9e-07; Accession=PF00036.22; Description=EF hand
  Pfam annotation: Domain name=efhand; Domain location=548-576; Score =42.0; E_value=2e-09; Accession=PF00036.22; Description=EF hand
  Pfam module annotation: Pfam domain module=Pkinase::Pkinase _Tyr::efhand::efhand::efhand::efhand; Domain location=127-383::127 -383::442-470::478-506::514-542::548-576
  Subcellular localization annotation: CTP_CleavageSite=49; ConfidenceScore=5.05e-01
MGNNCVGSRTSSKDVTNGCSNSSSFWWSRGHKKDASSHAHKSGNKKRTKAAETVQNKPPEMVKIEREDVKPPHESKETKPASEPTTTKEQQQAAKPKRPHNVKRLASAGLKTDSVLLRKTGNLKEFYNLGPKLGQGQFGTTFLCVEKISGKEYACKSILKRKLLTDEDVEDVRREIQIMHHLAGSPNVISIKEAFEDAVAVHVVMELCAGGELFDRIVERGHYTERKAAKLARTIVGVIESCHSLGVMHRDLKPENFLFVNQQEESPLKAIDFGLSAFFKPGEIFGDVVGSPYYVAPEVLRKRYGPEADVWSAGVIIYILLSGVPPFWGESEQDIFEAILHSELDFSSDPWPAISESAKDLVRKILVRDPTKRMTAYEVLRKILAYVPVRCHPWIHVDGAAPDKPLDSAVLSRLKQFYAMNKLKKMALRVIAQNLSEEEIAGLKEMFKMIDTDNSGQITFEELKVGLKKFGANLNESEIYDLMQSADVDNSGTIDYGEFIAATLHLNKVEREDHLVAAFAYFDKDGSGYITQDELQQACEEFGIGDVRLEEMIREADQDNDGRIDYNEFVAMMQKGNADLGKRVRKGSTSFRVGFREALPVC

SEQ ID NO: 168292 - protein, 34 aa, Glycine max
  Coding DNA Sequence Number=SeqID_51514
RGGFRNISVGDFAKDFSPFFDVLSFVLHRSSVFN

SEQ ID NO: 168293 - protein, 176 aa, Glycine max
  Coding DNA Sequence Number=SeqID_51515
EENFEAVEEAEEVWALKTELGKVRLSKEKFKLVATDVRKECVGLREENATTAKALEQKTMRARKEEHGRDKFREALWGNNSELKLRREERDRSQAHNMVLKEELAACSRSKRNLTQRLCETETNMLAIITKYQEELSLATTHERRVADEYAQVYAEKEARGRVIDSLHQEATMWMD

SEQ ID NO: 168294 - protein, 78 aa, Glycine max
  Coding DNA Sequence Number=SeqID_51516
MLRNFMDCAIMFSFDFRHITELHGLRNNGCQVPRSGQTRVASQQTDGPRTKLGYDKGHSCKHFWVTIPTSASLNVQQI

SEQ ID NO: 168295 - protein, 298 aa, Glycine max
  Coding DNA Sequence Number=SeqID_51517
  Gene Ontology: Mol. function=chitin binding; Cellular component =extracellular region; Biological process=chitin metabolic process
  Homolog annotation: Hit_ID=UPI000044A8F0; Match level="QueryCoverage =63%, HitCoverage=99%, E-value=4e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
YSSSPSERLHSLTFRGLHVLAFRELHALTSRGLHVLAFRGLHVLTFKGLHVLPFKGFHTFAFRGLHVLPLRGLYVLTIRGLHVLAFRGLHALFFKGLHVLAFRGLHALGFKGLHAVTFKGLHALAFRGLHVLTFIGLHALAFRGVHVLDFKGLHALAFRGLHALAIRGLHVLAFRGLHALAIRGLPALTFRGLHALSFIGLHICAFRELKLLCIPGQDFTQRPQCQSPPTEVSVGLCHDDIGIVPTRHPVDLEKSNRALGFPALVIGLCQSYWVPVPLARSLYRDRTRKTPSGPGEVQ

SEQ ID NO: 168296 - protein, 217 aa, Glycine max
  Coding DNA Sequence Number=SeqID_51518
  Homolog annotation: Hit_ID=Q8TGM5; Match level="QueryCoverage=18%, HitCoverage=61%, E-value=1e-07, Identity=70%"; Hit description =Uncharacterized protein ART3
PRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPPPSRRFSGLLTTSRAANRSRRRNLNTSPDHSIGRSDV

SEQ ID NO: 168297 - protein, 438 aa, Glycine max
  Coding DNA Sequence Number=SeqID_51519
  Homolog annotation: Hit_ID=Q9SJ62; Match level="QueryCoverage=53%, HitCoverage=52%, E-value=5e-39, Identity=41%"; Hit description =Expressed protein
  Pfam annotation: Domain name=TPX2; Domain location=223-279; Score =90.8; E_value=4.1e-24; Accession=PF06886.2; Description=Targeting protein for Xklp2 (TPX2)
EIQTKNEVSEAVVKVEGPKSAASKISKLAKEHGGKGGVASKNNKSATKDKPNLKSTTSSQTHRPNLSKSLSLPAKSAGGDGMKKSTNGTLAKPETKHANGAKAEASIRRLSRLTNSEVNSKEAKTNTGNSNQRTSLASMISLKTSELLFIDLLVHNFYPVYQSGISTPVNAVTKSLTSEESLPVDQISIPAKTEKPNKEEDDAHSTTSSHTPRRRSSGSGFSFRLEERAEKRKEFFSKLEEKIQEKEAEKTNQQEKSKENQEAEIKQLRKTMTFKATPMPSFYKEPPPKVELKKIPITRPKSPKLGRHKGSAVNKSADKSCSSPHGKQQQNDPTKAKAKGSNKEVISKKPIRKIQAKVQSQESAIRKTEKDSVKPTKVNQDAKAGTGNNEECHDPSVNNSEYQNDMELESKNELDQNVALVLNSSPPEIVSYEVAVGV

SEQ ID NO: 168298 - protein, 96 aa, Glycine max
  Coding DNA Sequence Number=SeqID_51520
MKSNSSFTIILGNLIRSIKVQNATDSAKVIPRRSLAILEENGQRHQKALSKVTSLEAEENGQRHQKTLSKVTSLEAEVTKWRVITRTVWRVKHPNT

SEQ ID NO: 168299 - protein, 369 aa, Glycine max
  Coding DNA Sequence Number=SeqID_51521
  Gene Ontology: Mol. function=zinc ion binding
  Homolog annotation: Hit_ID=Q2HT04; Match level="QueryCoverage=99%, HitCoverage=97%, E-value=2e-91, Identity=51%"; Hit description=Zinc finger, RING-type
MEGKTESHVTSAEAFVEGGVQEACDDACSICLEDFCKSDPATVSEKLPMSYVLATYQLEGYYKLYPFHHSQELLEAVELERSLRDTPSRNAAIFHHPALGDFELQHLPMAMNEADIEERIIQHLTAAAAMRRSHHLGQREGHRTRSSAHGRPHFLVYSTQPSAPPFAAGGESEPAAIPVGIPSTPLTFDGNEQSSPQQIPYFQTRGSSLTSGSTVATTNLQGVHSNDRRFASHSFPASQDRAQPSEQSFSDSLRSRFNAVSTRYKESISKGTRGWKERLFSPNSSMSELGSEVKRELNAKIASVSRLMERLETTRENNRAAGTSLSNPNHLVNCSIAETSNQNNVEARGENSLRDNSTPTTFSASSDSK

SEQ ID NO: 168300 - protein, 153 aa, Glycine max
  Coding DNA Sequence Number=SeqID_51522
  Gene Ontology: Cellular component=vacuole; Biological process =response to biotic stimulus
  Homolog annotation: Hit_ID=Q9SWS4; Match level="QueryCoverage=98%, HitCoverage=100%, E-value=3e-36, Identity=45%"; Hit description =Ripening related protein
  Pfam annotation: Domain name=Bet_v_I; Domain location=2-151; Score =159.2; E_value=1e-44; Accession=PF00407.9; Description=Pathogenesis -related protein Bet v I family
MVLKGKMVTELGIRSPAVKFFNVFAKQLHNLQDIVDKVYDGKLHEGDWHDTGSVKSWNLTTGKVRTFKESIEAIDEQSKSISFKIFDGENSKDYKMYKVHLQVIDIEEEGGVVTIWTIEYEKLNEDVAPPYHYLDIITATTKETDAHVLKAEQ

SEQ ID NO: 168301 - protein, 653 aa, Glycine max
  Coding DNA Sequence Number=SeqID_51523
  Gene Ontology: Cellular component=integral to membrane
  Homolog annotation: Hit_ID=Q2WBV9; Match level="QueryCoverage=15%, HitCoverage=11%, E-value=6e-13, Identity=40%"; Hit description =Hypothetical protein upg3
  Pfam annotation: Domain name=DUF408; Domain location=1-203; Score =141.4; E_value=2.5e-39; Accession=PF04181.3; Description=Domain of Unknown Function (DUF408)
MEKDKPVSVKDAVFKLQMSLLEGIQNEDQLFAAGSLMSRSDYEDIVTERSITNVCGYPLCSNALPSDRPRKGRYRISLKEHKVYDLHETYMFCCSNCVVSSKAFAGSLQAERCSGLDLEKLNNILSLFENLNLEPAENLQKNEDFGLSDLKIQEKTETSSGEVSLEQWAGPSNAIEGYVPKPRDHDSKGLRKNVKKGSKAGHGKPISDINLISSEMGFVSTIIMQDGYSVSKVLPGQRDATAHHQIKPTAIVKQLGKVDAKVVRKDDGSIQDLSSSFKSSLILGTSEKEEELAQSCEAALKSSPDCAIKKKDVYSVSISERQCDVEQNDSAKKSVQVKGKMSRVTANDDASTSNLDPANVEEKFQVEKAGGSLNTKPKSSLKSAGEKKLSRTVTWADKKINSTGSKDLCGFKNFGDIRNESDSAGNSIDVANDEDTLRRASAEACVIALSSASEAVASGDSDVSDAVSEAGIIILPPPHDAGEEGTLEDVDILQNDSVTVKWPRKPGISEADFFESDDSWFDAAPEGFSLTLSPFATMWNTLFSWITSSSLAYIYGRDESFQEEYLSVNGREYPCKVVLADGRSSEIKQTLASCLARALPTLVAVLRLPIPVSTMEQGMVLSGSQIGMEEYEVLKDLAVPLGRAPHISAQSGA

SEQ ID NO: 168302 - protein, 194 aa, Glycine max
  Coding DNA Sequence Number=SeqID_51524
  Gene Ontology: Mol. function=DNA binding; Cellular component=beta -galactosidase complex; Biological process=DNA integration
  Homolog annotation: Hit_ID=Q1SS89; Match level="QueryCoverage=99%, HitCoverage=25%, E-value=6e-84, Identity=70%"; Hit description =Integrase, catalytic region
MKNLDGLKYFFGIEVARSQRGIFLSQRKYVLDLLIEIGLLDCKPTNTSIVHNHKLSQYTDQVLVDKGSEKHMNAGNQILRYLKSSPGKGLMFPKNNHLSVEGYTNADWARNVLDRKSTSGYFTFVGGNLVTWRSKKQKVVALSSAEAEFRGMAKGFCELLWLRRLLMEIGFGASMEMNLFCDNKVAIDISKNPV

SEQ ID NO: 168303 - protein, 717 aa, Glycine max
  Coding DNA Sequence Number=SeqID_51525
  Gene Ontology: Mol. function=nucleic acid binding; Cellular component= beta-galactosidase complex; Biological process=DNA integration
  Homolog annotation: Hit_ID=Q1SS89; Match level="QueryCoverage=43%, HitCoverage=44%, E-value=5e-93, Identity=68%"; Hit description =Integrase, catalytic region
MVDSSVIGDSMKQPLNASAVDSILENLMAKMAEVLSKAQSTSQSSFSDSSTIPISIKLDGSNYALWSQVAEMYILGKDKLGYIDRSFPPPMETAKGVWDSIATTYFDGSDTSQVYDLRHKRIQQVVVVIATKGSKFGKLPTLVAGKHNSVLKSKGPSDGGKCTHCGNVRHTRDTYFKLHGYPKWWHELQAKKKKDTTTPEEGTGKAVVVTTESQLSLCPMTSSSTSMKPGNCGKVFCSSNSLDASAWIIDSRATNHMTFDPMDFSYSTPPRRTFIVNAVAYPVTSVGTMALSPSLSLSHILLDVLNKKIIGCGTKRRGLYYLDDFSKGEAHHVHHQSNNKEQEYGCCIVTCILAKSHRTSYHMSLNKSSVPFALIHSDVWGPSLGTIVSGHCWFVIFVDNCTRMTWLYLIKTKDEGSLLTIVSKHTPNNMVSFTRPHAHKLHNRMVLSNGKIIISWRQHLPIVLMLQPRIFVHLHKNQCTKLDACAIRCLFLGYGLHKKGYKCLDPTTNKTYITMDIVFLESESFFSLMVSNSTFYGEFMNKELNWYLVVPSSIVEKKQIGEHESKVEGVIHDEPIEMQHLNITEVESEEDPLTNEGTASEEVPVNEDYIDQGSQEPPLSIISDPLIENNPKVSSPTISSSTYSPRYVLLVRNNQGKPPNRYCPDVEERRSKYPIANYVSTQHLSKPIQSFTMTLFCCHIPKNVEEALADPKWAQAI

SEQ ID NO: 168304 - protein, 81 aa, Glycine max
  Coding DNA Sequence Number=SeqID_51526
  Homolog annotation: Hit_ID=Q94A28; Match level="QueryCoverage=73%, HitCoverage=3%, E-value=3e-09, Identity=92%"; Hit description =Aconitate hydratase 3, mitochondrial precursor
MARTDSHTTIIDGLGVAGWGVSGIEAEAAMLGQTCVVLAIGELIVRNIYLSHIFAAHDHGPTRILVAVLIVYERVGGCFGA

SEQ ID NO: 168305 - protein, 32 aa, Glycine max
  Coding DNA Sequence Number=SeqID_51527
MTSVPMAERLTCYSNNDGVEGDDALPMQGLQQ

SEQ ID NO: 168306 - protein, 92 aa, Glycine max
  Coding DNA Sequence Number=SeqID_51528
MSKTPKEKDAEEPLPDHLWCGRTDRRQWRCRRGRHHQYKKKVPKSLKLQCKRKSNNNKEGEPKPNNNNNVLKDNVESNARRTSRIMKKKHML

SEQ ID NO: 168307 - protein, 299 aa, Glycine max
  Coding DNA Sequence Number=SeqID_51529
  Homolog annotation: Hit_ID=Q1SHY8; Match level="QueryCoverage=95%, HitCoverage=61%, E-value=4e-47, Identity=47%"; Hit description=WD40 -like
  Pfam annotation: Domain name=WD40; Domain location=205-243; Score =38.6; E_value=2.1e-08; Accession=PF00400.22; Description=WD domain, G-beta repeat
  Pfam annotation: Domain name=WD40; Domain location=246-284; Score =1.7; E_value=23; Accession=PF00400.22; Description=WD domain, G-beta repeat
  Pfam annotation: Domain name=WD40; Domain location=86-201; Score=9.4; E_value=2.9; Accession=PF00400.22; Description=WD domain, G-beta repeat
  Pfam module annotation: Pfam domain module=WD40::WD40::WD40; Domain location=205-243::246-284::86-201
MDVFFDSVDSLSTQDSVLAKEEFGSGRCGYDEIWVKEPVSVKERRERFLQGLGLADSSSKVCSQEKMNLDDSSISLGLERIRECSGAISNACILHTDQVVSEKLILSGGKAASKEKISLDEFKGCPQDEAEANIQGKEHEFSSTAEEHRPREAVSQEEFQDFDMSKRKRKNWWKRFVNIRKSGEGNILLSSSMDKTVRLWQIGCNQCLNVFHHNDYVTCIQFNPVDENYFISGSIDGKVRIWGIREERVIDWADIRDAISAISYQQDGKGFVVGSVTGTCCFYVASGMHLLFNKYYQLL

SEQ ID NO: 168308 - protein, 178 aa, Glycine max
  Coding DNA Sequence Number=SeqID_51530
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=87%, HitCoverage=69%, E-value=3e-39, Identity=51%"; Hit description =Transcription factor, MADS-box
  Pfam annotation: Domain name=SRF-TF; Domain location=25-75; Score =68.7; E_value=1.9e-17; Accession=PF00319.9; Description=SRF-type transcription factor (DNA-binding and dimerisation domain)
MESNNMPDLNGVAKKTKGRQKIEMKKMRNESNLRVTFSKLRTGVFKKASELATLCGMDVAVIMFSPSNRVFSFGSPSVDSVVQRYKTQGPPPLLTLDLNKVHSTVDEVELHAHLHCLSNQIAIEKKRTKDLNHLAKAAEDQFWWARPIESMTDSQLDKYKKMLEEFKRQLKEKRGNLN

SEQ ID NO: 168309 - protein, 299 aa, Glycine max
  Coding DNA Sequence Number=SeqID_51531
  Gene Ontology: Mol. function=uridylate kinase activity; Cellular component=cytoplasm; Biological process=pyrimidine nucleotide biosynthetic process
  Homolog annotation: Hit_ID=Q9LSA9; Match level="QueryCoverage=84%, HitCoverage=74%, E-value=1e-126, Identity=90%"; Hit description =Similarity to uridylate kinase
  Pfam annotation: Domain name=AA_kinase; Domain location=58-268; Score= 204.3; E_value=2.8e-58; Accession=PF00696.18; Description=Amino acid kinase family
  Subcellular localization annotation: CTP_CleavageSite=65; ConfidenceScore=5.57e-01
WAIQPPTPPVSPFAPLIPKWALPLSPSISVVGRKPGIPSMSHLRLSMNESSKPSFKWRRVLLKVSGEALAGDHSQNIDPKITMAIAREVAAVTRLGIEVALVVGGGNIFRGSSWAGSSGLDRSSADYIGMLATVMNAIFLQATMESIGIPTRVQTAFRMSEVAEPYIRRRAVRHLEKGRVVIFAAGTGNPFFTTDTAAALRCAEINAEVVLKATNVDGVFDEDPKRNPQARLHETLTYQEVTSKDLSVMDMTAITLCQENNIPVVVFNLNKPGNIEKAIKGERVGTLIGATWNSTVSRT

SEQ ID NO: 168310 - protein, 77 aa, Glycine max
  Coding DNA Sequence Number=SeqID_51532
MLTSPGKVQMKMLVTACYRALSLTDSKWVCMGYRIGRLRVPMDSQVTIAKSGVVDKSEAFAPTYPQFMMRNSDQRSC

SEQ ID NO: 168311 - protein, 208 aa, Glycine max
  Coding DNA Sequence Number=SeqID_51533
  Gene Ontology: Cellular component=nucleus; Biological process=defense response
  Homolog annotation: Hit_ID=Q8LGD5; Match level="QueryCoverage=98%, HitCoverage=92%, E-value=3e-27, Identity=43%"; Hit description =Protein MKS1
  Pfam annotation: Domain name=VQ; Domain location=68-98; Score=42.3; E_ value=1.7e-09; Accession=PF05678.4; Description=VQ motif
MNPPEFPSAAAGTSSPPGKKELQLQGTRPPPLRVSKDSHKIRKPPLPPTAHQPAPPPPPEQRKPVIIYTVSPKVLHVTVSDFMNVVQRLTGPSSGAEPNLRAGDVSPAARLASIERTSPSEREKVRSEDNDVTLMLEGVEVGQFPGILSPATLPPISPGFFSESQTTSFWNDLSPFWSTTSFIASPSGLFPGNVMSPLPSPDIFNLFY

SEQ ID NO: 168312 - protein, 243 aa, Glycine max
  Coding DNA Sequence Number=SeqID_51534
  Subcellular localization annotation: CTP_CleavageSite=38; ConfidenceScore=5.25e-01
MSTQSSSVSNVFRHSSSLLSCCQGPPNFLGCAVTYQFLAAFRVDRNLIEVPSLYHRQWTSHYPPYVLFDYNGDKHFIKLRKFGNRYYFSDGLKDFRRTMGIHKGVMVSFAAPDKNWSFHLHFIPPLHRQTCGRPPTITRTHVFTVDVSHCMISRPYPLFLPLDALNSVNASTKYITVQCSSGRHHLWKISMHNGLQSLAGPWYQFLTENDLMAGDEVMFYYQPNHVWEVLFRKQLTWHEDESS

SEQ ID NO: 168313 - protein, 66 aa, Glycine max
  Coding DNA Sequence Number=SeqID_51535
MSTGTKILFDQLTEDAMKLMENDVYHEKQEVFDREAAKYLPMHAVDFTNIFKMALTGLKLNLKTTK

SEQ ID NO: 168314 - protein, 80 aa, Glycine max
  Coding DNA Sequence Number=SeqID_51536
  Gene Ontology: Mol. function=protein serine/threonine kinase activity; Biological process=protein amino acid phosphorylation
  Homolog annotation: Hit_ID=Q6QA01; Match level="QueryCoverage=91%, HitCoverage=17%, E-value=2e-18, Identity=77%"; Hit description=CDPK -related protein kinase
MKRFLLRLTGEVLTSIAKDRLVTSDGSVNMREIMARLSDTPMLWISRWFTKRKVLFIGDGALCWRRAVSQIREAWMVFGI

SEQ ID NO: 168315 - protein, 45 aa, Glycine max
  Coding DNA Sequence Number=SeqID_51537
MYVGIDKWRSSMAATPTDVDDSGDGEVFEEMAVDDQGRCCHRVQS

SEQ ID NO: 168316 - protein, 115 aa, Glycine max
  Coding DNA Sequence Number=SeqID_51538
MEREWGEEEGVGLQGRKKREKGRKEKKNQKREREGGKKMDLKREIQNLIGFLTIPRVMNELCGSASLFGNVVFPSLATQQLQGRQAARDIMSQQGHVFTTKKKSFQHRPINIGYS

SEQ ID NO: 168317 - protein, 156 aa, Glycine max
  Coding DNA Sequence Number=SeqID_51539
  Gene Ontology: Mol. function=nucleotide binding
  Homolog annotation: Hit_ID=Q33AG5; Match level="QueryCoverage=20%, HitCoverage=5%, E-value=5e-07, Identity=68%"; Hit description=ATPase, histidine kinase, DNA gyrase B-, and HSP90-like domain containing protein, expressed
MSLLPKTEQNDVPVVDIDSDENGVAAVAPAKNDASSHKTPSPQVELVQQETPASGSALSASDGLSRSFWKAGDYVVGPSSKPTPFQGPKVNPYSSFSSKPCYSSIPVTVFTPIAGHLEHARVHPKFLHSNATSHKWAFGGVVSLALLCLNKFWDLI

SEQ ID NO: 168318 - protein, 106 aa, Glycine max
  Coding DNA Sequence Number=SeqID_51540
  Gene Ontology: Mol. function=transporter activity; Cellular component= membrane; Biological process=oligopeptide transport
  Homolog annotation: Hit_ID=Q96400; Match level="QueryCoverage=59%, HitCoverage=10%, E-value=4e-19, Identity=70%"; Hit description =Nitrite transporter
MSVGLFEFLYDQSPESMRSSATALYCIVIALGSYAGTFVVTLVHKYSGSKERNWLPDRNLNRGRLEYYYLLPLEEIAEVSMEKDLELEQANSKVSCVNSKDGGDAE

SEQ ID NO: 168319 - protein, 100 aa, Glycine max
  Coding DNA Sequence Number=SeqID_51541
  Gene Ontology: Mol. function=transporter activity; Cellular component= membrane; Biological process=oligopeptide transport
  Homolog annotation: Hit_ID=Q96400; Match level="QueryCoverage=52%, HitCoverage=8%, E-value=1e-15, Identity=79%"; Hit description =Nitrite transporter
MRLYGEKEKGSNQLIDKRSNSNGPKAASKGLSNESTKKRGEATRSNKDCENVGGRYQWHVQHLGKYRLTRPYQYIIVVRISYSGTDSGEKEGPPRPFVYI

SEQ ID NO: 168320 - protein, 87 aa, Glycine max
  Coding DNA Sequence Number=SeqID_51542
VIAEGFLVNLRMNGTKRRSYTMTPVIMVTMSKIPDEEIGRILMMDFSSSTLCTVANFHKFGGAFGSLASSPVTIAALSNHLWIHIEH

SEQ ID NO: 168321 - protein, 152 aa, Glycine max
  Coding DNA Sequence Number=SeqID_51543
  Gene Ontology: Mol. function=transporter activity; Cellular component= membrane; Biological process=oligopeptide transport
  Homolog annotation: Hit_ID=Q96400; Match level="QueryCoverage=86%, HitCoverage=22%, E-value=3e-43, Identity=60%"; Hit description =Nitrite transporter
MTKNGVASRKWNLFNWYFFSLGLASLSALTIVVYIQDNTGWGWGFGIPTIVMLVSIIAFVLGSPLYKTEKPEGSPLVRLAQVIVAAIKKRNETLPSDPKFLYQDRDLDAAICLEGRLLHTDQFKMVNPECKITFRNALPFLASGIIIPEKEC

SEQ ID NO: 168322 - protein, 289 aa, Glycine max
  Coding DNA Sequence Number=SeqID_51544
MAESTCSKSAMERLEEALAKLASNVTKKLDDFLLRVASLETNTHHSPSLSSSSAIPTPNPQTLSQPKMKLNLPQFDGSNPSACFAHSPYKDPTGLLFKLTQKGTVRDYLNQFEALTNRIVGLPPPFLLSCFVSGLDPEIRREVQALQPMSLVHATGLARLQEEKLLEGRKGPRSRLSPMLNPSSHPSPFSILILVQWKGLFPEDTTWKKWEELKENYNLEDKVVLDVRGDVMEGEQNMEHYVATKQNTKSKDAEEAAKTEHAEEPNKEECRKSKREMNKPQYLEDYALK

SEQ ID NO: 168323 - protein, 51 aa, Glycine max
  Coding DNA Sequence Number=SeqID_51545
MSAKTAKDELQKSIADMEIEKSEVAVKEETRKRQHRRGGIRTLPFILVHDD

SEQ ID NO: 168324 - protein, 50 aa, Glycine max
  Coding DNA Sequence Number=SeqID_51546
  Homolog annotation: Hit_ID=Q96400; Match level="QueryCoverage=71%, HitCoverage=5%, E-value=9e-09, Identity=80%"; Hit description =Nitrite transporter
MTQIVESEKERMRNQFIDERSDNNGPKSASKGVSNESSKERSEARSSIKV

SEQ ID NO: 168325 - protein, 387 aa, Glycine max
  Coding DNA Sequence Number=SeqID_51547
  Gene Ontology: Mol. function=transporter activity; Cellular component= membrane; Biological process=oligopeptide transport
  Homolog annotation: Hit_ID=Q96400; Match level="QueryCoverage=96%, HitCoverage=61%, E-value=1e-157, Identity=70%"; Hit description =Nitrite transporter
  Pfam annotation: Domain name=PTR2; Domain location=1-295; Score =167.2; E_value=4.2e-47; Accession=PF00854.12; Description=POT family
MGWGWGLGIPTIAMLISIIAFVLGSPLYKTVKPHGSPLVRLTQVVAAAIKKRREALPEDDKLLYQNWELDAAISLEGRLLHSDQFKCLDKAAIVTNEEGSDPNAPPNLWKLATVHRVEELKSMVRMLPIWASGILLITASSNQQSFVIQQARTMNRHLSHSLQIPPASMSIFNVLTMMVGVVLYERLFVPFAFRLTKNPSGITCLQRMGVGFVVSIFATLVSALVEIKRKSVAAKYNLLDSPNATIPISVFWLVPQYCLHGVAEVFMVVGHLEFLYDQSPESMRSTATALYCITTAIGNYVGTLLVTLVHKYSGNERNWLPDRNLNRGRLECYYFLISGIQVVNLIYYLICAWFYTYKPLEEIGDINKQEDMEKDIEKIKHVNLLEG

SEQ ID NO: 168326 - protein, 50 aa, Glycine max
  Coding DNA Sequence Number=SeqID_51548
MSDMDTVENSIRGNGEIAEKEEHQHHTSKTEHRRGGIRTLPFILGSPRES

SEQ ID NO: 168327 - protein, 57 aa, Glycine max
  Coding DNA Sequence Number=SeqID_51549
MEEKEEKEIGKRYTDLCLLGGLMVHVGLRREEDVDMLSGTLRLLHLIEENQTFRYHP

SEQ ID NO: 168328 - protein, 155 aa, Glycine max
  Coding DNA Sequence Number=SeqID_51550
GLSTSISSPPDLPPNLKIISGRRLLPKVLPLCFAPAKETEKDPYLIPRVLLRQLPVEVQSIEDEYMEAPMKKEEAYISGLFFSPVTSAKERRLPRVEIDPGASINVMPLRALADLGMNSYEPAKSDQGYYSGVQCRLAAIGKIRLLCVPNMGSED

SEQ ID NO: 168329 - protein, 165 aa, Glycine max
  Coding DNA Sequence Number=SeqID_51551
MEQTNYTNKYLQVLGESIITKKISKQKSPEESQSNIPIEKPLFIPFKISDKAKQKIRELRKNKSLIEGVGENNSELLNKLDSLLIVIPETPQPSEGTSRMVTRSTSKLINVINENSDQNSKNAVEAKLHDESRMIQRCLDDNKGDDKKLKGQSKNEFKKDRIKKE

SEQ ID NO: 168330 - protein, 247 aa, Glycine max
  Coding DNA Sequence Number=SeqID_51552
MGTRGCISYNPVLAIRQLGYPMRGAPLEEEIVPVRKAWGVVQKKDKELRGSGPIGGYREWLKAHVQGLDWLPSLRTAKREEVEAPEEDEEENAELRDVNVATTKALEQKTKRARREEHGRNKFRGALWGSNNELKLWREERDQSRVDSLILKDELKACSRSKRSLSQRLCETETNMLAIITKYQEELSLATAHEHRVADEYAQVYAEKEARGWVIDSLHQEATMWMDRFSLTLNGSQELSRLLAKAK

SEQ ID NO: 168331 - protein, 58 aa, Glycine max
  Coding DNA Sequence Number=SeqID_51553
MPRWHKHASQMNETAPRKLPSKRSRKDKAVEGTSSAPEYESHRFRSAVHQQRFEAIKG

SEQ ID NO: 168332 - protein, 178 aa, Glycine max
  Coding DNA Sequence Number=SeqID_51554
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=86%, HitCoverage=65%, E-value=3e-39, Identity=51%"; Hit description =Transcription factor, MADS-box
  Pfam annotation: Domain name=SRF-TF; Domain location=25-75; Score =74.4; E_value=3.6e-19; Accession=PF00319.9; Description=SRF-type transcription factor (DNA-binding and dimerisation domain)
  Subcellular localization annotation: CTP_CleavageSite=47; ConfidenceScore=5.05e-01
MESNNMPDLNGVAKKTKGRQKIEMKKMRNESNLRVTFSKRRTGVFKKASELATLCGVDVVVIMFSPGNRVFSFGSPSVDSVVQRYKTQGPPPLLTLDLNKVHSTVDEVELHTHLHCLSNQIAIEKKRTKDLNHLAKAAEDQFWWARPIESMTDSQLDKYKKMLEDFKRQLKEKRGNLN

SEQ ID NO: 168333 - protein, 553 aa, Glycine max
  Coding DNA Sequence Number=SeqID_51555
  Gene Ontology: Mol. function=enzyme inhibitor activity; Cellular component=cell wall; Biological process=cell wall modification
  Homolog annotation: Hit_ID=Q9FXW9; Match level="QueryCoverage=90%, HitCoverage=87%, E-value=1e-175, Identity=60%"; Hit description =Pectin methylesterase-like protein
  Pfam annotation: Domain name=PMEI; Domain location=40-190; Score =81.4; E_value=2.8e-21; Accession=PF04043.6; Description=Plant invertasepectin methylesterase inhibitor
  Pfam annotation: Domain name=Pectinesterase; Domain location=236-542; Score=601.9; E_value=5.9e-178; Accession=PF01095.10; Description =Pectinesterase
  Pfam module annotation: Pfam domain module=PMEI::Pectinesterase; Domain location=40-190::236-542
  Subcellular localization annotation: CTP_CleavageSite=60; ConfidenceScore=5.33e-01
MVASLFYLSLSLSLILTLSSAAHHKPPHSPSKPPANPAVTAASPAIEQACAATLFPQQCEASLSQSQNLPPNPTPLQLLQSAIALSSDNLATAQTMAKSLLDASADSRNRTVAAATCIEILANSHHRISLASDALPRGRTKDARAWLGAALAYQYDCWNSLKYANDTQMVGKTMSFIDNLEILSSNALSMAFSFDAFGNDIASWKPPATERVGFWGTVGSGGPGPAGGVPLNLTPDVTVCKNGGDGCYKTVQEAVNAAPDNGNRTKRFVIHIKEGVYQETVRVPLAKRNVVFLGDGIGKTVITGDANVGQQGMTTYNSATVAVLGDGFMAKDLTIENTAGPDAHQAVAFRLDSDLSVIENCEFLGNQDTLYAHSLRQFYKSCRIEGNVDFIFGNAAAIFQDCQILVRPRQVKPEKGENNAITAHGRTDPAQPTGFVFQNCLINGTEEYMTLYHSKPQVHKNYLGRPWKEYSRTVFINSFLEVLVTPQGWMPWSGDFALKTLYYGEFESKGPGSYLSQRVPWSSKIPAEHVLTYSVQNFIQGNDWIPSIGSPSS

SEQ ID NO: 168334 - protein, 119 aa, Glycine max
  Coding DNA Sequence Number=SeqID_51556
MADWRSWRGVGFGGRFWDWEREASHCCGKSVAAQACSIAGEAAVTAGLAGGLDGEWGGLWCAAEERVRMRERERESSIWWLWFLSRDRGLRNGVTDGNGSGRHHEMVLEMSECDVDYDL

SEQ ID NO: 168335 - protein, 580 aa, Glycine max
  Coding DNA Sequence Number=SeqID_51557
  Gene Ontology: Mol. function=transferase activity, transferring hexosyl groups; Biological process=carbohydrate biosynthetic process
  Homolog annotation: Hit_ID=Q5BMA3; Match level="QueryCoverage=99%, HitCoverage=90%, E-value=0.0, Identity=76%"; Hit description =Secondary cell wall-related glycosyltransferase family 8
  Pfam annotation: Domain name=Glyco_transf_8; Domain location=251-463; Score=213.1; E_value=6.4e-61; Accession=PF01501.10; Description =Glycosyl transferase family 8
MTICGTYVTLLYSPKVYNNNHLSSSGSGPNFVNRWIWDGLDPRYVSNVDINWGDILQITAKLTGKKEFQGVGLVNFNNTELDHWEQLIPNATHVVLELEYAAKNVTWESLYPEWIDEEEETEVPVCHSLPSLRSPGIRLNLIAVKLAHVNGGNWSRDVARLHLQLAVARLATSFKGNYPVYVLFVTNFFPIPNLFTCKELVGHEGDVWLYKPNLKVLGEKLHLPVGSCELALPLRGKELSYVGNVRREAYATILHSAHVYVCGAIAAAQSIRMSGSTRDLVILVDETISEYHRSGLEAAGWKIRTIQRIRNPKAEKDAYNEWNYSKFRLWQLTEYDKIIFIDADLLILRNIDFLFGMPEITATGNNGTLFNSGVMVVEPSNCTFKLLMDHINEFESYNGGDQGYLNEIFTWWHRIPRHMNFLKHFWVGDEEEKKQMKTLLFGADPPILYVLHYLGMKPWLCFRDYDCNWNSDIFHEFASDVAHGRWWKVHDAMPELLQQFCMLKSKQKAQLEWDRRQAEIANYTNGHWQIKVKDKRLKKCIDNLCSWENMLKHWGETNWTDDESYTPTPPAISTSSLSDL

SEQ ID NO: 168336 - protein, 143 aa, Glycine max
  Coding DNA Sequence Number=SeqID_51558
METKTITERVPSDQGRKSQGPVGPLRVQRVPSGRRPCKQINGVSNYLGHANSHPCQDGVHHLALRQRERHPYLSQSSHAGAHNPHPPPRSGLGKVLHNSWAIASSSKPEAWSLLWLNSHRWFSSKISGWPRNWLRASVPKGIH

SEQ ID NO: 168337 - protein, 78 aa, Glycine max
  Coding DNA Sequence Number=SeqID_51559
  Subcellular localization annotation: CTP_CleavageSite=33; ConfidenceScore=5.05e-01
MASFVVTATKLGLMAFQRLWKQDSYIGSRMLISIASFWSLSRPRNSRTMNNEAGDILPKCALKLPSFENCCVQFGKYT

SEQ ID NO: 168338 - protein, 262 aa, Glycine max
  Coding DNA Sequence Number=SeqID_51560
  Gene Ontology: Mol. function=pectinesterase activity; Cellular component=cell wall; Biological process=cell wall modification
  Homolog annotation: Hit_ID=Q96497; Match level="QueryCoverage=75%, HitCoverage=64%, E-value=3e-76, Identity=58%"; Hit description =Pectin methylesterase
  Pfam annotation: Domain name=Pectinesterase; Domain location=12-241; Score=212.9; E_value=7.1e-61; Accession=PF01095.10; Description =Pectinesterase
  Subcellular localization annotation: CTP_CleavageSite=42; ConfidenceScore=5.43e-01
QQYGARDPSLHSGIQTRKIILTKTGVPRRCRRPLTPRQITLTAMTVITGNANVGQQGMTTYNSAAVAVLGDGFMAKDLTIENTGGPEAHHRSDSNQDTLYPHSLRQFYKSCSIEGNVDFIFGNAAAIFQDCQILVRPRQVKPEKGENNAITANARQDPAQPTGFVFQNCSINGTEEYMALYHSKPQGWMPWSGDFALKTLYYGEFENKGPGSYLSQRVPWSRKIPAEHVLTYSVQNFIQGNDWVPSPVGSPTDHSKFGAITK

SEQ ID NO: 168339 - protein, 139 aa, Glycine max
  Coding DNA Sequence Number=SeqID_51561
  Gene Ontology: Mol. function=sequence-specific DNA binding; Cellular component=nucleus; Biological process=regulation of transcription, DNA-dependent
  Homolog annotation: Hit_ID=Q1SEL3; Match level="QueryCoverage=84%, HitCoverage=69%, E-value=2e-14, Identity=31%"; Hit description =Transcription factor, MADS-box
MESNNMPDLNGVAKKTKGRQKIEMKKMRNEYFQESHPSVDSVVQRYKTQGPPPLLTLDLNKVHSTVDEVDLHTHLHCLSNQIAIEKKRTKDLNHLAKAAEDQFWWARPIESMTDSQLDKYKKMLEEFKRQLKEKRGNLN

SEQ ID NO: 168340 - protein, 408 aa, Glycine max
  Coding DNA Sequence Number=SeqID_51562
  Homolog annotation: Hit_ID=Q9LIH5; Match level="QueryCoverage=22%, HitCoverage=13%, E-value=2e-11, Identity=41%"; Hit description =Arabidopsis thaliana genomic DNA, chromosome 3, TAC clone:K24M9
  Pfam annotation: Domain name=zf-CCCH; Domain location=144-169; Score =15.7; E_value=0.011; Accession=PF00642.15; Description=Zinc finger C- x8-C-x5-C-x3-H type (and similar)
  Pfam annotation: Domain name=zf-CCCH; Domain location=89-114; Score =24.5; E_value=0.00037; Accession=PF00642.15; Description=Zinc finger C-x8-C-x5-C-x3-H type (and similar)
  Pfam module annotation: Pfam domain module=zf-CCCH::zf-CCCH; Domain location=144-169::89-114
MGFSCEEPVSGRKGSNKDDIANTNYGVWDATNAQDTDGSYNMQISPGLDEDYKNKCNQSLKDGCSKLFRSRSRSPPRSFRWDSGRVGGLTQPYCRDFVAGKCRRGNRCRFLHHDDQNYGNSWENRHIYSAPNENNNYSRTIGRSYNRTCFHYAQGRCKMGASCKYVHHDNFDRRRTESCLEQGVQHGSNQNRLHGESTFSSDIKKSNWAAKNDSANVHTSQTVGADIWLDNEKMSPPNWIYDVRSSIHINQEQGQSKQQVAPGQVLHQNVSKTFIKPEPVVRFPKQRDPTCNSREQKNVNATGGVSLAYFPNRQLVKNEHPVQLKGIHTFKFSLVEFVKELLNPTWKDGKITKEDYKAIVKKVTDKVIDTVQGAHIPQTQEKIDCYLSSSKSKLNKLVQAYVEKFQKA

SEQ ID NO: 168341 - protein, 259 aa, Glycine max
  Coding DNA Sequence Number=SeqID_51563
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=19%, E-value=6e-65, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNGNGGFNTHLPVFDGKNWSRWSIQMRVLFEAQDVLEFVNDGVPDLAENATEAQRNLHREKKKKDQKALFYIHQCVDAKIFEKIAESTTAKAAWDTLVRCYGGDATVKKVKLQSLRKQYENLNMKHNEKVADYVSRIITVTNEMKTCGETISEQMIVEKVLRSLTAQFDYIVVAIEQSKDTSTMKIDELQGSLEALELRVIERGNGKETDQALQAASKEKWREIKKKQWLDKKAKQNPNSSDKDKGKSLADKAESSNKG

SEQ ID NO: 168342 - protein, 157 aa, Glycine max
  Coding DNA Sequence Number=SeqID_51564
MWIIICDSSKHVDQPKYPSRSTYLQWCRSTRKGNGAYLDGGWWMVAKIFMATSSMHLMKASSRQRWWVKKKRKLNCWYDLLEKKDFGAECFTLSENKRSFCYFNKVNMTSNNSNVGSGSGDVVASGSGSGLVSSSIPNENTAPLWNYVTKLDKSGEV

SEQ ID NO: 168343 - protein, 301 aa, Glycine max
  Coding DNA Sequence Number=SeqID_51565
  Homolog annotation: Hit_ID=Q1RWU1; Match level="QueryCoverage=17%, HitCoverage=14%, E-value=4e-08, Identity=45%"; Hit description =Resistance-like protein HAAS-2-related
MVKTRGLDHALGRVGARGLGKGGDGDDIDGAPLRQRPTASARRRRVPVILDDDVPVVPADSPAVPEAEAVVAGDEPMVDAAAQDTGAETNTQDTGAETNGDEPVGFHGGPRDLSVLTEYADHVAGSVWSGQERLELKLCSHGRKVHNLGGPVPVIENMVTGTRLSSLIAFHLPVGEVSITLDNVASLLYLPIVGTFHDFQPLCTDEAVVLLVELLMVSAEVAMAETGQYGGPYAFHDLTLVGRYAWGAAGLVYMYDQLNDASLNTSRQLVGYITLLQCWIYEHFPSIAECNANPDYDEVSP

SEQ ID NO: 168344 - protein, 88 aa, Glycine max
  Coding DNA Sequence Number=SeqID_51566
MAKEIEGLVEEKEIVPGRAHRPPSSPCSTGNRGHHLAVLNGSLNSKASHFSNNGAMSTTDWEVFLEMMRLQPSAPTTTDIVIITDTDK

SEQ ID NO: 168345 - protein, 462 aa, Glycine max
  Coding DNA Sequence Number=SeqID_51567
  Gene Ontology: Mol. function=aldehyde dehydrogenase [NAD(P)+] activity; Cellular component=chloroplast; Biological process =aldehyde metabolic process
  Homolog annotation: Hit_ID=Q1S9R3; Match level="QueryCoverage=99%, HitCoverage=99%, E-value=0.0, Identity=79%"; Hit description =Aldehyde dehydrogenase
  Pfam annotation: Domain name=Aldedh; Domain location=3-416; Score =105.3; E_value=1.8e-28; Accession=PF00171.12; Description=Aldehyde dehydrogenase family
MDIGGEVEETVRELRQYFKTGKTKSVTWRKNQLTALLDLVHENEDAIFKALHQDLGKHPVEAYRDESDIPFLFFPAKGEVLSEPLGVVLIFSSWNFPIILTLDPIIGAISAGNVVVIKPSEQSPASSSFLATTIPRYLDSNAIKVIEGGPDVCEQLLLQKWDKIFFTGSPRVASVVMSAAAKNLTPVTLELGGKCPAILDSLPNPLEFKLAVKRIVGGKWGPCSGQACIAIDYLLVEKKFSYALIELLKKIIRRFYGENPVESKVISRILNKQHFERLCNLLKDPLVAASIVHGGSVDEENLFIEPTILLDPPLDSQIMSEEIFGPLLPIITMDKIQESIEFINAKPKPLAIYAFTKDETFKRNILSETSSGSVVFNDTMVQFLCDTLPFGGVGQSGFGRYHGKYSFDTFSHEKAVMHRKLFLEIEPRYPPWSKFKLEFIRLAYRLNYFGLLLHMLGLKRYK

SEQ ID NO: 168346 - protein, 75 aa, Glycine max
  Coding DNA Sequence Number=SeqID_51568
MKTEGRKETNSFAVVAASIAAETNSFAVVAASATMLASIATTQLGGKRKKEGTKWEKGQEGLSAQGPKLIRVFNL

SEQ ID NO: 168347 - protein, 598 aa, Glycine max
  Coding DNA Sequence Number=SeqID_51569
  Gene Ontology: Mol. function=DNA binding
  Homolog annotation: Hit_ID=Q1S9R4; Match level="QueryCoverage=99%, HitCoverage=94%, E-value=5e-96, Identity=37%"; Hit description =Forkhead-associated
  Pfam annotation: Domain name=FHA; Domain location=526-594; Score =23.1; E_value=0.001; Accession=PF00498.16; Description=FHA domain
MEPWLPQDDFLLKNAIEGGASLESLAKGAVRFSRRFSVTELRDRWQALLYDPDVSAAARAAMANLELTKYGGGTGTGEGGGGKKRNSESIRKHYSAMQKRLRRCRHGVAGSDAKNATEGCDGFSLPDMPVNVEGKSHGLEGRVNLKGECGNGVLRLNAPNAVLRDDAKNDLKCLFNLANEDEVVFMDLVRKEVLAADKDKPSYDNVDSLLLSSPCDVQGDDDGREPLGGGCADQHCVSESGNNAGSSGAVQTPHAEQSEGFMICVLNTEDTDIPSNDTTDIPILVPELVPLKFQPIVEELGCLESIINNKKRNESDGSLEKEVVLSQSSAALQTVRQGLVPNVNSSHRPLVLGLKSENPGRNSISAVSRQNNNVNVNINSRHSRLVRATVMPASDGHLKQEETNAPSSVHAKAEEHKALSKSEAKPLSLDHEGGDIEDGDDNDNDDELPNFSDVEEMILEMDLSPMDQETNASREVLRYQLDESKRTIMRLEQSAQSSMGRAISSQGAFAVVYGRILEKYIKTSKVILGRATNDVHVDIDLGKEGQVATRISRRQAVIKLEADGSFIIKNLGKRCIFLNGKEIATGQVRGLSAGSLIE

SEQ ID NO: 168348 - protein, 83 aa, Glycine max
  Coding DNA Sequence Number=SeqID_51570
MKKTVIILLITSVNFISAQQIFPLNTSKIDYPNGAYYKDLDGELNQYVGTWKGKVNLQRIEKDGTISNITLNSTNQPTPVPCS

SEQ ID NO: 168349 - protein, 111 aa, Glycine max
  Coding DNA Sequence Number=SeqID_51571
MNFQVNQWYDLHLVPSDEDHNFEPIDQTRARREDANTWRVLTSASCDWESKKEVKALSSVLQNFERASSQAIGIPPKMTKVISSYLGVIECLDPGKYLGLPFISGIKRRLS

SEQ ID NO: 168350 - protein, 125 aa, Glycine max
  Coding DNA Sequence Number=SeqID_51572
  Pfam annotation: Domain name=DUF1863; Domain location=62-99; Score =4.3; E_value=0.061; Accession=PF08937.1; Description=Domain of unknown function (DUF1863)
MALNRYYWPTKYNSRADFLRQGVKCVFISHQQKDKQEAKKIADYLINADLKVNHQSNNAKGVTDSIKRGINNSSHMLVLVSPNTLYSTWVPFEVGYGYDQTDLCVLCLKGIPKSLPEYLKAAKIV

SEQ ID NO: 168351 - protein, 851 aa, Glycine max
  Coding DNA Sequence Number=SeqID_51573
  Gene Ontology: Mol. function=nucleic acid binding; Cellular component= beta-galactosidase complex; Biological process=DNA integration
  Homolog annotation: Hit_ID=Q1S1G2; Match level="QueryCoverage=97%, HitCoverage=98%, E-value=1e-171, Identity=45%"; Hit description =Integrase, catalytic region; Zinc finger, CCHC-type; Peptidase aspartic, catalytic
  Pfam annotation: Domain name=zf-CCHC; Domain location=206-223; Score =7.3; E_value=0.061; Accession=PF00098.13; Description=Zinc knuckle
  Pfam module annotation: Pfam domain module=RVT_2::zf-CCHC; Domain location=377-610::206-223
  Subcellular localization annotation: CTP_CleavageSite=69; ConfidenceScore=5.14e-01
MSSTPPSNPKEDIPSGSGFNDPLLNPSSPYFIHPSDGPSSVSITPILDGTNYQSWSRTFRMTLISRNKMAFLLGTTPVPSITEPTLYSAWERCNTLIMEIFFALQSSRKKYMVFLKAKKYHQRDFVIRFLKGLDERFSVVRSQILLMDPLPMVNRVFSMVVQHECQLSVVPPSSDEPNSFVNASNGFGKGRGVSGSSSTHKNASNKRCSYCHRTGHTIDVCWGKHDYPLGHPRYPGRPRFNNSSSANSATSVDPVERPTASSGPITLTQAQYQSLMALIQQPNSASDAMGNILVQPNNANLIQVPFNERNDSDPNDYICSFETHPNQSSSTCLYPLQSVLSYSNISESEHHYIMNLSFGVEPQSYQEAVLSPCWVEAMKDEIEALKLNNTWEIVDTPAGVKPIGCKWGFSQVEGIDFFETFSPVVKMTTIRVILTLASANIWQLQQLDVSNAFLHGDLSEEVYMTIPQGLQGHGSSQSCKLKESLYGLKQASRKWYEKLSDLLISSGYQQSHADHSLFIKHNGDKFTALLIYVDDIVLTGNSATEMAQIKNIIIRIFKVKDLGALKYFLGLEINHSADGIYVSQRKYCLELLADSGMMGCKPCSTPMDSSLRLHQDDSSDLLDDPLSYRRLVGRLIYLTTTRPDIAFATQQLSQFIAHPTKSHLGAARRVLRYLKGSPSKGLQFKRDTPIHLIGFSDADWATCVDTRRSITGYCFFIGNSLVSWKTKKQNTVSHSSSKAEYRALATSTCELQWLTYLLNDLRICCSMPASLYCDNQSALYIASNPVFHERTKHLEIDYHLVREKVQAGLMRLLPVPSFHQLANMFTKTLSPHLFKSNVSKLELIDLYTPLA

SEQ ID NO: 168352 - protein, 81 aa, Glycine max
  Coding DNA Sequence Number=SeqID_51574
MSPRSIPNVYARSITILSSIYGPPLTEPGNCKYYAMNRTGYDQPQRPKTSHLAKDWEEINVEAVVGHCLSISLKKNLSTPP

SEQ ID NO: 168353 - protein, 675 aa, Glycine max
  Coding DNA Sequence Number=SeqID_51575
  Gene Ontology: Mol. function=RNA-directed DNA polymerase activity; Cellular component=chromatin; Biological process=chromatin assembly or disassembly
  Pfam module annotation: Pfam domain module=RVT_1::Retrotrans_gag; Domain location=390-592::219-303
MAPLGPSRHVPAPLLPAWLIGPSNDRIHDEEIKILIGSGGRSTVKSAKTRALMDPHFSNDIPNYIQINARNNKPRAKCRKECRDAVRRKRVLALEANFFIAFLYHFGAFVVMADSSRAKGTSDKLEDVILKLTNHQISLGESMQLLTLKFEELLQRIPPVPTASLSLPPLAPALSPTPASNHRIKLDVPRFDGTDPLGWIFKINQFFRYHGTLEHDHLTIASFYMEGRALAWFQWMTNNGQFTSWSVFLQALQTRFLPSQYEDPTRALFKLTQKGNPTRGPGTIAYDPGAGGWPCTTSRGKTPGCAADASRMASTHHPGAPLTFSSISRRASSAATTTATPSSQASVIGGDRFVPSFGLENAPIARLPFWPPSRGPRGWRKHPQFHSGGVNDQARVLFARNNPIAGYGWRSRVNPELIDATVVSQITQEIEHMFLLSHRGPCQGRTTYPGGESPPDATPVNVHPYRYPHYQKCEIELQVENMFPISTIDELLDELGGARWFSKLDLLQGYHQIRMHSGDIAKTAFLTHHGHYEFMRFIIVFFDNILIYNDSFDDHLIHLEKTFQILSDNQFVLKLSKCSFAQSKVEYLGHIISQGKMELVAAKGICYDRDSSCQCNYDRAIPVDGPNTGLPDFQLPFMMETDASSVGMGAGAIFDNGNGEEVAPIFAWTSFYHPY

SEQ ID NO: 168354 - protein, 216 aa, Glycine max
  Coding DNA Sequence Number=SeqID_51576
MHYKVNKVLNLQILRKQHGCWLIRLLEEKNPCHDVGEKDLINLEESYEHPGLTRSDHHSPMDVDVGENLDVQDLGNAPNQAKSFFNIFFPHLEHNRVHNYLEANREKLSIVGIINCCRGIRVEANRLTAIDVATKDKIDKLQKAKSEALDEIEYADLEIGKLKSKLINEKAESIVQYVVGFNAAIEQAKIVSLSDDFSFISPFKEVVNSKIVDVED

SEQ ID NO: 168355 - protein, 108 aa, Glycine max
  Coding DNA Sequence Number=SeqID_51577
MCEGGARLGVAYCLHQPTNFLLFKSRGTRRWLSLLLLRGCCCCCEGVVEACPFLYIFMIFFTKVVSNIRVVPHAKRQRVGTLCLAPLVGKLQGGSFYKMKKVEREVSL

SEQ ID NO: 168356 - protein, 640 aa, Glycine max
  Coding DNA Sequence Number=SeqID_51578
  Gene Ontology: Mol. function=protein binding; Cellular component =integral to membrane; Biological process=protein amino acid phosphorylation
  Homolog annotation: Hit_ID=Q1S9S5; Match level="QueryCoverage=96%, HitCoverage=97%, E-value=2e-96, Identity=41%"; Hit description =Leucine-rich repeat; Leucine-rich repeat, cysteine-containing type
  Pfam annotation: Domain name=LRRNT_2; Domain location=27-68; Score =42.8; E_value=1.1e-09; Accession=PF08263.3; Description=Leucine rich repeat N-terminal domain
  Pfam annotation: Domain name=LRR_1; Domain location=107-130; Score =8.7; E_value=6.7; Accession=PF00560.23; Description=Leucine Rich Repeat
  Pfam annotation: Domain name=LRR_1; Domain location=132-154; Score =15.1; E_value=0.26; Accession=PF00560.23; Description=Leucine Rich Repeat
  Pfam annotation: Domain name=LRR_1; Domain location=156-179; Score =17.9; E_value=0.038; Accession=PF00560.23; Description=Leucine Rich Repeat
  Pfam annotation: Domain name=LRR_1; Domain location=181-203; Score =15.6; E_value=0.18; Accession=PF00560.23; Description=Leucine Rich Repeat
  Pfam annotation: Domain name=LRR_1; Domain location=205-227; Score =11.4; E_value=2.1; Accession=PF00560.23; Description=Leucine Rich Repeat
  Pfam annotation: Domain name=LRR_1; Domain location=229-251; Score =15.0; E_value=0.28; Accession=PF00560.23; Description=Leucine Rich Repeat
  Pfam annotation: Domain name=LRR_1; Domain location=253-275; Score =10.0; E_value=3.9; Accession=PF00560.23; Description=Leucine Rich Repeat
  Pfam annotation: Domain name=LRR_1; Domain location=301-323; Score =12.8; E_value=1.1; Accession=PF00560.23; Description=Leucine Rich Repeat
  Pfam annotation: Domain name=LRR_1; Domain location=325-347; Score =16.9; E_value=0.074; Accession=PF00560.23; Description=Leucine Rich Repeat
  Pfam annotation: Domain name=LRR_1; Domain location=349-371; Score =20.7; E_value=0.0053; Accession=PF00560.23; Description=Leucine Rich Repeat
  Pfam annotation: Domain name=LRR_1; Domain location=373-396; Score =15.1; E_value=0.25; Accession=PF00560.23; Description=Leucine Rich Repeat
  Pfam annotation: Domain name=LRR_1; Domain location=397-419; Score =0.7; E_value=2.1e+02; Accession=PF00560.23; Description=Leucine Rich Repeat
  Pfam annotation: Domain name=LRR_1; Domain location=420-442; Score =13.7; E_value=0.67; Accession=PF00560.23; Description=Leucine Rich Repeat
  Pfam annotation: Domain name=LRR_1; Domain location=444-466; Score =12.6; E_value=1.3; Accession=PF00560.23; Description=Leucine Rich Repeat
  Pfam annotation: Domain name=LRR_1; Domain location=468-490; Score =5.6; E_value=26; Accession=PF00560.23; Description=Leucine Rich Repeat
  Pfam annotation: Domain name=LRR_1; Domain location=497-516; Score =4.0; E_value=50; Accession=PF00560.23; Description=Leucine Rich Repeat
  Pfam annotation: Domain name=LRR_1; Domain location=524-546; Score =10.5; E_value=3.1; Accession=PF00560.23; Description=Leucine Rich Repeat
  Pfam annotation: Domain name=LRR_1; Domain location=548-570; Score =9.0; E_value=5.9; Accession=PF00560.23; Description=Leucine Rich Repeat
  Pfam annotation: Domain name=LRR_1; Domain location=572-594; Score =12.9; E_value=1.1; Accession=PF00560.23; Description=Leucine Rich Repeat
  Pfam annotation: Domain name=LRR_1; Domain location=596-618; Score =7.9; E_value=9.6; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1; Domain location =27-68::...
  Pfam module annotation: Domain location=107-130::132-154::156 -179::181-203::205-227::229-251::253-275::301-323::325-347::349 -371::373-396::397-419::420-442::444-466::468-490::497-516::524 -546::548-570::572-594::596-618
MATYTRSESLMFLLIFSTLTSISEPCHMVDKEALLEFKSRIISDPSKLLHSWTPSSDCCHNWEGIACGSTGRVISLTRTGVVYDVDDIPLETYMSGTLSPYLGNLSGLQVLDLSNLKQLHGPMPPELAKLSHLRKLFLYSNKFTGGIPATFQNLSRLENLYLDNNQLSGNVPSSVFASLKYLSELSLSGNKLSGRIPSSIGSMVFLTRLDIHQNNFHGNIPFSIGNLVNLKGLDFSYNQISGRIPESIGRLSNLVFLDLMHNRVIGSLPFPIGDLISLKFCRLSENMLNGILPYSIGKLKNVQRLILENNKLTGMLPATIGHLTSLTDLFLTNNEFSGEIPPSFGNLINLQTLDLSRNQLSGELPHQLAKLDSLQTLDLSFNPLGLAKVPKWFSKLRVFQLKLANTGIKGQLPQWLSYSSVATLDLSSNALTGKLPWWIGNMTHLSFLNLSNNEFHSSIPVTFKNLSSLMDLDLHSNKLTGSLRVVFEKEVQFSLGHFNTIDLSNNKFCGPIGENIGEKASMSSIKFLALSHNPLGGSIPQSIGKLRELEVLDLEDSELLGNIPEELGSVETLTKINLSKNKLSGNIPDKVINLKRLEEFDVSRNRLRGRIPPHTAMFPISAFVGNLGLCGPPLPPCKLC

SEQ ID NO: 168357 - protein, 150 aa, Glycine max
  Coding DNA Sequence Number=SeqID_51579
  Subcellular localization annotation: CTP_CleavageSite=56; ConfidenceScore=5.13e-01
MAGKRLRIIRTNMTNLTQIWMTFLLSNVLLSDHNSDLTLPKCTTTGVGSAISASTRCTTTTSTSTTILGVHLSPLAEEGAPDAHDPSPYLWSTPEQFRATTAWPEDKPIFQEEARPVDAQGAAQGDGGRGKEDEDMADLVDYFMGGNGAS

SEQ ID NO: 168358 - protein, 98 aa, Glycine max
  Coding DNA Sequence Number=SeqID_51580
MGDFAKIFNRSSTFFIRSSSFFGLQPDKNNLTKHFVLKELRRSDFLITIEEYVGAKGNTLVDHKKRKNIKGHKRYKNVKGNIKIEVIFAQLIKGCRLL

SEQ ID NO: 168359 - protein, 82 aa, Glycine max
  Coding DNA Sequence Number=SeqID_51581
MTFNGKPAIFRICPLDLMMKSVHSQLNNWAKRASTAKRSFSALSAKENLAEHQHQGRALSAIGVFSQTQRTTGAKLKSTYPP

SEQ ID NO: 168360 - protein, 110 aa, Glycine max
  Coding DNA Sequence Number=SeqID_51582
  Homolog annotation: Hit_ID=Q1SKD7; Match level="QueryCoverage=97%, HitCoverage=27%, E-value=4e-08, Identity=29%"; Hit description =Ankyrin
MAPKKLSAKRSRRDATAEGTSATPEFDSHRFRRAEHQERFEAIKGWSFHGERRVQLKDDEYTDFQEEIACRHWTSLVTPMAKFDPEIVLKFYANAWPTKEGVRDMRSWVR

SEQ ID NO: 168361 - protein, 87 aa, Glycine max
  Coding DNA Sequence Number=SeqID_51583
MKGFKSFKAHPIPLKIIEATRSNKNKCNDVLPEQWVEGPMTYTGLYGMFDAPYLFGEQGQSSSTVVTHSENPETKQQHHHHEGEPMI

SEQ ID NO: 168362 - protein, 638 aa, Glycine max
  Coding DNA Sequence Number=SeqID_51584
  Gene Ontology: Mol. function=transferase activity, transferring glycosyl groups; Biological process=carbohydrate metabolic process
  Homolog annotation: Hit_ID=Q6R608; Match level="QueryCoverage=96%, HitCoverage=66%, E-value=0.0, Identity=66%"; Hit description=4-alpha- glucanotransferase
  Pfam annotation: Domain name=CBM_20; Domain location=15-111; Score =19.0; E_value=1.6e-06; Accession=PF00686.10; Description=Starch binding domain
  Pfam annotation: Domain name=Glyco_hydro_77; Domain location=247-637; Score=211.1; E_value=2.6e-60; Accession=PF02446.8; Description=4 -alpha-glucanotransferase
  Pfam module annotation: Pfam domain module=CBM_20::Glyco_hydro_77; Domain location=15-111::247-637
  Subcellular localization annotation: CTP_CleavageSite=34; ConfidenceScore=5.24e-01
MVNPGLFSANKSVNSVKVSFRIPYFTQWGQTLLVCGSVPVLGSWNVKKGVLLRPIHQGAELIWGGSITVPKGFRCQYSYYVVDDNKNVLRWEMGKKHELVLPEGIRSGHEIEFRDLWQAATGSDALPFRSAFKDVIFRQCWDLSDTTVGVNHINIEPEGEAILVQFKISCPNIEKDTSIYVIGSNTKLGQWKVENGLKLSYFGESVWKKSGPNREVSTNSSRSEAKYIFLSDGMMREIPWRGAGVAIPMFSIRSESDLGVGEFLDLKLLVDWAVATGFHLVQLLPINDTSVHGMWWDSYPYSSLSVFALHPLYLRVQALSKNIPEAIKKEIEKAKQQLDGKDVDYEATMATKLSIAKKVFAQEKDLILNSSSFKEFFSENEGWLKPYAAFCFLRDFFETSDRTQWGHFAHYSEDKLEKLVSKDSLHYEIICFHYYVQYHLHLQLSEAAEYARKKGVILKGDLPIGVDRNSVDTWVYPNLFRMNTSTGAPPDYFDKNGQNWGFPTYNWEEMSKDNYGWWRARLTQMAKYFTAYRIDHILGFFRIWELPDHAATGLVGKFRPSIPLSLEELEREGIWDFNRLSRPYIKRELLQEKFGDAWTFVATTFLNEIDKNFYEHTFSFNHNGSGSKFSEYILDALF

SEQ ID NO: 168363 - protein, 479 aa, Glycine max
  Coding DNA Sequence Number=SeqID_51585
  Gene Ontology: Mol. function=phosphotransferase activity, alcohol group as acceptor; Biological process=protein modification process
  Homolog annotation: Hit_ID=Q9SI52; Match level="QueryCoverage=71%, HitCoverage=52%, E-value=3e-87, Identity=50%"; Hit description =Expressed protein
  Pfam annotation: Domain name=PI3_PI4_kinase; Domain location=126-383; Score=227.7; E_value=2.6e-65; Accession=PF00454.17; Description =Phosphatidylinositol 3- and 4-kinase
MAVTIDRHHGLKPFSRSQRCKLQSYGHLDPNIIELNQTGGGAAALSSSQHSFGLASLQAENIHRSFSTPCLPLTTLLGGEADLTSSSSHPRVEIVLGSGAPPVNALVVEVAIAMASGVHPIPLPSGLGGAYVFRNQNGNNIAVAKPVDEEPLALNNPKGLGGQMLGQPGLKKSIRIGETGIRELAAYLLDHGGLAGVPPTVLVKFSHAAFFGAASSCSSSHTPKIASLQRFVSHGFDAGELGPSFFPVSSVHQIGILDIRIMNLDRHAGNMLVMKHDHNNSGYVDGVADLVPIDHGFCLPEWLDDPYFEWLHWPQASIPFSEYEIDYISKLDPFRDAEALRNELPSSLRESSIRVLIVCTILLKQAAAAGLCLAEIGQMMTRKFCGGEESRSELENICFMVKTSVVPRGGGDNNDNCKDEETNDDQVCDEVVAGDGGIISLADLNQGEWEAFLEVFSELLHGVFEAKRSSAKAKVGTYN

SEQ ID NO: 168364 - protein, 229 aa, Glycine max
  Coding DNA Sequence Number=SeqID_51586
  Gene Ontology: Mol. function=nucleic acid binding; Cellular component= mitochondrion; Biological process=DNA integration
  Homolog annotation: Hit_ID=Q1SRN1; Match level="QueryCoverage=99%, HitCoverage=14%, E-value=5e-81, Identity=62%"; Hit description =Integrase, catalytic region
MHVEYDSLIKNGTWTLVDLPSSRTVIGCKWVFRVKENPNGSVNKHKSRLVAKGFHQQLGFDYKNTFSPIIKLVAIRLILSLAISHKWSLQQLDVNNVFLYGILEEEVYMSQPLGFVSSNKHQACRLHKAIYGLKHAPRAWFNKLKATFISFKFSSSECDPSPFIYYEKGFVIYILVYEDDIIVTGNNINLIHSLVSQLNFVFSLKDLGDLDYFLGIKIQKTKDGSLILN

SEQ ID NO: 168365 - protein, 74 aa, Glycine max
  Coding DNA Sequence Number=SeqID_51587
FPRGGGDNNDICKDEETNDDQVCDEVVAGDGGIISLADLNQGEWEAFLEVFSELLHGVFEAKRSSAKAKVGTYN

SEQ ID NO: 168366 - protein, 428 aa, Glycine max
  Coding DNA Sequence Number=SeqID_51588
  Gene Ontology: Mol. function=catalytic activity; Cellular component =cellular_component; Biological process=metabolic process
  Homolog annotation: Hit_ID=Q9MB42; Match level="QueryCoverage=98%, HitCoverage=59%, E-value=0.0, Identity=82%"; Hit description=Beta -amyrin synthase
  Pfam annotation: Domain name=Prenyltrans; Domain location=290-332; Score=40.8; E_value=4.6e-09; Accession=PF00432.11; Description =Prenyltransferase and squalene oxidase re
  Pfam annotation: Domain name=Prenyltrans; Domain location=339-394; Score=33.8; E_value=6e-07; Accession=PF00432.11; Description =Prenyltransferase and squalene oxidase re
  Pfam module annotation: Pfam domain module=Prenyltrans::Prenyltrans; Domain location=290-332::339-394
MSYLYGKRFVGPITPLILQLREELFTQPYEKVNWKKVRHQCAKEDLYYPHSLIQDLVWDSLYMFTEPLLTCWPFNKLIREKALQVTMNHIHYEDENSRYITIGCVEKVLCMLACWVEDPQGDAFKKHLARVSDYLWVSEDGMTMQSFGSQEWDAGFAVQALLATKLIDEIGHSLAKGHDFIKKSQVRDNPSGDFKSMYRHITKGSWTFSDQDHGWQVSDCTAEGLKSKKGGIAAWEPIGAQEWLELLNPTEFFEDIVIEHEYVECTGSAIQALVLFQKLYPEHRKTEIKNFIVNAVQFLEDTQTTNGSWYGCWGVCYTYGSWFALGGLAAAGKTYTNCNAIRKAVKFLLTTQREDGGWGESYLSSPKKIYIPLEGSRSNVVQTAWALMGLIYAGQSERDLTPLHQAAKLLINSQLEEGDWPQQVHINL

SEQ ID NO: 168367 - protein, 851 aa, Glycine max
  Coding DNA Sequence Number=SeqID_51589
  Gene Ontology: Mol. function=DNA binding; Cellular component=beta -galactosidase complex; Biological process=DNA integration
  Homolog annotation: Hit_ID=Q1SS72; Match level="QueryCoverage=93%, HitCoverage=55%, E-value=0.0, Identity=42%"; Hit description =Integrase, catalytic region
  Pfam annotation: Domain name=rve; Domain location=573-733; Score =149.9; E_value=6.7e-42; Accession=PF00665.16; Description=Integrase core domain
  Pfam annotation: Domain name=zf-CCHC; Domain location=240-257; Score =13.3; E_value=0.0063; Accession=PF00098.13; Description=Zinc knuckle
  Pfam annotation: Domain name=zf-CCHC; Domain location=277-294; Score =14.7; E_value=0.0037; Accession=PF00098.13; Description=Zinc knuckle
  Pfam module annotation: Pfam domain module=Retrotrans_gag::rve::zf -CCHC::zf-CCHC; Domain location=61-184::573-733::240-257::277-294
  Subcellular localization annotation: CTP_CleavageSite=39; ConfidenceScore=5.09e-01
MESYLYLHPSENPAVALVSPVLDSSNYHSWSRSMVTALSAKNKVEFINGNAPEPLRTDRTYSAWSRCNNMAVSWIVHSVSVAIRQSILWMNKAEEIWNDLKSRYAQGDLLRISDLQQEASSMKQGTLSVTEYFTKLRIIWDEIENFRPDPTCSCTIKCSCSVLTIIAQRKLEDRAMQFLRGLNEQYNNVRSHVLLMEPMPTIPKIFSYVAQQECQLSGINSFSNLSIESKENVSINAVKITCEFCGRIGHTESVCYKKHGVPTSYEGRSKTYNRNGKTCTHCGKMGHTIDVCYKKHGYPPGYKFGNNKVVNNIIEGKATSDQMQRQESHDLVRFSPEQYQALLALIQQPSSGGSIPTQSQVASISSCSTNTSPGTILSLKTTESTSWILDSGATDHVSSSLANFHSYHQVNPIMVKLPNGHEVHATHLGTVHLTPSIILNDVLYIPSFSFNLISISKLISTNNYELIFSSNTCVLQDTNTKAKIGTIELSHGLYQFILKPSHSRTICSTIIHPKCNVIPIDLWHFRMGHPSIERLQVMQTYYPSLHNNNKNFVCTTCHYAKHKRSSFSSSTSHALSIFDLIHIDIWGPYSKVSMHGHHYFLTIVNDHSRFTWVYLMQTKAEARKLIITFVTYAQTQFNKTIKIIRSDNGAEFLMNDFYAQRGIIHQTTCIETPEQNGIVERKHQHLLHVTRSLLFQANLPLNFWCFALLHATYLINCIPTPFLHNKSPYEQLYTRPCDISNLWVFGCLCYISTLKSHRQKLDRRAHPCIFIGFKPNTKGYLVYDLHSHSITTSSNIVFYEDHFPLFPDTPESSTPPTSISSLPFSNNPDSFEHPIPPNDNPSSSHIPSPFL

SEQ ID NO: 168368 - protein, 35 aa, Glycine max
  Coding DNA Sequence Number=SeqID_51590
MGLGGLEAAKESASVEVMSEIRMSCVVALSVSGNA

SEQ ID NO: 168369 - protein, 78 aa, Glycine max
  Coding DNA Sequence Number=SeqID_51591
MGCLQSPWSSILVNRSPTQEFKCHKGSCQGDPSTPFLFLIVWSSEASQGKKLVGGIPSGVDRNVVEHYADFLNCRILS

SEQ ID NO: 168370 - protein, 95 aa, Glycine max
  Coding DNA Sequence Number=SeqID_51592
MQKLIKERMENKVVNLVGLNKVVSGIKWMNGMKYRNGNNGSYRAPNEVIPKREVDFLELWFERTRVEMIGRKESLFPARATHKGCESPLIQPGCS

SEQ ID NO: 168371 - protein, 57 aa, Glycine max
  Coding DNA Sequence Number=SeqID_51593
MCNIVSKCPSRMFFFRHFRLLKDRKRHCFFYKFFESLDPKGLDLLKKLYLTYMDQSN

SEQ ID NO: 168372 - protein, 161 aa, Glycine max
  Coding DNA Sequence Number=SeqID_51594
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=91%, HitCoverage=62%, E-value=5e-36, Identity=51%"; Hit description =Transcription factor, MADS-box
  Pfam annotation: Domain name=SRF-TF; Domain location=25-75; Score =65.3; E_value=2e-16; Accession=PF00319.9; Description=SRF-type transcription factor (DNA-binding and dimerisation domain)
MESNNMPDLNGVAKKTKGRQKIEMKKMRNESNLPVTFSKLRTGVFKKASELATLCGVDVAVIMFSPGNRVFFFGSPSVDSVVQRYKTQGPPPLLTLDLNKVHSTVDEVELHTHLHCLSNQIAIEKKRTKDLNHLAKAVEDQFWWARPIESMTYSQLDKYKK

SEQ ID NO: 168373 - protein, 180 aa, Glycine max
  Coding DNA Sequence Number=SeqID_51595
MGSEETNFPSKPSRRVSHHVQSDATRETTTHAWPQHRSPSPPPPCVKGNNNNNSNNEIDVSMSSGAQYCYYMLEAMPQPGPTWSTTGPCVLAEPTPTPSPSALIEDSSCTWWLGYLEGLDGNLTTLKLDPPFVENVVMENGKGLGYESTLVDAIDLSCCCPDDWLVIPTMDQDLGDIVMP

SEQ ID NO: 168374 - protein, 105 aa, Glycine max
  Coding DNA Sequence Number=SeqID_51596
SRPEDADISGSWPEDADISGEGADDDSRPEDADISREGADDDVSHCMLSSFESYGLQMSVCRLPYKASPRANGLTGHDSKKWGGRQKRGFCSYISSIYDEELRPT

SEQ ID NO: 168375 - protein, 86 aa, Glycine max
  Coding DNA Sequence Number=SeqID_51597
MVRQQTANNRVQGQGSPPFVRPTPEQFKAKVAWPGDWPTEEGTGPAGSPGEAEEAHMDEDMTDLLGYLGEGGATRPRSSHLLFHVV

SEQ ID NO: 168376 - protein, 130 aa, Glycine max
  Coding DNA Sequence Number=SeqID_51598
MTVEPVVEAVVEEPDIGGGDVVDGATEDVDVGQGRRRRSRRRGRGSGEGERGGGLHESHGLHEDVTVGELDGDSHGGENVNDLNGSLVENVAEDIAWSLSQRLWKPKGGVKRQRGSLRVNRRKSGERNEI

SEQ ID NO: 168377 - protein, 108 aa, Glycine max
  Coding DNA Sequence Number=SeqID_51599
MEHSCTEYARIEPTFNHYYNMLREEEDADREINWLNKISREKWTLAWDGREVATMLASSQLYMEVLNKVVKDALRKTNAHTILGSGDNKPERGSAHWRFHDQAGRKVV

SEQ ID NO: 168378 - protein, 120 aa, Glycine max
  Coding DNA Sequence Number=SeqID_51600
  Gene Ontology: Biological process=ubiquitin cycle
  Homolog annotation: Hit_ID=Q1S9B4; Match level="QueryCoverage=99%, HitCoverage=48%, E-value=2e-18, Identity=36%"; Hit description =Cyclin-like F-box; Serine/threonine protein phosphatase, BSU1
  Subcellular localization annotation: CTP_CleavageSite=43; ConfidenceScore=5.02e-01
MRVGREFAVAGVLHGKIYILSGYVADTWSSTPPLATGRELAVRRRSVRSGCTPAPSSGSGSTQWQIAVASWFNVGRGAWEELKGLEKGLPKFLCWATVVDLGGKLCVVWECQRNGNEMEI

SEQ ID NO: 168379 - protein, 321 aa, Glycine max
  Coding DNA Sequence Number=SeqID_51601
  Gene Ontology: Cellular component=integral to membrane; Biological process=polysaccharide biosynthetic process
  Homolog annotation: Hit_ID=Q46639; Match level="QueryCoverage=93%, HitCoverage=77%, E-value=1e-132, Identity=78%"; Hit description =Amylovoran biosynthesis protein amsL
  Pfam annotation: Domain name=Polysacc_synt; Domain location=1-218; Score=26.9; E_value=1.1e-05; Accession=PF01943.8; Description =Polysaccharide biosynthesis protein
MGMSSYIVHRQEITRREQSTIYWVNVSLSFCTGLIMLAIAWPVAWFYHLPELTALIMLTSLNFLVLGHLSQYQAHYVKTKRMVTLAKIEMGTKLFAFLCTVAMLYFTSLTVAAAILGLFINAFTRILCMIYFGEKSWRPTWEFDGKTFVSAVRYGIYQLGSQTINQLRTQADALIVGKVMGAEMLGIYSLAKELILQPLKLVSPVINRLALPRFAEKQHDPEQLKKLFLKGTFVIMLFSSAMYLAIGILSPVIVRVLYGASHEQVYHLIPRMLLFGMLRPMGGMTGAISQENERTNVEFYWKIVASLVVVVVLATTWIWPN

SEQ ID NO: 168380 - protein, 175 aa, Glycine max
  Coding DNA Sequence Number=SeqID_51602
  Gene Ontology: Mol. function=orotidine-5'-phosphate decarboxylase activity; Biological process='de novo' pyrimidine base biosynthetic process
  Homolog annotation: Hit_ID=Q8PER4; Match level="QueryCoverage=55%, HitCoverage=39%, E-value=3e-38, Identity=79%"; Hit description =Orotidine 5'-phosphate decarboxylase
MDGGVADRPLRQALDHRRGGGRDVEELQVNEHALVAAGQLIEHLEVLAGGEQFHADLVERHAVAEAVDPLKRLHAVRHVQREDQALVVAQRQRRAVHGRVRQHPPALAEPVVVLLQQRVTAIVGVGGHFDEIAQLVAELHQHAVLLPGQAAAAVLLAAGLLAAFDHGAQAQEHAV

SEQ ID NO: 168381 - protein, 63 aa, Glycine max
  Coding DNA Sequence Number=SeqID_51603
MEICFNVYWFYSVNHLDLIFAAYSLDEINGKMRSFCELAKYSASDGATVLDVCYIRHQRQVDP

SEQ ID NO: 168382 - protein, 243 aa, Glycine max
  Coding DNA Sequence Number=SeqID_51604
  Subcellular localization annotation: CTP_CleavageSite=79; ConfidenceScore=5.11e-01
MWGSIEGGSLRFSLSPSKSWPLRFCPQTPHESHFDMSNSKLVNMNNPLTIYVTNSYFKIGRVPLKLPSSFIRKALNRSVAESESSKYVEDGSQSPYSDVEANEAIILVEKEAMEKIHEPHGQKTGTEHAIEIKYSDEEEEEEGEESIGDIILEGEKEEKGNAESVLTEENKKLYGETGQFGAEDEDRESEIDEFLIGESVEEEVVEEPNWVLSTEELNKKFDDFIRKMKEDLRIEAQRQLLMV

SEQ ID NO: 168383 - protein, 268 aa, Glycine max
  Coding DNA Sequence Number=SeqID_51605
MRMRATWEYVSSVGGGQQGMVVLYVICGCGELLCTIARPPPSTTCDGLENEVRKLGGLLEARRASGNRLPKGCNRLPGLKWDWKIVEASRNRLPGCVIDYTEEHATGNRLPVMCNRLHSAFLQIVMAVQLIHDRVQMECLEGAWETLEGNARCRFRGTIRFTATSLVHPDEPARTLQRTVEWILPTPTPYRLVELVQVIEVTLFEEDPEEDLEELPPEPTVDALDFLEGDEDLLPKVDSPEDVMSASEADSTEDSGPGEMAISGGSSS

SEQ ID NO: 168384 - protein, 95 aa, Glycine max
  Coding DNA Sequence Number=SeqID_51606
MQRIELYMQHLADQQAVNHRGQVQLNDSFYQYTLHQQRQDSSPYPWPIFEQFRATIAWPRGRPNFQARAGLAEVSGGGDGAEEDGDMADVMDFFL

SEQ ID NO: 168385 - protein, 86 aa, Glycine max
  Coding DNA Sequence Number=SeqID_51607
MAPKKLLTKRARKDAIGEGSSAAPQEHQCRFEAIKDWSFLKERRVQLREGEYIELQEEVSRRQWTQLTKPMAKYDPKIVMEFYANA

SEQ ID NO: 168386 - protein, 101 aa, Glycine max
  Coding DNA Sequence Number=SeqID_51608
MLEEKFVTIIDASSNEEKVHYKTWARSDRLSLMLMRMTVADNIKTTLSKIESAKRFIGLVGEYSQTADKSVVGTLMSTLTTMKFDGSHTMYEHVIEMTNIT

SEQ ID NO: 168387 - protein, 1051 aa, Glycine max
  Coding DNA Sequence Number=SeqID_51609
  Gene Ontology: Mol. function=nucleic acid binding; Cellular component= beta-galactosidase complex; Biological process=DNA integration
  Pfam annotation: Domain name=rve; Domain location=425-567; Score =101.2; E_value=3.2e-27; Accession=PF00665.16; Description=Integrase core domain
  Pfam module annotation: Pfam domain module=RVT_2::rve; Domain location=649-797::425-567
MQKNNGNGNSLNQLPIFKGINFHFWSLKMKTLFKSQELWSSDESGFEDDGTEEPDQALREKRKKDSKALFIIQQALDDEVFPRIVVASTAKEAWRILNQEYAGDMKVVNVRLQSLRREFESFQMKENENMQECLSRISSTVQQMRTLGEEIKESQVVSKVLRSLTKKYDHMVATIEESKDMETYTFDELKGSLHSHEERICKGDDKKEEKAFQAKGEYSNKERAKQSSGRGREASCWKKEEDEQKGCDKKSNFVEQEEKLILAQHTSNNDDKGGVWYVDSGCSNHMSSAKSIFRTLDETAKTKVRLGDGKQLEVEGRGTIAIRTEQGNTKLLCDVQYVPRLSHNLLSVGQLLNSGYSVLFENGACLIQDRSSKEIVVKIAIGKNKMFPLDLSSHGLPKTGELELCEGCIYGKQSRGSFPTGKAWRASECLELLHADLCGPMKTVSLGGTKSETFESFKIFEAMVEKQSSLYVRALRTDRGGEFLSNEFITFCEEQGIRREWTAPYTPEQNGVAERKNRTVVKMTRSMLKARGVPNRFWCEAVATAVYILNVSPTKAFMNMTPLKAWRRKKPSEVSNVPENDHTPSPHSTPSSQGSLTPSSQGSSSSSSDSAPRRYRSLSDLYENCDFALMAADPTCFEEAEKEVEWQNAMKEEIKSIEKNVTWQLLNLPKGKNMGASKSTKLGWWLRAFLNGDLQEEVFVEQPLGFVNASEEGKVYKLQKALYGLKQTPRAWYSKIDSFFLQNEFERSENEPTLYVKKEVKQGEDGIFLCQRKYAEDFLKKFHMEKCKAMRTPMNTNEKLQRDDGIEKADEQLFRSLVGGLNYLTYTRPDIAHSVSVVSRYMHSPTKQHLGATQRVLKYVAGSIKLGILYESVDNFKLVGYSDSDWAGCLDDRKSTSGFVLSLGLGAITWSSKKQDTVSLSSSEAEYVVVGAAARQTIWLRKLLKDLCCEQEGAIKLWCNNRSVIAMSNNPAFHARTKHIEVQHHFIRKLVAEEKLVLKFRGTNEQNADLTTTILSFYIGSKWRSTSVDTRRRSKRRKKKNLFYDGRKRPS

SEQ ID NO: 168388 - protein, 250 aa, Glycine max
  Coding DNA Sequence Number=SeqID_51610
  Gene Ontology: Biological process=response to biotic stimulus
  Homolog annotation: Hit_ID=Q25BJ6; Match level="QueryCoverage=70%, HitCoverage=62%, E-value=2e-64, Identity=69%"; Hit description =Streptomyces cyclase/dehydrase family protein
  Pfam annotation: Domain name=Bet_v_I; Domain location=50-194; Score= -46.4; E_value=0.019; Accession=PF00407.9; Description=Pathogenesis -related protein Bet v I family
  Pfam annotation: Domain name=Polyketide_cyc; Domain location=59-193; Score=16.6; E_value=0.01; Accession=PF03364.10; Description =Streptomyces cyclasedehydrase
  Pfam module annotation: Pfam domain module=Bet_v_I::Polyketide_cyc; Domain location=50-194::59-193
MEKTHSSSAEEQDPTRRHLDPPPGLTAEEFEDLKPSVLEHHTYSVTPTRQSSSLLAQRIHAPPHAVWSVVRCFDNPQAYKHFIKSCHVKEGFQLAVGSTRDVHVISGLPAATSTERLDLLDDDRHVIGFTIVGGDHRLRNYRSVTSVHGFECDGKIWTVVLESYVVDVPEGNTEEDTRLFADTVVKLNLQKLASVSEGMCGDGDGDGDACPLFGGLARLNLFHVGNKVVALFVISKVYPVDVDFSLKSAV

SEQ ID NO: 168389 - protein, 71 aa, Glycine max
  Coding DNA Sequence Number=SeqID_51611
MLGNGGETPSRYELLSMVKNNSNSIGKMVIEEQNAFDIKMDTRFWHIVFDFYFVCGKESRGCQDDGLVFFV

SEQ ID NO: 168390 - protein, 103 aa, Glycine max
  Coding DNA Sequence Number=SeqID_51612
MGFLVEHEKFLSKRKIGGTKAALQNIWLGNEEIERGHGKMMMTALGLLTVLGVSRKRAREVVSTKVERNGGYKKWNRRRLEERGAREAKSQNEGHEIWKFKSP

SEQ ID NO: 168391 - protein, 43 aa, Glycine max
  Coding DNA Sequence Number=SeqID_51613
MGTKQALLVEALPCIRDVTPDPLSCYSHRVVWVIPHETIHAYL

SEQ ID NO: 168392 - protein, 113 aa, Glycine max
  Coding DNA Sequence Number=SeqID_51614
MAPKKLSAKRSRKDAAGEGSSAAPQADVDFDGHRERRVHLRDEKYAEFQEEIARRQWAQLVAPMAKFDPEIVMEFYANTWPTEEGVRDKCSWVRGPWVPFDEDAINQFLVSSY

SEQ ID NO: 168393 - protein, 350 aa, Glycine max
  Coding DNA Sequence Number=SeqID_51615
  Homolog annotation: Hit_ID=Q69KN1; Match level="QueryCoverage=31%, HitCoverage=13%, E-value=3e-09, Identity=36%"; Hit description =Putative SMA-9 class B
MTAQEYYDGERHCILITARDPIPKRMLVSVPEIQGRFIGTKLHTLKADFYEVAKMFGSLAVSLSIISPIQHPIFGVIFNMGNNDSSLANTPISDCRNEQFIVLLSRNFREAHYALHEKRTMDPPTKESVESLKTTNDIILAIDFADDHEEDLFSIMMTGKQIIEADKDDRLDPISLLPLSVPNASTGEVGISTLPMVISTTPTFIVGEGSLKGVVGGNSGNCSTSTAIAVGMADPRDAPPAQNSMLPHSIGNTFDVQPYSSLSMLPYASSSSRSRPYLPFQVIGFGPLGRIAFGTSTGVPPAPITPQFNPYDFWPPPSSLTNFNDYLLEWEGSLAGKIVKKNRQLHLWVK

SEQ ID NO: 168394 - protein, 61 aa, Glycine max
  Coding DNA Sequence Number=SeqID_51616
TPSPRGACGYGNTAYSFGKIPHSSSENTPKYGSKKVLLRDNGDRGDAIRVDKAFKKSSPRI

SEQ ID NO: 168395 - protein, 50 aa, Glycine max
  Coding DNA Sequence Number=SeqID_51617
LSVLEKSMTTKKWLNLIIDGNSTLGPYWPKIVSEYLEKIVRFVFSSYLQS

SEQ ID NO: 168396 - protein, 91 aa, Glycine max
  Coding DNA Sequence Number=SeqID_51618
  Gene Ontology: Mol. function=nucleic acid binding
  Homolog annotation: Hit_ID=Q1S6N9; Match level="QueryCoverage=88%, HitCoverage=6%, E-value=9e-22, Identity=65%"; Hit description =Integrase, catalytic region; Zinc finger, CCHC-type; Peptidase aspartic, catalytic
MQVLNLGREFEMQSMKETKTIKDHVDRLLSIANKVSLLGKDFPNKRIVQKVLVIVPEKYESKISAWEESKDLSVITLGELIMPCNNRSKEE

SEQ ID NO: 168397 - protein, 177 aa, Glycine max
  Coding DNA Sequence Number=SeqID_51619
  Gene Ontology: Mol. function=protein serine/threonine kinase activity; Biological process=protein amino acid phosphorylation
  Homolog annotation: Hit_ID=Q2HSJ8; Match level="QueryCoverage=49%, HitCoverage=12%, E-value=6e-26, Identity=65%"; Hit description =Protein kinase
MAEGLWGLAEYHGKRGEIGKAMKCLELFHRRNRSCTRDSSSLRPLEKDRSWRVWHHDSRKPQKRRRRSSHDRLNDAEDLLIKRWLLLLEFSILTLCNLKRLGLRRAALMKKSIGVYFPEECSNIFLTKDQDVRLDIYIGDFRLAKTLKADDMASFVCAFYVVIAFYHIQMSSSLACI

SEQ ID NO: 168398 - protein, 59 aa, Glycine max
  Coding DNA Sequence Number=SeqID_51620
MEWNAGKRNKVTWRRGKDVRRKRTSRKNSITISKTVTKVAPHAVNTTCPITIRVYIHDA

SEQ ID NO: 168399 - protein, 80 aa, Glycine max
  Coding DNA Sequence Number=SeqID_51621
MNINVKGEWILMHIMSCPNFVSLSSYYSITSSDFTPSTRTTELEKLFENFKDRGFVIRWVNDTVALAVFRTPPVATLIIS

SEQ ID NO: 168400 - protein, 68 aa, Glycine max
  Coding DNA Sequence Number=SeqID_51622
MAEEEEGLSKEEAHKSSNNEVVGTSFTTLKTNVTSNMVFPQTLEPLILSVIPSLISLDYIVLIPSGPI

SEQ ID NO: 168401 - protein, 636 aa, Glycine max
  Coding DNA Sequence Number=SeqID_51623
  Gene Ontology: Mol. function=receptor activity; Cellular component =integral to membrane; Biological process=red or far red light signaling pathway
  Homolog annotation: Hit_ID=Q6R8G7; Match level="QueryCoverage=88%, HitCoverage=67%, E-value=0.0, Identity=63%"; Hit description=PHO1 -like protein
  Pfam annotation: Domain name=EXS; Domain location=442-610; Score =270.1; E_value=4.4e-78; Accession=PF03124.5; Description=EXS family
  Pfam annotation: Domain name=SPX; Domain location=18-172; Score= -14.3; E_value=3.9e-05; Accession=PF03105.10; Description=SPX domain
  Pfam module annotation: Pfam domain module=EXS::SPX; Domain location =442-610::18-172
MVEKFSVDVLSDFPGARTGRIPTLIDYIKEEGSTHRGHSEESGDDDKGEEIETTNKSVEVHKKKKNLTPIKPIRPASVEILNRVQLNNTCETPRSTIRGFIKYPGQTEINFTKENLSKVEETLKLAFIEFYQKLRLLKNYTFLNVLAFSKIMKKYDKITLRGAAKAYMKMVDKSNLGSSDEVTRLMERVENVFIKHFSNSNRNKGMGILRPKPKRERHRTTMYSIVPNNLNMTYNRFTGFSAGCSAALTVALILIVRARKIMDHSGSTQYMEIMFPLYSLFGFVVLHMLMYAANIYFWRRYRVNHSFIFGFKQGTDLGYHQVLFVSFVLAALALASVIANLDMEIDPVTKQFEEFTELLPLFLVLSVIAILLCPLNIVYRSSRMFFLTCVCHCICAPLYKVTLPDFFMADQFTSQVQALRSFEFYICYYGWGDFKHRETSCKSNGIFRAFSFIVAAIPYWSRFLQCLRRLYEEKDIMQGYNALKYFLTIAAVCLRTASTLNQGMGWTVLAWIFSISTSIFSTYWDLVLDWGLLQRHSKNRWLRDKLLIPHKSVYFAAMVMNVLLRFAWLQTILNFKFSFLHRQAMVSIAASLEIIRRGMWSFFRIENEHLNNVGKYRAFKSVPLPFNYDEEEDKDE

SEQ ID NO: 168402 - protein, 142 aa, Glycine max
  Coding DNA Sequence Number=SeqID_51624
MVFSINSHEGEGAKGTGSLEREKRRERKEKEEKRSRGAAKSQPRIIPYITSLANLVPCATDDSDANDDYHRPISVVYGKRSRKEEGKNLVDAPMAKKQVTLFDSKVPKHPMVKHVVHRTKGPFQKVTVEKAPIKEALVPKRR

SEQ ID NO: 168403 - protein, 106 aa, Glycine max
  Coding DNA Sequence Number=SeqID_51625
MDDFSLHSNFNIVTQTANRSGVTFHEDISNAAVLEIRIGLEWEFLIPLGVILAILDPALIAVSKSGPAVIARKSIVLKPPTQNYLIYKHHLFLSTGQLATVSSAMP

SEQ ID NO: 168404 - protein, 220 aa, Glycine max
  Coding DNA Sequence Number=SeqID_51626
  Gene Ontology: Mol. function=actin binding; Cellular component =nucleus; Biological process=cytoskeleton organization and biogenesis
  Pfam annotation: Domain name=Transposase_21; Domain location=1-96; Score=-100.0; E_value=4.5e-06; Accession=PF02992.5; Description =Transposase family tnp2
MMLSMMISGPRQPGNDIDVYLCPLIEDLTKLWDKYSVKGHHACLICEEDTSYMQLRHEKNVYDSVIGTLLNIQGKMKNGLNTRQDLAEIAVHEDLKRVYQESTPSGSIYCGKYIEKAKPVWLPESWHEEVVGGKGSRELHVKCRRFATSSFPYILRHEGLVKESNPKMSKNRVLKEHNNTFLDWFKDTIFVDDNASEMLRKLVDRPKRNVMTWEGYEGIL

SEQ ID NO: 168405 - protein, 201 aa, Glycine max
  Coding DNA Sequence Number=SeqID_51627
  Gene Ontology: Mol. function=nucleotide binding
  Homolog annotation: Hit_ID=Q84WS1; Match level="QueryCoverage=66%, HitCoverage=35%, E-value=5e-27, Identity=44%"; Hit description =Putative axi 1 protein
  Pfam annotation: Domain name=DUF246; Domain location=13-199; Score= -106.0; E_value=1.8e-08; Accession=PF03138.5; Description=Plant protein family
MTDSEENKGYRRQMLRIWVASGIVALKSAASGVEKFTSKIALSNQILPLFGKHEVARFKKTEAPLANSGLSLDLQKLRCRVVRMVELMKKLRSSSGGILWLCFAVHILMDRYAFPSWREKEIVSEERRSLGLSPLTPEESALILQALGFDRETPIYISAGEIYGGERLRAAFPRIIHKTKGMRGERRGRCTRQNNRTKIRQ

SEQ ID NO: 168406 - protein, 102 aa, Glycine max
  Coding DNA Sequence Number=SeqID_51628
MTISDSFTVGSNFIGAVGGKAGGINRDAIIAVRRHVIPLRGKRWVIHDWGLVKTCVGIFRVSIGMSFEVTGFEYSFKPMLIPYGWSILAKHHDPDWSPYDLT

SEQ ID NO: 168407 - protein, 103 aa, Glycine max
  Coding DNA Sequence Number=SeqID_51629
MKCVAVEWRVVMRILKLAKYRLNVQVEKDECPSGEGQSPRVEKDEGLETETLPRQLIWRHPKLRSLYQTFGPVRFTSGGIQVRGDKLQGDVIQRSRGMEGGIL

SEQ ID NO: 168408 - protein, 223 aa, Glycine max
  Coding DNA Sequence Number=SeqID_51630
  Gene Ontology: Cellular component=integral to membrane; Biological process=transport
  Homolog annotation: Hit_ID=Q7XI54; Match level="QueryCoverage=45%, HitCoverage=46%, E-value=1e-33, Identity=61%"; Hit description =Putative transmembrane protein
  Pfam annotation: Domain name=EMP24_GP25L; Domain location=135-202; Score=53.5; E_value=7e-13; Accession=PF01105.14; Description =emp24gp25Lp24 family
  Subcellular localization annotation: CTP_CleavageSite=42; ConfidenceScore=5.04e-01
ESSIQCTWGVGLHQRTTDNPTSSIVVPATRPILSRGGKITMLAMEPSETCVVVDVDLSLNKVNKPDIISTSPKKEVVVAKKPLKKKVEEKKPEEKKSGKKPKEDLMTMKGTIDVKEMDIKSNSMTVGKYQIVSPNEGQPLPDAHRFTVRVTSSYGNNYHYGDRVQTGQFAFAAVEAGDYMTCFWAVDHNPVETLTVDFDWKTGVAAKDWSNVAKKGQVDVSTV

SEQ ID NO: 168409 - protein, 198 aa, Glycine max
  Coding DNA Sequence Number=SeqID_51631
MLLKDSLSEPDWLSVAHSLSEAASSLSKYKTLENVELETSALSTQLARLVRTLSFLALSVEAKLHDESRLIQRCFDDNKDGDKGDDKKLKGQSKNEFKMFKIESRTLQDSRGKLKNTSRFKRKVDFKNQESRFKDQASKNQDQNSRLKIQESREDLIKISMKRFFQKLSSTWIFLKTCLPKSFYSLVIDYQIDVIDYQ

SEQ ID NO: 168410 - protein, 94 aa, Glycine max
  Coding DNA Sequence Number=SeqID_51632
MEHSRRIFTWINSYRYSYTVEEEVHFHTHFGYIRRHFLLLDEPRIPLITLEAHATCHLISRCYNDDDNSDDNGSDNIDVDGDGDDSTSGRGGGN

SEQ ID NO: 168411 - protein, 293 aa, Glycine max
  Coding DNA Sequence Number=SeqID_51633
  Gene Ontology: Mol. function=protein serine/threonine kinase activity; Cellular component=cytoplasm; Biological process=protein amino acid phosphorylation
  Homolog annotation: Hit_ID=Q7XI53; Match level="QueryCoverage=81%, HitCoverage=53%, E-value=1e-106, Identity=73%"; Hit description =Putative ankyrin-kinase
  Pfam annotation: Domain name=Ank; Domain location=55-87; Score=45.9; E_value=1.3e-10; Accession=PF00023.20; Description=Ankyrin repeat
  Pfam annotation: Domain name=Pkinase; Domain location=147-292; Score=- 62.0; E_value=7.2e-05; Accession=PF00069.15; Description=Protein kinase domain
  Pfam annotation: Domain name=Pkinase_Tyr; Domain location=147-292; Score=-56.4; E_value=5.2e-09; Accession=PF07714.7; Description =Protein tyrosine kinase
  Pfam module annotation: Pfam domain module=Ank::Pkinase::Pkinase_Tyr; Domain location=55-87::147-292::147-292
MSSGSSSSHSSEKEKEKQRVSRTSLILWHAHQNDAAAVRKLLQEDPSLVKARDYDNRTPLHVASLHGWIDVATCLIEFGADVNAQDRWKNTPLADAEGAKKSNVIELLQSHGGLSFGQNGSHFEPKPVAPPLPNKCDWEVEPTELDFSNSVRIGKGSFGEILKAHWRGTPVAVKRILPSLSEDRLVIQDFRHEVNLLVKLRHPNIVQFLGAVTDRKPLMLITEYLRGGDLHQYLKEKGALSPATAISFSMDIVRTVTFAPATEAPCFSSTPSRLETFKFTLIVQSPLYNQDIS

SEQ ID NO: 168412 - protein, 262 aa, Glycine max
  Coding DNA Sequence Number=SeqID_51634
MAYLGNNNDRNISGGHDDSDSGDDVDGGGNDNVVVIAVLVVTTKGDDDVGGGDDDKVGINVNNVGGDDNVVVIAVLVVTTKGDDNVGGGGNDRGDINVNDVGGGSGSKRWQCGGGGSYDIGGGCCCDASGDCGGGDKGDIVGSGANNDDDREIDGSGGGSNVDGDGDVDGDDAMLVVMVMSVAITVVVAMLMVVVVAIGYGNDTNGDGVVVAMTRVVLVVVVVTSQFSMLCVSKPDFALLKVGNLNLNSFILPSKFHGDYKR

SEQ ID NO: 168413 - protein, 520 aa, Glycine max
  Coding DNA Sequence Number=SeqID_51635
  Gene Ontology: Mol. function=transferase activity; Biological process= protein modification process
  Homolog annotation: Hit_ID=Q71U39; Match level="QueryCoverage=46%, HitCoverage=80%, E-value=7e-56, Identity=47%"; Hit description =Putative tetrahydromethanopterin biosynthesis protein
  Pfam annotation: Domain name=ATP-grasp_3; Domain location=70-234; Score=-33.6; E_value=0.0021; Accession=PF02655.5; Description=ATP -grasp domain
  Pfam annotation: Domain name=CitG; Domain location=251-513; Score =47.7; E_value=8.9e-12; Accession=PF01874.7; Description =ATP:dephospho-CoA triphosphoribosyl transferase
  Pfam annotation: Domain name=GSH-S_ATP; Domain location=72-242; Score= -110.6; E_value=0.086; Accession=PF02955.7; Description=Prokaryotic glutathione synthetase, ATP-binding domain
  Pfam annotation: Domain name=RimK; Domain location=70-253; Score =52.2; E_value=1.7e-12; Accession=PF08443.2; Description=RimK-like ATP-grasp domain
  Pfam module annotation: Pfam domain module=ATP-grasp_3::CitG::GSH-S _ATP::RimK; Domain location=70-234::251-513::72-242::70-253
MVSLDSCHVSIIEQQVTVHIPGLMQSAPIAFVRGVAAGTTQQIITRMNILHTLQRQGMIIYNQARAIEITVDKGLTSQLLAEQGIATPSTWICEHRGIAHSLMQQAMDAGKSLVIKPLFGSQGKGVRLINPQQFALPQDPFVDGVYYLQEKIECGLHQHDYRVFVVRGEPVAVMKRQGDGWLHNVARGAKCTACDEPDVVELGVKAAQAINIDYAGVDIMRDQHGKLWVIEVNSIPAWRGLQISVQQAYLNACLAELEALKPGNVHIFADGHGMQVQDFIHSAEVSAPALCDDQAFGVRLLGQRILDALEVTYDKVGCNTNLGIVLLAAPVVQALANCPQQPLQYGLQQVLQQTTIADAACVYQGIRLVNPAGMGQRQEHDVSEAPQIDLLEAMRLASAQDMVARQYVDGYATIFSAVLPLYRELIRRWERPAWALTGVYLYWLSTFPDSHIARKYGAATAASVQKTAQMQYQAFIALENPKHSLSELLKWDHALKEQKLNPGTSADLTVIAAMCAALTE

SEQ ID NO: 168414 - protein, 100 aa, Glycine max
  Coding DNA Sequence Number=SeqID_51636
MCGEANNDAAKEFNYMANHNRQGFHTGGFSGYQQGGNFNNNQGEGWRSHSGNQFNKEQGGSQCPIIRVLSQQLRTWKSKRVIVGDESQSNEGELGAEEEK

SEQ ID NO: 168415 - protein, 182 aa, Glycine max
  Coding DNA Sequence Number=SeqID_51637
MHNKNILPERIVELAYSHYDEFLKELERRWWHRALTRQPDNHIDLALVMEFYANLYDLEDRSPRQCKVRGKLIKFDAATLKEFLETPMVLEPGERKDLTTLAQTWSVLSYFNLAPTSHTSDLNMDRARLVYGIVIKMDIDMNDSRMEKEEREETPLQGEDESRRSSPAKEAMDKSLEEEGDE

SEQ ID NO: 168416 - protein, 257 aa, Glycine max
  Coding DNA Sequence Number=SeqID_51638
MASKKRLASSSRPQEPYDTSRFVSEISWERYEMNVHHRNILPERNMELTYSHYDEFLRELERRQWHKNLTRQMENHIDLALIKEFYSNLYDLEERSLRQCKVRGKTIKFDAATLNTFLETPVVLEPGESTLEAVEEGLDHSRTDMLSHEDGHGPGLHHFWPDISDGPARTPSDAPAPTPLAPVPDSTNPFMPSSDVIVPMLQSIHHGLCLHTKAHSASMSHRARVSENPLSELGRAKLEKRQCPRWAGWLCTEHVDL

SEQ ID NO: 168417 - protein, 208 aa, Glycine max
  Coding DNA Sequence Number=SeqID_51639
  Subcellular localization annotation: CTP_CleavageSite=39; ConfidenceScore=5.20e-01
MDVGSIISGQISQMAQSNSSRLGFPTLIPALCISRRVVSDSLTFESLSPAINLAYIRKNSWNPDDPTITFHGSRKARARAPSNALTLALAPAPTPAPVPPAPANPSTSSSNAILPMLQSLHHNLCLVMQSIHDLAQQRSIISMEDFMTQVAWPRVQPSFLGGEDTLEAREAKKTPEETPTATPMEITEGGGVAEACIDEDYVADVTTA

SEQ ID NO: 168418 - protein, 113 aa, Glycine max
  Coding DNA Sequence Number=SeqID_51640
MQSMQNLSQQQPMMSMEDFLAQVACPGVQPFFLGGSEAPVVQDPSFHATEDTLEAGEAEDTPEAKAEAEDTSVEAPEEASGATDVDMDEDYVADITTGRGLGIHGPFLLRIEA

SEQ ID NO: 168419 - protein, 81 aa, Glycine max
  Coding DNA Sequence Number=SeqID_51641
MENLSQQQPMMSMEKFLAQGAWPGVQPFFLGGSEGPGGQDPSFHATEKTLKGGEGEKTPKAKGEAEDTSVEAPEEAFGATK

SEQ ID NO: 168420 - protein, 93 aa, Glycine max
  Coding DNA Sequence Number=SeqID_51642
MMRLDSIKILKKKIWTLDDHENIQHRNEDVSLFRKCLWLWLTCFINVHRPKQATAKKFWLIVHNSMIFSIVLTHAHPIAVPERVLAFHPVSFL

SEQ ID NO: 168421 - protein, 204 aa, Glycine max
  Coding DNA Sequence Number=SeqID_51643
MENKENINEWQQIEQFPELSEWNMVVINENYLVGDQASSTNNELSLLQIVPTTVTDPEVDGTSSPLTVSSSEGETAPLDWRVRVVSEAKKVLKVRLEGVRERVVGVASKVGNWAMCAGAFWSFTQVAGAAAAAAVLLSLVYVGIRRRRRRVGRRNVVVDPWVYLLKEKDEETPTLNGRFTDDSFSLTETPVAKFHNQLQKILGR

SEQ ID NO: 168422 - protein, 91 aa, Glycine max
  Coding DNA Sequence Number=SeqID_51644
MKKTLCVVNCGMSIKAGKLKKRREGVEMLLKDSLSEPDWLSEAYSLSEAASSLSKCKTLENFEPESSAFSAQPARPTRTLSLLVLSMFRPA

SEQ ID NO: 168423 - protein, 111 aa, Glycine max
  Coding DNA Sequence Number=SeqID_51645
MTSCMSINALVLYAVNKGHTMKGMSFTTCFKEHEAMESATRKGNEEGSMMGSMLESKRESKKQSARWFLQDSIGRDKKFERQSSKPVFEKPSWNDNNSKRISSKFSWNGSF

SEQ ID NO: 168424 - protein, 68 aa, Glycine max
  Coding DNA Sequence Number=SeqID_51646
  Gene Ontology: Mol. function=catalytic activity; Biological process =metabolic process
MNVKIREDMVVLRVSLRPHPIDAPRVQTVFLEEEDHRREERVANSRMRFWKLSRGREDGGYKGNTRTF

SEQ ID NO: 168425 - protein, 334 aa, Glycine max
  Coding DNA Sequence Number=SeqID_51647
  Gene Ontology: Mol. function=transcription factor activity; Cellular component=nucleus; Biological process=regulation of transcription, DNA-dependent
  Homolog annotation: Hit_ID=Q1T6R1; Match level="QueryCoverage=96%, HitCoverage=81%, E-value=3e-30, Identity=31%"; Hit description =Pathogenesis-related transcriptional factor and ERF
  Pfam annotation: Domain name=AP2; Domain location=45-109; Score =121.4; E_value=2.5e-33; Accession=PF00847.10; Description=AP2 domain
MANKRKRWEGQGDQGNSEEGNIELEQLREEAASMAADILVARRAKKRYIGVRQRPSGRWVSEIKDTIQNIRLWLGTYDTAEDAARAYDEAARLLRGANTRTNFFSSQSSPNSVPALPLKIAKLLLLRLKARNMASSCVVTPFPSNHYEPEPESHFYHQIEESYYGNSLDMVGNGIVEQNYYCASYSSSAIITTCDFSCGTNEENSNLEGSSREDSRLGYHCDDNVYDQNNQIVSGKEFEDCDAGIRDLQFLDTAGSLSCFFSPFEIAEEMVGSIEEEEKYRVDDSPLGRESFRMKYERKFSACLYTLIGVSECLSLQVGPGNGKELEKKIEDGK

SEQ ID NO: 168426 - protein, 124 aa, Glycine max
  Coding DNA Sequence Number=SeqID_51648
  Gene Ontology: Mol. function=amino acid transporter activity; Cellular component=membrane; Biological process=amino acid transport
  Homolog annotation: Hit_ID=Q4KBR6; Match level="QueryCoverage=65%, HitCoverage=18%, E-value=4e-13, Identity=53%"; Hit description=Amino acid permease, putative
ALDDAVFAAGAGVCGAEFGIAQRDGGGDAGGDQKRQKGAAAGVGDRQRGDDEDRTGRRHAGRGDHHHVEDAEIAFEGVFRGGLFHGITTPLTLYAGIKWSARKIPCAFQAAALLAADHSHQSLT

SEQ ID NO: 168427 - protein, 349 aa, Glycine max
  Coding DNA Sequence Number=SeqID_51649
  Gene Ontology: Mol. function=methylmalonate-semialdehyde dehydrogenase (acylating) activity; Cellular component=integral to membrane; Biological process=valine metabolic process
  Homolog annotation: Hit_ID=Q0X971; Match level="QueryCoverage=99%, HitCoverage=45%, E-value=1e-156, Identity=77%"; Hit description =Methylmalonate-semialdehyde dehydrogenase
  Pfam annotation: Domain name=Aldedh; Domain location=1-329; Score =205.4; E_value=1.3e-58; Accession=PF00171.12; Description=Aldehyde dehydrogenase family
MVPLWMWPMAVACGNTFVLKPSERVPSAALYIARLATEAGLPPGVLNVVNGDREAVETLLHDGRVKAISFVGSTPVAEHIYHTGCAQNKRVQALGGAKNHAVVLPDADIPGAVGALMGAAFGSCGQRCMAIPLVVAVGDGTAEALIAGLRQQMAAMRVGPGSDNRNDMGPLVTQQHYQKVKGYIDHGVAEGAELLVDGRELRVTGADGRPSQGYFLGPTLFDRVTPDMRIYQEEIFGPVLGVVRAASLPEAMALIDAHEYGNGTCLFTRDGEAARYFSSRIQVGMVGINVALPVPVAYHSFGGWKRSLFGDLHAYGPDAVRFYTKRKTVTQRWPSSGDARRASFSFPSG

SEQ ID NO: 168428 - protein, 89 aa, Glycine max
  Coding DNA Sequence Number=SeqID_51650
  Subcellular localization annotation: CTP_CleavageSite=76; ConfidenceScore=5.71e-01
MSPPPLEPHNHSQSRTTSSSSSVLCSATLDRLARISEFRLSARLLAQRMDSSSALSGMSSRLANMHNSSFCQILPRAQPREWCAQRMAR

SEQ ID NO: 168429 - protein, 232 aa, Glycine max
  Coding DNA Sequence Number=SeqID_51651
  Subcellular localization annotation: CTP_CleavageSite=57; ConfidenceScore=5.03e-01
MCFVQDSLKEQASQGSFVPHGRQDLLTTAIGRLKHPGRVRAAGAGVTIKQYFGSAPRSSRSSSSMAPKELEQLTQQIRDQLEESITEKIQPQGLALPPEPEVGPSVARVSIKGSCVDPSSTNPDTGDSDKCGLYIEENLSRLIALGRVYEGSTTVHNIPLLHGQVKVGVEEVKDVEALVPVPTDETAVSPAKPPDRPDHEVEDPLYLMTLTIRQLFFEASPGYVGCYHVRGV

SEQ ID NO: 168430 - protein, 123 aa, Glycine max
  Coding DNA Sequence Number=SeqID_51652
  Gene Ontology: Mol. function=RNA-directed DNA polymerase activity; Cellular component=chromatin; Biological process=RNA-dependent DNA replication
MDKQKVKAIEEWGVPVTELRSVLGLLNSSGKCQRAFEDLKRAVTEEPVLRLPDYTVPFEVHTEASDYAIGRVLVQEGHPVAYESRKLNETERRGPSPRERDNSHGALPEDVEALRAWIGSRFI

SEQ ID NO: 168431 - protein, 1021 aa, Glycine max
  Coding DNA Sequence Number=SeqID_51653
  Gene Ontology: Mol. function=metalloendopeptidase activity; Cellular component=periplasmic space; Biological process=proteolysis
  Homolog annotation: Hit_ID=UPI00005F7356; Match level="QueryCoverage =61%, HitCoverage=64%, E-value=0.0, Identity=61%"; Hit description =COG1025: Secreted/periplasmic Zn-dependent peptidases, insulinase -like
  Pfam annotation: Domain name=Peptidase_M16_C; Domain location=352 -529; Score=44.7; E_value=3e-10; Accession=PF05193.11; Description =Peptidase M16 inactive domain
  Pfam annotation: Domain name=UvrD-helicase; Domain location=618-1020; Score=-100.1; E_value=2.7e-08; Accession=PF00580.11; Description =UvrDREP helicase
  Pfam module annotation: Pfam domain module=Peptidase_M16_C::UvrD -helicase; Domain location=352-529::618-1020
GLADGVKAGADPMTERNSGVFAISVSLTDKGLAQRDRVLAAVFSYLDMLRKQGIDKRYFDEVAHVLALDFRYPSITRDMDYIEWLVDTMLRVPVTHTLDAPYLADRYDAAAISARLAEMTPQNARIWYISPAEPHNKQAYFVNAPYQVDKISAAQFSDWQQQAQQIPLSLPTLNPYIPSDFALIPSDGKHYDHPVALTNGDSMRIYWMPSQFYASEPKAAITLALRNKSAISDARQQVLFGLNDYLSSLALDELNSQASVGGISFSTGEDDGLVFNASGFTQRLPELLKKLVEGYASFQPDAQQLEQAKSWYLDRLEAAEKGKAFEQAIQPMQMLSQLPYTQREARRQLVKQITLQEVMDYRDALIQHATPEMMVVGNLSADRVKQLGEELKQQLHSAGHGYWHSNYVVVDKPIKANLQKTGSSTDSALATLYVPLGYSEYQSMANSTMLSQIVQPWFYNQLRTEEQLGYAVFAYQMPIGRQWGIGFLLQSNSKAPAYLLQRFQAFYPQAEQRLRSMKAEDFAQYQQALINDLKQRPQTLDEEANRYSRDFNRQNFAFDTREKAIAQIQQLTPASLADFFHQAVLAQQGMAMISQIGGSHDGTHDADYAPLPGFTTWDEVARLQQSLSGERLIEASAGTGKTFTIGLLYLRLLLGLGGPNAYARPLSVEEILVVTFTEAATAELRGRIRENIHELRLACLRGVSANPMLMQLLADIAQPAEAASLLLAAERQMDEAAIFTIHGFCQRMLNLNAFESGMLFEQQLIEDEQQLLRQATADFWRRHCYPLTLDIARVIVSEWSGPEQLLSTLRPAVAGAGREVLTLVGQSDVDKRSYSSKNLPLWVSKVSAWAQSETADYQIPAELARFGQQVLNEKTKKGAPPHHPLFAAIDTFLAQPLSLRDLVIARALVEVRHAVRKEKRLQALLGFDDLLSQLDEALQQPGGEQLAQAIRQRFPVALIDEFQDTDPLQYRIFRTLYLQQPQHALLLIGDPKQAIYAFRERQSAVYAPARTVSVCGHPVSA

SEQ ID NO: 168432 - protein, 353 aa, Glycine max
  Coding DNA Sequence Number=SeqID_51654
  Gene Ontology: Mol. function=amino-acid N-acetyltransferase activity; Cellular component=cytoplasm; Biological process=amino acid biosynthetic process
  Homolog annotation: Hit_ID=Q8ZH86; Match level="QueryCoverage=80%, HitCoverage=64%, E-value=1e-144, Identity=90%"; Hit description =Amino-acid acetyltransferase
  Pfam annotation: Domain name=AA_kinase; Domain location=93-336; Score= 116.0; E_value=1.1e-31; Accession=PF00696.18; Description=Amino acid kinase family
MQVLDIDHQPFGIAQRELLIVQRDVGFQRHARVSRGWPDAHGHNVLTGRKTAARHAQQPQRTCALGFAVKERSTELVQGFRHTVPYINAHRDKTFVIMLGGEAIEHENFSSIVNDIGLLHSLGIRLVVVYGARPQIDASLAQQQLEPIYHKHTRVTDAQSLELVKQAAGRLQLDITARLSMSLNNTPLQGAHINVVSGNFIIAQPLGVDDGVDYCHSGRIRRIDEEAIHRQLDNNAIVLLGPVAVSVTGESFNLTSEEVATQLAIKLKAEKMIGFCSEQGVTDREGTIISELFPNEAQTRIDEMESDGDFLSGTVRFLRGAVKACRSGVRRSHLISYQEDGALLQELFSRDGI

SEQ ID NO: 168433 - protein, 125 aa, Glycine max
  Coding DNA Sequence Number=SeqID_51655
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=22%, E-value=1e-37, Identity=53%"; Hit description =Kinesin, motor region; Prefoldin
VSSLRGELLQVRDERDRQLSQVQTLSSELEKVKESRKHSSTKLDSLTLKANDLEEKCSLKDNQIKALEEQLATAEKKLQELKGNIRVLCQVRPLLADESCSTEGKIFSYPTSMETSGRAIDLAQN

SEQ ID NO: 168434 - protein, 182 aa, Glycine max
  Coding DNA Sequence Number=SeqID_51656
  Pfam annotation: Domain name=zf-CCHC; Domain location=95-112; Score =17.9; E_value=0.0011; Accession=PF00098.13; Description=Zinc knuckle
MSLATLFGKLHEHEMELMRLHQHEKNDKKNKGIALKASSSSIQEESDKEDLNKIQEDDDFRFFMKRFNNFLRNKRNQRKSNINPKKKGEDSSLAPKCYECDQPEHMRFDCLVFKRRMEKSDKRNVKEKKEKKAHITWKDNDMDNSSDLENEIINLGLMAKDYESEEEMHSMICIKNMPNLPN

SEQ ID NO: 168435 - protein, 377 aa, Glycine max
  Coding DNA Sequence Number=SeqID_51657
  Homolog annotation: Hit_ID=Q1S0F5; Match level="QueryCoverage=30%, HitCoverage=26%, E-value=8e-08, Identity=34%"; Hit description=IMP dehydrogenase/GMP reductase
GPYLFSGFYPSLARTSKIVQISAQELDHRKQVENGVVGLPRKYLEAKARILAAIDAFLAYHNHKESPIIAMLADIYGTFDRRCKACLPARKSPLMHRERRRKLGATLSKQRMSICQLVPSMEGRTGVLISCGGFPNVPLLGTRGCISYNPVLAIRQLGYPMRGAPLEDELAPVISRGFNKTNVETLQKGPQGMGGVAKEGQGTQGQTTKREEVEALKEDEEVQALRAELEQAQTVKERARREEHGRNKFRGALWGSNNELKLQREERDQSRVDNLILKDELKACSRSKKSLSQRLCKIETNMLAIISKYQEELNLATAHEHRVADEYAQVYTEKEARGRVIDSLHQEATMWMDRFALTLNGSQELPRLLAKAKAMAN

SEQ ID NO: 168436 - protein, 41 aa, Glycine max
  Coding DNA Sequence Number=SeqID_51658
MWAIIDEYKEKLYLAAAHRQKLEDEYAKVSVLQAEREAREK

SEQ ID NO: 168437 - protein, 277 aa, Glycine max
  Coding DNA Sequence Number=SeqID_51659
  Gene Ontology: Mol. function=succinate dehydrogenase activity; Cellular component=membrane; Biological process=electron transport
  Homolog annotation: Hit_ID=Q6D5S1; Match level="QueryCoverage=94%, HitCoverage=27%, E-value=1e-111, Identity=74%"; Hit description =Putative NADH:flavin oxidoreductase
  Pfam annotation: Domain name=Oxidored_FMN; Domain location=6-277; Score=182.9; E_value=7.6e-52; Accession=PF00724.10; Description =NADH:flavin oxidoreductase  NADH oxid
MNTLTPILNPLTLPKGAVLKNRLVMAPMTTCTGYYDGGVTSDLVEYYRVRAGSIGTVIVECAFIDNRGPAFPGAIGIDSDNKIPGLARIAHAIKSQGSKAILQIYHGGRMVEPALIGGKTPVAPSAIAAPREGASTPQALTAEEVEVMITKFGDAVNRAIKAGFDGVEIHGANTYLIQQFYSPNSNQRDDKWGGSRDNRARFPLEVLEITHKMAERFAAADFIIGYRFSPEELEVPGIRWDDTLYLLEKLAARGLDYVHFSVGQLLRPSIVDTQDPT

SEQ ID NO: 168438 - protein, 313 aa, Glycine max
  Coding DNA Sequence Number=SeqID_51660
  Homolog annotation: Hit_ID=Q6D2U0; Match level="QueryCoverage=38%, HitCoverage=57%, E-value=2e-30, Identity=60%"; Hit description =Putative glutamine amidotransferase
MAPQAQLDVFEISPELVKGLRRWNDARMQVRACSAEYLSGETGAARRVCPVSVHLADPAQPVTLLHLAAPAGAEKYATRVGLSLHAALRALSLRLRARLLPETLQQLARPVFARQLRAIIADAGRQTGAPAANSAGSGNHPALNAPAPVPAAAVPAPTGGATTTPGRPPATVPATDRAVRVIAHFTAQRIGHQLMAIANAEQRQLRVDGRTNPGGGALAPVGVIGHHRPRTAENRAADARESRQLFPEMRPHNDIIIRLARVGIAGASATVSDLDALCGGGYRAGAVLPHHARPATVAADAGVYLWLHALFTA

SEQ ID NO: 168439 - protein, 513 aa, Glycine max
  Coding DNA Sequence Number=SeqID_51661
  Gene Ontology: Mol. function=oxidoreductase activity, acting on the CH-OH group of donors, NAD or NADP as acceptor; Biological process =metabolic process
  Homolog annotation: Hit_ID=Q6D465; Match level="QueryCoverage=39%, HitCoverage=83%, E-value=5e-97, Identity=79%"; Hit description =Putative hydrolase ECA2529
  Pfam annotation: Domain name=2-Hacid_dh_C; Domain location=104-277; Score=167.2; E_value=4.2e-47; Accession=PF02826.9; Description=D -isomer specific 2-hydroxyacid dehyd
  Pfam annotation: Domain name=3HCDH_N; Domain location=136-252; Score=- 114.1; E_value=0.087; Accession=PF02737.8; Description=3-hydroxyacyl -CoA dehydrogenase, NAD binding domain
  Pfam annotation: Domain name=NAD_binding_2; Domain location=136-257; Score=-79.6; E_value=0.033; Accession=PF03446.5; Description=NAD binding domain of 6-phosphogluconate dehydrogenase
  Pfam annotation: Domain name=PHP; Domain location=311-504; Score =140.7; E_value=3.9e-39; Accession=PF02811.9; Description=PHP domain
  Pfam module annotation: Pfam domain module=2-Hacid_dh_C::3HCDH_N::NAD_ binding_2::PHP; Domain location=104-277::136-252::136-257::311-504
MEIIWYHPSLNPQPWLDGMRQRLPSVRIRQWQPGDSAPADYAIVRSPPVEMLAGRALRGVFAMGAGVDEILRQLRTHPEMLADAVPLYRLEDTGMARQMQEYANWCVLGWFRRFADYHQQQRQALWQSLPDRERANFTIGVLGAGVLGRSVLESLRQWGFPLRCWSRSPKQIAGVTTFHGRDQLTEFLAGTQILIDLLPATPETSNLIDGAFLSALPRGACFLNLARGAHVVEADLLAALESGQLAAAALDVFQVEPLPAASPLWSHPRVMITPHNAATTLPHEAMDYIAGAITALEQGQQPREEKRMYPVDLHMHTVASTHAYSTLHDYVAQAKRNGLKLFAITDHGPDMADAPHYWHFVNMRIWPRVIDGVGVLRGIEANIKNQQGEIDCSGPMLDALDLIVAGFHEPVYAPRDKAHHTEAMIATMASGLVHIISHPGNPKFPVDIRAIAEAAAHYDVALEINNSSFTHSRPGSEPNCRAIAEAVRDAGGRLAFGSDSHTAFTLGDFEHCL

SEQ ID NO: 168440 - protein, 378 aa, Glycine max
  Coding DNA Sequence Number=SeqID_51662
  Gene Ontology: Mol. function=hydrolase activity, acting on glycosyl bonds; Cellular component=periplasmic space; Biological process =trehalose metabolic process
  Homolog annotation: Hit_ID=P13482; Match level="QueryCoverage=81%, HitCoverage=54%, E-value=1e-132, Identity=70%"; Hit description =Periplasmic trehalase precursor
  Pfam annotation: Domain name=Trehalase; Domain location=57-378; Score= 301.3; E_value=1.8e-87; Accession=PF01204.9; Description=Trehalase
MIKNVVFTPARLTLLLSAALLSASAVHAEDNSRMLSAQPQPPDVRLGPLFSAVQQARFYPDQKTFADAVPKYDPASILADWQMQKNQRNFDLRRFVDTNFTLPKAQDKYVPPAGQSLRAHINGLWPVLTRSTPTASQYDSLLPLPKPYVVPGGRFREVYYWDSYFTMLGLAESGHWDRVQDMVDNFASELDKYGHIPNGNRSYYLSRSQPPFFSLMVDLLASHKGDDVYRQYLPQLQKEYDYWMADSDKVAAGQASKRVVKLSDGTLLNRYWDDRDVPRTESWLDDVNTAKKAPERNKQQVYRDLRAGAASGWDFSSRWFTDAHNLASIRTTQLAPVDLNSLLFHLEQTLAKAAKLAKQNDKAQQFAADAEKRQAAIN

SEQ ID NO: 168441 - protein, 171 aa, Glycine max
  Coding DNA Sequence Number=SeqID_51663
MERSMIDAASGGALGDMTPAEAKNLFEKMASNSQQFSARSDAIVIRRVHEVATNSSSSGKTKKLEGKLDALVNLVTQLAMNKKFAPVARLCGLCSSADHHTNLFPSMQQSEAIEQCEAYAANIYNRPSQPQQQNQPQQNNYDLSSNRYNPEWRNHPNLRWSNPSQQQQQQQ

SEQ ID NO: 168442 - protein, 89 aa, Glycine max
  Coding DNA Sequence Number=SeqID_51664
  Gene Ontology: Mol. function=RNA-directed DNA polymerase activity; Cellular component=intracellular; Biological process=RNA-dependent DNA replication
MKPHQEETEIVNLGVGEERKEVKKQFDAGFLAVAQFPKWVANIVPVPKKDGKIKMTPEDMEKTTFVTLWGTFYYKVMSFGLKNVEATYQ

SEQ ID NO: 168443 - protein, 51 aa, Glycine max
  Coding DNA Sequence Number=SeqID_51665
MSDMPFRGLKSARKRAAFSGKHDELAKRACYAKRSLKNLLSALTVLSEFIF

SEQ ID NO: 168444 - protein, 303 aa, Glycine max
  Coding DNA Sequence Number=SeqID_51666
  Gene Ontology: Mol. function=protein binding; Cellular component =intracellular; Biological process=defense response
  Homolog annotation: Hit_ID=Q1S334; Match level="QueryCoverage=83%, HitCoverage=49%, E-value=3e-61, Identity=46%"; Hit description =Disease resistance protein; AAA ATPase
  Pfam annotation: Domain name=LRR_1; Domain location=125-147; Score =9.0; E_value=5.9; Accession=PF00560.23; Description=Leucine Rich Repeat
  Pfam annotation: Domain name=LRR_1; Domain location=149-171; Score =13.9; E_value=0.58; Accession=PF00560.23; Description=Leucine Rich Repeat
  Pfam annotation: Domain name=LRR_1; Domain location=173-195; Score =12.8; E_value=1.1; Accession=PF00560.23; Description=Leucine Rich Repeat
  Pfam annotation: Domain name=LRR_1; Domain location=197-219; Score =14.9; E_value=0.3; Accession=PF00560.23; Description=Leucine Rich Repeat
  Pfam annotation: Domain name=LRR_1; Domain location=221-242; Score =4.6; E_value=40; Accession=PF00560.23; Description=Leucine Rich Repeat
  Pfam module annotation: Pfam domain module=LRR_1::LRR_1::LRR_1::LRR _1::LRR_1; Domain location=125-147::149-171::173-195::197-219::221-242
QWRNCPNVYLILTSDNSVKECFRDLGLFPEDQRIPFTSLIDMWAELYGLDDDGIEAMSIINKLDSMNLANVSVESDLPFIIFTTDAIWVAFADENCTSDWPLMMQLAQVEAFENNHMLIPNAFPNLEELNIDHCKDMVALPKGLCDITSLKKLSITNCHKLSALPQEIGNLMNLELLSLSCCTDLEGIPASIGRLSNLRLMDISNCISLPSLPEDFGNLSSLQNLYMRSCARCELPFSVANLENLKVVVCDKEIAASWDDFKPMLPNLKIDTFDNLENLKVVIGDEETAASCEDFKPMLPNLK

SEQ ID NO: 168445 - protein, 552 aa, Glycine max
  Coding DNA Sequence Number=SeqID_51667
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=1e-46, Identity=27%"; Hit description= UPI00006A17C9 related cluster
MATRPRLAFRGQHIIAIRGLHVFVLRGLHVPAFRGLHNLAFRGLRVLAFTGLQVLAFTGTHFLVFRGLNVLTIRGLHVLAFRGLHVLAFKGLHALAFKGLHALTIRRLPALAKLSEDKTSSPSEDYTGLHVLVIRGLHVLAFRGLHVLAFRGLHVLAFRGLHVLAFRGLHVFAFRGLHILAVIGLHVLAFRGIHVLAFKGLYVLAIRGLHVLAFRGLHILAFRGLQVLTFRGLHVLTFKGLDVLAFGGLHTVASTSKDYTAAHTRLQRTTRPRLHRTTRPRLQRTTRPHLQRTTRRHVLAFRGLNVLALRGLNILAFRGLHVVTIRGLDVLAFRGLHALYILAFRGVDVLAIRGLHVLTFIGLHVVAFRGLHVFAFIGLHVLAIRGLHVLAFRGLHVLTFRGLHILAVIGLHVLAFRGMHVLAFRGLHVLAVRGLHALDLTSEDYTSSPSEVYTSSPSEGYVATCPFAGERRRGSRVRFPKEERCAELPPTFICGKRRKNRRKPVEMKILSSGVVFTFEEGISTSYVDKSGTLASMYPPSKRKSDLRSSFLR

SEQ ID NO: 168446 - protein, 237 aa, Glycine max
  Coding DNA Sequence Number=SeqID_51668
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=8e-35, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPSEGYTPSPLEDYTSSPLEDYTSTPSKGYTFSRSEDYTSSPLEEYTSSPSEDSTSSPSEVYTPIPLQGLQVLAIRGLLALAFRGLHVLPFRGLHVLAIRVLHALALRALHILAFRGLHALAFRGLHVVAFRELHVLAFRGLHVLTFRGLHVLAIRGLHALAFSGLHVLAFRGLHVLTFIGLDVLAFRGLHALTFRGLHALAFRGLHVVALRELHVLAFRGLHVLTFRGLHVLAI

SEQ ID NO: 168447 - protein, 42 aa, Glycine max
  Coding DNA Sequence Number=SeqID_51669
MVKVVHVNGSSLTELIVGSNGLVLGFSSVKTMLQDCHEMALM

SEQ ID NO: 168448 - protein, 126 aa, Glycine max
  Coding DNA Sequence Number=SeqID_51670
MDSSHQWCYCSDGQRRESNVLLEGNRFCFRLPWVSDPRKGPLVLGANGGAGLHINRTVDINIVLGCYCPHLLIRDEGKKKGFKVQAEIVATTDEVVDNVAIVNEVLIDLINTSALQDNEESTKSNA

SEQ ID NO: 168449 - protein, 98 aa, Glycine max
  Coding DNA Sequence Number=SeqID_51671
MVLGFALLEALSVHVTVIGISPVSFIYIQHIVKDGGYAVELYLVGILFGCEVQGILDMSMDSMILIEASKLQMQMKEVPGTRCTVKNLEGVIFVVTLE

SEQ ID NO: 168450 - protein, 270 aa, Glycine max
  Coding DNA Sequence Number=SeqID_51672
MMSESGVKVCVFNNGDTLCGGAEGITFNSDNKKCIIVQLDITISELKHIVDSIFCIKDDGSPLGGQLSAHTSNMTFCDSSSSPSTTLTQTQNPSDPQIIVPNRKRRVKASSDTQFKENWLASLSYPFPEKTHLLSGEHEPTHQNDGSKWVLGIDPDVSGAVALLKTHGSVCSAQVPCFFLSLLAKVLSFSVLCYITWFGCGFIVLDIVGNCGQSGCNCGRGDPKSLILQLKLRKLPNANQFGCNCGCQDPENLDAAQGFLSGDLLGLGVV

SEQ ID NO: 168451 - protein, 99 aa, Glycine max
  Coding DNA Sequence Number=SeqID_51673
MNDSERKKIWYAESFSHFSDEFGIKEFWRIFGRYGRVKEVFIAARRNQWGRRSSSRHSKVGSGKLPIHCHFNCDVILTRSGLFDISYGILDDVPFKEGI

SEQ ID NO: 168452 - protein, 125 aa, Glycine max
  Coding DNA Sequence Number=SeqID_51674
  Gene Ontology: Mol. function=nucleic acid binding; Biological process= DNA integration
  Homolog annotation: Hit_ID=Q1SRN1; Match level="QueryCoverage=86%, HitCoverage=8%, E-value=8e-16, Identity=43%"; Hit description =Integrase, catalytic region
MNSDKLDHRRKCLMEVKAMDLMKTLSYQPCFKLVDGTVNIFLYSKNPPCFKLVDGTVNIFLYSKNSLAPNSLSVGRMSKKQGRMQPKIVNSRVRPCLHRMIVNRDGMRCWNKLRRRSLRVMDSDV

SEQ ID NO: 168453 - protein, 36 aa, Glycine max
  Coding DNA Sequence Number=SeqID_51675
MGLQGKQIKNDLEGARKSRRWESHWKYLAWDWTDKR

SEQ ID NO: 168454 - protein, 49 aa, Glycine max
  Coding DNA Sequence Number=SeqID_51676
MEDDRIDDRVNPEYEAWEVQDQTLLLVVGVGVLVRHEEYVDTLEGLSSD

SEQ ID NO: 168455 - protein, 163 aa, Glycine max
  Coding DNA Sequence Number=SeqID_51677
MAVVVSFPDCSVERNGGNSDRDQGGGRFANFCFKYGYTPHFNQFPIPSNGGGGRGGFPDRNVGRNGGSCGRDQGGGQFANFQCQFCFKYGHTENDHASSIWIPNSGANFHVLTFFDRATLQPISYSSGSTRTSNTWVNPNSKPVGSNFKPTQCYAYQFLLPWK

SEQ ID NO: 168456 - protein, 400 aa, Glycine max
  Coding DNA Sequence Number=SeqID_51678
  Gene Ontology: Mol. function=RNA-directed DNA polymerase activity; Cellular component=chromatin; Biological process=chromatin assembly or disassembly
MDTRKIEAVLQCPLPKSVKSLRRFLRKAHKPSAIKASINYSFAEEGHCLFQPLSEASLNKSVYEKELMALVLANPALAALPAGAINQVVDALSEKENDKETQTLSKPYWQDISEIDQKQVSSAYQFKLDPSTIQGISLFLGVGATQGKYLTSSPAGLYLPKKYLTSSPAGLLQPLPIPNAHPYIASSVPDIFTKEVIRLHGIPSSIVSDKDALLLREVLLEAMTQDLMETINQLKFHLNKAHNHMTKYVNNHRLPSKIKEGDWVCLKIRPHRQASMPTRLNPKLSAKYYGPYRVVKQIGVVAFQLQLPDAAQIHLVFFHVSQLKLAVQEHQIEGGIVRQEESSTAAKSLLERGILGEIEQNKEIVKESPAEKSRSTSIVDGRETKALDMFWFLKPCTLSG

SEQ ID NO: 168457 - protein, 70 aa, Glycine max
  Coding DNA Sequence Number=SeqID_51679
MAFGTTIARPGELMLHPEVTGSPRGVAARPSKLVSKDKVTNFIRAILLSDQQLVKTKEVQPIKKNKQISA

SEQ ID NO: 168458 - protein, 97 aa, Glycine max
  Coding DNA Sequence Number=SeqID_51680
  Subcellular localization annotation: CTP_CleavageSite=31; ConfidenceScore=5.12e-01
MAEEGQVVGVHTVDAWNQQLQNGKDSQKLVSIQTNLNFFTNLLSAPPYFLLNFVLNSRSFILLSLYVLNPCGLQNYPVPYQQIIRWSEKTVVRLLYF

SEQ ID NO: 168459 - protein, 57 aa, Glycine max
  Coding DNA Sequence Number=SeqID_51681
MSLHPPPFVVGFAGDASHLWTSSPSSIFDVATHVKITPPVADEIIILRISSSSSWHL

SEQ ID NO: 168460 - protein, 739 aa, Glycine max
  Coding DNA Sequence Number=SeqID_51682
  Gene Ontology: Mol. function=beta-galactosidase activity; Cellular component=beta-galactosidase complex; Biological process =carbohydrate metabolic process
  Homolog annotation: Hit_ID=Q9M5J3; Match level="QueryCoverage=90%, HitCoverage=90%, E-value=0.0, Identity=94%"; Hit description=Beta galactosidase
  Pfam annotation: Domain name=Glyco_hydro_35; Domain location=34-340; Score=656.5; E_value=2.2e-194; Accession=PF01301.10; Description =Glycosyl hydrolases family 35
  Pfam annotation: Domain name=Glyco_hydro_42; Domain location=55-400; Score=-240.3; E_value=0.011; Accession=PF02449.6; Description=Beta -galactosidase
  Pfam module annotation: Pfam domain module=Glyco_hydro_35::Glyco _hydro_42; Domain location=34-340::55-400
METNSVSKLLLLVFSVLFVGSELIHCSVTYDRKAIIINGQRRILISGSIHYPRSTPEMWEDLIRKAKDGGLDVIDTYVFWNVHEPSPGNYNFEGRNDLVRFIKTVQRVGLYVHLRIGPYVCAEWNFGGFPVWLKYVPGISFRTDNGPFKAAMQGFTQKIVQMMKNEKLFQSQGGPIILSQIENEYGPESGQLGAAGHAYTNWAAKMAVGLATGVPWVMCKQDDAPDPVINTCNGFYCDYFSPNKPYKPSLWTESWSGWFTEFGGPIYQRPVQDLAFAVARFVQKGGSLFNYYMYHGGTNFGRSAGGPFITTSYDYDAPIDEYGLIREPKYGHLKDLHKAIKQCEHALVSSDPTVTSLGTYEQAHVFSSKNGACAAFLANYHSNSAARVKFNNRNYDLPPWSISILPDCRTDVFNTARVSFQTSQIQMLPSNSRLLSWETYDEDVSSLAESSKITASGLLEQISTTRDTSDYLWYITSADISSSESFLRGRNKPSITVHSAGHAVHVFVNGQFSGSAFGTSEDRSCTFNGPVNLRAGTNKIALLSVAVGLPNVGFHFETWKAGITGVLLHGLDHGQKDLTWQKWSYQIGLKGEAMNLVSPNGVSSVDWVRDSLAVRSQSQLKWHKAYFNAPDGVEPLALDLSSMGKGQVWINGQSIGRYWMVYAKGACGSCNYAGTYRPAKCQLGCGQPTQRWYYFSIQLQHYILILCKILLNCVTKSHTSMQITEPLCLCGVSDMTLFE

SEQ ID NO: 168461 - protein, 96 aa, Glycine max
  Coding DNA Sequence Number=SeqID_51683
  Gene Ontology: Mol. function=protein disulfide oxidoreductase activity; Cellular component=thylakoid; Biological process=glycerol ether metabolic process
  Homolog annotation: Hit_ID=Q93WZ3; Match level="QueryCoverage=90%, HitCoverage=64%, E-value=2e-33, Identity=73%"; Hit description =Thioredoxin H
  Pfam annotation: Domain name=Thioredoxin; Domain location=2-88; Score= 113.7; E_value=5.4e-31; Accession=PF00085.10; Description=Thioredoxin
MERERNIVVDFTASWCGPCRFIAPVLAEIARHTPQVIFLKVDVDEVRPVAEEYSIEAMPTFLFLKDGKIVDKVVGAKKEELQLTIAKHVSAAAASS

SEQ ID NO: 168462 - protein, 64 aa, Glycine max
  Coding DNA Sequence Number=SeqID_51684
MAKVGRAPMNDWATLGICCKIWFEAKQCLVRKIEESTTLGEMNNHFARMIALEGTPNQLEIIIL

SEQ ID NO: 168463 - protein, 104 aa, Glycine max
  Coding DNA Sequence Number=SeqID_51685
  Homolog annotation: Hit_ID=Q00M75; Match level="QueryCoverage=29%, HitCoverage=5%, E-value=3e-08, Identity=93%"; Hit description=PPR -repeat containing protein
MLCVALSFKQQQEVAFRNSSSRHGIVRLPVVKFLAGTKCKIRVYIKLRTPLSKGSSLCEGMGEGCCTQPYPCICKEAVSRFEPMTNKSPRHNFTAALGLALKYI

SEQ ID NO: 168464 - protein, 378 aa, Glycine max
  Coding DNA Sequence Number=SeqID_51686
  Gene Ontology: Mol. function=oxidoreductase activity; Cellular component=vacuole; Biological process=hydrogen peroxide catabolic process
  Homolog annotation: Hit_ID=Q96512; Match level="QueryCoverage=92%, HitCoverage=97%, E-value=1e-133, Identity=68%"; Hit description =Peroxidase 9 precursor
  Pfam annotation: Domain name=peroxidase; Domain location=79-342; Score=445.4; E_value=7.6e-131; Accession=PF00141.13; Description =Peroxidase
MEHTITKINKLFNSVAILVTMHFIKLTLLAMVAFCLSVKLSLANPGFHFGWGGHHHGEISFGLSPQFYQFSCPQANDIVMSVLEKAIAKDMRIAASLLRLHFHDCFVQGCDASILLDDSARIVSEKNSGPNKNSVRGFEVIDKIKSKLEEACPQTVSCADILALAARGSTVLSGGPNWELPLGRRDSKTASLSGSNKNIPPPNATIENLVTFFKRQGLDEVDLVALSGGTSTSISCHAMLNGAHTIGVARCATFKQRLYNQKGNNQPDENLEKSFYFDLKTMCPKSGGDNFISPLDFGSPRMFDNTYFKLILRGKGLLNSDEVLLMGNVKETRELVKKYAQDESLFFEQFSMSMIKMGNLRPLIGFNGEVRKNCRRVN

SEQ ID NO: 168465 - protein, 239 aa, Glycine max
  Coding DNA Sequence Number=SeqID_51687
  Gene Ontology: Biological process=biosynthetic process
MDMARNADLVILNTAVAGKWLDAVLKEKVSEVLPKVLWWIHEMRGHYLKVEIKMPETYAVHLGNSRELMEVAEDIVAKRVLREHVWQSLGKRRRSYFMELRTNACLNLLMHSQPPSVSRGKGQDLFLRSFYESLLLIQEKKLQVPSLHAIVVGSDMNTQTKFETELRQFVMEKKIQDHVHFVNKTLVVAPYLASIDVLVQNCQAEAAAAAALTRSKRHFYDEDNDYVEQEASVIQEEWW

SEQ ID NO: 168466 - protein, 429 aa, Glycine max
  Coding DNA Sequence Number=SeqID_51688
  Gene Ontology: Mol. function=nucleoside-triphosphatase activity; Cellular component=protein complex; Biological process=protein catabolic process
  Homolog annotation: Hit_ID=Q9SEI3; Match level="QueryCoverage=99%, HitCoverage=100%, E-value=0.0, Identity=86%"; Hit description=26S proteasome AAA-ATPase subunit RPT4a
  Pfam annotation: Domain name=AAA; Domain location=175-373; Score =291.7; E_value=1.4e-84; Accession=PF00004.19; Description=ATPase family associated with various cellular activities (AAA)
  Pfam annotation: Domain name=AAA_2; Domain location=171-314; Score= -35.4; E_value=0.0045; Accession=PF07724.4; Description=ATPase family associated with various
  Pfam annotation: Domain name=AAA_3; Domain location=175-317; Score= -22.4; E_value=0.091; Accession=PF07726.2; Description=ATPase family associated with various
  Pfam annotation: Domain name=AAA_5; Domain location=175-320; Score =2.8; E_value=0.0011; Accession=PF07728.4; Description=ATPase family associated with various
  Pfam annotation: Domain name=Sigma54_activat; Domain location=141 -271; Score=-180.7; E_value=0.018; Accession=PF00158.16; Description =Sigma-54 interaction domain
  Pfam module annotation: Pfam domain module=AAA::AAA_2::AAA_3::AAA _5::Sigma54_activat; Domain location=175-373::171-314::175-317::175 -320::141-271
MTDAAEDATRRRNAVAEYRKKLLQHKELESRVRSVRENLRASKKEFNKTEDDLKSLQSVGQIIGEVLRPLDNERLIVKASSGPRYVVGCRSKVDKEKLTAGTRVVLDMTTLTIMRALPREVDPVVYNMLHEDPGNISYSAVGGLSDQIRELRESIELPLMNPELFIRVGIKPPKGVLLYGPPGTGKTLLARAIASNIEANFLKVVSSAIIDKYIGESARLIREMFGYARDHQPCIIFMDEIDAIGGRRFSEGTSADREIQRTLMELLNQLDGFDQLGKKHLLPFLTNLKVKMIMATNRPDVLDPALLRPGRLDRKIEIPLPNEQSRMEILKIHAAGIAKHGEIDYEAVVKLAEGFNGADLRNVCTEAGMAAIRAERDYVIHEDFMKGLLLVAHRHNNLTSFFGSQAVRKLNDAKKLESSAHYSADFGKD

SEQ ID NO: 168467 - protein, 107 aa, Glycine max
  Coding DNA Sequence Number=SeqID_51689
MARGQGWTQTTNNRSKEYDHCASGVPSSNGTLKDAVISSGYCTAATEAFQNHNASSIKTRSSSPMSSHYSMLLTSTDTTTSTVLISNRTVSGKMEALTHGTQGLDKA

SEQ ID NO: 168468 - protein, 92 aa, Glycine max
  Coding DNA Sequence Number=SeqID_51690
  Gene Ontology: Mol. function=catalytic activity; Biological process =auxin mediated signaling pathway
  Homolog annotation: Hit_ID=P33083; Match level="QueryCoverage=96%, HitCoverage=100%, E-value=1e-35, Identity=80%"; Hit description =Auxin-induced protein 6B
  Pfam annotation: Domain name=Auxin_inducible; Domain location=1-90; Score=174.8; E_value=2.1e-49; Accession=PF02519.5; Description=Auxin responsive protein
MGFRLPGIRRPSFAANIASSKAGEVPKGYIAVYVGERMKRFVIPISYLSQPSFQDLLSLVEEEFGYDHPMGGLTIPCSEDVFQHITSSLNGQ

SEQ ID NO: 168469 - protein, 448 aa, Glycine max
  Coding DNA Sequence Number=SeqID_51691
  Homolog annotation: Hit_ID=Q1AN55; Match level="QueryCoverage=93%, HitCoverage=36%, E-value=1e-75, Identity=36%"; Hit description =Telomerase
EFKNWNDAVHGVKHKLLEKWIFWYFSFLVVPLVQSNFYVTESEQGKQDIYYYPKPVWEKLAASTVACFKDWRYSCLDDVAVRNILRGRKFGFSKLRLQPKENGVRMVANLKGSSKMPLLMSTMGVRNWKTKGKGSASMPNLFIVKSDVMKAFDSINQDKLLDIMKDFLLKDVYFLKQYDEVVCTKKSLWVQKQFTMLDETRNNSDTQFTSFASFHSHHGVFVNQGKAAYNIPPPYLRIAKSLWAMGYEEYLSIHERWNTVKKKALNADLMQHVKRNVLQFNGKFYLQDVGIPQGGVLSSLLCSMYYGHLERHVIFPFLEKTLECGSCTENNAGQTNYDDKVSSYMLMRFIDDFLFISTSKKQAASFFSRLERGFRGYNCHMNKKKFGANFDVEHISDCPLNRVYVGEDGATSFLQWSGLLINCSTMEIQADYTNLEVKGVSGLSDLVL

SEQ ID NO: 168470 - protein, 464 aa, Glycine max
  Coding DNA Sequence Number=SeqID_51692
  Gene Ontology: Mol. function=metal ion binding
  Homolog annotation: Hit_ID=Q1SKJ1; Match level="QueryCoverage=86%, HitCoverage=98%, E-value=1e-68, Identity=39%"; Hit description=Zinc finger, RING-type
  Pfam annotation: Domain name=zf-C3HC4; Domain location=300-358; Score= 16.4; E_value=0.0031; Accession=PF00097.15; Description=Zinc finger, C3HC4 type (RING finger)
AVSHSHRKEAEAPFSFSNNLYPNAVITEEVSYCFLLEIEVAFEFSIVIFGLTVMFGAAIMGSACCVAAKDPNLPNRTGGESLHRDVVCSPSGSFQWDSRGRFAGEIENPSYHTSHVDSRNVSMELKGSLSSERGNLSDGGSIVENSVTPIFLKSPVDEALVANLMTPTSVFSTPTADPLPNHNYHHLPSSTPTRWAHRSPAHPLLRQISDSRIMDLKLPDNSISEGRPSFVLSTCSNEMTAGSICGSSDGWSMRTFSELVASSQRERWSFDSECFGSGRHKISGSSSRFSYSPSMELQSCGACSKLLTERSTWSNQKFISNSDLSVVAVLVCGHSYHAECLEAMTSEADRYDPACPICMVGDKHLSKLLSRKGLRAESDIKAKNHKISRNRVVDSYLDGGFDVFDRQKGIDLRGKVSKMEPSSSARSSFGKPFLRRHFSLGSKWSRSLSENDSARKKGFWARYR

SEQ ID NO: 168471 - protein, 151 aa, Glycine max
  Coding DNA Sequence Number=SeqID_51693
  Subcellular localization annotation: CTP_CleavageSite=50; ConfidenceScore=5.62e-01
MAHVRRPSANPLQHHHFLAPSAVSAGALPLPRPRLPRLRRRRGEVSSPPRGSLGLPRTALEMLRRRSKKRAFAAPVLLSALLPLVPIYGSKVRIYDEILESNNSRDKEILQFQQGKRVAMMVEGERNLLERERRSRERERVERKLVIENSA

SEQ ID NO: 168472 - protein, 42 aa, Glycine max
  Coding DNA Sequence Number=SeqID_51694
MADMGESVKDENANENNKKATAFPVVYGCGGPYVYRKFRMRI

SEQ ID NO: 168473 - protein, 102 aa, Glycine max
  Coding DNA Sequence Number=SeqID_51695
MEALEKSNGHNFSLRMSNSGASHIEMLEIEQWKLSRYSNGHNFSHGGPIQAHNTSRCSKLNNGSSQEIQMVETIHSDVRFRRITYRDARNRTTEALEKFKWS

SEQ ID NO: 168474 - protein, 106 aa, Glycine max
  Coding DNA Sequence Number=SeqID_51696
LSKLKIINDENFEAPEEDEETSGESVPGYEKKMQLPQEPLEQETKRARKEEHGCDKFRGALWGSNKTNMLAIVSKYQEELNLATGHEHKVADEYAQVYAEKEARGR

SEQ ID NO: 168475 - protein, 178 aa, Glycine max
  Coding DNA Sequence Number=SeqID_51697
  Gene Ontology: Mol. function=ribonuclease H activity; Cellular component=mitochondrion; Biological process=DNA integration
  Pfam annotation: Domain name=rve; Domain location=65-177; Score=19.0; E_value=0.00015; Accession=PF00665.16; Description=Integrase core domain
MLVKVHEGFFGTNANGHAMDQKILRVGYYWLTMESDCCIHVRKCHKCQTFADNVNAPPIPFNVLAALWPFSMWGIDVIVAIKPKALNGHRFILVAIDYFTKWVEATSYSSITKSVVVRKIIIDNATNLNNKMMKEICEDFKIQHHNSTPYRPKMNGATEVANKNIKKIIQKMIVSYKD

SEQ ID NO: 168476 - protein, 140 aa, Glycine max
  Coding DNA Sequence Number=SeqID_51698
  Gene Ontology: Mol. function=RNA-directed DNA polymerase activity; Cellular component=intracellular; Biological process=RNA-dependent DNA replication
NARATYQQAMVALFHDMMHKEIEVYVDDMIAKSRTEEEHLINLLGKLLGFVVSQKGIEVDPDKVKAILDMPEPRMEKAFQLDRNVHITAHRYLRAALQTLAQELVYSLERRLSRGIWKDQAMPYESSYAYASYPVHDSVG

SEQ ID NO: 168477 - protein, 42 aa, Glycine max
  Coding DNA Sequence Number=SeqID_51699
MDVLCLVGTSVKPTKHRGRICQDSYHRTFLTMAVGKESVDCC

SEQ ID NO: 168478 - protein, 76 aa, Glycine max
  Coding DNA Sequence Number=SeqID_51700
MGPGIKNVVFFNDASLAKWRWALFAREESLWSEGEICLSGKDNNIWSFNNAWLKYNSNLTERMHGCGVKKLREFLD

SEQ ID NO: 168479 - protein, 160 aa, Glycine max
  Coding DNA Sequence Number=SeqID_51701
MMVITSTFVQVKPPSRPCPLLMSTCCFRFLNQTPWRILMGDIENADEGDASERSNDDEVVADIDKECALLIIYFNEVQDASDEEVRSEGNGVEDVEGPTRMSLLMLGGNNLVEVETCSANERICESPLVEVGEFTYIYELLVGKFGVQCCVSSDRAQVSS

SEQ ID NO: 168480 - protein, 245 aa, Glycine max
  Coding DNA Sequence Number=SeqID_51702
  Gene Ontology: Mol. function=alpha,alpha-trehalose-phosphate synthase (UDP-forming) activity; Cellular component=alpha,alpha-trehalose -phosphate synthase complex (UDP-forming); Biological process =trehalose biosynthetic process
  Homolog annotation: Hit_ID=P93653; Match level="QueryCoverage=96%, HitCoverage=25%, E-value=1e-127, Identity=89%"; Hit description =Trehalose-6-phosphate synthase
  Pfam annotation: Domain name=Glyco_transf_20; Domain location=1-245; Score=109.5; E_value=9.8e-30; Accession=PF00982.11; Description =Glycosyltransferase family 20
MSMLFNKGVKEFEAKWIGWAGVNVPDEIGQKALTKALAEKRCIPVFLDEEIVHQYYNGYCNNILWPLFHYLGLPQEDRLATTRSFQSQFEAYEKANQMFADVVNRHYEEGDVVWCHDYHLMFLPKCLKTHNKKMKVGWFLHTPFPSSEIHRTLPSRSELLHSVLAADLVGFHTYDYARHFVSACTRILGLEGTPYGVEYQGKLTRVAAFPIGIDSERFIRALDLPPVQDHIKELQERFKGRKVLL

SEQ ID NO: 168481 - protein, 180 aa, Glycine max
  Coding DNA Sequence Number=SeqID_51703
  Homolog annotation: Hit_ID=Q1EP73; Match level="QueryCoverage=22%, HitCoverage=4%, E-value=3e-12, Identity=85%"; Hit description =Trehalose-6-phosphate synthase, putative
MRYASTSSPHNMFEELLHGDPFHVEAYHNLLMLTSKTNKPTEELLKRIEEDCGLIFDIKEVGRGADKGYNGNSSNIPTSRLERLLRDRELRKSGRASENNGEAMEEEVVRLREEESAAEAATKGAGGGEERQETKPFRQRLLVVANRLPVSAVRKGEDAWSLEMSAGGLVSALLGKWRSS

SEQ ID NO: 168482 - protein, 192 aa, Glycine max
  Coding DNA Sequence Number=SeqID_51704
  Gene Ontology: Mol. function=alpha,alpha-trehalose-phosphate synthase (UDP-forming) activity; Biological process=trehalose biosynthetic process
  Homolog annotation: Hit_ID=P93653; Match level="QueryCoverage=58%, HitCoverage=13%, E-value=6e-14, Identity=45%"; Hit description =Trehalose-6-phosphate synthase
MGADKIDVTVTPPTTLKKNEAHHDHDDRHLPNNALTRPPALISNDHASSPFRTADTGSLLATTSSLCRNGFVSCLSSPPPAPFVAASAALSSSLNRTTSSSIASPLFSLALPLFLSSLSLNNRSKRLVGMLLELPLYLFPGISTNNNDRLAKFVKQMCELFCLPNYICFKAAFQKHASIQQLPIKSRNEIDK

SEQ ID NO: 168483 - protein, 110 aa, Glycine max
  Coding DNA Sequence Number=SeqID_51705
  Gene Ontology: Mol. function=protein serine/threonine kinase activity; Cellular component=membrane; Biological process=protein amino acid phosphorylation
  Homolog annotation: Hit_ID=Q84QD9; Match level="QueryCoverage=90%, HitCoverage=22%, E-value=5e-31, Identity=69%"; Hit description =Avr9/Cf-9 induced kinase 1
MTVTGATGGRGGLEAAMGLRFQTKNMRPDDNKLIGYCCEEEHRVLVYEYLPTGSLENQLFRRFSASLSWSMRMKIVVGAVKGLAFLHEAEKPVIYRDFKASKILLGSVTY

SEQ ID NO: 168484 - protein, 318 aa, Glycine max
  Coding DNA Sequence Number=SeqID_51706
  Gene Ontology: Mol. function=alpha,alpha-trehalose-phosphate synthase (UDP-forming) activity; Cellular component=cytosol; Biological process=trehalose biosynthetic process
  Homolog annotation: Hit_ID=P93653; Match level="QueryCoverage=98%, HitCoverage=34%, E-value=1e-124, Identity=69%"; Hit description =Trehalose-6-phosphate synthase
  Pfam annotation: Domain name=Trehalose_PPase; Domain location=1-229; Score=251.7; E_value=1.5e-72; Accession=PF02358.7; Description =Trehalose-phosphatase
MELKVHPKLRQPLTALCSDPNTTVVVLSGSGRQVLDDNFKEYDMWLAAENGMFLHPSKGEWMTTMPEHLNMEWVDSVKHVFEYFTERTPRSHFVFEERETSLVWNYKYSDVEFGKLQARDMLQHLWTGPISNASVEVVQGSRSVEVRAVGVTKGAAIDRILGEIVHSKSMTSPIDYVLCIGHFLGKDEDLYSFFEPDLPSIGVGLPRSKVTTDGVKFPVERKPSLNVPATKSGPKSFPNKAQRSVSNSEKKTNNHICSTPRRPAPEKESWNVLDLKKENYFSCAIGRTRTNARYILDSSDDVVSFLKELAVASSRLYH

SEQ ID NO: 168485 - protein, 126 aa, Glycine max
  Coding DNA Sequence Number=SeqID_51707
  Gene Ontology: Mol. function=transferase activity; Cellular component= cytosol; Biological process=trehalose biosynthetic process
  Homolog annotation: Hit_ID=Q1SQA5; Match level="QueryCoverage=74%, HitCoverage=18%, E-value=1e-35, Identity=75%"; Hit description =Glycosyl transferase, family 20; Trehalose-phosphatase
MFAGAAQSLGAGAILVNPWNITEVAAAIARALNMPSAEREKRHKHNFNHVISHTAQEWAGTFVSELNDTVIEAQLRTRQVPPRLPTKTAIEKYVASALEELVVFQSQQELPPARRHEYAIQLKEVA

SEQ ID NO: 168486 - protein, 64 aa, Glycine max
  Coding DNA Sequence Number=SeqID_51708
MGSMRKPLPSCCAHLGRISPKPLQGGGYGAYQAPSGPRKVQQGPGVSGADHGPLPVLRSSHHSQ

SEQ ID NO: 168487 - protein, 119 aa, Glycine max
  Coding DNA Sequence Number=SeqID_51709
MRNFWSPKCFYDIKDSTTRSRYKKTCYVPIDYESIDHVDCWVIEEETPPNLDIDEFKNALYHESAIPFGESSINHEDDDNLDTMEFQVDTGDVSGSMASTNEDVIPNMSEFEGINLNIL

SEQ ID NO: 168488 - protein, 109 aa, Glycine max
  Coding DNA Sequence Number=SeqID_51710
  Subcellular localization annotation: CTP_CleavageSite=52; ConfidenceScore=5.05e-01
MFVESKDPLRRWPSHWATPKDGRNLGYAFFKSLTLKRYNKRLGRGLKNWSFTLSMTTSLNASGLLSPRSPALCKKSPWKPAIMCKRAPNDLVHGHLSQLNMTCALSTCI

SEQ ID NO: 168489 - protein, 79 aa, Glycine max
  Coding DNA Sequence Number=SeqID_51711
MEVQRLMFKEGVFSLNLNGCVEGKSSDSKEEVVMLVKRTQELGRGDGRGKGSWCWRTYAGIGGRSGGTVAPRFRVKGLM

SEQ ID NO: 168490 - protein, 257 aa, Glycine max
  Coding DNA Sequence Number=SeqID_51712
MGEVDEVQERIKADIEALKEKMATMMETMMSMKKMMEVNAAAVVATNVVAEELGSTSGPHFVQVQNKHAFPPYGLPPNYTPPNVVHTPNENVNNSNPILIESQQPQSDHAHVSQPMREAHEIPYHNLADFEPCLGYAIEGQAIDVVPLPNTLEEPQFRSQPQPLHFVAGRVPPTMAEKGKLDHIKERLRAIEGGGDHAFANMEELYLVPDIVIPPKFKVSDFDKYKGTTYPKNHLKLYYRKMGAYAKDEKLLMHFFQ

SEQ ID NO: 168491 - protein, 142 aa, Glycine max
  Coding DNA Sequence Number=SeqID_51713
  Gene Ontology: Mol. function=nucleic acid binding
  Homolog annotation: Hit_ID=Q9FNZ2; Match level="QueryCoverage=98%, HitCoverage=33%, E-value=5e-37, Identity=48%"; Hit description=Zfwd1 protein
  Pfam annotation: Domain name=zf-CCCH; Domain location=19-43; Score =4.9; E_value=0.3; Accession=PF00642.15; Description=Zinc finger C-x8- C-x5-C-x3-H type (and similar)
  Pfam annotation: Domain name=zf-CCCH; Domain location=99-124; Score =30.7; E_value=5e-06; Accession=PF00642.15; Description=Zinc finger C- x8-C-x5-C-x3-H type (and similar)
  Pfam module annotation: Pfam domain module=zf-CCCH::zf-CCCH; Domain location=19-43::99-124
MDVDGGNKRVYNRLGGDAKHQKVCYHWQAGKCNRYPCPFLHSESPANSHHANGTSSKRTYDNSGFSGPRRSPNFNNTWGRGGGRGGGGGGGAGRGVVVKAEKVCNYWIQGSCSYGERCKFLHSWSVGDGFSLLTQLEGHQKG

SEQ ID NO: 168492 - protein, 138 aa, Glycine max
  Coding DNA Sequence Number=SeqID_51714
  Gene Ontology: Mol. function=nucleic acid binding
  Homolog annotation: Hit_ID=Q9FNZ1; Match level="QueryCoverage=78%, HitCoverage=24%, E-value=3e-37, Identity=66%"; Hit description=Zfwd2 protein
  Pfam annotation: Domain name=WD40; Domain location=16-52; Score=32.7; E_value=1.3e-06; Accession=PF00400.22; Description=WD domain, G-beta repeat
  Pfam annotation: Domain name=WD40; Domain location=56-92; Score=31.4; E_value=3.1e-06; Accession=PF00400.22; Description=WD domain, G-beta repeat
  Pfam module annotation: Pfam domain module=WD40::WD40; Domain location=16-52::56-92
DGSILAWKFNVATNCFEPAASLKGHSRGVVSLVVGANRLYSGSMDNTIKVWNLETLQCLQTLTEHTSVVMSVLCWDQFLLSCSLDKTVKVWYATESGNLEVTYSHNEENTAFPTLLTSRSYTAGIKYSITWNASDKWG

SEQ ID NO: 168493 - protein, 73 aa, Glycine max
  Coding DNA Sequence Number=SeqID_51715
MTKDVIHNHNSATLRLHLPLSSSFWCSSEKSQEVQKNSLRKAKLVQANFMLSSEGTHSPKRVVARPGELVTYA

SEQ ID NO: 168494 - protein, 114 aa, Glycine max
  Coding DNA Sequence Number=SeqID_51716
MARKDKYGHLPLLSKTQCLSIETITVSFCQPETSDSVGTRRQIMVILHLFYPETIKSNARKDRYGHLLPLSKTQCLSTETIAFSLRHSEIIKSNGTQRQIWPSAPFVEDSMSFD

SEQ ID NO: 168495 - protein, 527 aa, Glycine max
  Coding DNA Sequence Number=SeqID_51717
  Gene Ontology: Mol. function=UDP-glucose 4,6-dehydratase activity; Cellular component=cytoplasm; Biological process=UDP-rhamnose biosynthetic process
  Homolog annotation: Hit_ID=Q9SYM5; Match level="QueryCoverage=98%, HitCoverage=78%, E-value=0.0, Identity=84%"; Hit description =Probable rhamnose biosynthetic enzyme 1
  Pfam annotation: Domain name=3Beta_HSD; Domain location=16-286; Score= -27.5; E_value=5.3e-11; Accession=PF01073.9; Description=3-beta hydroxysteroid dehydrogenaseisomerase family
  Pfam annotation: Domain name=Epimerase; Domain location=15-257; Score= 220.0; E_value=5.4e-63; Accession=PF01370.11; Description=NAD dependent epimerasedehydratase family
  Pfam annotation: Domain name=NAD_binding_4; Domain location=17-241; Score=32.5; E_value=9.3e-11; Accession=PF07993.2; Description=Male sterility protein
  Pfam annotation: Domain name=Polysacc_synt_2; Domain location=15-300; Score=-89.2; E_value=7e-08; Accession=PF02719.6; Description =Polysaccharide biosynthesis protein
  Pfam annotation: Domain name=RmlD_sub_bind; Domain location=14-327; Score=-143.5; E_value=0.00013; Accession=PF04321.7; Description=RmlD substrate binding domain
  Pfam annotation: Domain name=adh_short; Domain location=13-184; Score= -64.3; E_value=0.095; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=16-286::15-257::17-241::15-300::14-327::13-184
MKKLPDMASYTPKNILITGAAGFIASHVANRLVRSYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVVLHKGEVGHVYNIGTKKERRVIDVAKDICRLFSMDPEICIKFVENRPFNDQRYFLDDQKLKDLGWSERTTWEEGLKKTMDWYINNPDWWGDVTGALLPHPRMLMMPGGLDRHFEGSEEEKPASFGSSNTRMVVPPSKNTSSQHKHPFKFLIYGRTGWIGGLLGKLCEKQGIPYEYGKGRLEDRSSLMADLQNVKPTHVFNAAGVTGRPNVDWCESHKTETIRTNVVGTLTMADVCREHGILMVNYATGCIFEYNATHPEGSGIGFKEEDKPNFIGSFYSKTKAM

SEQ ID NO: 168496 - protein, 82 aa, Glycine max
  Coding DNA Sequence Number=SeqID_51718
MNLYPLRNVEQRHVGWVFSSLNNSHNEELFIPTPMMQSYPLRALDRRLQEDWASDAEEGPRVLMNLRVCRVTYKLMAPYLTS

SEQ ID NO: 168497 - protein, 81 aa, Glycine max
  Coding DNA Sequence Number=SeqID_51719
MSGVATNVYLRKTLEKLKRRRYADFENEGSGVVYAWGSLPSRLFIAKQGILDEGNSPRQAGYFTMKLFFWCPRRARGLKKV

SEQ ID NO: 168498 - protein, 133 aa, Glycine max
  Coding DNA Sequence Number=SeqID_51720
MAETEPVLDELILDDVLEVEILAEVMDDKTASGGVGQNELDQPVLPSLAEAISNEGFGHALCLVMCFLADRPMQTHIMKEKMSIIWSPLQGVSIDKINTYTFLFQFYHHVDIHKVQRGGPWMMETCLRSFYGG

SEQ ID NO: 168499 - protein, 150 aa, Glycine max
  Coding DNA Sequence Number=SeqID_51721
MLCGLLFEAKCLKCKRQVIEAGIKRKRVDLRMNALLELKLLHPRKTMNCLQPSLITSLENPSDSNCVFVILNNHVPIFEILHFSMRSCWLKALLATCVLVIEFFGTDTILNNHCEKMKNKKVTAAGVSLSEAYALSEQYPLSETSARLAS

SEQ ID NO: 168500 - protein, 223 aa, Glycine max
  Coding DNA Sequence Number=SeqID_51722
  Gene Ontology: Mol. function=zinc ion binding; Cellular component =integral to membrane; Biological process=defense response to bacterium
  Homolog annotation: Hit_ID=Q9LH79; Match level="QueryCoverage=91%, HitCoverage=88%, E-value=5e-72, Identity=63%"; Hit description=MtN3 -like protein
  Pfam annotation: Domain name=MtN3_slv; Domain location=125-211; Score= 90.7; E_value=4.6e-24; Accession=PF03083.6; Description=MtN3saliva family
  Pfam annotation: Domain name=MtN3_slv; Domain location=6-92; Score =35.7; E_value=1.6e-07; Accession=PF03083.6; Description=MtN3saliva family
  Pfam module annotation: Pfam domain module=MtN3_slv::MtN3_slv; Domain location=125-211::6-92
MISANNLIPKTTEIWHLSMSPIPIFRRIIKNGSTKMFSGLPYIYSLLNCLICLWYGTPLISPDNLLVTTVNSIGAAFQLVYILFLMYAEKARKVRMVGLLLTVLGIFVIILVGSLQVDDSTMRGMFVRFLSCASLISTFASPLFIIKLVIQTKSVEFMPFYLSISTFLMSISFFLYGFLSDDAFIYVPNGIGTVLGMIQLVLYFYYKGSTSEECREPLIVSYE

SEQ ID NO: 168501 - protein, 114 aa, Glycine max
  Coding DNA Sequence Number=SeqID_51723
MGFDFDIAYKLGCENKAVDALSKRMTYSAISMIIFSDKEEWESKVLADPKSKKIISTYNPQTDGQIEVVNRGVKTYLRSMRAKWRWKKDDWRCHFKEKMSQEQAYHHRKPWIRV

SEQ ID NO: 168502 - protein, 253 aa, Glycine max
  Coding DNA Sequence Number=SeqID_51724
  Gene Ontology: Mol. function=RNA-directed DNA polymerase activity; Biological process=RNA-dependent DNA replication
MDKSLKIGEDEWKEKERRGTKFCASNEDCIRINNPNLIMPMLFNPWGKHMKLPKTTLWPAPGPTLDMPLKGMHFLEGPVLEKERIEHMEERLRSIERGGNYAFADIAELCLVPDVVIPPKFKMPDFDKYKGTTCLKNLLKKYYRKMKAYAKDEKLLIHFFQESLARTAITWYTNLEPCWVHSWKDLMVAFIRQYQYNSDMAPDRMQLQNMCKKDYESFKEYAQRWRDLAAQVAPLMMERDDNNDSGCIAGVLL

SEQ ID NO: 168503 - protein, 192 aa, Glycine max
  Coding DNA Sequence Number=SeqID_51725
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=12%, E-value=5e-26, Identity=38%"; Hit description=Chromo
MVDLHVLPLCGVDVVLGVQWLKSLGPVLTDYNTLSMKFVYQGSLIELKGNSDSFLLAITTPQLRRLTQTHSAVEYFHIRVYDQASSSSMPHPDIHALTTQFSSLFQPPTTLPLFHLPATLTTLSTFHPTLFRLMFVLICILIFINKRLKLKLPTCFNMALSDPAPAPAPFLLLCYWSKNEMEPGPSAWTTEH

SEQ ID NO: 168504 - protein, 108 aa, Glycine max
  Coding DNA Sequence Number=SeqID_51726
  Subcellular localization annotation: CTP_CleavageSite=49; ConfidenceScore=5.20e-01
MTTSWCKIRPASRKVSGAVCPERACRLIWVGSGSHKPRSLRFASSSTVRRQTGRGGGLAEKGKRGRLGLLVETGAGKGGAKGVVEGGGAKDGPEDAKAKVGPGGGEAK

SEQ ID NO: 168505 - protein, 453 aa, Glycine max
  Coding DNA Sequence Number=SeqID_51727
  Gene Ontology: Mol. function=RNA-directed DNA polymerase activity; Cellular component=chromatin; Biological process=chromatin assembly or disassembly
MAPTDVSKTAFKTHHGHYEFLVMPFGLCNAPSSFQATMNSTFAPYLRKFIIVFFDDILIYNKSFSNHLIHLKLAFQTLRAHSFFLKFSKCSFATPQVEYFGHIVSERGVEPVLAKGYASLAAPLTALLTKESFLWTIAANQAFLKLKEALCKALVLGIGMGVILSQRHHPIAYFSKPFCSKLLRASTYVRELAAITIAVKKWHQYLLGHHFTILTDHRSLKELMAQAIQTHDLHKELATHKEFPEFQQKLLSEPHKHPDYLLRQDFILQRGRIWLPQNARVIPLILVEFHSTPTGGHMGIMKTLAQVNENFVWENMMKDIRQALRHSGSSGSLFKWHSSGTLTTSLYGLQCHEDIHGHFRQNPWYASEFGLRPRSSLYQPLLAGVIQAQWYQALYELGLPSSDRRPDGGHEPGHRAVPPILGPSEASNIGAFSNLGRVVLQHLRSLCYENVAI

SEQ ID NO: 168506 - protein, 96 aa, Glycine max
  Coding DNA Sequence Number=SeqID_51728
MQMMRMMQQEQSMQQKPEKEKKDQNKVATGHVTWMTTWPSDELATIFQKQNLPILQSRCAVMGCLTSTLHFQIPPRQKMPKSIRKLYLEFTAETSI

SEQ ID NO: 168507 - protein, 49 aa, Glycine max
  Coding DNA Sequence Number=SeqID_51729
MRKRKWRKEYEFLESQNVVGFDLKNPFASLMVSPFEEEQGRVVIDYRIW

SEQ ID NO: 168508 - protein, 127 aa, Glycine max
  Coding DNA Sequence Number=SeqID_51730
MSLRLDARTEVHRNCYKVVVVVGWSIFRSCSSHRPMFRLGSEAKRISNGSWMVRILRTKPYSAMAWPLMEWPFSCTATVRFGDAKILIGNTNGIEFLDTGLKLKRFGEARYVVVLPRFGVVFVNKVF

SEQ ID NO: 168509 - protein, 71 aa, Glycine max
  Coding DNA Sequence Number=SeqID_51731
MVGIVTCGCGGGEAKQVTLVQQLSFSFSQTYHFPYANPAYATENNHINRTLIIPTFHSAELAPPRTYTQFP

SEQ ID NO: 168510 - protein, 126 aa, Glycine max; identical to SEQ ID NO: 144870
  Coding DNA Sequence Number=SeqID_51732
  Gene Ontology: Mol. function=two-component sensor activity; Cellular component=membrane; Biological process=two-component signal transduction system (phosphorelay)
  Homolog annotation: Hit_ID=Q4IXN6; Match level="QueryCoverage=61%, HitCoverage=19%, E-value=4e-12, Identity=53%"; Hit description=GGDEF
  Pfam annotation: Domain name=GGDEF; Domain location=1-84; Score= -40.8; E_value=0.00059; Accession=PF00990.12; Description=GGDEF domain

SEQ ID NO: 168511 - protein, 291 aa, Glycine max
  Coding DNA Sequence Number=SeqID_51733
  Gene Ontology: Mol. function=protein binding; Cellular component =vacuolar membrane; Biological process=GPI anchor biosynthetic process
  Homolog annotation: Hit_ID=Q2V9B6; Match level="QueryCoverage=98%, HitCoverage=90%, E-value=1e-127, Identity=67%"; Hit description=Per1- like family protein
  Pfam annotation: Domain name=Per1; Domain location=26-286; Score =414.2; E_value=1.8e-121; Accession=PF04080.3; Description=Per1-like
GCVEQCKKTGCVGDRCFQHCKFSSDGKPIDGPWYYCMLAREEERTKLGDKPVKYHGKWPFRRVYGIQEPVAVALSAVNLAMQFHGWVSFFILVYYKLTLRPDKKTYYEYTGLWHIYGILSMNAWLWSAVFHSRAVELTEKLDFSSAVALLGFSLILAILRAFNVRDEATRVMISAPLIAFVTTHIMYLNFYELAYGLNRIVCTGMVVVQLLIWAIWAGASNHPARWKLWAVVVGGGLAMVLETYDFPPYMGYVDAHALWHATSIPLTFFWWGFIRDDAEFRTTAMLKKAFI

SEQ ID NO: 168512 - protein, 88 aa, Glycine max
  Coding DNA Sequence Number=SeqID_51734
MFLTFNLMQRIGVAVGGGEGAEEEEYGGEEQQRAKGTHRNRKKAKVKARRGRKSGRRFRRESTPNFALTEKGGGGCSGGGARRRSGGG

SEQ ID NO: 168513 - protein, 503 aa, Glycine max
  Coding DNA Sequence Number=SeqID_51735
  Gene Ontology: Mol. function=ATPase activity, coupled to transmembrane movement of substances; Cellular component=integral to membrane; Biological process=transport
  Homolog annotation: Hit_ID=Q8LPQ6; Match level="QueryCoverage=95%, HitCoverage=67%, E-value=0.0, Identity=73%"; Hit description=Non -intrinsic ABC protein 8
  Pfam annotation: Domain name=ABC_tran; Domain location=287-473; Score= 236.3; E_value=6.8e-68; Accession=PF00005.17; Description=ABC transporter
  Pfam annotation: Domain name=SMC_N; Domain location=276-477; Score= -112.5; E_value=0.0022; Accession=PF02463.9; Description=RecFRecNSMC N terminal domain
  Pfam module annotation: Pfam domain module=ABC_tran::SMC_N; Domain location=287-473::276-477
MVPYLSRENLISLFCHLYCPYGPHVIGTIFILFSLSPQLAPILGVLMLAVSISIAVYKRSTLPVFKAHGMVQASISDCVTETFSAIRTVRSFGGEKRQMFTFANQVLSFQSSGIKLGTFKSVNESLTRVAVYISLIALYCLGGSKVKAGELSVGTMASFIGYTFTLTFAVQGLVNTFGDLRGTFAAVERINSVLSGAQVDDALAYGLERELRQKTLDDENYKLILSNISTENNQKHYLHYMSALKTSSNLFSLAWSGDICLEDVYFSYPLRPDVEILRGLNLRLKFGTVTALVGPSGAGKSTVVQLLSRFYEPTSGCITVAGEDVRTFDKSEWARVVSIVNQEPVLFSVSVGENIAYGLPDEDVSKEDVIKAAKAANAHDFIISLPQGYDTLVGERGGLLSGGQRQRIAIARALLKNAPILILDEATSALDAVSERLVQDALNHLMKGRTTLVIAHRLSTVQNAYQIALCSEGRIAELGTHFELLAKKGQYASLVGTQRLAFE

SEQ ID NO: 168514 - protein, 95 aa, Glycine max
  Coding DNA Sequence Number=SeqID_51736
MGELGLPDVFWKTVFDEFLIFVLVKAHEVDEIAGFRARFEVEHHRVVASASDPSWDWGLRFPLVKEMIVEECEWALGVEIGQARPGFKRPEPSLR

SEQ ID NO: 168515 - protein, 238 aa, Glycine max
  Coding DNA Sequence Number=SeqID_51737
  Homolog annotation: Hit_ID=Q9FIS4; Match level="QueryCoverage=97%, HitCoverage=97%, E-value=9e-57, Identity=53%"; Hit description =Arabidopsis thaliana genomic DNA, chromosome 5, P1 clone:MTG10
  Subcellular localization annotation: CTP_CleavageSite=34; ConfidenceScore=5.36e-01
MNCKINSLSSPIPCKLYTKKPRLRRTNTILFSFSSSEKQQKTISTSTSIEAYTVSFKTEKGCKLGISRYPDFEYDAEGGIGTGVGAKDTKNDPANNDLPVSFDLETLYIPPLTSSTTKFLGLPLPPFLKIDIVPEAFQGNINQESGKVDLEFKAKFLFSAASLYKAPPLMVKTVLTSEETNGTMRRGRGKRLDKEGKCRLVGVATVDPIDDIFMNSFLGLPTECLAELNAVISISSSS

SEQ ID NO: 168516 - protein, 385 aa, Glycine max
  Coding DNA Sequence Number=SeqID_51738
  Gene Ontology: Mol. function=RNA-directed DNA polymerase activity; Cellular component=intracellular; Biological process=RNA-dependent DNA replication
VMDIQAAYSCLLGSPWIHEAGAVTSTLHQKLKFVRNGKLITVRGEEALLVSHLSAFSFIGADETEGTSFQGLTLEGKKPEKNEVSFATWKSAQKVVQEGTGVGWGKVVQLLESKNREGLGFASSAGSATNSVGSSSITSTFCSAGFINNSPEANAALEDAPEEIVLAFVTPGKLVRNWDAVDIPSVVHASKAVLFQALLLLMENVVYPDIYAYCSFWKMPVEHNNPALSPNFESPVYEAEEEEDDEIPEELARLLEYEKKTIRPHEEVVEVINLGTEEDKKEVKIGASLEAAVKRRVIELLKEYVDVFAWSYQDMPGLDPRIVEHRLPLKPECPPVKQKLRRTRPDMALKIKEEVQKQIDAGFLVTSEYPQWLANIVPVPKRDGK

SEQ ID NO: 168517 - protein, 69 aa, Glycine max
  Coding DNA Sequence Number=SeqID_51739
MVDTKRAGGIVGKLQPTSFKVSERVFSGGIMKGKGHLGQGKLTQASQLLMAEGISSPRRVGARLSELVA

SEQ ID NO: 168518 - protein, 80 aa, Glycine max
  Coding DNA Sequence Number=SeqID_51740
MKSSTYWQAEKMISHREEIFSHPKGTWCTRHTNGKPNIYSCEGATISGLYCIKLLLMGSVDDQIDFIMGDFFLLTHKLKV

SEQ ID NO: 168519 - protein, 65 aa, Glycine max
  Coding DNA Sequence Number=SeqID_51741
MQHHRPCSALDEIQNIDGTSKVPSEAYDGQNQPRRRQSRGGSMEFKEEKGNLEYVVFFSHSMCDI

SEQ ID NO: 168520 - protein, 146 aa, Glycine max
  Coding DNA Sequence Number=SeqID_51742
  Gene Ontology: Mol. function=RNA-directed DNA polymerase activity; Biological process=RNA-dependent DNA replication
MPPLIGVVASLSWILLVDGAVNRARNGTFICLKGPDGIIMEQSVEFNFNPSHNQAKYMALLALMGLAREMGVTKLIVCIDSKIGATKCIKITARYTIVVDKIYRKGFINPLLRCLSPQQDNVVIKEAHEGVCKSHIGSRLLGKKII

SEQ ID NO: 168521 - protein, 88 aa, Glycine max
  Coding DNA Sequence Number=SeqID_51743
MPWLRESNGIRMHHLRILISCFFAGFEPLIALMLTHDFWRRLRLLGGGVIMGVCGGDCFLISAVRYSYTRYKCSEAVILVTGNINYLS

SEQ ID NO: 168522 - protein, 474 aa, Glycine max
  Coding DNA Sequence Number=SeqID_51744
  Gene Ontology: Mol. function=zinc ion binding; Biological process =protein folding
  Homolog annotation: Hit_ID=Q338Y6; Match level="QueryCoverage=81%, HitCoverage=92%, E-value=5e-84, Identity=41%"; Hit description =Expressed protein
  Pfam annotation: Domain name=DUF641; Domain location=65-200; Score =214.6; E_value=2.3e-61; Accession=PF04859.3; Description=Plant protein of unknown function (DUF641)
MESVKPSAVTPRKKLARSFAKVLHVKALIGIASVDGLKNVISDANLKDEGKIAKSKTTLNWSESFNEDDDEELQERVANEALLAKLFASISTVKAAYAELQHAQSPFDPDGIEAADQLLVSELKNLSELKQCYLKKQFDPLPEKEILAAESKELQGVIKTYEIMGRKLESQVRLKDSEIIFLREKLEEANMHNKAIEKRLNQSGQLSVLDNLHITGLSPSHFIMVLRHAVRSIRNFVRLVVDEMRSAGWDIDAAVDAIEQNVVYMAEDHKCFAMEAFVCREMFDAFHIPNFSLSSESPLEKNRRQQWFFGKFNELKSMKAKDYLAERPRSSFAKYCRVKYLGLVHPKMESSFFGNLSQRNLVNTGGGFPDTAFFTSFAEMAKRVWLLHCLAFSYEPEASIFQVEKGCRFSDVYMESVNDEIFLYSEVESDPQVAFTVVPGFRIGKTVLQCQVYLTSQHKQQSKVKFFFTSTKQR

SEQ ID NO: 168523 - protein, 140 aa, Glycine max
  Coding DNA Sequence Number=SeqID_51745
EKVLVADSLEKVNRKLDKFYMVLILRSLHSDFDHVRDQVLAGDQVPSMDSLITRLLRVPHVSKDENPTDGVETSAMVASRGRGGGRNIRRGRSGRDGRPHCTYCKRMEKAESRFFDEEYQEYLKLKSDKSNSQAQSSSVP

SEQ ID NO: 168524 - protein, 93 aa, Glycine max
  Coding DNA Sequence Number=SeqID_51746
EGDILTTCVFAVFHLVLLFVVKEVSGLWKAKSSVGSSLSFNSGNWFDSKVPDILVEFSLTRGICGRGLIRTRLGYHEESGSNSPGDNIGTHEQ

SEQ ID NO: 168525 - protein, 61 aa, Glycine max
  Coding DNA Sequence Number=SeqID_51747
MAEINQGKTMTGHDWSHIIWLLLAGSSGQTLTHKERGDMVNVPLKKKMWQVSSPGRATPAF

SEQ ID NO: 168526 - protein, 72 aa, Glycine max
  Coding DNA Sequence Number=SeqID_51748
  Gene Ontology: Mol. function=catalytic activity; Biological process =metabolic process
MVQAFRADKHLHCVIDSDDYSPDWRVQFYVFPYTRTRSTLCELRRYFLKKRIIGVREESRVRKRDFGNFRVK

SEQ ID NO: 168527 - protein, 130 aa, Glycine max
  Coding DNA Sequence Number=SeqID_51749
  Gene Ontology: Mol. function=transferase activity, transferring glycosyl groups; Cellular component=integral to membrane; Biological process=biosynthetic process
  Homolog annotation: Hit_ID=UPI00003ABDD9; Match level="QueryCoverage =91%, HitCoverage=41%, E-value=1e-12, Identity=35%"; Hit description =Alpha-1,3-mannosyltransferase ALG2 (EC 2.4.1.-) (GDP- Man:...
  Homolog annotation: Hit description=Man(1)GlcNAc(2)-PP-dolichol mannosyltransferase).
MHLIKLCRIAGIADLILVNSKFTASTFANTFKYLDAKGIRPAVLYPAVNVDQFNEPSSFKLNFLSINRFERKKNIQLAISAFAMLNSPEGVLKHKDITNASLTIVGEHVLFMPVFPMIDIMNLLNLAVCV

SEQ ID NO: 168528 - protein, 74 aa, Glycine max
  Coding DNA Sequence Number=SeqID_51750
  Gene Ontology: Mol. function=transferase activity, transferring glycosyl groups; Cellular component=integral to membrane; Biological process=biosynthetic process
  Homolog annotation: Hit_ID=O94738; Match level="QueryCoverage=76%, HitCoverage=12%, E-value=3e-15, Identity=64%"; Hit description=Alpha- 1,3-mannosyltransferase ALG2 (EC 2.4.1.-) (GDP- Man:Man(1)GlcNAc(2) -PP-dolichol mannosyltransferase)
MAKVTSSKLNIAIIHPDLGIGGAERLIVDAAVELASQGHKVHVFTAHHDKNRCFEETVAGESLSMHICVCDRIN

SEQ ID NO: 168529 - protein, 69 aa, Glycine max
  Coding DNA Sequence Number=SeqID_51751
  Gene Ontology: Mol. function=nutrient reservoir activity
  Homolog annotation: Hit_ID=Q8LA49; Match level="QueryCoverage=94%, HitCoverage=18%, E-value=3e-23, Identity=77%"; Hit description =Globulin-like protein
MEIDLSPQLAKKVYESNGGSYHAWSPSELPMLHEGNIGAAKLALQKNGFALPQYSDSSKVAYVLQGEVL

SEQ ID NO: 168530 - protein, 371 aa, Glycine max
  Coding DNA Sequence Number=SeqID_51752
  Gene Ontology: Mol. function=nutrient reservoir activity; Cellular component=protein body; Biological process=protein oligomerization
  Homolog annotation: Hit_ID=Q9SIA7; Match level="QueryCoverage=99%, HitCoverage=100%, E-value=1e-158, Identity=74%"; Hit description =Legumin-like protein
  Pfam annotation: Domain name=Cupin_1; Domain location=190-354; Score =64.1; E_value=4.6e-16; Accession=PF00190.13; Description=Cupin
  Pfam annotation: Domain name=Cupin_1; Domain location=5-157; Score =95.8; E_value=1.3e-25; Accession=PF00190.13; Description=Cupin
  Pfam module annotation: Pfam domain module=Cupin_1::Cupin_1; Domain location=190-354::5-157
MEIDLSPQLAKKVYESNGGSYHAWSPSELPMLHEGNIGAAKLALQKNGFALPQYSDSSKVAYVLQGSGVAGIVLPESEEKVLAIKKGDALALPFGVITWWYNKEDTELVVLFLGDTSKAHKTGEFTDFYLTGSNGIFTGFSTEFVGRAWDLEEKDVKTLVGKQSGNGIVKLEGNINLPEPKEEHRKGMALNCEEAPLDVDIKNGGRVVVLNTKNLPLVGEVGLGADLVRLDGKAMCSPGFSCDSAFQVTYIVRGSGRAQVVGADGRRVLETTVKAGNLFIVPRFFVVSKIADSDGLEWFSIITTPKYYLELIGSNDYYNVSPVFTHLAGSIGAWKALSPTVLQAAFNVDAGLEQLFRSKRNADAIFFPPPN

SEQ ID NO: 168531 - protein, 114 aa, Glycine max
  Coding DNA Sequence Number=SeqID_51753
  Subcellular localization annotation: CTP_CleavageSite=35; ConfidenceScore=5.15e-01
MYQTVNLNISLFRSQSHFPAAAAFGSLTRSNPHVYAAVTSDSKAATLLDLTQHDLDNSGDSANGNGDDGGGGGEGGGDNSKGEEGSDGDKRKMPLLMSQKFTLAYAALVGGGLS

SEQ ID NO: 168532 - protein, 77 aa, Glycine max
  Coding DNA Sequence Number=SeqID_51754
MAPLKSLEKEYPLIDSNFQTFCASHGIFSGSVPLSLAGQGYLILGIDQLISIIDALHPPLLNGLQLLEDAQCFVHWM

SEQ ID NO: 168533 - protein, 344 aa, Glycine max
  Coding DNA Sequence Number=SeqID_51755
  Gene Ontology: Mol. function=monooxygenase activity; Cellular component=integral to membrane; Biological process=electron transport
  Homolog annotation: Hit_ID=Q2MIZ2; Match level="QueryCoverage=84%, HitCoverage=63%, E-value=1e-102, Identity=62%"; Hit description =Cytochrome P450 monooxygenase CYP93B12
  Pfam annotation: Domain name=p450; Domain location=36-336; Score= -144.7; E_value=0.00022; Accession=PF00067.12; Description=Cytochrome P450
MISESLLLFLIVFISASLLKLLFERKNKRKGHLKNPPSPPTIPIIGHLHLLKPLIHHSFQDLSLRYGPLISLRIGPVKFIVASTPSLAKEFLKNNELTYSSRKMNMAINMVTYHNATFAFAPYDTYWKFMKKLSTTELLGNKTLAQFLPIRTREVHDFIQILFHKSKTQERVNLTEALLSLSTNVISQMMLSIKSSETDSQAEQARALVREVTQIFGEYNISDFLGFCKNLDLQGFKKRALDIHKRYDALLEKIISDNGDEKVKDFLDILLDVSEQKECEVELTRNHVKSLILGEWGKACEVFDEMLQKRVQPSVVSYNSLIGFLCRKADLDKALALLEDMGQK

SEQ ID NO: 168534 - protein, 982 aa, Glycine max
  Coding DNA Sequence Number=SeqID_51756
  Gene Ontology: Mol. function=RNA-directed DNA polymerase activity; Cellular component=chromatin; Biological process=chromatin assembly or disassembly
  Pfam annotation: Domain name=Chromo; Domain location=933-979; Score =25.9; E_value=0.00014; Accession=PF00385.14; Description='chromo' (CHRromatin Organisation MOdifier
  Pfam annotation: Domain name=RnaseH; Domain location=371-491; Score= -28.2; E_value=0.024; Accession=PF00075.14; Description=RNase H
  Pfam annotation: Domain name=rve; Domain location=627-783; Score =97.1; E_value=5.4e-26; Accession=PF00665.16; Description=Integrase core domain
  Pfam annotation: Domain name=zf-H2C2; Domain location=568-609; Score =25.8; E_value=0.00013; Accession=PF09337.1; Description=His(2) -Cys(2) zinc finger
  Pfam module annotation: Pfam domain module=Chromo::RVT_1::RnaseH::rve: :zf-H2C2; Domain location=933-979::131-317::371-491::627-783::568-609
MQFFHQGRLVELKGENDTNLRQLSSPQFRRLCRTQGDGFFFHITMLTDNPSTTEITSLHPALQTLLLRYDALFQPPHTLPPARTTDHHIHLIPQATPVNVRPYRYPHFQKREIESQVDLMLQRGLIQPSTSPLSSPVLLAKKSDGTWRFCVDYRALNAVTVKDRFPIPTTDELLDELGGACCFSKLDLLQGYHQIRMHDADIHKTSFQTHHGHYEFKVMPFGLCNALSSFQATMNLLFGPYLRHFIIVFFDDILVYSSSFDEHLRHLETTFQAQVEYLGHVVSTKGVEPIASKIDAIKQWPIPQSTRALRSFLGLVGFYRRFIRNYATMAAPLVKLTTLPSFQWSTDAQLAFDHLKEALSSTPVLTLPDFTTPFTLETDASGVGMGAVLSQKGHPVAFFSKPFTPKLLRSSTYVRELCAITTTVRKWRQYLLGRHFTIITDHRSLKELLTQVIQTLEQHQYMARLMGYDYDIQYRSGSHNQAADALSRISEQQPTLTMILSVPCLSFMKELRAQFDSHDGYDQLRQAILAEPSRHPGFSVIHNLIMHKGCIWIPYDLPIIPTLLHEYHTTPTGGHAGIRKTLARLSENFIWQGLREDVARFVANCLDCQLTKYEAKKSAGLLCPLPVPQRPWEDLSMDFIVGLPPYHGHTTIFVVVDRFSKGIHLGTLPTSHTTHMVASLFLNIVIKLHGFPQSIVSDRDPLFISHFWQDLFRLSGTVLRMSSAYHPQTDGQTEVLNRVIEQYLRAFVHGRPRNWGRFIPWVEWSHNSSWTVGSGSTPYEITYGRKPFAFPEYLLGTSRIDAVEEFLVDRDTTFQSIRKKLIKAQEAMKIYANKNRREVNYEINDWVLVKLRPYRQSTVRGSPTSSGKLTKRYFGPFRVIERIGMAAYRLELPEGAKIHSVFHCSLLKPFRGSPTHPDSTSLPPQFIDGHPSTTPLAILSSRQVNNSWEVLVQWQGMSPDEASWENWTTLCQAYHLEDKVDF

SEQ ID NO: 168535 - protein, 185 aa, Glycine max
  Coding DNA Sequence Number=SeqID_51757
  Gene Ontology: Mol. function=transferase activity; Cellular component= mitochondrion; Biological process=embryonic development ending in seed dormancy
  Homolog annotation: Hit_ID=Q94H87; Match level="QueryCoverage=53%, HitCoverage=6%, E-value=1e-20, Identity=48%"; Hit description =Putative disease resistance protein
  Pfam annotation: Domain name=PPR; Domain location=30-64; Score=38.3; E_value=2.6e-08; Accession=PF01535.11; Description=PPR repeat
  Pfam annotation: Domain name=PPR; Domain location=65-99; Score=43.9; E_value=5.4e-10; Accession=PF01535.11; Description=PPR repeat
  Pfam module annotation: Pfam domain module=PPR::PPR; Domain location =30-64::65-99
MEGLCSVEKYEEAKKLMFDMAYHGSKAQPVNFGVLMKNLGKRGKVEEAKALLHEMKKRRLKPDVVTYNILINYLCKEGKAMEAYKVLLEMQIGGCVPNAATYRMVVDEMEKRKVEFDLERWETIIKSACSEDKGASEQIVFNGWIYVGAYLRGLAKMRVELREHIYDMKQQKYENKDDRTVKIRT

SEQ ID NO: 168536 - protein, 49 aa, Glycine max
  Coding DNA Sequence Number=SeqID_51758
MVVFLAHKFSLLKAVKGLAKMRVELREHIYDMKQQKYENKDDRTVKIRT

SEQ ID NO: 168537 - protein, 240 aa, Glycine max
  Coding DNA Sequence Number=SeqID_51759
  Gene Ontology: Mol. function=nucleoside-triphosphatase activity; Cellular component=nucleus; Biological process=response to DNA damage stimulus
  Homolog annotation: Hit_ID=Q9LQQ2; Match level="QueryCoverage=99%, HitCoverage=76%, E-value=7e-50, Identity=46%"; Hit description=DNA repair protein RAD51 homolog 4
MAPLESLEKEYPLIDSNFQSFCASHGIFSGSCCAHAHDSIIFSVEDFLLHDLDALLSFTDNHSTSQTLKQGIDQLISIIDALHPPLLNGLQLLEDAQRNKHVLSTGCEGIDALLRGGLREGQLTELVGSSSSGKTQACLLSASTVVAKHKSSVIYLDTGNSFSPQRIAHFVGQSSGHIFGNQIVKSNQHVRLLIVDSISSLITPILGGSGPQEAYSLHVTGDFRTCFNDICWVFTEEVST

SEQ ID NO: 168538 - protein, 179 aa, Glycine max
  Coding DNA Sequence Number=SeqID_51760
  Gene Ontology: Mol. function=DNA binding
  Homolog annotation: Hit_ID=Q0GPF4; Match level="QueryCoverage=75%, HitCoverage=60%, E-value=2e-76, Identity=100%"; Hit description=BZIP transcription factor bZIP132
MRQVETLRESHVNMHAPSPQPLSVLFINPHSYITISNGQKRATMNNPSSPSPCAAFADFYEQWFEELQSLMQQLRGEGRKEEVMEKVMWHHQNYYVAKSAAAEKDPLNVFLSPWATTLERSLHWITGWRPTTAFHLIYTESSLMFESHIIDILQGLRTGDLGDLSPSQFRRVSDIQCDT

SEQ ID NO: 168539 - protein, 255 aa, Glycine max
  Coding DNA Sequence Number=SeqID_51761
  Gene Ontology: Mol. function=protein binding; Cellular component =cellular_component; Biological process=regulation of transcription
  Homolog annotation: Hit_ID=Q2HSA0; Match level="QueryCoverage=94%, HitCoverage=63%, E-value=1e-114, Identity=84%"; Hit description =Tubby; Di-trans-poly-cis-decaprenylcistransferase; Cyclin-like F- box
  Pfam annotation: Domain name=Tub; Domain location=1-255; Score=368.5; E_value=1e-107; Accession=PF01167.8; Description=Tub family
MSLYVSSFLLHPLPAFTDKGKFLLAARRYRCGTHTEYIISLDADDLSQGSNAYVGKLSSDFLGTNFTIYDSQPPHSGAKPSSGRASRRFASKQISPQVPAGNFEVGQVSYKFNLLKSRGPRRMVCSLKCPVTPVVSPSVESSDSTPVNGHKIPDKEQVASGYTILKNKAPRWHEHLQCWCLNFHGRVTVASVKNFQLVATVDQSQPGGKGDEETVLLQFGKVGDDTFTMDYRQPLSAFQAFAICLTSFGTKLACE

SEQ ID NO: 168540 - protein, 61 aa, Glycine max
  Coding DNA Sequence Number=SeqID_51762
MRDSAPTGNVLEPLNAAREVVGDVDSIKDELVLWLINDDNRTCGVTCEQYWFRCLTLAMRA

SEQ ID NO: 168541 - protein, 124 aa, Glycine max
  Coding DNA Sequence Number=SeqID_51763
  Subcellular localization annotation: CTP_CleavageSite=74; ConfidenceScore=5.05e-01
VAPSMVRIMKQANGPYNQQGQWRTHPGNQFNKDQNGPSNRPIQQGPNIFQRTTKMEETLTQFMQIANKSSNIFVANTEQNPKEECKAVMTRSKRFMEAEDEDSVGHKEKAVEKKATQVENNGQE

SEQ ID NO: 168542 - protein, 309 aa, Glycine max
  Coding DNA Sequence Number=SeqID_51764
  Gene Ontology: Mol. function=helicase activity; Biological process =viral genome replication
  Homolog annotation: Hit_ID=Q1SN45; Match level="QueryCoverage=92%, HitCoverage=17%, E-value=5e-59, Identity=39%"; Hit description=AAA ATPase
YDRVTAVVIHDANGTLENAISQNDEIKEYVDCRYISPCEATWRIFGFPIHARKPVVERLHFHLLGQHSVFYEDDDDIDDILSKPSISDSKFLAWMNSNKCFLEGRNLTYSQFVSKFVYNQKARSWNLRKKGNTIGRLIWVPPTTGELFYLRMMLTACKGATSFEDIRTVENVLYLTYREACFAMGFLQDDREFMEAIKEAKDWGVITKPKELWSQTWNWLAEDIAYHYKKTTLNTKSHIDDEQLKNLTLLEIEKLLHPNQRSLRDYPTMPYPEGGNPASCLKNSLILSELNYNNDEARSEFKNLFLSMT

SEQ ID NO: 168543 - protein, 54 aa, Glycine max
  Coding DNA Sequence Number=SeqID_51765
MDEHQQNWKEMTNIMIKINKESDEMFNTIHVIDQLYGEVSRSFAIRWKDELEPT

SEQ ID NO: 168544 - protein, 97 aa, Glycine max
  Coding DNA Sequence Number=SeqID_51766
MDSAVLFNFLLNNRECPVPFPWQAIIDIQKNLVYYRNNETGFVIFDFRPLVDLGGGVFFENTIGSSWGIGPLSQGRLKPAYAHAVVIHAGLFDSGFA

SEQ ID NO: 168545 - protein, 108 aa, Glycine max
  Coding DNA Sequence Number=SeqID_51767
  Subcellular localization annotation: CTP_CleavageSite=28; ConfidenceScore=5.09e-01
MITHFKCVFVFGLIVILFHGRGCHTLPRSNNTSHLPTTSLLPLKVGKFLSSLLAWGGAWVLVLVEGWWGVGFWFWWRGLVRGWVMVGKVYRCPEYVFQKTHSVTGVLE

SEQ ID NO: 168546 - protein, 268 aa, Glycine max
  Coding DNA Sequence Number=SeqID_51768
  Subcellular localization annotation: CTP_CleavageSite=30; ConfidenceScore=5.13e-01
MDRKRPRKLNLNAPLLSTRRLGSPNVADTSCSSYSVGAVQNTSERVPFSWEKAPGKPKETERSDNTQDGGTLRLRLPPRHWFLPKEAVEEDVDRGDDAFHDQGDGSCDGDDDKDDFFSDAMDVLSLSEALDYVQKKSENAHSNTNDGLRLKLAESNGYQSPTYMINRFLPDATALAASSALHFSTNLEEKDCDTCSYPGCYTRHSYASSPKGCGLELLFPWRMKHKLCSIESPVLPCSTNLHKHKRNSKQKKHRSSTTYIPCTNMKDI

SEQ ID NO: 168547 - protein, 954 aa, Glycine max
  Coding DNA Sequence Number=SeqID_51769
  Gene Ontology: Mol. function=protein binding; Cellular component =thylakoid; Biological process=ethylene mediated signaling pathway
  Homolog annotation: Hit_ID=Q1SC84; Match level="QueryCoverage=99%, HitCoverage=100%, E-value=0.0, Identity=70%"; Hit description=TPR Domain, putative
  Pfam annotation: Domain name=BTB; Domain location=234-344; Score= -9.7; E_value=0.031; Accession=PF00651.21; Description=BTBPOZ domain
  Pfam annotation: Domain name=TPR_1; Domain location=574-607; Score =16.6; E_value=0.056; Accession=PF00515.18; Description =Tetratricopeptide repeat
  Pfam annotation: Domain name=TPR_1; Domain location=774-807; Score =21.1; E_value=0.0041; Accession=PF00515.18; Description =Tetratricopeptide repeat
  Pfam annotation: Domain name=TPR_1; Domain location=903-936; Score =22.6; E_value=0.0014; Accession=PF00515.18; Description =Tetratricopeptide repeat
  Pfam annotation: Domain name=TPR_2; Domain location=445-478; Score =10.5; E_value=2; Accession=PF07719.7; Description=Tetratricopeptide repeat
  Pfam annotation: Domain name=TPR_2; Domain location=574-607; Score =21.7; E_value=0.0027; Accession=PF07719.7; Description =Tetratricopeptide repeat
  Pfam annotation: Domain name=TPR_2; Domain location=666-699; Score =3.6; E_value=12; Accession=PF07719.7; Description=Tetratricopeptide repeat
  Pfam annotation: Domain name=TPR_2; Domain location=700-733; Score =15.6; E_value=0.18; Accession=PF07719.7; Description=Tetratricopeptid e repeat
  Pfam annotation: Domain name=TPR_2; Domain location=774-805; Score =3.2; E_value=14; Accession=PF07719.7; Description=Tetratricopeptide repeat
  Pfam annotation: Domain name=TPR_2; Domain location=806-839; Score =8.3; E_value=3.6; Accession=PF07719.7; Description=Tetratricopeptide repeat
  Pfam annotation: Domain name=TPR_2; Domain location=870-903; Score =14.0; E_value=0.56; Accession=PF07719.7; Description=Tetratricopeptid e repeat
  Pfam annotation: Domain name=TPR_2; Domain location=904-936; Score =8.0; E_value=3.9; Accession=PF07719.7; Description=Tetratricopeptide repeat
  Pfam module annotation: Pfam domain module=BTB::TPR_1::TPR_1::TPR _1::TPR_2::TPR_2::TPR_2::TPR_2::TPR_2::TPR_2::TPR_2::TPR_2; Domain location=234-344::574-607::774-807::903-936::445-478::574-607::666 -699::700-733::...
  Pfam module annotation: Domain location=774-805::806-839::870 -903::904-936
MQHNIFASMRSLKIMDGCKGTQVYAINPSSATGGGIGEKLLQQLHDHIKSHTLRTKSVRNLQPPNMTTPSEVFVSDGSLLPYGLPMTDLLEPKIEPSLVSVDFVETLAGVYRRTEDRHQFDRSEVYLEQCAVFQGLADPKLFRRSLRAARQHAINVHAKVVLSAWLRYERREDELIGSSLMDCSGRNLECPRTTLVPGYDPELVFDSCACTGARAGNGDNDNDDAMAIVVDEQCSTSEEEEEDGDMSFCVGDDEIKCNRFNIASLSRPFKIMLYGGFIESTREKINFSRNCFSVEALRAAEVFSRRKRLSHLEPKVILELLSLANRFCCEEMKNACDAHLASLVCDIDDALLLVEYGLEETAYLLVAACLQVFLRELPGSMQSLSVVKIFCSPEGRDRLALAGHASFVLYYFLSQIAMEEEMRSNTTVMLLERLVECAKDGWEKQVAFHLLGVVMLERKEYKDAQYWFQAAVDAGHAYSLVGVARAKYKRGHTYSAYKLMNSLISDHKPVGWMYQERSLYCVGKEKLMDLMSATELDPTLSFPYKFRAVSFLEENKIGPAIAEINKIIGFKVSPDCLELRAWFLIAMEDYEGALRDVRAILTLDPNYMMFYGHMHGDQLVELLQPFVQQWSQADCWIQLYDRWSSVDDIGSLAVVHQMLAKDPGKSLLCFRQSLLLLRLNCPKSAMRSLRLARNHSTSDHERLVYEGWILYDTGYREEALAKAEESISIRRSFEAYFLKAYALADSNLDSESSKYVICLLEEALRCPLDGLRKGQALNNLGSVYVDCDKLDLAADCYMNALNIKHTRAHQGLARVYHLKNLRKAAYDEMTKLIEKARSNASAYEKRSEYCDRDMAKSDLSMASQLDPLRTYPYRYRAAVLMDDHKEAEAIEELSRAIDFKPDLQLLHLRAAFYDSMGDFVSAVRDCEAALCLDPNHNEILDLCNKAREHIREPK

SEQ ID NO: 168548 - protein, 205 aa, Glycine max
  Coding DNA Sequence Number=SeqID_51770
  Gene Ontology: Mol. function=RNA-directed DNA polymerase activity; Cellular component=intracellular; Biological process=RNA-dependent DNA replication
  Homolog annotation: Hit_ID=Q1SAS4; Match level="QueryCoverage=85%, HitCoverage=8%, E-value=1e-34, Identity=42%"; Hit description=RNase H, putative
MKVDMEAMKDQMTTMMEMMMSMNKMMKELYEDFKIQHHNLTPYRPNMNDAVEVANKNIKKIIQKMTVTYKDWPEMLLFALHDIPSLRVQSKAELEEVELAQAHSNKLDLIEGKRSTAMSHGGYIYLGLTKNKRGYISCGSVLVEGTSTRFKENNGGYIPCGSLLVKGHSIQQPFVVKKAFSGGTLILTNMDREELPLPINSDVVK

SEQ ID NO: 168549 - protein, 175 aa, Glycine max
  Coding DNA Sequence Number=SeqID_51771
  Gene Ontology: Mol. function=protein serine/threonine kinase activity; Cellular component=cell surface; Biological process =protein amino acid phosphorylation
  Homolog annotation: Hit_ID=Q5DMV1; Match level="QueryCoverage=61%, HitCoverage=16%, E-value=2e-21, Identity=48%"; Hit description =Receptor lectin protein kinase-like
MASYGDLTRTRKVSTSSDVYAFGVLLLEVVAGIRPLGSSGQFLLVDWVLENCQLGQILRVVDPKLGSVYDEEEVELVLKLGLLCSQYKVDYRPSMKQMARYLHFDDPLLDISYWRYCDSQSSTTSLSFSKAMSTRKIASSYSLSSIGSRNTMPIKTVLLINGTKVFIRIRSKPFA

SEQ ID NO: 168550 - protein, 119 aa, Glycine max
  Coding DNA Sequence Number=SeqID_51772
MSNNKKESGVQQALIRGAGSNNPLKRTRINGSSDMRELDGSCFLHSLFAFQNDQSERQKKYFEKSAGIKLECAGSNSPAQLMRNKPFSQKVLVAQKIAVQDMGQDFVYPTNLPSPPCRF

SEQ ID NO: 168551 - protein, 163 aa, Glycine max
  Coding DNA Sequence Number=SeqID_51773
  Gene Ontology: Mol. function=protein serine/threonine kinase activity; Cellular component=cell surface; Biological process =protein amino acid phosphorylation
  Homolog annotation: Hit_ID=Q5DMV1; Match level="QueryCoverage=76%, HitCoverage=25%, E-value=2e-36, Identity=49%"; Hit description =Receptor lectin protein kinase-like
  Pfam annotation: Domain name=Pkinase; Domain location=2-154; Score= -76.3; E_value=0.00051; Accession=PF00069.15; Description=Protein kinase domain
  Pfam annotation: Domain name=Pkinase_Tyr; Domain location=4-154; Score=-137.8; E_value=0.00051; Accession=PF07714.7; Description =Protein tyrosine kinase
  Pfam module annotation: Pfam domain module=Pkinase::Pkinase_Tyr; Domain location=2-154::4-154
MSLLIEVRGFGAEYKCVLPNTGTEVAIKRIMRSPMQGMREFVAKIERLGRLRHKNLRFNILKGVATGLLYLHEEWEQVVIHRDVKSSNILIDGEFNARLGDFGLARLYSHDQVLDTTSVVGTIGYIVRQVTSDILRRGVELRYYKLFPQLKFYFDFNASSKFP

SEQ ID NO: 168552 - protein, 341 aa, Glycine max
  Coding DNA Sequence Number=SeqID_51774
  Gene Ontology: Mol. function=sugar binding; Cellular component =extracellular region; Biological process=water transport
  Homolog annotation: Hit_ID=Q1T1S6; Match level="QueryCoverage=99%, HitCoverage=94%, E-value=1e-119, Identity=56%"; Hit description =Curculin-like (Mannose-binding) lectin; Apple-like
  Pfam annotation: Domain name=B_lectin; Domain location=65-170; Score =107.4; E_value=4.3e-29; Accession=PF01453.15; Description=D-mannose binding lectin
MASLPQPKTSPLTLFFFSSFTIIAHAIVPQNETFKFENSGELGPYIVEYGVDYRMISIFNSPFHVANRGNPVGENATFSLGTDGNLVLAEADGRIAWQTNTANKGVVAFRLLPNGNMVLLDAQGKFLWQSFDHPTDTLLNDQYLRPKGPSKLISRLSEKENVDGPYSLVLEPKRLALYYKSKNSPKPILYWYKLFTQQGTNEFRTMATGFGNIPVGVMGMPVNNSTLTYLRLGIDGNIRLHTYFLGVRSGVWQVTYTLFNRDSHDEFECQWPENNNCTAKPVKSCKARDFHCYKVEGVRHYLSKYTEGGKVRESTCGNKCTKDCKCVGCFYHGEVKVLDSL

SEQ ID NO: 168553 - protein, 86 aa, Glycine max
  Coding DNA Sequence Number=SeqID_51775
MEMKGPKMESLSEEKENNQQTTIPTITFAILTTSIVKKTSQPSICLSSPPSLPFPSICLKTFFPLQLFISIFSPKQLHHYTTFLAT

SEQ ID NO: 168554 - protein, 106 aa, Glycine max
  Coding DNA Sequence Number=SeqID_51776
  Homolog annotation: Hit_ID=Q7Y1Z2; Match level="QueryCoverage=58%, HitCoverage=31%, E-value=1e-12, Identity=49%"; Hit description=27K protein
  Pfam annotation: Domain name=GILT; Domain location=44-106; Score= -7.8; E_value=6.6e-05; Accession=PF03227.6; Description=Gamma interferon inducible lysosomal thiol reductase (GILT)
MKMRPFLRSFPRSLIFFFGCFLLLPLLLLLLVAPSSSGAPNEKVTLSLYYESLCPYRADFIVNHLVRLFQTGLISILNLRLVPWGNARIAPDGTVVCQLWVIFWDQ

SEQ ID NO: 168555 - protein, 89 aa, Glycine max
  Coding DNA Sequence Number=SeqID_51777
  Pfam annotation: Domain name=zf-CCHC; Domain location=48-65; Score =33.1; E_value=9.5e-07; Accession=PF00098.13; Description=Zinc knuckle
MELQHLNQNEETDKRKRSIAIKASSLIIMERSHNFNNGKRSQEVSPTLKCYKCNQTGHIKANCPSNESWPEKNEKKGYKEIRSKKAYIA

SEQ ID NO: 168556 - protein, 118 aa, Glycine max
  Coding DNA Sequence Number=SeqID_51778
GGEPDDMRRQIMVIPHTICHPDAIVSDGTQRQIMVILRLVSNERNEFGSPADGEIVRPNGIICLLGCDPRLTTLRYLTPIVRQSVKFRYMSGVERTGVQIAIRPTWAFQDLPTEDGAF

SEQ ID NO: 168557 - protein, 88 aa, Glycine max
  Coding DNA Sequence Number=SeqID_51779
MWGSNNELKLRREERDQSQLDGIILKDELKTCLRKDAITKHAPRHPNRTRSKSRTMGDLEEVQEQMKADMSALKEQMASMMKAMLGMK

SEQ ID NO: 168558 - protein, 604 aa, Glycine max
  Coding DNA Sequence Number=SeqID_51780
  Gene Ontology: Mol. function=transferase activity, transferring glycosyl groups; Cellular component=endoplasmic reticulum; Biological process=electron transport
  Homolog annotation: Hit_ID=Q1T1R8; Match level="QueryCoverage=95%, HitCoverage=95%, E-value=0.0, Identity=76%"; Hit description=Alg9 -like mannosyltransferase
  Pfam annotation: Domain name=Glyco_transf_22; Domain location=42-485; Score=407.4; E_value=2.1e-119; Accession=PF03901.7; Description=Alg9 -like mannosyltransferase family
  Pfam annotation: Domain name=MFS_1; Domain location=122-438; Score= -44.6; E_value=0.035; Accession=PF07690.6; Description=Major Facilitator Superfamily
  Pfam module annotation: Pfam domain module=Glyco_transf_22::MFS_1; Domain location=42-485::122-438
MSLSTVRQRRSEPSDPSPSEPYTKLDKPEKAEEKDEGLGWVFPFVALGLLRYMSATSNIIHDCDEVFNYWEPLHFLLYKSGFQTWEYRFCSVLLFFFFFFVGVQFWGDDGSREKRESFDFYYFWGVFGSQFALRSYLYLLFHEIVGRPASWLFSEDKVRVFYAVRFFLGLLSVLTDTVLVVALSRKYGKRLATYALAMLCLTSGCFFASTSFLPSSFSMYAISLASGLFLLDKPAAAISVAVIGVILGWPFSILAFLPVTLYSLSRKFKQAFIAAAVTSILLLALSIVMDFYYYGKWTSSVLNLLIYNVAGGGESHLYGTEGPLYYLRNGFNNFNFCFVLALLFLGILPIAKKKYAPDLLIVISPIYIWLGFMSLQPHKEERFLYPVYPLICVAASAVIESFPDLFRSKYNPYDRSIIVTVAKVMRPVVLSLILYASHARTFSLINGYSAPLEVYKILEHHDAENNSVLCVGSEWHRFPSSFFIPDYVGQVRWIDDGFRGLLPIPFNSTLGGTASAPPYFNNKNMASDKQYLHDVDACTFLVELQLERPYLTRGSDLSTWEPIAALPYLDRELSPALYRSFFIPYLWQEKNVFGMYKLLKRRTT

SEQ ID NO: 168559 - protein, 101 aa, Glycine max
  Coding DNA Sequence Number=SeqID_51781
MVKWACKSRIAVLCRSEKAVDFYGKIETLSEQMSVIRKKRKWVAAGDDGNVIESSHGWFSDLSVPSFHCLPPQCGNLVLPVTGFSFYDSDWKVGPMGVVVP

SEQ ID NO: 168560 - protein, 140 aa, Glycine max
  Coding DNA Sequence Number=SeqID_51782
  Gene Ontology: Mol. function=protein domain specific binding; Cellular component=spindle pole body; Biological process =intracellular signaling cascade
  Homolog annotation: Hit_ID=Q96299; Match level="QueryCoverage=93%, HitCoverage=50%, E-value=7e-52, Identity=75%"; Hit description=14-3 -3-like protein GF14 mu
  Pfam annotation: Domain name=14-3-3; Domain location=1-140; Score =107.8; E_value=3.2e-29; Accession=PF00244.10; Description=14-3-3 protein
MVDAMKKVAKLDVELSVEERNLFSVGYKNVVGSRRASWRILSSIEQKEDSKGNELHVKHIRDYRNKVELELSNICSDIMIILDEHLIPSTNIAESTVFYYKMKGDYYRYLAEFKAGNEKKEVADQSLKAYQVFAGGLGLM

SEQ ID NO: 168561 - protein, 123 aa, Glycine max
  Coding DNA Sequence Number=SeqID_51783
  Gene Ontology: Mol. function=protein domain specific binding; Cellular component=nucleus; Biological process=negative regulation of ubiquitin ligase activity during mitotic cell cycle
  Homolog annotation: Hit_ID=Q96299; Match level="QueryCoverage=83%, HitCoverage=40%, E-value=2e-38, Identity=74%"; Hit description=14-3 -3-like protein GF14 mu
  Pfam annotation: Domain name=14-3-3; Domain location=1-103; Score =19.6; E_value=4.6e-05; Accession=PF00244.10; Description=14-3-3 protein
MKTSNFQLRLNCYDYLQTASTTAESELQPTHPIRLGLALNFSVFYYEILNSPERACHLAKQAFDDAVSELDTLNEDSYKDSTLIMQLLRDNLTLWTSDIPEEGEDLKMESAARVDQGEDELGR

SEQ ID NO: 168562 - protein, 117 aa, Glycine max
  Coding DNA Sequence Number=SeqID_51784
  Subcellular localization annotation: CTP_CleavageSite=50; ConfidenceScore=5.04e-01
MELTRGLGDTSSTSALPLCLRGALRKAPVKLACWVQQRCTECSATAGSCSCSRKQEQEAPLEAAGCGQVGGAITRSALLLYIQFSSTALLPVLLSLRLSSILLPLLLSFLLLVTSWF

SEQ ID NO: 168563 - protein, 83 aa, Glycine max
  Coding DNA Sequence Number=SeqID_51785
  Gene Ontology: Mol. function=DNA binding; Biological process=DNA integration
  Homolog annotation: Hit_ID=Q0KIN0; Match level="QueryCoverage=100%, HitCoverage=5%, E-value=2e-22, Identity=58%"; Hit description =Integrase core domain containing protein
MAITRGIQKLAYHTYCKCDVWSGDNDIIKSSNGSPVIWKKLDIGIHGSVSRATIKHVSLSKYIQSIFPLGNSNDSRGLINFNA

SEQ ID NO: 168564 - protein, 54 aa, Glycine max
  Coding DNA Sequence Number=SeqID_51786
MAKQKPKQRLSFTHRGGAMSEVAERVTVGDIGFFGGRSAVRASHRYLAIDVKKQ

SEQ ID NO: 168565 - protein, 392 aa, Glycine max
  Coding DNA Sequence Number=SeqID_51787
  Gene Ontology: Mol. function=binding; Cellular component=thylakoid; Biological process=photosynthesis
  Homolog annotation: Hit_ID=Q5QNE5; Match level="QueryCoverage=99%, HitCoverage=58%, E-value=1e-131, Identity=59%"; Hit description =Tetratricopeptide repeat protein-like
  Pfam annotation: Domain name=TPR_1; Domain location=112-145; Score =18.7; E_value=0.022; Accession=PF00515.18; Description =Tetratricopeptide repeat
  Pfam annotation: Domain name=TPR_1; Domain location=158-191; Score =9.2; E_value=0.43; Accession=PF00515.18; Description=Tetratricopeptid e repeat
  Pfam annotation: Domain name=TPR_1; Domain location=192-225; Score =30.1; E_value=8e-06; Accession=PF00515.18; Description =Tetratricopeptide repeat
  Pfam annotation: Domain name=TPR_1; Domain location=226-259; Score =15.3; E_value=0.08; Accession=PF00515.18; Description=Tetratricopepti de repeat
  Pfam annotation: Domain name=TPR_2; Domain location=112-145; Score =23.1; E_value=0.00098; Accession=PF07719.7; Description =Tetratricopeptide repeat
  Pfam annotation: Domain name=TPR_2; Domain location=158-191; Score =20.6; E_value=0.0058; Accession=PF07719.7; Description =Tetratricopeptide repeat
  Pfam annotation: Domain name=TPR_2; Domain location=192-225; Score =20.8; E_value=0.0048; Accession=PF07719.7; Description =Tetratricopeptide repeat
  Pfam annotation: Domain name=TPR_2; Domain location=226-259; Score =18.5; E_value=0.024; Accession=PF07719.7; Description=Tetratricopepti de repeat
  Pfam annotation: Domain name=Thioredoxin; Domain location=289-389; Score=15.7; E_value=8.8e-06; Accession=PF00085.10; Description =Thioredoxin
  Pfam module annotation: Pfam domain module=TPR_1::TPR_1::TPR_1::TPR _1::TPR_2::TPR_2::TPR_2::TPR_2::Thioredoxin; Domain location=112 -145::158-191::192-225::226-259::112-145::158-191::192-225::226 -259::289-389
LGQVENARKHLCYPGMQPDPSDMQRLQVVEKHISKCGDVRRVGDWKSVLREVDAAVAAGADSSYQLFMCRAEAFLKLHQIDDAESILLHIPKSEPHTNSSSQARFFGMLCEAYSYFVRAQIEMALGRFENAVTAAEKASQNDSRNVEVAVLLNNVRMVARARVRGNDLFKSERYTEACLAYGEGLRLDPSNSVLYCNRAACWFKLGQWERSIEDSNQALHIQPNYTKALLRRAASNSKLERWEEAVKDYEILRKELPNDNEVAESLFHAQVALKKSRGEEVTNLKFGGEVEEVSGLEQFRAAISLPGVSVVHFEVASNSQCKQISPFVNTLCGRYPSINFLKVDIQQSPTVATAENVRIVPTFKIYKNGCRLKEIVCPSHDMLEHSVRHYSF

SEQ ID NO: 168566 - protein, 280 aa, Glycine max
  Coding DNA Sequence Number=SeqID_51788
  Gene Ontology: Mol. function=binding
  Homolog annotation: Hit_ID=Q9SIN1; Match level="QueryCoverage=100%, HitCoverage=40%, E-value=2e-38, Identity=39%"; Hit description =Expressed protein
  Pfam annotation: Domain name=TPR_1; Domain location=220-253; Score =28.4; E_value=2.5e-05; Accession=PF00515.18; Description =Tetratricopeptide repeat
  Pfam annotation: Domain name=TPR_2; Domain location=220-253; Score =27.3; E_value=5.4e-05; Accession=PF07719.7; Description =Tetratricopeptide repeat
  Pfam annotation: Domain name=TPR_4; Domain location=254-279; Score =18.4; E_value=0.027; Accession=PF07721.5; Description=Tetratricopepti de repeat
  Pfam module annotation: Pfam domain module=TPR_1::TPR_2::TPR_4; Domain location=220-253::220-253::254-279
MSHSSGKPVSEVVGIDATFSDRFRDALTCDDNNNINKPDFRELDLGSPVSPLRTTRGPAASSSSSSSGSFSGRTGPTRKPESAQNNSNTNTHIHSNNNNSGELSGSSENSPTARKPGHTRSDSGSAPVPLIYSGQTATSPVMNVLPTGNICPSGKILKTGMTPNRSSRTSRSDVLGSGMGNYGHGSIMRGGGKAEPASTRGSGGGNEMVKRGGHVQSVDPEELKRLGNECYKRGNFVDALSLYDRAIAMSPASAAYRSNRAAALTGLGRLGEAVRECEEA

SEQ ID NO: 168567 - protein, 84 aa, Glycine max
  Coding DNA Sequence Number=SeqID_51789
MTKKKVIRQRVQDLCSFLRGSLSHSKQIVETTNYFSITVSFGNNCTYLLHLQLQVQFDLTISGDKGVHVDQPSSSSSCLGFTTL

SEQ ID NO: 168568 - protein, 92 aa, Glycine max
  Coding DNA Sequence Number=SeqID_51790
  Homolog annotation: Hit_ID=Q5MJW2; Match level="QueryCoverage=51%, HitCoverage=18%, E-value=5e-07, Identity=50%"; Hit description =Avr9/Cf-9 rapidly elicited protein 102
MGVNVDLTRPQQVWVHALLVVHREHHHPLLTATRANDLVHEALDSRRGSEGEREVEVSTKGRVNGVIDGGGVGLDDTGGMGLFSLEKGKKEN

SEQ ID NO: 168569 - protein, 84 aa, Glycine max
  Coding DNA Sequence Number=SeqID_51791
  Gene Ontology: Cellular component=phragmoplast
  Homolog annotation: Hit_ID=Q6ZJ66; Match level="QueryCoverage=60%, HitCoverage=10%, E-value=2e-14, Identity=70%"; Hit description =Putative microtubule-associated protein
MVVINLLSLSYAEVTNSGSLTLEIVQQVGEIDHYDLLLSMDEQISRSKEEASSRKAIMEKVEKWKLACDEERWLEEYSRVRIFI

SEQ ID NO: 168570 - protein, 76 aa, Glycine max
  Coding DNA Sequence Number=SeqID_51792
MCPNIMKIFKRGKTEFMIILANIDTFQRVCVKDCCCTRMGEEGGRGGSIRVARKPYGQITRYSMAANNKRGLSRKP

SEQ ID NO: 168571 - protein, 76 aa, Glycine max
  Coding DNA Sequence Number=SeqID_51793
MEARNWKKLRVCGNGGLDHGHGMEQRLKGCEGEDECDRKKERDTKRPCMRTLCPLVGQLKTTKVQFFFTQSINHFR

SEQ ID NO: 168572 - protein, 45 aa, Glycine max
  Coding DNA Sequence Number=SeqID_51794
MRHKWTRPSGKCGSIVGFPKALSTSGGEEMKRRKMAIRAFQLRKC

SEQ ID NO: 168573 - protein, 365 aa, Glycine max
  Coding DNA Sequence Number=SeqID_51795
  Gene Ontology: Mol. function=transferase activity, transferring glycosyl groups; Cellular component=membrane; Biological process =protein amino acid glycosylation
  Homolog annotation: Hit_ID=Q9LKA9; Match level="QueryCoverage=86%, HitCoverage=83%, E-value=1e-125, Identity=71%"; Hit description =Similarity to Avr9 elicitor response protein
  Pfam annotation: Domain name=Galactosyl_T; Domain location=92-316; Score=43.4; E_value=6e-10; Accession=PF01762.12; Description =Galactosyltransferase
  Subcellular localization annotation: CTP_CleavageSite=77; ConfidenceScore=5.56e-01
MPPFPKTFYARPPPRRTSFLVFSCLFLSLSLFVFFFAFLRPLRDPPCPNRVPRSVKVLWDHRLSGDSNNAPVETRHKVMAFVGIQTGFRSVGRRQSLRNTWFPSDPHGLQGLEEATGLAFRFVIGKTSDRSKMSALQKEVAQYDDFILLDIEEEYSKLPYKTLAFFKAAYALFEAEFYVKADDDIYLRPDRLSLLLAKERSHPQTYIGCMKKGPVFTDPKLKWYEPLSNLLGKEYFLHAYGPIYALSADVVSSLVALKNNRQICPCHLALEFIVYTCKRGQRFSCHTVLSFRMFSNEDVTIGAWMLAMNVNHENNLELCARECTSTSIAVWDIPKCSGLCNPEKRMLELHQKESCTQSPTVDSDE

SEQ ID NO: 168574 - protein, 190 aa, Glycine max
  Coding DNA Sequence Number=SeqID_51796
  Subcellular localization annotation: CTP_CleavageSite=14; ConfidenceScore=5.24e-01
MPISPCGSISWSVSSRHRVTPTRHPVDPEKSNRALGFPALVTGLYQSYRVPVPPGKVMPSRHRDHARKTPSGPREVQQGLRVSSSDYGPLSVLQLVAPNKAIRPLLTGLSSRSTAPPGRRRARHHGSGQQTHRHHLWSSPQLIHKKVRALPATHGRPIGDQVQSQRRPAQDVKEALLGDNLVPFKSLLVI

SEQ ID NO: 168575 - protein, 66 aa, Glycine max
  Coding DNA Sequence Number=SeqID_51797
  Subcellular localization annotation: CTP_CleavageSite=44; ConfidenceScore=5.04e-01
MDAKDMSFIHKCSTGMPAGNPCGVLNSSTGVHTGDSYGLAFAITGSTSGSVYGTNDSGGVTSKSFS

SEQ ID NO: 168576 - protein, 235 aa, Glycine max
  Coding DNA Sequence Number=SeqID_51798
  Gene Ontology: Mol. function=chitin binding; Cellular component =extracellular region; Biological process=chitin metabolic process
  Homolog annotation: Hit_ID=UPI000044A8F0; Match level="QueryCoverage =71%, HitCoverage=99%, E-value=1e-21, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
EEHTLRHPYRTHARAGVMVEVNEVQERMKADMEAMKEQMVTMMEAMMSMKKIMEVNAARRLHVLAFRGLHALNFRGLHALTFKGLHILTFRGLHALAFRGLHALAFRGLHVLAFRGLHVLAFRGQNVITFRGLHILTFRGLHVLAFRGHHVLTFRGLHVLAFRGLHVLAFRGLHVLDYRGLHALAFRRFHALDFKGLHVLAFRGLHVLAYRGLHTLSFRGLHALAFRGICRNKAS

SEQ ID NO: 168577 - protein, 96 aa, Glycine max
  Coding DNA Sequence Number=SeqID_51799
MGTKETSFSGMQHVSSCLAGDDIMVFPTCIDEILLKTWAVRFKFRSQLRQSSVLDVSEELHHIQSLIATLGLKEQSSKGKGIAVEPESSPPIFVPT

SEQ ID NO: 168578 - protein, 82 aa, Glycine max
  Coding DNA Sequence Number=SeqID_51800
MCPPPPFNGSGRPNWDKEALQQKARKFVSSQTSISHNGDDDTIPTSARVKSFQADEDPSFVELLFQYGQYLLISCLQLRWQT

SEQ ID NO: 168579 - protein, 320 aa, Glycine max
  Coding DNA Sequence Number=SeqID_51801
  Homolog annotation: Hit_ID=Q339Q0; Match level="QueryCoverage=33%, HitCoverage=15%, E-value=4e-31, Identity=50%"; Hit description=Large secreted protein, putative, expressed
MSVLAIPIPILVATVNADAIVSGGVPEGLSIGIDSIGDLRELVQHGVPAAVFGADTAVVGGGRCKAAAGGLQWEQEERGRPLHGERNDKLLCREGERWCRNGRRSHERENERMDMRVVEEEGDWEHTVSYEANGWVAHHVSDIWGKTSPGQGQAIWPMGGAWLCTHLWEHYTYTLDKGCGGLLETNPSTSPEHMFTVLDRKTASVSYSSTMDISIIKEVFSMIIFAIEARGSSVSDFSHQPHLIDSAYDDGGCAKTLSFDTRKLSLLSLLLAPGFDCDREDEYDEENGIQRMPSKLILQVTPIKSYYGSASMLKGQFNGF

SEQ ID NO: 168580 - protein, 123 aa, Glycine max
  Coding DNA Sequence Number=SeqID_51802
MAKPSTQLVAFPFSNEYRFDTEQGTTCKEVYIRSNQMEEMQENIPSSNTHKRKSLSALETAKTEERVRGVRSKVRVLPQLARVFDSFPKVWEPKTTFIQEARDLKNLSWDELLEILKVHEVHL

SEQ ID NO: 168581 - protein, 33 aa, Glycine max
  Coding DNA Sequence Number=SeqID_51803
MRGSARRSTMAPMAVRAVLERATGGVEKALLGV

SEQ ID NO: 168582 - protein, 138 aa, Glycine max
  Coding DNA Sequence Number=SeqID_51804
  Homolog annotation: Hit_ID=Q9FFN1; Match level="QueryCoverage=43%, HitCoverage=6%, E-value=2e-17, Identity=65%"; Hit description =Selenium-binding protein-like
MAQSKTHTNGNSSFFALSFSTFSVDGRGLEIMILECLKIGYEPDTSFVLHEVEEYHKKNFLFHHSAKLAATYGMLMTKPGKPIRIIGTPIYIPSREFIDIGRVASIENNHLPVDYARKGQKVAIKIEEAKVAGLLGSA

SEQ ID NO: 168583 - protein, 176 aa, Glycine max
  Coding DNA Sequence Number=SeqID_51805
  Gene Ontology: Mol. function=binding; Biological process=translation
  Homolog annotation: Hit_ID=A0EFD6; Match level="QueryCoverage=94%, HitCoverage=6%, E-value=1e-15, Identity=32%"; Hit description =Chromosome undetermined scaffold_93, whole genome shotgun sequence
MLEPTELKSYPNFSDSKHNLLCSELKQLYVAITRTRQRLWICENTEEYSRPMFDYWRKKGLVQFKELDDSLAQAMKVASSLEEWRSRGKKLYYQNNYEMATMCFERAGDSYWERKSKVSGLRANANCLRDLNPEDSNAMLREAAEIFEGIGMVESAAQCFSDLGDYKRAGCRSEPA

SEQ ID NO: 168584 - protein, 177 aa, Glycine max
  Coding DNA Sequence Number=SeqID_51806
  Homolog annotation: Hit_ID=Q2HS46; Match level="QueryCoverage=47%, HitCoverage=62%, E-value=4e-08, Identity=34%"; Hit description =Polynucleotidyl transferase, Ribonuclease H fold
  Subcellular localization annotation: CTP_CleavageSite=66; ConfidenceScore=5.36e-01
MIHTTARSETQLSVNHFNDFVVQMERRRRKGFTGKRGRPAQLVAPGRPSLPNPVPPPLPPSHVMPRVAITGNAPSEEAHCSKKIDPRSMCLRDNHGNFIKDETCTASGIPSPSEAEVWALHSAIVWIKGLGFSNVIIETDCKVSSDCFYSGIKVSSDFHVILNKYKDVLSLIPNFKG

SEQ ID NO: 168585 - protein, 37 aa, Glycine max
  Coding DNA Sequence Number=SeqID_51807
MEMEILSKLRNPFIVEYKDSWVEKVIVRLETCEPYSS

SEQ ID NO: 168586 - protein, 660 aa, Glycine max
  Coding DNA Sequence Number=SeqID_51808
  Gene Ontology: Mol. function=identical protein binding; Cellular component=cytoplasm; Biological process=negative regulation of enzyme activity
  Homolog annotation: Hit_ID=Q1S0Z4; Match level="QueryCoverage=96%, HitCoverage=87%, E-value=0.0, Identity=63%"; Hit description =Orn/DAP/Arg decarboxylase 2; Protease-associated PA; Proteinase inhibitor I9, subtilisin propeptide
  Pfam annotation: Domain name=PA; Domain location=304-404; Score=81.5; E_value=2.7e-21; Accession=PF02225.12; Description=PA domain
  Pfam annotation: Domain name=Peptidase_S8; Domain location=53-543; Score=15.9; E_value=1.2e-07; Accession=PF00082.12; Description =Subtilase family
  Pfam module annotation: Pfam domain module=PA::Peptidase_S8; Domain location=304-404::53-543
MVWKLTGKYLDVIIFQGLQLEGEATKLKVEKGIVAIFLDTKYELHTTRSPIFLGLEPAKSTNMWSEKLASHDVIVGVLDTGIWPESESFKDVGMRPVPAYWEGACEIGTSFTKSHCNKKVVGVRVFYHGYEAVVGRINEQKEYKSPRDQDRHGTHAVATVGGSPMHGANLLGYANGITRGMAPGERIAAYKVCWVGGYFNSDIVSAIDKVVADGVNVLYTSLGGGVSSYYRDSLSMIAFEAMERCVFVSCSAGNAGPDPASLTNVSPWITIVGGNTMDRDFLVDVRLGNGKKMIGVSLYKWKNVLSIEKQYPWVYMVSNSSRVDPRSICLEGTLDPKVLSGKIVICDRSLSPRVQKGDVVRSLGGVGMILTNTEANGEELVADSHLLLVVEIGEKEGKKLKSYLLSSKSSTATLAFKGTRLGIKPSPVVAAFSSRRPNFLTLEILKPNLVAPAVNILVAWSEAIRPSSLKINNRKVKFNIVSGTSMSCPHVSGIATLVKSRHPEWSPTTVKPALMTTTYVLDNTKKTLRDASIAKPFSPYDHGLRHIDPIRALDPSLPHHQCLPKNTHFIPSPVIVHKTITNVGPPDSKYHVMVSPFKGASMKVEPKTLNFIEKHQKLSCKITFKPKIQQTSPEFGSMEWKDGLHTMRSPIVITWMPPPM

SEQ ID NO: 168587 - protein, 158 aa, Glycine max
  Coding DNA Sequence Number=SeqID_51809
  Homolog annotation: Hit_ID=Q8RW43; Match level="QueryCoverage=44%, HitCoverage=16%, E-value=7e-16, Identity=61%"; Hit description=TCP1 protein
  Subcellular localization annotation: CTP_CleavageSite=72; ConfidenceScore=5.42e-01
GGGGGGGGGGGGGGGGFVFNAPSTLPGPATVASPTVVFGHGYGQGQYFSQRGPLQSSNSPSVRAWIDAPSFVAAAADHRHHHYLSPAAAAAALVYQSAPPTAAFTAAPGGFSGFRVPARIQGEEEHDGGMDGGDEVGLGMVRFGSVDYYACGMKKIWG

SEQ ID NO: 168588 - protein, 277 aa, Glycine max
  Coding DNA Sequence Number=SeqID_51810
  Gene Ontology: Mol. function=oxidoreductase activity; Cellular component=membrane; Biological process=metabolic process
  Homolog annotation: Hit_ID=UPI00006DC132; Match level="QueryCoverage =99%, HitCoverage=100%, E-value=1e-111, Identity=72%"; Hit description=COG1028: Dehydrogenases with different specificities (related to short-chain alcohol dehydrogenases)
  Pfam annotation: Domain name=ADH_zinc_N; Domain location=3-158; Score= -5.9; E_value=0.019; Accession=PF00107.16; Description=Zinc-binding dehydrogenase
  Pfam annotation: Domain name=Epimerase; Domain location=7-247; Score=- 50.1; E_value=0.007; Accession=PF01370.11; Description=NAD dependent epimerasedehydratase family
  Pfam annotation: Domain name=KR; Domain location=6-186; Score=-87.7; E_value=0.028; Accession=PF08659.1; Description=KR domain
  Pfam annotation: Domain name=adh_short; Domain location=5-169; Score =98.6; E_value=1.9e-26; Accession=PF00106.15; Description=short chain dehydrogenase
  Pfam module annotation: Pfam domain module=ADH_zinc_N::Epimerase::KR:: adh_short; Domain location=3-158::7-247::6-186::5-169
MASAKTIVITGVSSGFGQALAREALAVGHRVVGTVRNSEALQAFAALDTQHAFGYLLDVTDDERIDEVVGEIESAVGPIDVLVNNAGYGHEGILEESPLAELRRQFDVNVFGAVAMIKAVLPGMRQRRRGHIINVTSMGSFITLPGISYYCGSKFALEGISETLSKELAPFNLHVTAVAPGSFRTDWAGRSMVRSPRCLPDYDALFEPVRQARQEKSGKQLGDPVKAAHAMLALIESRNPPTHLLLGSDALSLVRQKLEALGKEIEQWEKLTRSTDG

SEQ ID NO: 168589 - protein, 521 aa, Glycine max
  Coding DNA Sequence Number=SeqID_51811
  Homolog annotation: Hit_ID=Q5PDV8; Match level="QueryCoverage=49%, HitCoverage=96%, E-value=7e-85, Identity=60%"; Hit description =Hypothetical protein yeeI
  Pfam annotation: Domain name=DUF980; Domain location=264-516; Score =394.0; E_value=2.2e-115; Accession=PF06167.2; Description=Protein of unknown function (DUF980)
MKERPILFSEQRVRALLVGQQTQTRRIMKTQAFGPGQDHHEGVHAFDVSANHLHGYKLMSMADIGAQCPFGQVGDRLWVRETWRGPIVPEAQLAEYERDPLPFRNPAFCQYRADSHELGQQEENQQVAEQFGWQTAIHMPRWASRIDLEITAVRAEKIQDISEDDIMAEGVQTDSHFLNNFFTMNMNSESPKEAYRKAWQKHVWSVKAKRLPSSAQKRASSFARFSESPALAPSPAAQRAPFPPCQFAIPVTDKSAANRVSDAMIKWPWRAQKDAAVTALPWQQALGQPIFSLLNSDEQQALVALAQRFLLQKKITPLQGLELSELRLARLSLLFCLPILKLGLEWLDGFHEVLIYPEPFSVDDRWEDDSGLVHHAPAVHAGQSWTQGPVVLNALDIQDSYDLSGYNLVIHEVAHKLDARGSGYTSGIPAIALRDVASWEKDLLQAMAEIEAEVDLVGEQAATLDPYAASDPAECFAVLSEYFFSAPDLLASRFPAMYRHLQQFYHQDPLARLAQQAPESA

SEQ ID NO: 168590 - protein, 94 aa, Glycine max
  Coding DNA Sequence Number=SeqID_51812
MKGTVHEPQVNIGADQKFPTSNIQSCGFGMTGPLDESISCFLIRVDPWVLVPITFRGLHVLTIRGLHALTSRGLHVLALRGLHALTVGTSYPHR

SEQ ID NO: 168591 - protein, 123 aa, Glycine max
  Coding DNA Sequence Number=SeqID_51813
  Gene Ontology: Biological process=regulation of transcription
  Homolog annotation: Hit_ID=Q8RW43; Match level="QueryCoverage=69%, HitCoverage=20%, E-value=3e-38, Identity=89%"; Hit description=TCP1 protein
  Pfam annotation: Domain name=TCP; Domain location=29-121; Score=78.6; E_value=2e-20; Accession=PF03634.4; Description=TCP family transcription factor
MGEPQHPHQHHQQAAATPSRAAMRGGGGGEIVEVQGGHIVRSTGRKDRHSKVCTAKGPRDRRVRLAAHTAIQFYDVQDRLGYDRPSKAVDWLIKKAKAAIDQLAELPPWNPTATPMQPPSQEI

SEQ ID NO: 168592 - protein, 70 aa, Glycine max
  Coding DNA Sequence Number=SeqID_51814
ERRVKKRKIGLYGTCLGEDLSKIRRFEDLGMEEARGEALAAQQLWFRGSNKPSGNRLQDVVIDYRLPVLV

SEQ ID NO: 168593 - protein, 129 aa, Glycine max
  Coding DNA Sequence Number=SeqID_51815
MVIRLWFYQNRCRFEAKASHPSINFEREKEIERKIGEAKKSESQRRNGSWWPSQILGLDHLSTSHLSSPRLGTPVKLLKKEDSNKAESTQGMLLNKKEKYTTREDAILHALQLERQMLKKQEKIGDASD

SEQ ID NO: 168594 - protein, 332 aa, Glycine max
  Coding DNA Sequence Number=SeqID_51816
  Gene Ontology: Mol. function=protein dimerization activity
  Homolog annotation: Hit_ID=O81190; Match level="QueryCoverage=51%, HitCoverage=24%, E-value=2e-24, Identity=34%"; Hit description =Putative transposase
  Pfam annotation: Domain name=hATC; Domain location=93-177; Score =32.0; E_value=2.1e-06; Accession=PF05699.5; Description=hAT family dimerisation domain
MAVMEAPYEPATLRDPYSDPFGPTTLSVRLPSAPAILSSDGPLCWIMFGTGTSTASSNTTIGHFLNPEFFYDNPSMEFDGELIRGLYEVINLEGDQEMEKIIMGELLFYKMGAAQWWQMYGSDTLHLQQIATRILNLTCSASGCECNWSVFEKIHSKRRNRLEHKRLHDLVYVKYNQAPHRRYNLRDKIDPISLNEIDECDEWLLGEMDGDGDGEDRVFEEEDDDLNWRHVYNALDLGKPIYSRRKRKQRTRGAGQEGTSQRSSKRCKGGASSTRKGKMVQVEEALEDNSSEEEELEADLSEEEAAGFAPLENVEIDYVGLEEGDEDENDDY

SEQ ID NO: 168595 - protein, 99 aa, Glycine max
  Coding DNA Sequence Number=SeqID_51817
MKRKIGEAKKSESERMNGSLWPSQILGLDHLSTSNLTSPRSGTPVKLLRKEDSNKAESTQGMLLKKKEKYTHREDAILHALQLERQMLKKQEKIGDAFV

SEQ ID NO: 168596 - protein, 220 aa, Glycine max
  Coding DNA Sequence Number=SeqID_51818
MQTASSIGAFAVAVTRGEYAIATSGFHGVASLIGDFAMQGGVVSQTGEFQAQGAGFSAFSGFSVGRHFQLAGAGVQSKGKYIMSSVITVLYFDGRSNLHGDEDDDDDDDYLVSNSYVEESLEKDDNIDGISNTDDDDEVTDMIQPVRIVHPVEGVQGIQNPFWNDALHYNNINWSHPDEEDICGLEMPSSFNVGQKLYVGMDFDSNDAVKNVVKQYVMKA

SEQ ID NO: 168597 - protein, 76 aa, Glycine max
  Coding DNA Sequence Number=SeqID_51819
MEVELRRTKEENEEIEVIQYLEMGMGIRSVEKWSIEGILCGRRRKGFRDYPILCPMHSDRGKGCKCNLEFRFAFFL

SEQ ID NO: 168598 - protein, 184 aa, Glycine max
  Coding DNA Sequence Number=SeqID_51820
  Subcellular localization annotation: CTP_CleavageSite=74; ConfidenceScore=5.03e-01
MVEEKKVISNCMNMVGMKRQTPYPFSPDFPHVPAFNCISSPFAEVGTNAKTPCGNGSGFNFGNSTSREVSSSCLASNSEPKSKKRREENENFNGDFLTLAPPSPTSYPPSKSKLSLTFQAFHNQGNVEDQIPAAPPVFRLFNQQKQPFYGFFLPEPKEEQIGETAARIQNGHEVGESVDLNLKL

SEQ ID NO: 168599 - protein, 329 aa, Glycine max
  Coding DNA Sequence Number=SeqID_51821
  Gene Ontology: Mol. function=calcium ion binding; Cellular component =integral to membrane
  Homolog annotation: Hit_ID=UPI000034EDFE; Match level="QueryCoverage =88%, HitCoverage=49%, E-value=6e-27, Identity=28%"; Hit description =calcium ion binding
  Pfam annotation: Domain name=Na_Ca_ex; Domain location=185-319; Score= 64.6; E_value=3.2e-16; Accession=PF01699.14; Description =Sodiumcalcium exchanger protein
  Pfam annotation: Domain name=efhand; Domain location=49-77; Score =16.4; E_value=0.11; Accession=PF00036.22; Description=EF hand
  Pfam annotation: Domain name=efhand; Domain location=89-117; Score =20.2; E_value=0.0075; Accession=PF00036.22; Description=EF hand
  Pfam module annotation: Pfam domain module=Na_Ca_ex::efhand::efhand; Domain location=185-319::49-77::89-117
MVQIFQPWIQRRKLEFIKHKHVILGLLTHLKKRALGRLLKENGEPDKEVIRKLFQTIDENQDDNLTHNELRALVIGIQFEEIDLDHDDAVKRIMDDFDTSGNERVDREEFVNGVSRWLQRAQRARVASGDAGPHTMKFLSDFHTETKREHDLLDVGGQVNEEAEGIENAKWISIKAVLLLLLGTIIAAAFADPLVDAVDNFSEATSIPAFFISFIFLPLATNSSEAVSAIIFASRDKRQTASLTFSELYGAVTMNNVLCLSVFLALVYARGLTWDFSSEVLVILVVCIVVGVFASFRTVFPLWTAILAILLYPFSLALVYVLDYVFGWS

SEQ ID NO: 168600 - protein, 281 aa, Glycine max
  Coding DNA Sequence Number=SeqID_51822
MPQDDQGNCDGTRGIGVLGRSSKKSKLKKVPQRGLGVAQLEKIRLEEQQKRDVAAILPSPSALSSTTPSHLPLPVKNFHDSNVSPSTPLLPCEPPSEFRSPLSLQQQHHQQQHMDVKVPSTVPLANSGDFEAGWPVVPGHGNVPKWWSSFQFDSEKNNFGVELGSPILPSVPFESSPIWPLPNLVQRTPQYQHQHQTSSPMASVSSGTLSTYMPHFTIEPPSNQNNNCSSVPVKSMEKLNVVYSVVVANGWCGGGGLLKGHINGGGRENVECAPQIWGEMV

SEQ ID NO: 168601 - protein, 56 aa, Glycine max
  Coding DNA Sequence Number=SeqID_51823
  Homolog annotation: Hit_ID=Q9FRU4; Match level="QueryCoverage=71%, HitCoverage=7%, E-value=5e-17, Identity=100%"; Hit description =Putative nitrate transporter NRT1-3
MTMEEGRVENEDYTQDGTVNIKGKPILRSKSGGWKACSFVVAGQRSDVVPTLSVLP

SEQ ID NO: 168602 - protein, 470 aa, Glycine max
  Coding DNA Sequence Number=SeqID_51824
  Gene Ontology: Mol. function=transmembrane receptor activity; Cellular component=membrane; Biological process=regulation of transcription
  Homolog annotation: Hit_ID=Q850J2; Match level="QueryCoverage=23%, HitCoverage=50%, E-value=2e-20, Identity=48%"; Hit description=NBS -like putative resistance protein
  Pfam annotation: Domain name=LRR_1; Domain location=218-240; Score =9.9; E_value=4.1; Accession=PF00560.23; Description=Leucine Rich Repeat
  Pfam annotation: Domain name=LRR_1; Domain location=242-263; Score =4.8; E_value=36; Accession=PF00560.23; Description=Leucine Rich Repeat
  Pfam annotation: Domain name=LRR_1; Domain location=265-284; Score =1.8; E_value=1.3e+02; Accession=PF00560.23; Description=Leucine Rich Repeat
  Pfam annotation: Domain name=LRR_1; Domain location=286-307; Score =11.7; E_value=1.8; Accession=PF00560.23; Description=Leucine Rich Repeat
  Pfam annotation: Domain name=LRR_1; Domain location=309-332; Score =1.1; E_value=1.8e+02; Accession=PF00560.23; Description=Leucine Rich Repeat
  Pfam module annotation: Pfam domain module=LRR_1::LRR_1::LRR_1::LRR _1::LRR_1; Domain location=218-240::242-263::265-284::286-307::309-332
MMLSREESERMPLTSLCDKLLSKLLKAGPDSKLIITTRDRHLLRRRVGDRHVYEVKAWSFAESLELFSLHAFKERHPQKGYKVLSKRAVNCAKGVPLALKVLGSNLYSRSTEFWDDELSKLENYPNDSIQDVLQGSDLIEGIKLDLSSIEDLHLNTDTLNMMTNLRVLRLYVPSGKRSRNVHHSGVLVNCLGVVNLVRIDLRECKHWKNLPDLSKASKLNWVNLSGCESLRDIHPSIFSFDTLETLMLDGCKKLKGLKSGKHLTSLRKISVNGCTSLKEFSLSSDSIRSLDLSSTRIGMIDSRFERLTSLESLNVHGLRYENCRELGSLSKLPPFVTEFNAVNCWSLISVSSLNSSALNLKGKGKFISFKNCGWLDEPSLHCIMKDEANTKNCNNKSVKVCFPGSKVPSQFKCQSTDSSITVNLPSYLNEYMGLTLCVVLSRSRVAAKIRCQCTWFGVEITTWCNLNEAE

SEQ ID NO: 168603 - protein, 367 aa, Glycine max
  Coding DNA Sequence Number=SeqID_51825
  Gene Ontology: Mol. function=calcium ion binding; Cellular component =integral to membrane
  Homolog annotation: Hit_ID=UPI000034EDFE; Match level="QueryCoverage =68%, HitCoverage=43%, E-value=2e-19, Identity=28%"; Hit description =calcium ion binding
  Pfam annotation: Domain name=Na_Ca_ex; Domain location=271-367; Score= -11.7; E_value=0.068; Accession=PF01699.14; Description=Sodiumcalcium exchanger protein
  Pfam annotation: Domain name=efhand; Domain location=145-173; Score =24.0; E_value=0.00053; Accession=PF00036.22; Description=EF hand
  Pfam annotation: Domain name=efhand; Domain location=185-213; Score =17.0; E_value=0.068; Accession=PF00036.22; Description=EF hand
  Pfam annotation: Domain name=efhand; Domain location=48-76; Score =29.8; E_value=9.7e-06; Accession=PF00036.22; Description=EF hand
  Pfam annotation: Domain name=efhand; Domain location=8-36; Score=2.0; E_value=9; Accession=PF00036.22; Description=EF hand
  Pfam module annotation: Pfam domain module=Na_Ca_ex::efhand::efhand::e fhand::efhand; Domain location=271-367::145-173::185-213::48-76::8-36
IFTKNGTPNVSAIREIDQDGSSGISASEVKDLLLKNKVTETNFDEEKEIKEVLKVFDLDGDKKINKEEFVSGFTKWLDQTKHALKKQYFSRKSLKDIYQAFGPWIENKRKEREGKKQLIFEILRHVQSDVVGSLLTEDGKPDQHAIRGLFEKIDRNRDNFISQSELKELIMNIKFVKASMEVEEAVALVIEELDIDKDRTINEKEFVAGFEKWLSSTSAPAPVSDSESQEDMFQTWEEADIVVEERQNNAVVDKSIWAWIKAITYVMLGIAMLSILAEPLTESVHNFSNSAGFHPFFMSFILAPLATNAREATSAIKEASHKKPRTTSLAISEIYGGVFMNNILGFFAISVLIFVREVTWQFSAELL

SEQ ID NO: 168604 - protein, 161 aa, Glycine max
  Coding DNA Sequence Number=SeqID_51826
MLEITRQGKENSDRIERLEVNQQGRKIAECKGAAHILLLEKARAAQREVERLTKEAKEGSSEIKACDDNISSWEATITNLLSQVDDLRQKIVTEQAKRKELQEKAADSIQKLVAEKGREGLKAFSASQAVADEARAMESADQVLSKEMATLKKLYEDLIMT

SEQ ID NO: 168605 - protein, 86 aa, Glycine max
  Coding DNA Sequence Number=SeqID_51827
  Subcellular localization annotation: CTP_CleavageSite=19; ConfidenceScore=5.43e-01
MIRIQPVTASYDTTRSKVRSVLQSKSLARTCSNRKERRVFKKEFPGSKEYLRSTKLRQERGLRVIGQFELVYGRVEVEAARVLDLA

SEQ ID NO: 168606 - protein, 89 aa, Glycine max
  Coding DNA Sequence Number=SeqID_51828
  Homolog annotation: Hit_ID=Q8W543; Match level="QueryCoverage=75%, HitCoverage=68%, E-value=4e-12, Identity=47%"; Hit description =Drought-induced protein RDI
MEVIRRAITKVTLLSPEENWNKFGICMIASELEVGESCSNSWLPAMTQLPQTTVRSKMDDPANKPTPLKAYSCAISLLLTSPETDDDRN

SEQ ID NO: 168607 - protein, 69 aa, Glycine max
  Coding DNA Sequence Number=SeqID_51829
  Gene Ontology: Mol. function=serine-type endopeptidase inhibitor activity; Cellular component=vacuole; Biological process=response to wounding
  Homolog annotation: Hit_ID=Q1S278; Match level="QueryCoverage=95%, HitCoverage=95%, E-value=2e-23, Identity=71%"; Hit description =Proteinase inhibitor I13, potato inhibitor I
  Pfam annotation: Domain name=potato_inhibit; Domain location=7-69; Score=117.9; E_value=2.9e-32; Accession=PF00280.8; Description =Potato inhibitor I family
MSQCKGKRSWPELVGVKGTVAEATIERENSLVNAIVVPQGSGVTADFRCDRVWVWVNENGFVFQVPTIG

SEQ ID NO: 168608 - protein, 174 aa, Glycine max
  Coding DNA Sequence Number=SeqID_51830
  Gene Ontology: Mol. function=nucleic acid binding; Cellular component= intracellular; Biological process=regulation of transcription
  Homolog annotation: Hit_ID=Q93XJ4; Match level="QueryCoverage=82%, HitCoverage=73%, E-value=1e-14, Identity=38%"; Hit description =Lateral shoot inducing factor
  Pfam annotation: Domain name=zf-C2H2; Domain location=32-54; Score =22.8; E_value=0.0012; Accession=PF00096.16; Description=Zinc finger, C2H2 type
MNSEKSVSLDISSEENDHHDQDDDTGGTKRSYECTFCKRGFTNAQALGGHMNIHRKDRAKAKQFTIDASPSVNKFNNDDSTALPFVSEIMNQPTKPNYYSLLESQMNFQPPHAFYYEFCNSRSQPLSLNQGLHGANLSLQIGPSHVDDNIHQFRRGNQKTSEVDLELRLGHDPY

SEQ ID NO: 168609 - protein, 133 aa, Glycine max
  Coding DNA Sequence Number=SeqID_51831
  Gene Ontology: Mol. function=calcium ion binding; Cellular component =integral to membrane
  Homolog annotation: Hit_ID=Q8W543; Match level="QueryCoverage=32%, HitCoverage=30%, E-value=1e-13, Identity=86%"; Hit description =Drought-induced protein RDI
MIRNVSKTPYFIFLLVLVTVEVQGRYLPERATELVSDGVHNNLQHNETSYLVLKGIDDESFEEPCKQMYGFLPCTNNIFGHLFLILVYEYLLFHGESYLAKGGEQIFKILGPGIFGASAFQILGALPESLILL

SEQ ID NO: 168610 - protein, 242 aa, Glycine max
  Coding DNA Sequence Number=SeqID_51832
  Gene Ontology: Mol. function=ATP binding; Cellular component=nucleus; Biological process=response to DNA damage stimulus
  Homolog annotation: Hit_ID=Q1S277; Match level="QueryCoverage=97%, HitCoverage=98%, E-value=7e-89, Identity=66%"; Hit description=XRCC4, N-terminal
MEEETERFSCSKLLIPKGEPIFVKATWFPTHFHLAVTDGITAWHCHLKQRAAQWDLPVSEYLNLSERYLGLQQPGSVYAFDDAGDSHKRLSWTFEKEGMTLLWRWKCLLSPDSKKSNVEILDFLMGSNINLSDKVVTENELFEKMKVEAEKCLTQSERIANERLEFESEIYAKSKLRVLRDKLSKQENSEKSPEEEDTDKTESFDEENDFERSDEDPQKDITSSSKEVMANKPSHPKRIRHK

SEQ ID NO: 168611 - protein, 394 aa, Glycine max
  Coding DNA Sequence Number=SeqID_51833
  Homolog annotation: Hit_ID=Q1S275; Match level="QueryCoverage=99%, HitCoverage=100%, E-value=1e-115, Identity=56%"; Hit description =Targeting for Xklp2
  Pfam annotation: Domain name=TPX2; Domain location=244-294; Score =70.3; E_value=6e-18; Accession=PF06886.2; Description=Targeting protein for Xklp2 (TPX2)
MGVEDTDICIIKEPDHVVVYSDGISHDSGHEAGSDHHNITESYEQINETTEHHSSEESAKEYEVKECTTEISVKVSDVSNVKKCEDKLTSDSEGVLSEKSFKSHKTRCKHKPRDTGKNGSRPPVTGSAQIRPTVPQPFSLATEKRASIATRPAFEEDNKGSNERKSLNKKNVLSPNLFKQNQLKSPVVSRMPLQPDNKKHPDDDDSCSVASMYPLKNVAVKSVKFSSSVRSIKSRTTVASAPVFRSTQRAEKRKEEKQQAMEAEKNQSEARTKEEMEEAIKQLRKSLTFKASPMPSFYHEGPPPKVELKKLPATRAKSPKLGRRKSNNGAVNLSEGDKEKGAGIRRKHHTPKTNNYGDKSDVNGLSDPKNKTKHIEGINATEVTGQANLEIGSQ

SEQ ID NO: 168612 - protein, 326 aa, Glycine max
  Coding DNA Sequence Number=SeqID_51834
  Gene Ontology: Mol. function=zinc ion binding
  Homolog annotation: Hit_ID=O65462; Match level="QueryCoverage=62%, HitCoverage=100%, E-value=1e-101, Identity=84%"; Hit description =Receptor like protein
  Pfam annotation: Domain name=BAH; Domain location=114-229; Score =151.2; E_value=2.7e-42; Accession=PF01426.8; Description=BAH domain
  Pfam annotation: Domain name=PHD; Domain location=233-282; Score =61.3; E_value=3.1e-15; Accession=PF00628.19; Description=PHD-finger
  Pfam module annotation: Pfam domain module=BAH::PHD; Domain location =114-229::233-282
MAIGAILAVTMNQDRVNNVIVKITVTHWHKERHAHSLFSCPSSNSSLKRTERKNLRRNSTVLAIAEAPTPRISNSSPKTLFVGTEFQRETLHNMAKTRPGRKDLDSYTIRGTNKIVRAGDCVLMRPSDTSKPPYVARVEKIEQDSRNNVKVRVRWYYRPEESIGGRRQFHGAKELFLSDHYDVQSAHTIEGKCIVHSFKNYTKLENVGAEDYYCRFEYKAATGAFTPDRVAVYCKCEMPYNPDDLMVQCEGCKDWYHPACVGMTIEEAKKLEHFVCSECSSDDDMKKPHATFSVSPGSDVKVRLPASSHEQFELRCTSTYVPFQFP

SEQ ID NO: 168613 - protein, 60 aa, Glycine max
  Coding DNA Sequence Number=SeqID_51835
MEHLACMYDHKSMYEMAPKKLSMKRSRRDAAAEGYSATPEIDSHRFQSAEHQQRFEAIKG

SEQ ID NO: 168614 - protein, 124 aa, Glycine max
  Coding DNA Sequence Number=SeqID_51836
  Homolog annotation: Hit_ID=Q10GG7; Match level="QueryCoverage=66%, HitCoverage=15%, E-value=4e-17, Identity=49%"; Hit description=H1flk, putative, expressed
MQLQDGSVGKVINNLSQVLARVVGDQSIFPHLHKKDHSAHVIEKFSHYVGRQMGFLESEVPAELCRLADEYLIKPKECVESILEYLAHQKDPTTLCQKLIDEFDRCILSYFAFNWNQASYMISQ

SEQ ID NO: 168615 - protein, 103 aa, Glycine max
  Coding DNA Sequence Number=SeqID_51837
  Gene Ontology: Mol. function=nucleic acid binding; Cellular component= oxygen evolving complex; Biological process=DNA integration
MANNKVWDLVELPNGIKPIGCKWVFKTKKDSLGHIERHKARFVAKGFTQREGVEYRETFSLVSMKHSLCIIMALVAHFDLELHQMDVKTAFLNGDLEEEIYMT

SEQ ID NO: 168616 - protein, 107 aa, Glycine max
  Coding DNA Sequence Number=SeqID_51838
MIFKRYLEKFMTIGKKKKARSFGDLHCDEVLCGERLCDEAQRRSRRNPFTKGRRKLHFWPWRNKREKASPTGLSLEGKRERERTKITAASDLGLATKPTSKLCLHPF

SEQ ID NO: 168617 - protein, 60 aa, Glycine max
  Coding DNA Sequence Number=SeqID_51839
MVMILIVVAVLVLATNDDSGKDIDGDDGKCDISGDNYNGVSDSDIGDINDDDNGNQHSGY

SEQ ID NO: 168618 - protein, 85 aa, Glycine max
  Coding DNA Sequence Number=SeqID_51840
MERVVLENCSDSVMITTDAATITNHEKSVLEGGDDDDDLSFLDTYTEPDNFGATMIFTRRNIARVSSIDQNILGSYSYSLSFENA

SEQ ID NO: 168619 - protein, 251 aa, Glycine max
  Coding DNA Sequence Number=SeqID_51841
  Gene Ontology: Mol. function=DNA binding; Cellular component=nucleus; Biological process=regulation of transcription
  Homolog annotation: Hit_ID=Q0PJC1; Match level="QueryCoverage=51%, HitCoverage=83%, E-value=2e-51, Identity=70%"; Hit description=MYB transcription factor MYB122
  Pfam annotation: Domain name=Myb_DNA-binding; Domain location=14-61; Score=47.6; E_value=4.3e-11; Accession=PF00249.21; Description=Myb -like DNA-binding domain
  Pfam annotation: Domain name=Myb_DNA-binding; Domain location=67-112; Score=55.6; E_value=1.7e-13; Accession=PF00249.21; Description=Myb -like DNA-binding domain
  Pfam module annotation: Pfam domain module=Myb_DNA-binding::Myb_DNA -binding; Domain location=14-61::67-112
MVKNTYSDKSGHRKGTWTPEEDKKLIAYITRYGHWNWNLLPKFAGLERCGKSCRLRWLNYLRPNIKRGNYTQEEDETIIKMVQRLGNRWSLIAAQLPGRTDNEIKNYWHTNLKKKYHQQNVNAETEVSKSKDHQSPDEALPKPNNVDDVPFQNLPPTSQSTDSCTTSSIIISPTQFSITTTGRSSDDSKEKFDIPYEDEFAFADVMNESFWLEPYVVDISCYPSDVLVAEPDCFSPVPDVELWSHDHEYFA

SEQ ID NO: 168620 - protein, 320 aa, Glycine max
  Coding DNA Sequence Number=SeqID_51842
  Gene Ontology: Mol. function=protein dimerization activity; Cellular component=nucleus; Biological process=regulation of transcription, DNA-dependent
  Homolog annotation: Hit_ID=Q0GPI0; Match level="QueryCoverage=86%, HitCoverage=90%, E-value=8e-66, Identity=50%"; Hit description=BZIP transcription factor bZIP50
  Pfam annotation: Domain name=bZIP_1; Domain location=171-235; Score =31.0; E_value=4.2e-06; Accession=PF00170.11; Description=bZIP transcription factor
  Pfam annotation: Domain name=bZIP_2; Domain location=171-225; Score =35.7; E_value=1.6e-07; Accession=PF07716.5; Description=Basic region leucine zipper
  Pfam module annotation: Pfam domain module=bZIP_1::bZIP_2; Domain location=171-235::171-225
  Subcellular localization annotation: CTP_CleavageSite=59; ConfidenceScore=5.84e-01
MAQLPPKIPTIPQNWPSFPHQRVPSMANFNPTTSTTTATTTPPPPSWVDEFLDFSSARRGAHRRSASDSITFLEAPFLDECRAGFDRLDEDQLISMFSDDIAAASLPPPPPLSSASNPSSPASDQNSSEEKPMEMALDVKPKAETLEEESSYKDEEAAPQPSAIATCTETVVDPKRVKRILANRQSAQRSRVRKLQYISELERSVTTLQTEVSALSPRVAFLDHQRLILNVDNSALKQRIAALAQDKIFKDAHQEALKKEIERLRQIYHQQNLQKMNSNLQQTTPTSQPQQQPMQLHHHQQPIAVSQPLGCKDNKEQLLS

SEQ ID NO: 168621 - protein, 624 aa, Glycine max
  Coding DNA Sequence Number=SeqID_51843
  Gene Ontology: Mol. function=ionotropic glutamate receptor activity; Cellular component=membrane; Biological process=ion transport
  Homolog annotation: Hit_ID=Q5VMN1; Match level="QueryCoverage=95%, HitCoverage=69%, E-value=1e-104, Identity=34%"; Hit description =Putative Avr9/Cf-9 rapidly elicited protein
  Pfam annotation: Domain name=ANF_receptor; Domain location=51-381; Score=172.3; E_value=1.2e-48; Accession=PF01094.18; Description =Receptor family ligand binding region
MGSMHMFVPLLCFMSMLKFALRNVAADDGTHVMGTNTIGVITDNKSRNGKEEIVAIKMALEDFYQYSNQNFGLDLQIRNSHGDPLQAALAARDLIDTKHVEAIIGPQTWEETTLVADICSQNMTPVLSLADATPNWSTLKWPFLVQASPNHFKQMKAVAAIVHSFGWYDVNIVYDDRDSSSTRMLSHLYRALSKACVQISNLLPIPLISSSLSQELEKLREGHCKVFVVNLSLSLAINLFETAKKLNMMEKGYVWIITDPFTSLVHSLKASTISSMQGIIGVKSYFPEIGVQYEDFYLRFRRKFSSENPQEFNNEPGIFAARAYDAAWTLALAMTQTDNKGGQILLDNILLNNFTGLSGKIQFTDQKLDPSNTFQITNVIGKGYKEVGFWSDGLGFSNNIGQNATTFNSSMKELGQVLWPGRPWGNPRGWTPPTSDKPLRIGVPVLATLKQFINVIQDQTENTSTFQGFTIDLFRSTMELLPYHLPYKFYPFNDTYDNLVKQVYLKNFDAVIDVTIISYRYQYAEFTQPYTDPGVVMVVPLKSKLAHRTWLFMKPYTKTMWALILAMIIYNGFILWMLERRHNPEIRGSMLNQTGSMAWLALTPLIKLDGNLRLRSCLDKFLPK

SEQ ID NO: 168622 - protein, 96 aa, Glycine max
  Coding DNA Sequence Number=SeqID_51844
  Gene Ontology: Mol. function=exonuclease activity; Cellular component= intracellular
  Homolog annotation: Hit_ID=Q8LAA0; Match level="QueryCoverage=71%, HitCoverage=32%, E-value=7e-14, Identity=75%"; Hit description =Exonuclease, putative
MEGSLLVMPCPMILSRSSSRRALRHLAAEHLGVNIQTGEHCPVEDARAAMLLYQRNRKEWEKNIKDQFRLKQKQRKSKQKKKQKNEDVSNANHVEI

SEQ ID NO: 168623 - protein, 74 aa, Glycine max
  Coding DNA Sequence Number=SeqID_51845
MANSIKEDWKGQNALNDDGEHSKEVRKEKVGILATSSHSDLGFPSKKEANGKYKDKRNKKEERPTLGEDRRGMA

SEQ ID NO: 168624 - protein, 131 aa, Glycine max
  Coding DNA Sequence Number=SeqID_51846
MVRNKFDVISQSFSTILKTSTSIGRKANIRDRMQMAIGGNIMEHEIEDEGIVNCNKLLLEYMKKLLIGVRTIAMYSMRNPWICISLLTLFFSLFTHNSLAALPTVSSNQTLTGDQTLLSKGGIFELGFFKP

SEQ ID NO: 168625 - protein, 291 aa, Glycine max
  Coding DNA Sequence Number=SeqID_51847
  Gene Ontology: Mol. function=oxidoreductase activity; Cellular component=mitochondrion; Biological process=transport
  Homolog annotation: Hit_ID=Q84N44; Match level="QueryCoverage=99%, HitCoverage=79%, E-value=1e-112, Identity=69%"; Hit description =Oxidoreductase
  Pfam annotation: Domain name=ADH_N; Domain location=1-69; Score= -12.1; E_value=0.0084; Accession=PF08240.2; Description=Alcohol dehydrogenase GroES-like domain
  Pfam annotation: Domain name=ADH_zinc_N; Domain location=100-247; Score=71.3; E_value=3.1e-18; Accession=PF00107.16; Description=Zinc -binding dehydrogenase
  Pfam module annotation: Pfam domain module=ADH_N::ADH_zinc_N; Domain location=1-69::100-247
MRAGYGRSIFERLLPIILGRDVSGEVAAVGDKVRLVSVGEQVFGALHPTAVRGTYADYAILSEEEVTPKPDSLTHVEASAIPFAALTAWRALKSTARISEGQRILVVGGGGAVGLSAVQFAVAAGCSVVTTCGSQSVDRLLAAGAEQAVDYIAEVDVELAIKGKFDAVLDTIGMPETERMGINFLKRGGHYMTLQGEAASLSDRYGLIIGLPAATAVLLKKQLLYRFSHGIEYSWTYMRDDLEGLTEIRKLCEAGKMKIPVYKTFPIAQVKEAHEAKDKKLIPGKVVLEID

SEQ ID NO: 168626 - protein, 366 aa, Glycine max
  Coding DNA Sequence Number=SeqID_51848
  Gene Ontology: Mol. function=catalytic activity; Biological process =protein amino acid phosphorylation
  Homolog annotation: Hit_ID=Q9FM53; Match level="QueryCoverage=85%, HitCoverage=62%, E-value=3e-89, Identity=56%"; Hit description =Arabidopsis thaliana genomic DNA, chromosome 5, P1 clone:MJH22
  Pfam annotation: Domain name=DUF860; Domain location=9-276; Score =231.7; E_value=1.6e-66; Accession=PF05898.4; Description=Plant specific of unknown function (DUF860)
  Subcellular localization annotation: CTP_CleavageSite=60; ConfidenceScore=5.08e-01
MPWPPTPLNATKLHPQLCVRLTPAAAALASEEFNLQSSVSNMLATKLQKLLMLSSHHRLLLSKLVHFAPDLGLPPNFRSRLCNDHPDRFKIVDTSYGRTLELASWDVNLAKPLVPPASSSNSLGFIVDRPLKFKQLSLRKGLNLKRRHQDFLLKFEEMPQVCPYRNPAESLTKESLEAEKRSCALVREVLAMTVEKRTLIDHLTHFRKEFGLPNKLRGMIIRHPELFYVSLKGERDSVFLVEGFGEKGDLLEKDGALFIQDRWMDLARESKRMRRERRKNRIDKDVGSLNGTDQNSYDSDDDNIEMDNFKDGYDDGFEDIFEELDFEAEDDDHRNGFFSQNSNGEFWIAGPFPIQHGLDEVQTQPW

SEQ ID NO: 168627 - protein, 772 aa, Glycine max
  Coding DNA Sequence Number=SeqID_51849
  Homolog annotation: Hit_ID=Q9LIM5; Match level="QueryCoverage=84%, HitCoverage=88%, E-value=4e-32, Identity=41%"; Hit description =Arabidopsis thaliana genomic DNA, chromosome 3, BAC clone:F4B12
  Subcellular localization annotation: CTP_CleavageSite=64; ConfidenceScore=5.41e-01
METDRERPHRSTSELFVCFTSRLSSSSMKLSSKSILSPSRSRDPPQISLSSSLSRRLKSNGSIKGGGGGQASPMFPTGGGGKRRGCGFENPEPSSPKVTCIGQVRVKTKKQGKKMRARSKRRGEASFRKGEQQVGVNSNANIGSANLNPDLTRQNSQGFQHHQNCLKHRNNQRWVHLPLTICEALREFSCFFPCRSSCMSTEKEEKGGGVEGGGHGMMMREGSCGINNNNNNNNNNNVGRWLVALQDGDGKGRGIELVMEEEMEVSGRERSVRSHSQRRHVFEDIDVDLVVGEEQEKKHEELVGEEEEQARVSICIPPKNALLLMRCRSDPVKMAALANRFWESPVHKDKCQEEQQDDEEESGDEEEEQEDDKEQHHKMKDEQQEEALEQVEREAIEDSICERETETAVVATENDEEEQDGKESYEIVSRENLESQVFTEVVKEEEKVDEEEAANGGNAIEEGETLTHPEAYSDLENLKTEEKEANLEEGKEERENNDSSELSSTPETFAASEKENDGAEAETEPVTVETSEGSTEEEEEKVIEPKEQPQQPGPTREPNSDPESMERENGSKREERDREALPECLLLMMCEPKLSMEVSKETWVCSTDFIRWLPERTAAGGGNRVAAETLAKSKPKPKPMMQPPRSSCSFPAARGGAGVSMAAMIEQKLMGSKSGNGYEPFVLTRCKSEPMRSSAKLAPEACFWNNRKLEPHPPAAQLGVGAPAGIGLLSLNFGQLCHYKVFMSGYSLVVRSRRKVCVKGNEELRYRLRIET

SEQ ID NO: 168628 - protein, 98 aa, Glycine max
  Coding DNA Sequence Number=SeqID_51850
MTTEQMFKFLMLCNCMLFRTIVNGLTYLATFVFGLNSLGLFLYSGQLALKFIMGNSTEKETESKSTDQPNLSNSSIESSTDKTELSSRKEEQSSNDAQ

SEQ ID NO: 168629 - protein, 297 aa, Glycine max
  Coding DNA Sequence Number=SeqID_51851
  Gene Ontology: Mol. function=protein serine/threonine kinase activity; Cellular component=cell surface; Biological process =protein amino acid phosphorylation
  Homolog annotation: Hit_ID=O64477; Match level="QueryCoverage=92%, HitCoverage=32%, E-value=3e-93, Identity=61%"; Hit description =Putative receptor-like protein kinase
  Pfam annotation: Domain name=B_lectin; Domain location=72-190; Score =142.2; E_value=1.4e-39; Accession=PF01453.15; Description=D-mannose binding lectin
  Pfam annotation: Domain name=S_locus_glycop; Domain location=205-297; Score=93.6; E_value=6.2e-25; Accession=PF00954.11; Description=S -locus glycoprotein family
  Pfam module annotation: Pfam domain module=B_lectin::S_locus_glycop; Domain location=72-190::205-297
MRNPWFCISLLTLFFSLLTHNSLAALTNVSSNQTLTGDQTLLSKGEIFELGFFKPGNTSNYYIGIWYKKVTIQTIVWVANRDNPVSDKNTATLTISGGNLVLLDGSSNQVWSTNITSPRSDSVVVAVLRDSGNLVLTNRPNDASASDSDSLWQSFDHPTDTWLPGGKIKLDNKTKKPQYLTSWKNNEDPATGLFSLELDPKGSTSYLILWNKSEEYWTSGAWNGHIFSLVPEMRANYIYNFSFVTNENESYFTYSMYNSSIISRFVMDVSGQVKQFTWLENAQQWNLFWSQPRQQCE

SEQ ID NO: 168630 - protein, 187 aa, Glycine max
  Coding DNA Sequence Number=SeqID_51852
MGKFAFDTKSQTNSRRYLSLSGSINSNNRSTIIIPEAGNSTPQNNQITAIYYISDVALSVPPPPPSLPIHTHTPQTIPPWLAQLADAAADIDFETEGEGPVELPFSSTPSIFATADDPSPIQVASSVLLTGAVSVFLFRSLRRRAQRVKQSQFRSSGEKSIKEEALDSLKAMGSGSVKAKEDSASPG

SEQ ID NO: 168631 - protein, 334 aa, Glycine max
  Coding DNA Sequence Number=SeqID_51853
  Homolog annotation: Hit_ID=Q9LIM3; Match level="QueryCoverage=95%, HitCoverage=96%, E-value=5e-21, Identity=30%"; Hit description =Arabidopsis thaliana genomic DNA, chromosome 3, BAC clone:F4B12
MEPIGNSYESSFSKDEKVEAADLLLEECWFFDNLLKITPRMTRCHSEPYPSSTGLISPPDFLVKDSNSNSSSPSKPLNNGAIVHPKIQRAPYMPPLRLREEEEDQKGSSSTRSKLVHQPTDPVVSHAASKPHCAQMKGRHNSDCVRRKSKLLRTPSLPPSIGRDEKLQVYDTRPGRFHKQPSTPTQIDILPPRQTSKSCSIPRCRPARKTEVESFNKEGIMEMRRRYLNQKTMRRSLSDLEFEEVQGFKDLGFSFEKETLSPSLASILPGLQEKKRDETEEDKAARRPYLSEAWLVQSCAPAIPNWTSHKSSGDMKVQIKFWARAVASNVHLKC

SEQ ID NO: 168632 - protein, 140 aa, Glycine max
  Coding DNA Sequence Number=SeqID_51854
MSQLQFTNFNTLFEDELSRFKANQSSDVPKNPVVRQFKEAVWNVHHAGQPMPGEEQEDIVMTSIQSNILNITCPLSGKPVTELAEPVRSTNFSENSCWNDKFKHAKPTFWVDYGVDVNGLAWLKAEDTCKSMRKMPVSVL

SEQ ID NO: 168633 - protein, 1872 aa, Glycine max
  Coding DNA Sequence Number=SeqID_51855
  Gene Ontology: Mol. function=nucleoside-triphosphatase activity; Cellular component=protein complex
  Homolog annotation: Hit_ID=Q9LIM2; Match level="QueryCoverage=98%, HitCoverage=99%, E-value=0.0, Identity=41%"; Hit description =Similarity to 26S proteasome subunit 4
  Pfam annotation: Domain name=AAA; Domain location=654-844; Score =270.4; E_value=3.7e-78; Accession=PF00004.19; Description=ATPase family associated with various cellular activities (AAA)
  Pfam annotation: Domain name=AAA_2; Domain location=650-784; Score= -51.1; E_value=0.07; Accession=PF07724.4; Description=ATPase family associated with various
  Pfam annotation: Domain name=AAA_3; Domain location=654-799; Score= -17.2; E_value=0.025; Accession=PF07726.2; Description=ATPase family associated with various
  Pfam annotation: Domain name=AAA_5; Domain location=654-790; Score= -4.7; E_value=0.0041; Accession=PF07728.4; Description=ATPase family associated with various
  Pfam module annotation: Pfam domain module=AAA::AAA_2::AAA_3::AAA_5; Domain location=654-844::650-784::654-799::654-790
MRSSPSSLGSSSRSGSRLRKKHKRLDAICEEEYSRNHGELNEDNGDLNPDAGVRRSSRVRRAPMLLDASPAPPKKRRKVGKGGIGRIVEGARRLGRENKGSGGAWSSRLRSRVGNVGVRVKEERESPRGKRKLFEGVVGRRGVEEVGGKEELGGLMPKVVKSKRPGRIKATKHEEGHEEDVSDGSLEESKSQEVEIMLSSGEESDSDPETKLSGGDCMDDSDGNASPVIGNEEGNPMDDSDGDVAPMIGNEEGDQMDDFDGNDPLMVGNKKNLCNDLQIDECDGNAESSPMEHVVKVDDQLESVKESKNVGDVAEQVDNEGSVGKEVDVNENVLKDANDGKEDDADENVLKGANVGRSDELKHASIDKRGHQRIKEGRRCGLCGGGSDGKPPKRLAQDNGESENEAYSGSSSSEETNYDIWDGFDDEPGWLGRLLGPINDHCGIARIWVHLHCAVWSPEVYFANFGCLKNARAALFRGRALKCTRCGRRGATTGCRVDRCPRTYHLPCARASGCIFDHRKFLIACTDHRHLFQPRGNKYLARIKKLKARKIMWEIRKRSNEACRKDIGDEERWLENCGEDEEFLKRENKRLHRDLLRIAPVYIGGSDSASENSFQGWESVAGLKDVIRCMKEVVILPLLYPDLFDNLGLTPPRGVLLHGHPGTGKTLVVRALIGACSRGDKRIAYFARKGADCLGKYVGDAERQLRLLFQVAEKCQPSIIFFDEIDGLAPRRTRQQDQTHSSVVSTLLALMDGLKSRGSVVVIGATNRPEAVDPALRRPGRFDREIYFPLPTIEDRASILSLHTQKWPKPITGSLLEWIARKTPGFAGADLQALCTQAAMNALKRNFPLQEVLSLAAEEKHSGSKHIPLPSFAVEERDWLEAFFSSPLPCSRRDAGNAANDAVCSPLPIQLIPCLLQPLCTLLVSLYLDERLWLPLSILKAATVIKDVMISALDKKQKPSDRWWLHMDDFLQETNIVYELKRKLTCSGILSANDGNAGSCETEDDANNNSLKLESSTRNHPGMRSGLFALTNKSGFRILISGNSRSGPRHLASCLLHCFIGNIEIQKIDMATILQEGHGEVVQGIGQILMKCASRQSCIVFLPRIDLWAVEKHFQIAERTDSCLMMGKSCFTRNQVVEKENEISTEKNSTEMIKGQANTKASYAWMSFIEQVESIDVSTSLMILATSEVPYTELPHKVREFFKSYQSKDGRSTPLEQTIPRFSVQIDENFDHDMVINLSALELLRNVVEQLVQLIHQRSHVHMGSQKGRSYESIEVSKDKVCQRKEDGPANDKKSEIQLESFTKVPPTPNSKSLKGKSTLLLAISTFGYQILLYPHFAELCWVTSKLDEGPCADVSGPWRGWPFNSCIVRPNNSQDKVAVSCSSGGTKSREASGLVRGLIAVGLSAYRGVYKSVREVSLDVRKVLEILIEKINTKIQVGKDRYQYFRILSQVAYLEDMVNNWAYSLLSNSFHFSLEQDSPEHKTKVIPESGGPLNSHLTWENHQTEDEDCHLVVPVDGNDLETLEGSHKEIPSETTGYLASDDNNDNVEIIDCDDGNASSEGSLQNHSFPDNKNINNTTAASQPLYPSTSLENGTLFGQSEPVTAGNNEEMDGELEISEDLKKSTCTHPVVPFQNGLHTACDPETQNVEIGNLITISDQPFSLSAVETATKSSDGKSDKQENATDNNVSSSNGSGPAESGVICLYQCCPACLHSLHHLTKKILVEKWGLNSEQWTAEDVHDAVASLSVDLISAVRKCSMPQDFIDSSNKTSRNEKHGTSLDCLKLRTCNNGNQGKDVVPAECFSHAASQHATAMEDMALNEESTKLDLKFVFRDGVLVHMDPDKDVKVHCKFENLCLCSLRELIVMKKRPFD

SEQ ID NO: 168634 - protein, 382 aa, Glycine max
  Coding DNA Sequence Number=SeqID_51856
  Subcellular localization annotation: CTP_CleavageSite=29; ConfidenceScore=5.08e-01
MTQGSFVPHGRDDILNMAIGKPEHLGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSAIHNVTDADDVVRVSVDKVIEGDAKVPFPTSEIQYESDTSPKKLPETNERGTNDFDHDPLHQLIKSLYFMYDTPVELKWDGSKFELSNVDASFFLTFSDVNEIVAGYKCLNISILQLWMFINFYVYFIKADFWMSGAQLWVMLPCMDSLSHNRYTMQRINVLNVSITYKHDSRNRNERGHWQLVVLCPATNVVAWFCSLRKKPDTHIKTAINK

SEQ ID NO: 168635 - protein, 85 aa, Glycine max
  Coding DNA Sequence Number=SeqID_51857
MGTTDIGLVYHGDTSCALAEEASMKEENERDRVMQSYPLRALDRRLQEDWPRDAREGPPVLMSLKVDFRPMTWAKYELTYLCILD

SEQ ID NO: 168636 - protein, 109 aa, Glycine max
  Coding DNA Sequence Number=SeqID_51858
  Subcellular localization annotation: CTP_CleavageSite=46; ConfidenceScore=5.14e-01
MLLPNAVHVSSTFEFGAMFHDCLSADPQGNPPFSPFFGAPGMSLSSAVHVSSIIKRGASGDWEICSSVVFRIGSFAKHQKRRSRDENRHHGKGRMDEIHVLSLLPSYLR

SEQ ID NO: 168637 - protein, 60 aa, Glycine max
  Coding DNA Sequence Number=SeqID_51859
MTEVSTEAIASLVQYYDQTLRNWTAGSKSKMRWLEYQGNVWKHRRESWQVKTNGPRSWTS

SEQ ID NO: 168638 - protein, 394 aa, Glycine max
  Coding DNA Sequence Number=SeqID_51860
  Gene Ontology: Mol. function=nucleoside-triphosphatase activity; Cellular component=intracellular; Biological process=transport
  Homolog annotation: Hit_ID=Q3BMH0; Match level="QueryCoverage=88%, HitCoverage=58%, E-value=1e-160, Identity=81%"; Hit description=Type II secretory pathway ATPase
GGGLARAGRAGDQHDAVRSLDQRIPAGGLLRAETELVDALEGGIGVEDAHHALLAEGGGHGRQAHLDLAAARRAGLDAAVLRAPALGQVHAAEHLDAADHGGHHCRRDLEHLVQHAVDAEAHAPHFAAWLQVDVRGALFVGVLQQPVDDVHDVLVVGIDVAGAAQLHQLLEAGQGGVGLAAHVATGAAHRAGHPVELHGVAVQVQRIDHRQFDAAAGQVLQVAAPFLHQRLAGGHQHALGIHRQRQETVAARVGVRHQRGHRSDVDPGWIDAQVAAAGALRQPLGEALQGQFAAAGGGQLEVGQQYQRMHFTGVACAMRGKPHALAVLLGHQVIGDQGRGNLLEMQPSPGQRDAARLAGRACRQPMFHLPAPPGYGMPRRSADILAHPLAGQDS

SEQ ID NO: 168639 - protein, 279 aa, Glycine max
  Coding DNA Sequence Number=SeqID_51861
  Homolog annotation: Hit_ID=Q1RTB4; Match level="QueryCoverage=87%, HitCoverage=64%, E-value=2e-10, Identity=25%"; Hit description=IMP dehydrogenase/GMP reductase
MDILTLLIFGVVLFPNVDGLVDRAAIDAFLAFYDRKESPVVAILADLYDTFDQRCEKKNARIVCYTSALYIWGCINYNPVLAIRQLGYPMRGVPLEEGLIPFITRGFDSTNAGVLQKVHKAWEMSQRKDKELKWSSNGPIGDYHRWLKAYAQDLDWLLSLRTTKGMEVETLEEDEEVQALKTELEKAQIVKEKFKSAAVRIRKENAKLRGVNIATTKALEQETKRARKEEHGRNKFRGALWGSNSELKLRREERDQSRVDSLILKDELRVCLRSKRSLS

SEQ ID NO: 168640 - protein, 111 aa, Glycine max
  Coding DNA Sequence Number=SeqID_51862
MGANRNKDSKQWVRLAKLGPDSGSLLVREYCPVISHSIALFVALTYNDCSMHTVTYKTKNLNKAFQLMKATKDTDIRYFTVNGVFDQDRNSVKQLAKTYPCAIPCFGLHPR

SEQ ID NO: 168641 - protein, 178 aa, Glycine max
  Coding DNA Sequence Number=SeqID_51863
MDRAHKTPSGPEEVQQDPGVSSSGYGPLSVLQGARPPQRGIALVRHPVDKKESHRVPVPPSKGLCPQDTQWTRRSPTRPWGFQLWLRASVRPTGRPSPPASSCHRDIGKDCAHKTPSGPEEVQQGLGVASSDYGPLSSGPLLIELSSRSTAPPGKRRVKLHSSLGMAGSGQQTHYHHL

SEQ ID NO: 168642 - protein, 122 aa, Glycine max
  Coding DNA Sequence Number=SeqID_51864
MGLGNIFQEEEINVKELKSVNKTWQPKVIAISISKDLATMTHAKLFGKLREYDMDLTRMAEEEAIDKKNKGNVDELVVENLNLFVRRFNKFLKKKKNYGSITFQPKKNFMKENYLPPMDSLA

SEQ ID NO: 168643 - protein, 394 aa, Glycine max
  Coding DNA Sequence Number=SeqID_51865
  Gene Ontology: Mol. function=nucleic acid binding; Cellular component= chromatin; Biological process=DNA integration
MACLMSNDDLSLLWHRKIAHIHMDKLNKLVSKEFVRGLPKLKFEKDELCNTCQKGKQTRVSFKSKNAVSTTRVLELLHLDLFGPSRTMIIGGNYYALADEDLLLGYSTNGKAYQVFNKHTLRIEKSMHVVFDESNPQRLGKLPLYDDDDDVGSPKKSPPTSEKVVNNNRLEGHSLQHNNLPKGVSTRHSLNLFWEFYAFVSMIEPSTIEDALVDEHWALAMNDELNEFKRNEVWELVPRTSKTNIIDTKWVFKKKLDEHGLIAMNKARLVAIGYNQQEGIDFGETYASVARLEMQGEIEMSMIGELNYFLGLQAKQMNHGMFLHHTKYCKALLKKFDMEKSKEAATPMATNCYLSADKKAKLVDQTKYKAIIVKRVMKYLIRTLDVGLWYPKGV

SEQ ID NO: 168644 - protein, 123 aa, Glycine max
  Coding DNA Sequence Number=SeqID_51866
IYVSSIFGPDVLDIVSDIVDPAASLLHLTFILPCALCSNSSIFGQDVLDIVRAVIQVGSATFIIRVIKHSGICSGDSKNSASCKSTSLFQDVKTSHVTSAFCSPCLHAPTAVKQFTAASSISY

SEQ ID NO: 168645 - protein, 69 aa, Glycine max
  Coding DNA Sequence Number=SeqID_51867
MHNLRKTNILPLLCLNEMTPQPSCMKFFWSYATSAPMLVSALIPWMVVSMPLMLALEAWILSSLSLRRI

SEQ ID NO: 168646 - protein, 248 aa, Glycine max
  Coding DNA Sequence Number=SeqID_51868
  Gene Ontology: Mol. function=isoleucine-tRNA ligase activity; Biological process=tRNA aminoacylation for protein translation
  Homolog annotation: Hit_ID=Q9SV89; Match level="QueryCoverage=34%, HitCoverage=6%, E-value=5e-33, Identity=79%"; Hit description =Isoleucine-tRNA ligase-like protein
  Pfam annotation: Domain name=Anticodon_1; Domain location=4-145; Score=19.4; E_value=6.3e-07; Accession=PF08264.3; Description =Anticodon-binding domain
MEIATVTSVSNQIEHVVPYLLKFLDNLTNIYVRFNRKRLKGRSGEEDGRIAPSTLYNVLLLSCKVMAPFTPFFTEELYQNMRKVCSGSEESIHYFSFPTEEGNLLLVQDGKLYGRYPMFSMITRVVGLPEVTENHDIQKNKFMVQLGQVDMRFNVKNAYWLNDRIRDKILQTEKNRINKDRELVISSTKTRTQKFVSPLLYYLFSLPLGSIEDALTKLQLSLLGTFGNDYISLFSSYLKHSEKKVILL

SEQ ID NO: 168647 - protein, 317 aa, Glycine max
  Coding DNA Sequence Number=SeqID_51869
  Gene Ontology: Cellular component=membrane
  Homolog annotation: Hit_ID=Q6D712; Match level="QueryCoverage=97%, HitCoverage=95%, E-value=1e-121, Identity=67%"; Hit description =Putative membrane protein
  Pfam annotation: Domain name=DUF6; Domain location=13-141; Score =21.0; E_value=0.0042; Accession=PF00892.11; Description=Integral membrane protein DUF6
  Pfam annotation: Domain name=DUF6; Domain location=168-307; Score =3.4; E_value=0.042; Accession=PF00892.11; Description=Integral membrane protein DUF6
  Pfam module annotation: Pfam domain module=DUF6::DUF6; Domain location=13-141::168-307
MFAGIVFALAAGLMWGMIFVGPLLIPDYPGTLQSAGRYVAFGLVVLPLAWLSRRRLKQLTRPDWTEAVKLSLVGNLLYYACLASAIQRTGAPVSTMIIGTLPVVITVTANLCYGHLEGRLPWRRLMPALVIIAVGLGCVNAAELHGQGSAFDLWGYLSGLLLAVLAVVCWTWYPLRNARWLREHPQHKPSSWATAQGLVTLPLALVFYGLVSLQIHWQQPDFALPFGPQPARFIWLMLAIGLFCSWLAALCWNAASQRLPTVVMGPLIVFETLSGLLWTFIYRQSWPPLLTSIGIGCLIVGVIYAMRIKPQRLSALP

SEQ ID NO: 168648 - protein, 73 aa, Glycine max
  Coding DNA Sequence Number=SeqID_51870
MNEDQWMYDNIMFEEVDMDYQNEQEYGVNESHVDCSDAFNTSQVFNTRDDVLQCARSVAHENEFVAVIMRSDI

SEQ ID NO: 168649 - protein, 178 aa, Glycine max
  Coding DNA Sequence Number=SeqID_51871
MATPPSSPPLPPPIAEFDVPEASDLRTQKKILQTVGERWRQFKYDLTSKWALAVDKESVDDTVCEKYDISKEKWAQFCQTHKDPLWEAQAIQKKNTAPHVLSYGGYQYLENKLMDEKRKKKLEEVAQSGITDTMIDPSSPIRRHVKWKMARTKKIGQMMSEAAKEIADKIDSLEDQAS

SEQ ID NO: 168650 - protein, 208 aa, Glycine max
  Coding DNA Sequence Number=SeqID_51872
MTHTKKTGQITSEAAKEIVKKIDSMEEQASHGSFVAHGRQDVLIVAIGRPEHPGHVRVVGSGVTIKQYFGLAPSTSHTYSSMALKDLEQLTQQIRDQLEEPIIEKMQSQGLALPPEPEVGPSAARVSTKESCVDTSGNDPDTSNSDKYGLYFEENPPRLVRDANALIPVPTEEVKLVGQTLNTFLAWPTHPVKRLLEQGSYETGKTCR

SEQ ID NO: 168651 - protein, 124 aa, Glycine max
  Coding DNA Sequence Number=SeqID_51873
MRGAPTEESLSPFLVRDFGAQSFKIVQRVRKAWESPLRKDKELRGIRNGIIGDWLSKFKVINEENFEAPEEDEEVQALKTELGKARLAKAKAMAEVCSAPEEIHGLINYCQHMVDLMAHIIRNH

SEQ ID NO: 168652 - protein, 91 aa, Glycine max
  Coding DNA Sequence Number=SeqID_51874
MRFQPNSLSTPTTLSEFIFWGRTFIFLRRYLWLSGADLLSPEAECLTNLADGTIDVALVNEFYANLYSPEDPSPKQARVRADGSRKFALKL

SEQ ID NO: 168653 - protein, 121 aa, Glycine max
  Coding DNA Sequence Number=SeqID_51875
MGFTLVDFQKIGYKDEPFIMVAQARHVFYVEDLSDSIWSVVLQGKTSAQKSITLHDNKDDDLKNQRMSSRIESSTLQGSRGKLNSRIKNQESSFKIQVSRIKIKIKIQDSRFKNQDKTQSR

SEQ ID NO: 168654 - protein, 80 aa, Glycine max
  Coding DNA Sequence Number=SeqID_51876
MHSEAEALEHMKKRDRGHQSVSFENKTGDSTMVKMSEKNNNADAGDCMILDDHKGEEHCCGKGTNARSVSFLPREDRRFG

SEQ ID NO: 168655 - protein, 128 aa, Glycine max
  Coding DNA Sequence Number=SeqID_51877
  Gene Ontology: Mol. function=serine-type D-Ala-D-Ala carboxypeptidase activity; Cellular component=membrane; Biological process =peptidoglycan biosynthetic process
  Homolog annotation: Hit_ID=P37604; Match level="QueryCoverage=95%, HitCoverage=31%, E-value=4e-44, Identity=71%"; Hit description =Penicillin-binding protein 6B precursor
  Pfam annotation: Domain name=Peptidase_S11; Domain location=14-128; Score=12.6; E_value=3.7e-11; Accession=PF00768.11; Description=D -alanyl-D-alanine carboxypeptidase
MIVWASLAHADDSMPFPLTPPAIDAASWVLMDATTGQILTAGYPDAERNPASLTKLMTGYVVDRAVDQKKITRDDVVTVGKDAWAAGNPVFKGSSLMFLKPGDKVTVRDLMRGVIIDSGNDACVALAD

SEQ ID NO: 168656 - protein, 121 aa, Glycine max
  Coding DNA Sequence Number=SeqID_51878
  Gene Ontology: Mol. function=RNA-directed DNA polymerase activity; Cellular component=chromatin; Biological process=RNA-dependent DNA replication
MLCVPKCSIRDLLLKEAHEGGKIKSEATWFYHPLPVLDFPRVDISMDFVLGFPRTKSGKDSVFVVVDKFSKMTHFIPCKKVDDACHVADLFFKEVVRLHGPPRSIVSDRDTKFLSHFWRTL

SEQ ID NO: 168657 - protein, 249 aa, Glycine max
  Coding DNA Sequence Number=SeqID_51879
AASPMTCADKLWSFRTPFRHSEAIVSDGAQRQIMVILRLSIQVRSCPMAHRDKLWSFCALLSSRGDPARWHTETNYGHPRTFAICKTRSVINAQRQIMVILCPLSFRSSESSDKCAETNYGYYAPFVIQEQRVEGDPARWHTETNYGHPRTFAICKTRSVINAQRQIMVILCPLSFRSSESSDKCAETNYGAASRVINAQRQIMVILRPLSLRSSKSSDKRAETNYGHFAPFVIQEQQVDVINAQRQIK

SEQ ID NO: 168658 - protein, 81 aa, Glycine max
  Coding DNA Sequence Number=SeqID_51880
MWYHSSGNFLSMSTRHFHLGKLGSKFRGHPIVHKQLPLHGDQPESQGSSKSSDMPSDIPLVKNIVFLENQHATGTGIHPHS

SEQ ID NO: 168659 - protein, 79 aa, Glycine max
  Coding DNA Sequence Number=SeqID_51881
MEVLKDLMEKVEALLFEEIVGKTWNRHPKTRPRKSLKQLLMQSYPARALARRLQVDWARDPRKGPRVLMSLRVDFEPMG

SEQ ID NO: 168660 - protein, 60 aa, Glycine max
  Coding DNA Sequence Number=SeqID_51882
MWQAAVARGDNKWSWVVKEKLVIKAAKIEQFMNGKDQRKSQRLEKSLNHIHGIGGGRGRL

SEQ ID NO: 168661 - protein, 262 aa, Glycine max
  Coding DNA Sequence Number=SeqID_51883
  Gene Ontology: Mol. function=transferase activity
  Homolog annotation: Hit_ID=Q3IA91; Match level="QueryCoverage=99%, HitCoverage=96%, E-value=2e-56, Identity=42%"; Hit description=WbcY
  Pfam annotation: Domain name=Glycos_transf_2; Domain location=3-152; Score=59.6; E_value=1e-14; Accession=PF00535.16; Description =Glycosyl transferase
MFSVVITTKNRLDFLRRAVESIVKSSLLPDEIIIVNDGGEKPELTDISFGKINVVIENNPSSLGANYSRNRGIELTSTENIFLLDDDDAVEVDSFQKRLDILLADDEVGLVFTGIKIVLSTELNRVRRTVYPREYPDFTEALFTKGKFDEALSCMQDYDLWIRMSQLCKIQHDSSATVIYTVHSNKNQISSNFRKYLETGQILLNKYSRLINNDARRHFMANLYFRVALSSASTSFVHRMRYAFLSLASVFSLKGLILLLTP

SEQ ID NO: 168662 - protein, 42 aa, Glycine max
  Coding DNA Sequence Number=SeqID_51884
MADQRATKSKAKGKQSTRTHLVAHDPGDLNKTSASSEGREIP

SEQ ID NO: 168663 - protein, 149 aa, Glycine max
  Coding DNA Sequence Number=SeqID_51885
  Homolog annotation: Hit_ID=Q1RTB4; Match level="QueryCoverage=56%, HitCoverage=18%, E-value=1e-09, Identity=39%"; Hit description=IMP dehydrogenase/GMP reductase
MVGASVNWFPRWKEGRVGVLSSCEGFSNVPLMGMRGCINYNPVLAIRQLGYPMKGVSLEESTMPFISWGFKDPNARIFQRVRKAWSAAQRKDMELRGSSNGIIGMPQVRKRLKPRRRVRSRGIRTGNKEGPKGRMGSKEVLRGVVGQQQ

SEQ ID NO: 168664 - protein, 242 aa, Glycine max
  Coding DNA Sequence Number=SeqID_51886
MDRHIDVALVKEFYSNLYDPEDKSPKQVRVRGRLIKFDAASLNAFLETPPVIQPGEQYLSYSIFCKSHTDPQELASKLCIPGRGFVLNAEGAPWKLLRKDLMTLAQTWSVLSYSNLAPTSHTSDLNMDRARLVYGLVMKMDMDLGFLISHQISQMAQSNSSRLGTREARARGSEGPSSDAPPALASSAPAPSRLQPLLLQHHHFLLLILIHQLPLLHHHHSSANALWSPFLCCRASTVAYAW

SEQ ID NO: 168665 - protein, 151 aa, Glycine max
  Coding DNA Sequence Number=SeqID_51887
GGEPDDMRRQIMVIPDTFSPFRHDRVRWHAKMVILRLLSSRGGEPDDMRRQIMVIPDTFSPFRHDRVRWHAETNYGHYAPFCHPEVVSPMTCGDKLWSFCTFCHPDTIVSDGTQRQIMVILRLSYPNFVRGPLLDDVRPFFGPREVLGTHH

SEQ ID NO: 168666 - protein, 81 aa, Glycine max
  Coding DNA Sequence Number=SeqID_51888
MSRRARRSLQNPGREPGRSGRRCRSWCLPTLETAQPEVGSSGWKSTARRVVSGAPPAALENPEDRVPPTPGRTHNRIRSPR

SEQ ID NO: 168667 - protein, 295 aa, Glycine max
  Coding DNA Sequence Number=SeqID_51889
  Gene Ontology: Mol. function=transferase activity; Biological process= biosynthetic process
  Homolog annotation: Hit_ID=Q0AJZ4; Match level="QueryCoverage=65%, HitCoverage=68%, E-value=5e-42, Identity=54%"; Hit description =Glycosyl transferase, group 1
MRRSAFRPADLRLVRNGVDTRRFRPASPHEAALAREQLLPAALRDRLVVGSQAGTAAYKNWLDMVAAVAMLPEAQRRQIAVLIAGQPPSAADLQRVDEMGMRDAVVFTDDLVCLPRNDGGRQARHRQRHGRAGRECRQRQQRLDRSGRRGGARGGDTGRCPGKPDSAGLDGGGGAAQGGQGFLAGDLRAWHRAGLRRKRARRAAAPGPGPRLEGARPAGSFAVGLGAVEVDRQQVQHRQAGHGVLGLLVDVGLQHVGIQHADVLAPRRRHVGESLVAVAAGGVEAQDEQLVGAVQ

SEQ ID NO: 168668 - protein, 228 aa, Glycine max
  Coding DNA Sequence Number=SeqID_51890
  Gene Ontology: Mol. function=transferase activity
  Homolog annotation: Hit_ID=Q2NQV3; Match level="QueryCoverage=51%, HitCoverage=37%, E-value=6e-15, Identity=38%"; Hit description =Putative lipopolysaccharide glycosyltransferase
MPVAAAQPAASPRAPTAPAGECELPDSTREAYAARQARGEVTRAQVRAQVEVWRASGMAQLSRARPLPDVYSERYRQHYAAYARMRNGPAYAQALCQELGNDRPLAKGLRMLYRHTRPPAQRHNAVLWPFVRVQRDPAGRLSGCALRGATGPGLLPLAMVARRITAAAHLILSGPSVARIDYDQCVLETVMGVNGSIALRQRHPGLRFDYYAMLDAGFVRRRRDLVAQ

SEQ ID NO: 168669 - protein, 133 aa, Glycine max
  Coding DNA Sequence Number=SeqID_51891
VDSRGSHRILGGVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 168670 - protein, 128 aa, Glycine max
  Coding DNA Sequence Number=SeqID_51892
  Homolog annotation: Hit_ID=Q1SN43; Match level="QueryCoverage=96%, HitCoverage=28%, E-value=1e-12, Identity=31%"; Hit description =Nucleic acid-binding, OB-fold, subgroup
MGIASNIGGFRTNHHPYKLTFQFNTKVILLDDGAIPNIVHDLVSISTIMDGGLDFDFLVERERKDGKKTKMNVIQLANERVRIEYTLFGKYELNAFLTYGEDKIHIQNCMICTKSIFNSQYELAMELT

SEQ ID NO: 168671 - protein, 195 aa, Glycine max
  Coding DNA Sequence Number=SeqID_51893
  Gene Ontology: Mol. function=integrase activity; Biological process =DNA integration
  Homolog annotation: Hit_ID=Q019M1; Match level="QueryCoverage=46%, HitCoverage=24%, E-value=1e-12, Identity=42%"; Hit description=[S] KOG2972 Uncharacterized conserved protein
  Pfam annotation: Domain name=DUF28; Domain location=51-190; Score= -75.1; E_value=3.7e-08; Accession=PF01709.11; Description=Domain of unknown function DUF28
  Subcellular localization annotation: CTP_CleavageSite=47; ConfidenceScore=5.21e-01
MRAVLQLQALTARLSLSPSNFVRRKSLWFDANRDNSQVRRIWPSTPVCMGRRSIKIAGRKGAQDAKKTKLYSRIGKEVVSAVKRGGPNVTSDSVLAAVLGKAKELDLPKDIVDRNIKRANEKGQEAYIEKAYKVGRGIFGETDRYGTEFQDGACTVELRPGQWAYLDHLLFLKNMTLIVLREKHKYSCVDTHLYK

SEQ ID NO: 168672 - protein, 267 aa, Glycine max
  Coding DNA Sequence Number=SeqID_51894
  Gene Ontology: Mol. function=integrase activity; Biological process =DNA integration
  Pfam annotation: Domain name=DUF28; Domain location=55-267; Score =62.5; E_value=1.5e-17; Accession=PF01709.11; Description=Domain of unknown function DUF28
MRMLRWMCGKTRQDKIRNEAIRERVGVAPIVEKMVENRLRWFGHVERRPVDSVVRRVDQMERRQTIRDRGRPKKTIREVIKKDLEINGLDRTTKKPSRFLDGVELGPAVWEWVYGYGGVSMVVEVSTDKVHRSVTKIREVIRDYGGKMADSGSVTFKFKRVRLVNIKATNADKDQLLAIALDAGAEDVIEPPTYEDDTEEDRSERYYKIVGSSENFSFIPSKLRDNSSELLPNTLVVVDDEAMDLNKELMSKLLELDDVDAVYTDQK

SEQ ID NO: 168673 - protein, 534 aa, Glycine max
  Coding DNA Sequence Number=SeqID_51895
  Gene Ontology: Mol. function=oxidoreductase activity, acting on single donors with incorporation of molecular oxygen, incorporation of two atoms of oxygen; Cellular component=chloroplast; Biological process=DNA integration
  Homolog annotation: Hit_ID=Q6Q623; Match level="QueryCoverage=97%, HitCoverage=94%, E-value=0.0, Identity=82%"; Hit description =Dioxygenase RAMOSUS1
  Pfam annotation: Domain name=RPE65; Domain location=45-533; Score =18.0; E_value=2e-17; Accession=PF03055.6; Description=Retinal pigment epithelial membrane protein
MLVPDMPHNNISLRNKGFIYKGQHGINLRDFTKANVASPSLPVIAPPTPEERKETTADDRHHHHHHVAWTSIPQERWEGELQVQGKIPLWLDYNFRHLFDGYATLVRLGFQNGRLVAGHRQIESEAYRAAKKNKKICYREFSEVPKAANFLAYVGELASLFSGASLTDNANTGVVKLGDGRVVCLTETQKGSIVINPETLETVGKFEYSDSLGGLIHSAHPIVTDNEFLTLLPDLVRAGYLVVRMEPGTNERRVIGRVNCRGGPAPGWVHSFPVTEHYVIVPEMPLRYCAQNLLKAEPTPLYKFEWHPESKAFMHAMCKTSGKIVASVEVPLFVTFHFINAYEEQDEDGRVTAIIADCCEHNSDTTILDRLRLQNLRSFNGEDVLPDARVGRFRIPLDGSPYGTLEAALEPNEHGRGMDMCSINPNYLGKKYRYAYACGAQRPCNFPNTLTKLDFELKKAKNWHEEGAVPSEPFFVARPGATEEDDGVVISIVSEKNGEGYALLLDGSTFEEIARAKFPYGLPYGLHGCWVPKE

SEQ ID NO: 168674 - protein, 140 aa, Glycine max
  Coding DNA Sequence Number=SeqID_51896
IAPIRRPVDPEKSNRALGFPALVTGLCSPTGSPVDPEKSNRALGFPALVTSLCRIAPARHPVDPKKSNRVLELSSSNYGSLSVLRRRNTTVAWGWPAAANRCTAITSRVHLISSTKKVCERQAIKRPAQDVKEALLEGNL

SEQ ID NO: 168675 - protein, 249 aa, Glycine max
  Coding DNA Sequence Number=SeqID_51897
  Homolog annotation: Hit_ID=Q947Y6; Match level="QueryCoverage=34%, HitCoverage=5%, E-value=6e-17, Identity=51%"; Hit description =Putative retroelement
MYANVSSSVGNMSSMWTWYQTYGLSAELGCLTAGYPATVLNISASLCFRGQRIFLHNASGWFGSVPLEASGDFGIHPEEGEFHLMCQSFFVRLRSGDWIWTDQPKTHLIRWSFAGKVVRVTTAVAAGKVAGKGERAIRGRAMSRNVHWNVKTGCRKTGDKHKGVGAVLMQGGRPIAYFSMALANYNSAKSVYEKELMALVLSIQHWRHYLIGRTFTVFTDQSSLKSLLQQRVASCDQQCWILKLLRLSF

SEQ ID NO: 168676 - protein, 285 aa, Glycine max
  Coding DNA Sequence Number=SeqID_51898
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=69%, HitCoverage=13%, E-value=1e-36, Identity=40%"; Hit description=Chromo
  Pfam annotation: Domain name=Chromo; Domain location=138-192; Score =41.0; E_value=4.1e-09; Accession=PF00385.14; Description='chromo' (CHRromatin Organisation MOdifier
MTPFEVVNGKKPRSVIQFIHVEMKVEAVAQELQDRDEALLQLKYNLAKAQEQMKRYADKRRKMQNLNIGDRVFLKLRPHRQQSVVLGKLGEVAYKLQLPPSSKVHPVFHVLQLKKAIGEYTTEAILPADLEEEHADIVEPEKVLANRIIMKNSFQVNQFLLQWKVMPMESATWEDEPNLRSQFPHFSLEDKTVLSGVGSDRVLNQDVGLDHDMGLDSKSKGWKTLHHWIQCMYWWKFHLLEEQETVARCSAEAECRAMALATCELIWIKQLLQELKFCEIQQMRL

SEQ ID NO: 168677 - protein, 149 aa, Glycine max
  Coding DNA Sequence Number=SeqID_51899
  Gene Ontology: Mol. function=DNA binding; Biological process=DNA integration
  Homolog annotation: Hit_ID=Q1SMW8; Match level="QueryCoverage=56%, HitCoverage=4%, E-value=6e-12, Identity=54%"; Hit description =Integrase, catalytic region; Zinc finger, CCHC-type; Peptidase aspartic, catalytic
MILAETKWILLFSEEKLEKIIIVQIYVDDIIFGATNASLCKDFSDLMKSEFKISMMGELVFFLGLQIKQDSKGLFSNRYQFVGKMILVATYAMTGRRRQNRKAKASISKGENERSHHQRYSRKTLEKPKMRSTNFENKGSGVVYAWGKY

SEQ ID NO: 168678 - protein, 221 aa, Glycine max
  Coding DNA Sequence Number=SeqID_51900
  Homolog annotation: Hit_ID=Q1S077; Match level="QueryCoverage=50%, HitCoverage=30%, E-value=7e-16, Identity=56%"; Hit description =Asp/Glu racemase
MTSSWEGGPCGSSMVFGFCLEIKLWKPETASLFMEFSILVKSWDIDLFQQLAKNFFPNKEQIKFHVFGSCMKNMVVSKRHSAHVVPMNNRNNIAQKEEIEARILQQFGPKKTQAPDVDLLSFGSAAAQSASQKAVMEKGAEAGKGYNSTVECHLDVVEVISSSLIIPKPNELTPVKYEVPGYKFCLGMEDNSESALSTNKEAISNATRNLMESSILAQNEH

SEQ ID NO: 168679 - protein, 63 aa, Glycine max
  Coding DNA Sequence Number=SeqID_51901
MTLDRRLQEDWAKDAREESKSIDETLINDDWIIAMEEELHQFTKNDHCTLVFKPGNKRNIGIR

SEQ ID NO: 168680 - protein, 275 aa, Glycine max
  Coding DNA Sequence Number=SeqID_51902
  Gene Ontology: Mol. function=RNA-directed DNA polymerase activity; Cellular component=membrane; Biological process=RNA-dependent DNA replication
MWLQEAVRVHIVNIYSPCDIQNKRLLWDSFKQLKSPTSGGLWCIVGDFNSIRQPTERMGVCHRAVEDGTSREFNDWIAELEVEEAPWVGRKFTWFRPNGTAKSKLDRFLLSPEWFSKWSGTAQYTLDRNFSDHCPLLLRSKCVDWGPKPFRILDCWLTDSSFREIVHQSWSSNQQSGWGGFILKEKIKRLKANIKNWNRDHFGDTLNKYKKIEEDLNKLDEDTIDRPLEPQEVVSRKKLQEELWVAAQSHESLLRQKARSRWIRKGVVIPDTSTC

SEQ ID NO: 168681 - protein, 81 aa, Glycine max
  Coding DNA Sequence Number=SeqID_51903
  Gene Ontology: Cellular component=integral to membrane
  Homolog annotation: Hit_ID=Q402F2; Match level="QueryCoverage=79%, HitCoverage=25%, E-value=2e-14, Identity=52%"; Hit description =Tobamovirus multiplication 1 homolog
MGSEGVPSMVVEVMSMATVELTDASSWWHEIDDSPAWQDRISYTLVVLYGIVATVALVQLAWIQLRVVFHLINILVNGVTA

SEQ ID NO: 168682 - protein, 123 aa, Glycine max
  Coding DNA Sequence Number=SeqID_51904
  Gene Ontology: Mol. function=oxidoreductase activity; Cellular component=cellulose and pectin-containing cell wall; Biological process=lignin catabolic process
  Homolog annotation: Hit_ID=Q655H5; Match level="QueryCoverage=82%, HitCoverage=16%, E-value=2e-35, Identity=83%"; Hit description =Putative PS60
  Pfam annotation: Domain name=Cu-oxidase_3; Domain location=32-118; Score=8.1; E_value=2.1e-06; Accession=PF07732.5; Description =Multicopper oxidase
MGCSIRECCVLFLVLLVSCARGEDPYRFYTWNVTYGDIYPLGVKQQGILINWQFPGPQIEAVTNDNLIINVYNSLDEPFLLSWLVSFSDFLLVQFTLKEWSSAEEKLMAGWSVWYQLSNSTRA

SEQ ID NO: 168683 - protein, 154 aa, Glycine max
  Coding DNA Sequence Number=SeqID_51905
LWGRNSELKLRREERDQSRAHSMVLKEELAACSRYKRNLSQRLCKTETNMLAIVSKYQEELNLAMAHEHKVADEYAQVYAEKEARGRVIDSLHQEATIWMDRFALTLNESQELPRLLAKAKAMADTYSTPEEIHGLLSYCQHMIDLMALIIRNR

SEQ ID NO: 168684 - protein, 290 aa, Glycine max
  Coding DNA Sequence Number=SeqID_51906
  Gene Ontology: Cellular component=integral to membrane
  Homolog annotation: Hit_ID=Q8L4G8; Match level="QueryCoverage=79%, HitCoverage=35%, E-value=6e-33, Identity=36%"; Hit description=C4 -dicarboxylate transporter-like protein
  Pfam annotation: Domain name=C4dic_mal_tran; Domain location=46-289; Score=142.2; E_value=1.4e-39; Accession=PF03595.8; Description=C4 -dicarboxylate transportermalic acid transport protein
MGDNEKQHPQPHVELPIDVSLTKTQSNCKPQIQIQCLSCILTQFHAGYFRISLSLSSQAFLLKILIEPIQDAFALRRLFSSIPSSVHTLLWFLALFTLASLSFLYILKCLFHFDMIKEEFLNHVGVNYLFIPWISWLLLLESSPFLSPATLYYKVLWWVFVAPLVMLDVEIYGQWFTKGKGFLSIGANPTSQLSVIGNLVGAQAAAQMGWKESALCMFCLGSTHYLVLFVTLYQRLAGNNSVPSMLRPVFLSFAAPSMASLAWNSICGRFDTTCKMLFFLSLFLFMSLVI

SEQ ID NO: 168685 - protein, 63 aa, Glycine max
  Coding DNA Sequence Number=SeqID_51907
MKNYIKDENDEWKEWVIIVFEDARGGEVSEVIEGEVKVGEVAGFATDGDDDGESCNEDEDNKG

SEQ ID NO: 168686 - protein, 359 aa, Glycine max
  Coding DNA Sequence Number=SeqID_51908
  Gene Ontology: Mol. function=RNA-directed DNA polymerase activity; Biological process=RNA-dependent DNA replication
  Homolog annotation: Hit_ID=Q1RXD8; Match level="QueryCoverage=47%, HitCoverage=20%, E-value=6e-41, Identity=50%"; Hit description=RNA -directed DNA polymerase
FQEPDFARPRLDGSTFKTIHSLQNDMLVGRFQEDEVKKGSNASFIALIPKVADPLMLKDYRPISLIGCMYKIVAKILANRLKKVLHNLIDESQSAFIEGRHMLHSVVTANEVVDEAKRKNKPCIVFKVDYEKAYDSVSWDFLLYMLRRMGFCSRWIHWIEECLKSTSVSVLVNGSFNDARGDIIISHDYITVNSASAAFDLYMRVQTSYPDDFHHKTKDYNIARAIPFTIDGVELDLRMRGFEFFSLVSAYAMDSLRPLLLKASGRIKFQGKVLKPNGIISEQNFEMTRQHVQMLEKGIADSLFGEVSISGLKLNQLMLAPQLSGLLRLSPGRIKNVANWAYCFPYLWTMLPFETFADN

SEQ ID NO: 168687 - protein, 160 aa, Glycine max
  Coding DNA Sequence Number=SeqID_51909
MGYKERLRECNRAWVGKGPSHKQMGNGVQDVKLLDQQLADLVIGGLKFHLNILKHGRCNVRRARTREKQCGRSGTHQKRRDTQHRGCRNGEPNAQRVSGAQASDINNIPLVTVAKHTHGTAETLQYHLVWGAEELVCFRQIRRRVHLGSMTGVEDKVPWG

SEQ ID NO: 168688 - protein, 297 aa, Glycine max
  Coding DNA Sequence Number=SeqID_51910
  Homolog annotation: Hit_ID=Q1RVN3; Match level="QueryCoverage=54%, HitCoverage=24%, E-value=2e-08, Identity=27%"; Hit description =Nucleotide-binding, alpha-beta plait
  Pfam annotation: Domain name=RRM_1; Domain location=101-171; Score =18.8; E_value=0.0026; Accession=PF00076.12; Description=RNA recognition motif. (a.k.a. RRM, R
RKSLGEVISVLVEGWNINHLQQLAEQFLSDKEQIKFHVFVLAWRVGEQDCEQEIQCSWRGRQREEVRTRVDPRTNYVNTRLGQHQRYQHANWRERADITTFYFTRFPEHTTEKDLWTQFKKWGDVREIFISKHRNKGGRRYDFVRFKGVSDKRRLERQLNNIIVGGLKMYVNVPKYGRGKERHEEHNVKPRTQADGYNTEVEASGQTIKHHRAASMTCESDPDGGEEMVHKCMDRLKKPGIFERVKDEHPWEIGTNVVPKYIGDDMILLLGLSDTKAEELITKETKHDTSPFHLLEK

SEQ ID NO: 168689 - protein, 222 aa, Glycine max
  Coding DNA Sequence Number=SeqID_51911
MHKALWANAPLPYPQLVTLFLRHFQIPLDDEPFVQVKRSFAIGAGAVTSFGYRKDRNGQWLKKDALPPQDERTPSPPPQRDDSFTLLTEVLSKLRGLCTYVGERFDSLDGCFEGMDTRITQLEEDELNCYHQKGGDCRSKDFAFDVLMMPYDREVLMPYKNAFLKFNSRQKSKNTRYNIKKISSVLGREFQIQTAKGLAKKFKQKCLFQEIYSLVIDYQWPK

SEQ ID NO: 168690 - protein, 148 aa, Glycine max
  Coding DNA Sequence Number=SeqID_51912
  Homolog annotation: Hit_ID=Q00M75; Match level="QueryCoverage=24%, HitCoverage=6%, E-value=4e-10, Identity=86%"; Hit description=PPR -repeat containing protein
MLYAALPLHMQRGCFRIRTHDQQVTKAQLYRRTRARPRVLQHTCIPKSSKHHNSLISSPDRLPQLPILFFFDSLLIPPIEILKNKTAWQNRPRNERDLPPPLRQQELNVAEPPKHPRHQFHPPCHLQHYSLLTNSVTGTPLLFISTNS

SEQ ID NO: 168691 - protein, 196 aa, Glycine max
  Coding DNA Sequence Number=SeqID_51913
MVGAFSQNIVTLTGLPMILLSESDLTNPLCDVSCYVLLSAPGWFFTDMRVSHKTLRSNAPLPYPQWVTLFLRHFNVPLESEPFIQVKHSYAIGVGVVTSFGYCRDKDGQWLKKDAQPQQEECTPSPLPQRDDSSALMHEVLSELRGLCTYVGERFDSLDSRLNAIDARFAGMDNRITQLEDDMSFIRRFFDPLADS

SEQ ID NO: 168692 - protein, 242 aa, Glycine max
  Coding DNA Sequence Number=SeqID_51914
  Homolog annotation: Hit_ID=Q1S7C5; Match level="QueryCoverage=20%, HitCoverage=4%, E-value=6e-12, Identity=70%"; Hit description =Integrase, catalytic region
MEIDVFSVREKILAKQLSIVHIPTLDQWADVLTKFLSATRFEVLRDKLNVKRSLAFANNTSLVLDSRLCALYGLLALLIVPHCSVVALKNLDGSQRRPVVATKGGSSNVMLTGDASRAMCVNLSRWKRALRGAIVAMCRVGCDCGRHGVLERSLKQTDKRAVNWLPNRPNSGRGYCSPGKKVAHRQVSVTGEVTVVDSGRKRRKVHQKAEASRQDKCNDHKGPLRKVGPWWGTIFVIPSTLF

SEQ ID NO: 168693 - protein, 57 aa, Glycine max
  Coding DNA Sequence Number=SeqID_51915
  Gene Ontology: Mol. function=RNA-directed DNA polymerase activity
  Homolog annotation: Hit_ID=Q1T4S3; Match level="QueryCoverage=79%, HitCoverage=2%, E-value=6e-14, Identity=80%"; Hit description=Zinc finger, CCHC-type
MLMVPSTGSEQDRSLVCKLNKALYGLKQAPRQWFDRLKSTLLQFGFVGSKCDSSLFI

SEQ ID NO: 168694 - protein, 510 aa, Glycine max
  Coding DNA Sequence Number=SeqID_51916
  Homolog annotation: Hit_ID=Q016Y8; Match level="QueryCoverage=87%, HitCoverage=18%, E-value=3e-28, Identity=30%"; Hit description =Homology to unknown gene
MGVKVDRMTPLITIEKTVLQQNYSCYELQGEYVLPGTRDRNPVDKEGGLIKRLMSGHIGNAISSMGRWRMKLEVRRAEVAEMLPLARLLSRSMDPAVRSRSKVVSLSLFMSWEPTFYNPPLAPYNKSPHPNALLSGWKTVRGLHAPSNDVVLDDLSLPGLSELKGHWHGSLDASGGGNGDTLAEFDFHGEDWEWGDYKTQHVLAVGAYSNDDGMHLERIFIQKDNATIHADGTLLGPKTNLHFAVLNFPVSLVPTVVQIIESTAMDVVHSLRQLLAPIKGILHMEGDLRGSLAKPECDVQVRLLDGSIGGVDLGRAEVVASLTSTSRFLFNAKFEPITQNGHVLIQGSIPVAFVQNNTLQEDVELDKSQVTWVPDWVKEKNRGTVDDASDKKVSRDRNEEGWNTQLAESLKGLNWQILDVGEVRIDADIKDGGMTLVTALSPHANWLHGNADLKLEVRGTVDQPVLNGHASFHRASISSPVLRKPLTNFGGNVHVQSNRLCITSLESRIS

SEQ ID NO: 168695 - protein, 67 aa, Glycine max
  Coding DNA Sequence Number=SeqID_51917
MQRESQFEPFDVEMGDCLEDMICDLGQESFQQAHGPMYDTLQSDSKNPLYPRCKKSLMLLSVDAKSS

SEQ ID NO: 168696 - protein, 257 aa, Glycine max
  Coding DNA Sequence Number=SeqID_51918
MRASPGAAAAYNIPPPYLRIAKSLWAMGNRVRKTERQSGFPQGSAIDTRRKQGGAVSDVHKLARQLDQIVIGGLKLYVNIPKYGRDTTRMEMALPEPTRHDVKRQHTARHWGQHNGLNSLISYAEVVARDKHTGGQAKGIVNENHNRPASHSSLTIDIPLNDKKWFSEAWVGRMKNLIWFDKLEEDPLWDFGADITPKYLGDDMVLLLGLSDDRAERMMQEVEANLGPMLGHSTYSMGEEIFPADRGGNGGCGGCRQ

SEQ ID NO: 168697 - protein, 111 aa, Glycine max
  Coding DNA Sequence Number=SeqID_51919
  Gene Ontology: Mol. function=two-component response regulator activity; Cellular component=membrane; Biological process=negative regulation of ethylene mediated signaling pathway
  Homolog annotation: Hit_ID=Q9ZTP3; Match level="QueryCoverage=91%, HitCoverage=14%, E-value=6e-24, Identity=54%"; Hit description =Putative ethylene receptor
MMQGNIWISPNTLGLVQGMTLLKFQIRPSLEKSIFAPKDYSSSQFRGLKVVLAKDDGINRTVTKKLLEKLGFHVIVVSSGFECLSAISGAGNSFRIILLDLHVTPFTPTYI

SEQ ID NO: 168698 - protein, 264 aa, Glycine max
  Coding DNA Sequence Number=SeqID_51920
  Homolog annotation: Hit_ID=Q016Y8; Match level="QueryCoverage=85%, HitCoverage=11%, E-value=3e-53, Identity=47%"; Hit description =Homology to unknown gene
MEQIQIKPNVEIRLNDLKLVLGPELKIVYPLILNFGVSGELELNGQAHPKWIKPRGILSFENGEVDLVATQVRLKREHLNIAKFEPECGLDPMLDLALVGSEWQFRIQGRASNWLGKLEMTSTRSVEQDALSPAEAAQRFESQLAESILKDNGQLAFEKLATATLEKLMPRIEGKGEFGQARWRLVYAPQIPSLVSVDPTADPLKSLASNISFGTEVEVQLGKRLQESHEDSPNGGFNPFYVSLTFGNSIGAVGGETEGILGNR

SEQ ID NO: 168699 - protein, 91 aa, Glycine max
  Coding DNA Sequence Number=SeqID_51921
MWEGYCTQPYPCICKEAVSGFEPMTNKSPRHQVHVYITRQARVARPISRLLLTENEVAQVNLMQVNPGMWQNIQKEGVWMEQIVGALANDL

SEQ ID NO: 168700 - protein, 538 aa, Glycine max
  Coding DNA Sequence Number=SeqID_51922
  Gene Ontology: Mol. function=nucleic acid binding; Cellular component= beta-galactosidase complex; Biological process=DNA integration
  Homolog annotation: Hit_ID=Q1SRN1; Match level="QueryCoverage=59%, HitCoverage=25%, E-value=4e-56, Identity=38%"; Hit description =Integrase, catalytic region
MEKGINIDYKINQLLINRAGRSCSAYCPLSPVVSGHCRRSPPFFPVIAGFGASHQAWPSPEESELRHDTMVRVVGLFQSSFSLQIIISLLFKNQGPWIIDSGASDHISGNASLFSSMSSPKFPRLITLANGAKVASKVVGQISLSPSPNLESVVFVPNCPFNLIPLSQLSKTLLPRNQFFCVLKKLFAEVPARSQSTGTTSTHEVSSTSGTNSTNEVSSSASSPEPAATTLPTSVQSIAESPPLLVRPDNTHSMCTRKKAGIVKQRLQPTLLLTHVAPKSTKSALSNPTWHAAKKAEYDALLLNNTWTLVDLLSSRSTIEFLTLTVTNKWKLQQLDVNNAFLNGILEEEVYMTQPPGFEDSNKHLVCKLNKAPRFDTTTVEYMLVYVDDIIIRGNNHTFIKSLVSKLNSEFSLKDLGDLDYFLGIEVSSQPNGSLLLTQSKYIRDLLAKITMDEPNFSVSLTILFMPIVMLTGHQILMIEGPHQTTDEVTWIQSLLAELKVPHAPPVIGKHIQVVHVRAADQRADILTIALTPSNFTA

SEQ ID NO: 168701 - protein, 161 aa, Glycine max
  Coding DNA Sequence Number=SeqID_51923
  Gene Ontology: Mol. function=nucleic acid binding; Biological process= DNA integration
  Homolog annotation: Hit_ID=Q1S7C5; Match level="QueryCoverage=91%, HitCoverage=13%, E-value=2e-25, Identity=38%"; Hit description =Integrase, catalytic region
MASTPSNFISQLFPNSIAEKLDDLNYLHWRQHVEPVIKLHKLQRFVINPIVLPRYLMEDDRIADRVNPEYEAWEVQDQTLLVWLQSTLSKSVLFLGEVHEYFSLHTKSRARQFRTMMRAVTLDGKSINEYLRKIKGYVDELAGVGVPVRHEEYVDALLEGL

SEQ ID NO: 168702 - protein, 99 aa, Glycine max
  Coding DNA Sequence Number=SeqID_51924
MVLTISLACCHVASKVMRTRLEEGPREEMWRAEAEVDEEKRKKAYRKQLRRGDRPLRRWLADLGGGLDWRKWKCVAETNAIGTVAVGADEATLVKRLLQ

SEQ ID NO: 168703 - protein, 80 aa, Glycine max
  Coding DNA Sequence Number=SeqID_51925
MNKDKTRVRTIDIVVSVIKASEKSKKKMKCDSNKGKDLNVGSEAIGKRKSDEVEKDWEEECLVKCVSLIMLKNESSTGKV

SEQ ID NO: 168704 - protein, 111 aa, Glycine max
  Coding DNA Sequence Number=SeqID_51926
MEWFYKISHPLMSLPQLGEPPRHQPMVHDDTYIIVDPLVLPVHTTTMPQPPALAAIDANMPQHAMAAYQKMAKSLEHMINMRIVTIGTDAYTLTEHYLGLAIYWRHETTIS

SEQ ID NO: 168705 - protein, 141 aa, Glycine max
  Coding DNA Sequence Number=SeqID_51927
MNSHKAYLVLMALELTCIGIKYGVSDNTNPFQHSTPTILLFLTAMISHVLASTADMTHQTTTLTFHVSGVVGCQTLLWIIVAQVMWYYVINLLLLLVASFRFFNYVTQLLSATPSNANDLMSNTELQSQEAQDSGLHSLWQ

SEQ ID NO: 168706 - protein, 87 aa, Glycine max
  Coding DNA Sequence Number=SeqID_51928
MVGAFSQNIVTLTGLPMILLSESDLTNPWCDVSCYVLLSTPGNVITHSLCVVVFESCDDLELVFGGADEYVDDYEEPHARGHGNTTL

SEQ ID NO: 168707 - protein, 93 aa, Glycine max
  Coding DNA Sequence Number=SeqID_51929
MVKAVKTRCGDSDDNNGEMVVVMMITMVGLDNDKSSENNDGGNKCGATTTVCDGSGSSDGEGSVVTTTEVVMRVGVDVVVVVVVTMVVLECIF

SEQ ID NO: 168708 - protein, 63 aa, Glycine max
  Coding DNA Sequence Number=SeqID_51930
  Gene Ontology: Mol. function=DNA binding; Cellular component=nucleus
  Homolog annotation: Hit_ID=Q0PJI6; Match level="QueryCoverage=82%, HitCoverage=16%, E-value=6e-16, Identity=67%"; Hit description=MYB transcription factor MYB133
MTNIAIKDSMNDDLGFTIAGQTAPLNCCCNSTNERTPPTRPSSKRINQGDQKPIKGAGKTCNL

SEQ ID NO: 168709 - protein, 170 aa, Glycine max
  Coding DNA Sequence Number=SeqID_51931
  Gene Ontology: Mol. function=nucleic acid binding; Biological process= DNA integration
  Homolog annotation: Hit_ID=Q1SKA8; Match level="QueryCoverage=64%, HitCoverage=44%, E-value=2e-11, Identity=32%"; Hit description=Zinc finger, CCHC-type
  Pfam annotation: Domain name=zf-CCHC; Domain location=94-111; Score =28.4; E_value=2e-05; Accession=PF00098.13; Description=Zinc knuckle
MSLATLFGKLQEHEMELIRLNQHEENDKKKKGIALKASSSTQEGSDKEDSIELDKDDDLSLCVKRFNKFFRVRGNQRRSNFKSKKRTEDSSSTPRCYECNQPGHLRVDCPMFKKRIEKSEKKKKVLNEKKAYITWDDNDIDSSEESENEAVNLSLMAKNYESDEEKKSKI

SEQ ID NO: 168710 - protein, 135 aa, Glycine max
  Coding DNA Sequence Number=SeqID_51932
  Subcellular localization annotation: CTP_CleavageSite=73; ConfidenceScore=5.29e-01
MHPAILLGHPANSEWTILPFCEGCFRKTSLRKTSGKTFFRKKNVRFRKNSRICSGRTCSGIFPKEGSSGRPPSSSGRSYCAAFSFYTLPFHLHPRLLAIAILFRKKLFWWSREVVVPYLKIWWSREAVVPYLKLC

SEQ ID NO: 168711 - protein, 616 aa, Glycine max
  Coding DNA Sequence Number=SeqID_51933
  Gene Ontology: Mol. function=sequence-specific DNA binding; Cellular component=nucleus; Biological process=regulation of transcription
  Homolog annotation: Hit_ID=Q2HT21; Match level="QueryCoverage=91%, HitCoverage=88%, E-value=1e-125, Identity=49%"; Hit description=DNA -binding WRKY
  Pfam annotation: Domain name=WRKY; Domain location=355-415; Score =142.7; E_value=1e-39; Accession=PF03106.6; Description=WRKY DNA -binding domain
MDSDPIGSFFLHKPIVLNSFSAEDTNNHNPEWKKLSLHNNNMDATVTTKDYTIPFRINLSCSSADNHDDVSSPTSLRSRTEMDFFSNKNSTKDDDNNIVAAAGSASLPDNDHHSISPPTLDLKVNTCLNLLTTNASSDQSMVEDEISPNSEDKETKKEMADLQGDLERIKRENQKLRDTLDEVNTNYNALQMHFMNMMQERKGEEGEDQQEVSDGKVKEKKQGQSGGGVLVSRQFMDLGLASADIEPSSSSGGIRSQDRSGSPNIDVASKGLGTSNNDGNNSVNDEEEKEYDRGIESEDSPSGHADKVPRFSSPSKNNNVDQAEAEATMRKARVSVRARSEAPMLMEKFFTLAQITDGCQWRKYGQKMAKGNPCPRAYYRCTMAAGCPVRKQVQRCAEDRTVLITTYEGNHNHPLPPTAMAMAQTTSSAARMLLSGSMSSADSIMNADFLTRTLLPCSSSMATISASAPFPTVTLDLTHSPNPLQFPRQQHPNQLQIGVPQNFANSPSSLMPQIFGQALYNQSKFSGLQMSSHDTADPSSQFGYQPHQVPPHLADTVGAAIATDPNFTSALAAAITSIIGGAQQQHSNINNNSNNNVNMTANINNGNGNSNGNGKQ

SEQ ID NO: 168712 - protein, 313 aa, Glycine max
  Coding DNA Sequence Number=SeqID_51934
  Gene Ontology: Mol. function=RNA-directed DNA polymerase activity; Cellular component=chromatin; Biological process=chromatin assembly or disassembly
  Pfam annotation: Domain name=RVP_2; Domain location=187-311; Score= -25.8; E_value=0.0001; Accession=PF08284.2; Description=Retroviral aspartyl protease
  Pfam module annotation: Pfam domain module=RVP_2::Retrotrans_gag; Domain location=187-311::1-98
MVASFYLDGPALSWFQWMFRNGVITSWPALLQAIESRFAPSIYDDPHGALFKLIQQALARLQEDKINDHRKHIRSLFGHPPPNNPTPSNPHTTQTARPKPPFLQRTQEDMAYRREIGLCYNCDEKWSSSHRCKGRVLFFITESDESPPSEMITVEPSNPSVTEPDPIIDDPSQLFDPTSLQPYISLHAMAGVPATDTFRLYGLINNTRVTILVDSGSTHKFVHPGVAKFLNLPMQDMMPLRVMVGNGSILDCRQLCPDTKILIQDHTFVVTLRVLPLSGADVVLGVEWLRMLGPVVTDYTAFTMQFTFFGRPI

SEQ ID NO: 168713 - protein, 396 aa, Glycine max
  Coding DNA Sequence Number=SeqID_51935
  Homolog annotation: Hit_ID=Q8LDC7; Match level="QueryCoverage=33%, HitCoverage=63%, E-value=5e-53, Identity=71%"; Hit description =Putative carboxymethylenebutenolidase
  Pfam annotation: Domain name=DLH; Domain location=259-396; Score =46.7; E_value=7.8e-11; Accession=PF01738.9; Description=Dienelactone hydrolase family
METYIRLKRSWVEKLAGIIYDWVGFGHGRAYFAPVGHVFLGSLEERGFRSSCLGSVRVRGGGVLRYCTLLNQLEQSSVWVIVDRGGEARFDCLEESWPRSDNSVPEHPLKPAECRTIKVEGSYHDTILFWSSLVVERLGDFEDPSKRVMTVKTRNVKLDWWPRDLRRWWRSGRHVRETLAHGLKLVGQVRMFLGEGSNGLLEAICGGAAGSMLCHGKGQVRPVVESKPFIYNCARTAMVFGLCGIPLWPFFMCFFWCQRDVFHVLSTVGAIRIVVIQEWWGVDFEIKNHAVMISQLGRGYKALIPDLYKGKVGLDVAEAQHLFDGLDWQGAVGVTGFCMGGALSVASSVLVPNVDAAVAFYGAPSSELADPAQAKAPIQAHFGELDNFVGFSDVTV

SEQ ID NO: 168714 - protein, 121 aa, Glycine max
  Coding DNA Sequence Number=SeqID_51936
MTNVLWWESMRWVRVVGPLSINPIHHLYQFCEGFGSNVNYSSRCGWWIALTISIWQHRNQLIFQGKPFDPCKVMDHAIYLAWSWVALWCLVILLFGTSGDLMMAQVGGPNIVVMSYLAAIL

SEQ ID NO: 168715 - protein, 102 aa, Glycine max
  Coding DNA Sequence Number=SeqID_51937
  Homolog annotation: Hit_ID=Q2PMM5; Match level="QueryCoverage=26%, HitCoverage=1%, E-value=7e-09, Identity=92%"; Hit description =Protein ycf2
MESIPNIYTMVPYLDRVQISKFHIFRVLPNWFFPFPEVIATTYDHYNSRQTCGRDRGHSRDHGGGHDGDYGHMETTHLDVVDFFVEPDGNIDHLIGDGSVNK

SEQ ID NO: 168716 - protein, 86 aa, Glycine max
  Coding DNA Sequence Number=SeqID_51938
  Gene Ontology: Mol. function=metal ion binding; Cellular component =integral to membrane; Biological process=ubiquitin cycle
  Homolog annotation: Hit_ID=Q5VRD4; Match level="QueryCoverage=80%, HitCoverage=17%, E-value=6e-21, Identity=60%"; Hit description=ATP synthetase alpha chain-like
  Pfam annotation: Domain name=zf-C3HC4; Domain location=11-51; Score =40.4; E_value=6e-09; Accession=PF00097.15; Description=Zinc finger, C3HC4 type (RING finger)
MTSECCCRQVCCICLAKYENNDELRELPCSHLFHKDCVDKWLKINALCPLCKSDVGENLTGSVSGEDASQQQGESRVENGLTNTSV

SEQ ID NO: 168717 - protein, 892 aa, Glycine max
  Coding DNA Sequence Number=SeqID_51939
  Gene Ontology: Mol. function=RNA-directed DNA polymerase activity; Biological process=RNA-dependent DNA replication
VDSTSSEFSWICIPLIGAPEYTCILKHMAKQDMGGKIEEAHITNAAQIAVEVNAQRSAIFYSLEKWSPQLKTGHRLVDDDMDELHRLDRGRILVKTSRPPLIQHKVGLWINGVEYNEITSVDSDSEAGTQMTSGDVFSDTEMSSEDHRPRMVGCEKDQGDTMIQQTEGQHQPVSPQVNNQRSLLTTNEWAILQTCNGQRGTDRSNLRSDKSKIIQAQGTAEVSNRTPNSQLGKEDKANEDKKEEEVLKEGGMVAAEIPERELSRESQNCKEDNGKKDKTNEDKKEEEMLKEGGKMAAEIPETELSWESQNCKEDSGKKGVQKEISIMNRQAEDMWERCTQEVKGVERNWTKEKAVLTTPDQAQPATQAPLQKDSHQTCDQLMEASTQWEMTQNLGVTCEGRDATIITKFMKMEVRDKEDADKLGSRRFKEIGQQHIVRLLGPFTEKEIKDAIWECGSDKTPGPYGINFRFIKEFWEVLKVDVLRFMDEFYVHGSFPKGCNAFFITLVPKVKDPQNLHKFRPISLIGCIYKMVSKVLARRWVTWIEGCLKSASISILVNGSPTPEFIPQRGLRQGDPLSPFLFNILVEGPNALVKEAMDKNLFQGFNVGRNEVKVSILQYADDTLFLGKVSMENVKAIKVILRSFELASGFKINFSKSRFGVIGMSDSWEASTASYLNCELVDIPFLYLGIPIGSYPRGSELWDPIVKKWAEHKKIAWVKCESVCLPKDKGGIGIKDLRKFNHALLGKWKWNLFHNQGDLWARILNSKYGVCGNLEGVRRGGRVSAWWKDINNILFDDIGWEWDFKWRRQFFDTELDLAVRFLEDLEGTNIHSERLDKWIWKEDGSGLYTARNRYRLLLSDQINDNQDGAFIELWKVKVPMLVDFPDMEYLAT

SEQ ID NO: 168718 - protein, 137 aa, Glycine max
  Coding DNA Sequence Number=SeqID_51940
MLRSFELVSGLKINFAKSRFGAIGATEQCILDAATVPKKVVDRLVGLQRRKGAWVSGIWESLTLLYSGNGAGTYFTITGSWGHKFWNQSIGVGGIWMRQGGPSKNLSGGGILVLFGICLRRGAGLKNQILASWVPSG

SEQ ID NO: 168719 - protein, 110 aa, Glycine max
  Coding DNA Sequence Number=SeqID_51941
MSQNRGATSESINALPIYKFKMKKNKRNGNGNSAAAEGGVVAAGTEKEHVISGEDAEDSHDLMAFDRGKVDLDEEEESLCRRTFSPLPERPTWTEMGMMKESEGERERGQ

SEQ ID NO: 168720 - protein, 257 aa, Glycine max
  Coding DNA Sequence Number=SeqID_51942
  Gene Ontology: Mol. function=metal ion binding
  Homolog annotation: Hit_ID=Q84PB2; Match level="QueryCoverage=46%, HitCoverage=55%, E-value=1e-24, Identity=51%"; Hit description =Putative ATP synthetase alpha chain
MDVIVVSLNLCLEGSSGTLPLLMERSGSLNSSQHVIEIAGSADASTSSASHHDRHFNGTNVTQHEERISGARMPLSQPSVSATSVSNGSNSRNSSFIRRGDTRRNRSPVHSGLWISIELVLLLSQIVASIIVLSLSRHEHPRTPLFQWIIGYASGCAATLPLLYWRYYHHNHMQEQESSQSRQTSPRINDPSGTLLFSSRTNGGEDGQSAVASSRSNQPSLLMNRSSVVNSSQELNISLTVVENWFQSLGCNQKFEN

SEQ ID NO: 168721 - protein, 85 aa, Glycine max
  Coding DNA Sequence Number=SeqID_51943
MGMARNAILGETGGMHHASDIISFYFTRFPEDMNETELWYVFKKWGDVREVFIARNRNKWGKRYGFVRFKGVKDATTLERNLDSL

SEQ ID NO: 168722 - protein, 82 aa, Glycine max
  Coding DNA Sequence Number=SeqID_51944
MVTYQGLRDTEYALSYFNSPDVLPRCKRKKIDRKKSTFIERAQDVAYYTLGSGRCAAHFVDALKVKVWRKESEMKFAGKRRV

SEQ ID NO: 168723 - protein, 56 aa, Glycine max
  Coding DNA Sequence Number=SeqID_51945
MTMMLTPTKVTLKPTPITNDMAKRDASDVVLVRLAHVMEVHDPGTRWLSIHPKEIK

SEQ ID NO: 168724 - protein, 361 aa, Glycine max
  Coding DNA Sequence Number=SeqID_51946
  Gene Ontology: Mol. function=RNA-directed DNA polymerase activity; Cellular component=intracellular; Biological process=RNA-dependent DNA replication
MAKEDQDVDDNANLVYPCGPHEELNNMKIQEFLNNSVSIACYNFDHPMYQADEGDDDLETPLELKRLEVKVGIVIKEDIKDQLLKLLSSYIDIFAWSYQDMPRLDPSIVEQRLPLKPECPPVKQKLRRMKPEVSLKVKEEVKKQLDVGFLEVENIVHVPKKDEKVRMCVDYCDLNKVSLMDDFPLPHIDMLLFDHLRKYKLQLNSAKCTFGVKSSKLLGLKVSEKDIEVDPDKVQAILEMPTPSIEKKVHGFLGRLKYIVRFISHLTATWFARRLKQYMLSHTTWSPKWIQSKEDIMALFEYGEPGDGEKWIMLFDGIPMNWEYKACVMGVRATIEFKARILEVFGDLTSVIHQLKGEWEV

SEQ ID NO: 168725 - protein, 142 aa, Glycine max
  Coding DNA Sequence Number=SeqID_51947
MTKEPTTPALEETQPSSVLDLNEDQPQEEQDESIIHRRWFKANLYQIWGRYYQGMKAKYLRKKGKYGEGMNEKVKVILWMNALLEPKLLNPRKTMNCWQPNPITSLESSSDSFLCVHFCMIGDEMQRLELVLVVYDGISLNT

SEQ ID NO: 168726 - protein, 99 aa, Glycine max
  Coding DNA Sequence Number=SeqID_51948
  Homolog annotation: Hit_ID=Q94FN3; Match level="QueryCoverage=45%, HitCoverage=8%, E-value=2e-12, Identity=71%"; Hit description =Phosphatidylinositol transfer-like protein II
MEEGVWCRHHHGDFGFKEIDEVLQYYPQGHHRVDKDGRPMYIERLGLLVESLRGVKDILVIVPTRTVSVVHDVLLISKSQIGDFYTIFSALSFGSNKNW

SEQ ID NO: 168727 - protein, 83 aa, Glycine max
  Coding DNA Sequence Number=SeqID_51949
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=87%, HitCoverage=10%, E-value=1e-09, Identity=54%"; Hit description =Cellulose synthase
MSRITPMNAGFCAFLSVLLKLLRIFETVFDIIKKDLPPAEDVGDDKDAGRHYHFVVATDNNVYQVIRVATSSANSEWEWKWTR

SEQ ID NO: 168728 - protein, 146 aa, Glycine max
  Coding DNA Sequence Number=SeqID_51950
  Homolog annotation: Hit_ID=Q2HT12; Match level="QueryCoverage=38%, HitCoverage=7%, E-value=5e-13, Identity=62%"; Hit description =Cellulose synthase
MVLWKNFFRNVKFLLPKNHPEELVPETKPLQEGRGGEILTLRKKCINNTTKSFEDERKWQLEGRDAHGGRRKRRKARRRKVLDAPSMSQKVGDQNSVYQAQLPSQVSLQELAQLQWPNKRDGPQDCLRSSVASIALLLAHFFVSLL

SEQ ID NO: 168729 - protein, 180 aa, Glycine max
  Coding DNA Sequence Number=SeqID_51951
  Gene Ontology: Mol. function=zinc ion binding; Cellular component =intracellular; Biological process=regulation of transcription, DNA -dependent
  Homolog annotation: Hit_ID=Q9ZTK7; Match level="QueryCoverage=69%, HitCoverage=44%, E-value=7e-30, Identity=48%"; Hit description =CONSTANS-like protein 2
MVSTPNSFLHLSISEEALRGEMRGAFELLGEATSGGGIIRNLLDKVDVDVGVAALCLACNRDIHSANPLASRHERIPVTSFFESINSVKVSDANADAHVSTEEAETASWLLPNPKTDLNSSQYLFSEIEPVPYIDLDYATMDPKSEQKSSATADDIVPVQSNFESFTYKHQTSFELEPLE

SEQ ID NO: 168730 - protein, 352 aa, Glycine max
  Coding DNA Sequence Number=SeqID_51952
  Gene Ontology: Mol. function=cellulose synthase (UDP-forming) activity; Cellular component=membrane; Biological process=cellulose biosynthetic process
  Homolog annotation: Hit_ID=Q2HT16; Match level="QueryCoverage=97%, HitCoverage=46%, E-value=1e-134, Identity=67%"; Hit description =Cellulose synthase
MANQNSLPLYEKFWYKHNYKRVTESLLSVLLLWLLGYRVISINNYSFPWFVAFLCESWFTISWFLALTTQWSPAVTKTYPDRLLQSVQELPPVDLFVTTADPELEPPIITVNTVLSLLALDYPAHKLACYVSDDGCSPLTFYALQEASKFAKFWVPFCKKYEVQVRAPLRYFFDKPEVSTANNTPKFKQEWLKMKDMYDQLSRKIDLDSFTKSNPCLGEFATFSNTERTNHPSIIQVIWENNESLADGLPHLIYISREKRPKQPHHFKAGAMNVLTRVSGLITNAPFMLNVDCDMIVSNPKIVLHALSILLDPKGEKEVAFVQCPQQFYATLKDDPFGNQMTILFKVIVIKH

SEQ ID NO: 168731 - protein, 363 aa, Glycine max
  Coding DNA Sequence Number=SeqID_51953
  Gene Ontology: Mol. function=cellulose synthase (UDP-forming) activity; Cellular component=membrane; Biological process=cellulose biosynthetic process
  Homolog annotation: Hit_ID=Q2HT17; Match level="QueryCoverage=98%, HitCoverage=46%, E-value=1e-109, Identity=52%"; Hit description =Cellulose synthase
SGISDEEFKEKFGASKDFLKSAAFALKGRIYSPNDINISNVVDVASQVAGCGYEYGTGWGKQVGWIYGSITEDVLTGLTIHEKGWRSELCTPSPIPFTGFAPGGGPTSMAQQKRWATGMLEIFICKHCPIISSLFRKLTLRQCLAYMWIINWGLQPVFEVCYACLLAYCIITNSNFLPQDLGIRIPIAFFAIYKVYTVCEYLAAGLSVREWWNNQRMSRITSMNAGFCAFLSVLLKLLRISETVFDVTKKDLPPTGNVLDDKDAGRYTFDESVVFLPGTTILLLQLTAMVIKLLGLQPPVPTPSRNGSGLGEIFCSVYLMICYWPFLRGLFETGKYRIPMSTICKAAILTCLFVHLCRRIITS

SEQ ID NO: 168732 - protein, 244 aa, Glycine max
  Coding DNA Sequence Number=SeqID_51954
MRLNAYESSRIYKERTKTYHDKKLQRREFQPGQQVQTAKGGVLRAEVQWAARSHALSARRRAKRLGIITLSLAHRLSGSKPSEEQHEERAQPLQDTGATTKRSLSRTVALSALNCISERAKRVRVALSACQQQLQGGAPSAGLGLGMASRKRRAVPTPGEASNWDTSRFTSEIAWHRYQDNIQLRNILPERNVELGPGMFDEFLQELRRRRWDQVLTHLPEKRIDVALVKEFYSNLYDPEDHSP

SEQ ID NO: 168733 - protein, 46 aa, Glycine max
  Coding DNA Sequence Number=SeqID_51955
MRKGPLEEGGTKAIDSVETLRTWALSAHQALSVQLTAGAERGVKHE

SEQ ID NO: 168734 - protein, 226 aa, Glycine max
  Coding DNA Sequence Number=SeqID_51956
MALSEPSRSESPLKAEVGKIKGEISKSIESKTEAQKQSKEAKNLNFQEDFRIRIHLLINFVVVNRLPPVRGEREKFDHIEERLRAIEGGGDYAFPDVPNFDKYKGTTCPKNYLKMYSRKMGAYAKDEKLLMYFFQESITGAAYNSDMAPDRMQPQNMCKKEYESFKEYAQRWRDLAAQVAPPMTEKEMITMIVDTIPVFYYEKMEAWANGENEKKGRTHAVTVAPT

SEQ ID NO: 168735 - protein, 92 aa, Glycine max
  Coding DNA Sequence Number=SeqID_51957
MEQNYITRVWSKVAYFSCRLHVEHALLGLEGMVIYHAFSAVFALSATLGFLMGLLHAKCVLVAKQACALSWLSNSSNFCSSLFLPIFASISF

SEQ ID NO: 168736 - protein, 94 aa, Glycine max
  Coding DNA Sequence Number=SeqID_51958
MTNKERMKNDVEVDYGRNSKNKTFGTKAARPGELLLHFEVTLLVRRAGYFTMKLFGGPAKPEASLSELGTKNLPEMTHLPLPFGIFHKLDQNIE

SEQ ID NO: 168737 - protein, 578 aa, Glycine max
  Coding DNA Sequence Number=SeqID_51959
  Gene Ontology: Mol. function=protein binding; Cellular component =nucleus; Biological process=mitotic cell cycle
  Homolog annotation: Hit_ID=Q2HT10; Match level="QueryCoverage=97%, HitCoverage=82%, E-value=0.0, Identity=59%"; Hit description=Barren
  Pfam annotation: Domain name=Barren; Domain location=1-568; Score =231.4; E_value=2e-66; Accession=PF05786.4; Description=Barren protein
MAQEASCTLEAGVKIYSLRVDSVHSEAYKVLGGMNRAGQEAEEAMMSDTTLNGVNIESGQVESRKETSKKLSPLSTLESSFEALNVKKFDGDLKSYFISVTCLLRRCVEVVLKMAAFVVDPLYRQTTAKFDEGGAKGLLMNNLGVYGDCRVLFDSQEVPAKCMASQNQSDISDTIDLSFAKDCIDQMVLDMRVKDEISPSLRTIVNQFDESNRRPADIQLQGQNSAEDLDNADNNENGFYREEYENCMAWSDDRDDQTVVADPGYNDADPSFPSYPQDNDEPFPSPEIDMDGRFENVDGYLFLSLGFSSKQNAWAGPDHWKYRKSKEVHPTSEDGSTLKSRQPKSKRQTEVDLNFTNSLEKKMLDTFSPPKNPKLLLLPESRLPCNTKLPEDCHYQPEDLVKLFLLSNVKCLGRKANRFSDGSREQSDEYESFPSWDNGSVCGDDAGDYGGDLHGDMEDTDTLVTQPRQVSKIEVQYDKTSKQVDVHALKITLWDHVQESVKLPLEGQKDTLSFRNILANFPSECNAAATISDISPHLCFICLLHLANEKGLSIQNSPNLDDLAIRFPQVADSMRGTV

SEQ ID NO: 168738 - protein, 291 aa, Glycine max
  Coding DNA Sequence Number=SeqID_51960
  Gene Ontology: Mol. function=carboxypeptidase A activity; Biological process=proteolysis
  Homolog annotation: Hit_ID=Q3PD18; Match level="QueryCoverage=65%, HitCoverage=26%, E-value=5e-35, Identity=40%"; Hit description =Peptidase M14, carboxypeptidase A
LNNRIERREAFLRKALTLYHAMGGAMEDVEAAVKDAVSSPAPTIDVAVGDVMYKLAAIGHQGQEAAAKTARSETGCGNAGEVNRPPGAVAVSGHLRRQDFLPGIVGGQHRFHLRGVAGDEIRAIDGFVGIFGDQRHRHGVAVIDGRQARKAVDDAETGFAGVDFIKRDLAVIVVEQAGNGAEMAGYLVQQGFRSAFPVRMAGAAHFLRLEADFLLVQMRSRIFRRAIFEVIAKGGVPRRMMHVARIIDAQTLMQGVTVRIFQRRDGEMRALAISEFAGAADGADDARRLVG

SEQ ID NO: 168739 - protein, 133 aa, Glycine max
  Coding DNA Sequence Number=SeqID_51961
RNNNVLPLAFPIVEGATNPSNDPLHGIEGPMTKSKTKRMKQALCFEANLKNHFGKPNLQDKKHPWAELINLGRLLSYPNFVRGPLLDDMRPFFGPCEALPNRFRNVFREEFREGFDRSSTFFIHSSSFFDLQR

SEQ ID NO: 168740 - protein, 90 aa, Glycine max
  Coding DNA Sequence Number=SeqID_51962
MGAKHLTRTKERSHAIKQRYPDETRVAGTKGAEDYVSLCMSSGPPPLDDTRVRITVRYLRVSSGPPPLDDTRLQNDQILSLRVIGPAASG

SEQ ID NO: 168741 - protein, 131 aa, Glycine max
  Coding DNA Sequence Number=SeqID_51963
  Gene Ontology: Mol. function=DNA binding; Biological process=DNA integration
  Homolog annotation: Hit_ID=Q1T010; Match level="QueryCoverage=99%, HitCoverage=9%, E-value=2e-17, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
HIPNEKRNNLEDKSELMILVGYHSAGSYRLYNPVNYKIIISRHVFVDEKSSWDWKVQSYVPMELGEDHIDEEQRSEKCVPQSENHINEEQRSEECDPQPKNLRSQRNRRLPLKLNDCQMIPDNMITIDGKL

SEQ ID NO: 168742 - protein, 106 aa, Glycine max
  Coding DNA Sequence Number=SeqID_51964
MSGFTRDSPQISASPHQLDLAPYASEPYNAQWNAPGLLRDKHTLRSSRIFGEMEVYEPWLGLWLPLNYQIDMGARIAFVDNWAVGKEKEWQSQHGLLPHSHPLHLP

SEQ ID NO: 168743 - protein, 131 aa, Glycine max
  Coding DNA Sequence Number=SeqID_51965
MAPEDLDQLTHKIQDQLEEWITQRVTQQLMFSFSQMQSQGLALPPKVEVGPSASCVGTKESCIDPSRLYVDDNPPRLVALGRVYEGWTIVPNVPVATYPSTGGRRRAHGCIFQGRRNQRLFEENVRKIGKV

SEQ ID NO: 168744 - protein, 200 aa, Glycine max
  Coding DNA Sequence Number=SeqID_51966
  Subcellular localization annotation: CTP_CleavageSite=39; ConfidenceScore=5.32e-01
MATPPNSPPLHESVALSPSTSKKTRNATQLRSLATRPVREEGPVVHVDPATGKVDGPYKKNLRTYLEIVTHNKLKSDAILPRKGLVTRAISKRLQEDWARATEEGPKDRFLSAWDKLSYWRGVFPWGELSYWRGVTLASQGSFSRKLSSIMYFGMGVKSNLTSKWAVANDKEGKDDKGNFVAHGRQDGLIDCCHWVTRAP

SEQ ID NO: 168745 - protein, 59 aa, Glycine max
  Coding DNA Sequence Number=SeqID_51967
MDTRLRVIGDPMNEVQRQIPLNESDDNYCRSGCHNPLFEDSPSECGGGAATVRYGLISK

SEQ ID NO: 168746 - protein, 149 aa, Glycine max
  Coding DNA Sequence Number=SeqID_51968
  Gene Ontology: Mol. function=protein serine/threonine kinase activity; Cellular component=beta-catenin destruction complex; Biological process=protein amino acid phosphorylation
  Homolog annotation: Hit_ID=P43289; Match level="QueryCoverage=71%, HitCoverage=26%, E-value=1e-54, Identity=95%"; Hit description =Shaggy-related protein kinase gamma
  Pfam annotation: Domain name=Pkinase; Domain location=3-146; Score= -96.1; E_value=0.0078; Accession=PF00069.15; Description=Protein kinase domain
  Pfam annotation: Domain name=Pkinase_Tyr; Domain location=1-120; Score=-153.6; E_value=0.0048; Accession=PF07714.7; Description =Protein tyrosine kinase
  Pfam module annotation: Pfam domain module=Pkinase::Pkinase_Tyr; Domain location=3-146::1-120
MAERIVGHGSFGVVFQAKCLETGETVAIKKVLQDKRYKNRELQTMRLLDHPNVVCLKHCFFSTTEKDELYLNLVLEYVPETVNRVIKHYNKLNQRMPLIYVKLYTYQPSELLLKFWSMHLNGKINIEPCCCCSSGVNSLCQELLLYAIG

SEQ ID NO: 168747 - protein, 369 aa, Glycine max
  Coding DNA Sequence Number=SeqID_51969
  Gene Ontology: Mol. function=sugar porter activity; Cellular component=integral to membrane; Biological process=ion transport
  Homolog annotation: Hit_ID=P22340; Match level="QueryCoverage=93%, HitCoverage=67%, E-value=1e-115, Identity=60%"; Hit description =Sucrose porin precursor
  Pfam annotation: Domain name=LamB; Domain location=124-369; Score =117.4; E_value=4.1e-32; Accession=PF02264.6; Description=LamB porin
MMRCLNRFSKKNTSDDSLASGMQTVKKSIIAITLSTVLGSGSAWAADDMSSIEARLAAMEKRLAAAEQRASVAEQRAQAAEQQVQKLAAVQQQNPTPVAVAQTEPQAAQPVAPAASSESEGFEFHGYARSGLLMNSSAAKTQGGPTVTPAGETGGHVGRLGNEPDTYVELNLEHKQTLANGATTRFKAMLADGQRTYNDWTAASSDLNLRQAFVELGQLPTFTGAFKDSTVWAGKRFDRDNFDIHWIDSDVVFLAGTGAGIYDMKWGDDARSNLSIYGRTFGDIENNDNTAQNYILSLNNFVGPLQLMVSGMRAKDNDQRTDIDGNRVKSDAASDGVHALVGLHNDSFYGLGEGSAKTALLYGHGLGAE

SEQ ID NO: 168748 - protein, 76 aa, Glycine max
  Coding DNA Sequence Number=SeqID_51970
MLRKLTDCITILPFDFRHVTEFHGLRNNASFLISGMSRNFTYCATKGAKYLATVNQRRIISNWAWIQNWAEPSAWT

SEQ ID NO: 168749 - protein, 223 aa, Glycine max
  Coding DNA Sequence Number=SeqID_51971
  Gene Ontology: Mol. function=DNA binding
  Homolog annotation: Hit_ID=Q1S0F5; Match level="QueryCoverage=57%, HitCoverage=24%, E-value=7e-16, Identity=38%"; Hit description=IMP dehydrogenase/GMP reductase
IDAFLAYHDHKESPVVAMLADLYDTFDQRCEKRSTRIVCCTLVLYVWLVLHLFRQEVRHACPLESHRSCTEKGGANWDQLLANKEGASVNWFPRWKEGRTGVLISCGGFPNVPLIGTRGCISYNPVLAIRQLGYPMKGAPLEEEIAPIISRGFNRNNMETLQKVRKAWKVVRKKDKELRGSNNGPIGGYRKWSKAHVQSLDWLLSLRTAKREEVEAPEEDEEV

SEQ ID NO: 168750 - protein, 169 aa, Glycine max
  Coding DNA Sequence Number=SeqID_51972
YILCGTSKAYIYLGCNTENKRGYICCGSVQVERTSIWLFKENKGGYIPCGSLLVKDFTRLLEISRTGGCLGTGCHLIQHILLSRSSNLAQAFEEDLILMWAFQTGRQIDWAHLVRYQMHKVVRANALLPYPYLVTLFLHHFNIALDDEPFVKVKRSFSIGAGAITSFGY

SEQ ID NO: 168751 - protein, 74 aa, Glycine max
  Coding DNA Sequence Number=SeqID_51973
MAVPGRRNGINDDEEELDDNALFEEQGVVEDDTDTPPHLRDLSAAAQIGDAHALRLALGLSLSLSLQFTVIMDH

SEQ ID NO: 168752 - protein, 137 aa, Glycine max
  Coding DNA Sequence Number=SeqID_51974
MAPTMHPLDPEKSNKALGVHVTPSKVIRPPITRAFIEKYYTPRQAPSDAHQDAGAPPPPRQADLAGSLSMEQYLQHLVRQKAANHRGQFGAEVAWPGDWPDAQTGEEPAESLDETDEPHMDEDMTDLLGFLRGSGAT

SEQ ID NO: 168753 - protein, 85 aa, Glycine max
  Coding DNA Sequence Number=SeqID_51975
MGAKYLEVVKRGSHPNNGWSPNEIRTQNDHNLSLRFVGNDRAWAARYKMTIICLCMPPDTIAHFLNDKGRKICLCAFITQLAKSE

SEQ ID NO: 168754 - protein, 219 aa, Glycine max
  Coding DNA Sequence Number=SeqID_51976
  Gene Ontology: Mol. function=protein kinase activity; Biological process=protein amino acid phosphorylation
  Homolog annotation: Hit_ID=Q2QZ78; Match level="QueryCoverage=97%, HitCoverage=38%, E-value=4e-61, Identity=52%"; Hit description=AT hook motif-containing protein, putative
  Pfam annotation: Domain name=DUF889; Domain location=146-218; Score= -91.3; E_value=2.6e-05; Accession=PF05970.5; Description=Eukaryotic protein of unknown function (DUF889)
MPTDQQAKIYNQIIQAVNKNEGGMFFLYGYEGTGKTFIWKTLAASLRADNKIVIMTASSSIASLLLPRGKIAHSKLKIPVPIFEDSTCNIHQGSQLAELLNEASLISWDEAPMAHKFCFEALDRSLRDVIKAKSSSDKIFGGKVMVFGGDFWQILPVIPRRSRSDIVNATINSSYLWNHFHVLTLSKNMRLEANTDATDREETAAFAEWILNIGDGIAG

SEQ ID NO: 168755 - protein, 751 aa, Glycine max
  Coding DNA Sequence Number=SeqID_51977
  Gene Ontology: Mol. function=calcium ion binding; Cellular component =extracellular region; Biological process=pathogenesis
  Homolog annotation: Hit_ID=Q8XQP2; Match level="QueryCoverage=53%, HitCoverage=87%, E-value=3e-52, Identity=32%"; Hit description =Probable hemagglutinin/hemolysin-related protein
MLFSDTSASSSHPVLSPPVVIFAERGWYNDPQKRWQGTVQTPDAVEVIVTVNGGNPLRVPVINGHFEWMPPQPMADGEYQLTFTAVDAAGNHSAPTRVDYNIDTHPPARPIIEAIEDHVAGGVEDGNSIRRNGYTNDDQPVVRGQAEANALVYLYNGKQLLASVRADAQGNWQAQLDLPQDGTYNLTAQAEDRADNRSQPSPKWTFHLDTLTPETPTFSHYDDNRGLYQGQFGRGKPTDDVRPELHGEAEPGSVVRIQYAAPGGKWIVGGTATVDSSGHWHWTPPQDLLPDGDWRFRSRSSDKAGNVSQWSDSWTLTIDTRINTPAILQAIDDVGTIQPVLPGQTTDDKRLDFSGQAEPYSQVTLYQNGLAAGSATVGADGRWQITPDRDMQPGSNNFTVKAVDLAGNISNYAPNWMINYDSGVKHSSGEENWNCRANTSWQTGRVYQYGGLKVTELKHGTSNNCFYTGIMNRPDGYESKAIEMLDHSVVQFDFGATNYVEFNYGYLHNCDTYVDIFSPSGELLGREYLQPGGASRSEQGLNTFSWQAPAGQQIGYIDVHSGEDPDTYKKVLCWNVLVKRDVGWIIDTVRWGKDESLVQHHTLPETLEQEGAQLHLNDVQQWLAAHSGQLPQGFSALVLEGEHQQLDYQQLTQHISGLQHIDLTGSGDNLLQLDAQQLLQQAHQDVLLPERTRSWLIDGDAGDVVQLNDSTQFYQQWQQQGTHQSGGKVWQVFESPDHSATLLINNEVMVA

SEQ ID NO: 168756 - protein, 319 aa, Glycine max
  Coding DNA Sequence Number=SeqID_51978
  Gene Ontology: Mol. function=hydrolase activity, acting on glycosyl bonds; Cellular component=outer membrane; Biological process=cell wall catabolic process
  Homolog annotation: Hit_ID=Q6D8K0; Match level="QueryCoverage=99%, HitCoverage=89%, E-value=1e-148, Identity=80%"; Hit description =Membrane-bound lytic murein transglycosylase C precursor
  Pfam annotation: Domain name=SLT; Domain location=154-282; Score =156.3; E_value=8.2e-44; Accession=PF01464.10; Description =Transglycosylase SLT domain
MGQFAANIENIWGINEVLIAGPKDYVKYSDNYYTRSHINFDSGSITIETISGTDPMASLRQAIITTLLIGDDPGNVDLYSDANDIQISKEPLLYGQVLDNTGQPIRWQGRAGNFADYLIQNKLQKRTSGLHVIWSVTIPMVPNHLDKRAHKYLPLVRKAAEQYGVDASLILAIMQTESSFNPYAVSNADALGLMQVVQHTAGVDVFRMKGKWGKPSRSYLLDPANNIDAGTAYLSLLQKSYLGGIQDPLSRRYAVITAYNGGAGSVLRVFSSDKDRAFATINGMSPSQVYQTLTTNHPSAESRRYLYKVSQAQRSYHRY

SEQ ID NO: 168757 - protein, 247 aa, Glycine max
  Coding DNA Sequence Number=SeqID_51979
  Pfam annotation: Domain name=PRA1; Domain location=76-221; Score =21.2; E_value=1.6e-07; Accession=PF03208.9; Description=PRA1 family protein
  Subcellular localization annotation: CTP_CleavageSite=66; ConfidenceScore=5.07e-01
MVFSSNPLSLSVPEPAFESWLRDTGFLEVLDHRTSSSAAAASPAPSSAASTLFSRLLTFLSLFTLNAFAKLAADDFAADTPSWSRSFFAFSDSYSFPSSPSQARLRVQENVKRYARNYAYLFIVFFACTLYKMPVALVGLVLCLALWDFFKFCSHRWGLEQYPLTRQILIRVVQCATAVILIFSNVQMALFCAICVSYVGMILHAGFRKLTPVKQPSVSRGMCKPLIIKERIVILTLPIVSLFPNYD

SEQ ID NO: 168758 - protein, 115 aa, Glycine max
  Coding DNA Sequence Number=SeqID_51980
MTFTGSFTRPTAQLASPEKQMQQGHKQLNIDLSTWGGREGVGIGEGEEGAGPGGGVGGEVIGGELGEGVEGEEGEEGQEAGEEGGGGGGGSGGGGCGGGGGAVVEDFEEAGVAEP

SEQ ID NO: 168759 - protein, 208 aa, Glycine max
  Coding DNA Sequence Number=SeqID_51981
  Gene Ontology: Mol. function=RNA-directed DNA polymerase activity; Cellular component=chromatin; Biological process=chromatin assembly or disassembly
MAEPNNDRVEAALARLTSRIEDLLQHVTPSASPPFPPRSPIPVHSHRIKLDVPRFDGTDPLGWIFKITQFFEYHGTPEHDRITIAAFYMEGRALAWFQWMSSNGQFTSWPVFLQALQTHFAPSQYEDPSGSLFKLTQRTTVTEYLSEFEELANRVVGLPAPFLLSCFVSGLASEIRREVMVNQPLTVAEAAGLARLHEEKLRDLRFDF

SEQ ID NO: 168760 - protein, 890 aa, Glycine max
  Coding DNA Sequence Number=SeqID_51982
  Gene Ontology: Mol. function=RNA-directed DNA polymerase activity; Cellular component=chromatin; Biological process=chromatin assembly or disassembly
  Pfam annotation: Domain name=rve; Domain location=603-759; Score =103.6; E_value=5.7e-28; Accession=PF00665.16; Description=Integrase core domain
  Pfam annotation: Domain name=zf-H2C2; Domain location=544-585; Score =18.1; E_value=0.0014; Accession=PF09337.1; Description=His(2)-Cys(2) zinc finger
  Pfam module annotation: Pfam domain module=RVT_1::rve::zf-H2C2; Domain location=131-300::603-759::544-585
MQFFHDGRIVQLQGDPVAQRDLLFSPQFRRVCRNQPNSICFHITVLPEDSEPVMPSPIDPQVQHLLQQFFVLFQDPTQLPPARDTDHQIHLRPDATPVNVRPYKYPYYQKREIETQVETMLQRGIIQPSKSPFSSPVLLVKKSDNTWRFCVDYRALNALTIKDRFPIPTIDELLDELGGASCFSKLDLLQGYHQIRMQSEDIPKTAFRTHHGHFEFKVMPFGLCNAPSSFQATMNTLFRPYLRRFIIVFFDDILIYSVSLSDHLRHLQTTFQVLYDNHFVLKLSKCLFAQPQVEYLGHLVSHRGVQPVASKIAAIAQWPNPRSVRALRSFLGLAGFYRWFIRGYATIAAPLVKATTIEPLHWTPATQTAFDTLKEALTSAPVLALPDFKLPFTVETDASAIGMGAYLLGHSFTILTNHQSLKELMTQVVQTPEQHTYLARVMGYDYHIQYRSGSHNQAADALSRLPEGASQAFLILSVPCLTFLDELHDQLRTNSTFQQKLLDVQNHPDHHPEFSIADKLLLYKGRIWLPSDIPIITTLLTEYHATPTGGHAGVAKTVARLMTNFYWPGLRDDVSRFVAQCVDCQVTKYETKELAGLLCPLPVPSQPWYDLSLDFITSLPVYRGNTVILVVVDRFSKGIHLGMLPPSHSALTVAKLFLDIVVKIHGMPRSLVSDRDPLFVSQLWQELFKANGTQLRMSSAYHPQSDGQTEVMNRVVEQYLRAFVHRRPKNWGRLLPWVEWSHNTSWMANTGTTPYEITFGRRPFNFPDYLAGSSKVDAVLVRLRPYRQSSAKGGSSTNVKLAHRYYGPFQVTAKIGPVAYRVNFPAGVRIHPGLSPEETSWEDWDQLRQDYHLEDKVILQGPRDDTGIGYEEEDAEEEEDQSSAQEKKKG

SEQ ID NO: 168761 - protein, 58 aa, Glycine max
  Coding DNA Sequence Number=SeqID_51983
  Homolog annotation: Hit_ID=Q9FN32; Match level="QueryCoverage=54%, HitCoverage=24%, E-value=1e-09, Identity=87%"; Hit description =Protein yippee-like At5g53940
MGRIFVVELEGRSYRCKFCRTHLALADDLISRVVEHHLPHSTVAIGFALAKDGTKDRN

SEQ ID NO: 168762 - protein, 69 aa, Glycine max
  Coding DNA Sequence Number=SeqID_51984
MVEALYTIMIHDRFEKVNGVRELRMEKLVNSMSIELKGESTKTRKNLRGVRSYNVGPIVNRLTMFPSTM

SEQ ID NO: 168763 - protein, 82 aa, Glycine max
  Coding DNA Sequence Number=SeqID_51985
MRGCPRDSRCGADLNGYECEWKGRIHSFVILVHYSCASWRRRRHRRRKRCVERESESEAGEWGPRGAFCVDYVAVGVHVVFT

SEQ ID NO: 168764 - protein, 123 aa, Glycine max
  Coding DNA Sequence Number=SeqID_51986
  Subcellular localization annotation: CTP_CleavageSite=62; ConfidenceScore=5.22e-01
MLKIHWLKQKLLEIFDPLQLSQSSSKSPKQASKLNHQAKSTTRPFGRSKLKESVSDPFHDIFSNSRSSSSLLPVGASITLRTYLCSFTSIPFVRTSQCYPPSIFQFSNKAMKEFSTKYINKLN

SEQ ID NO: 168765 - protein, 581 aa, Glycine max
  Coding DNA Sequence Number=SeqID_51987
  Gene Ontology: Mol. function=RNA-directed DNA polymerase activity; Cellular component=chromatin; Biological process=chromatin assembly or disassembly
  Pfam annotation: Domain name=rve; Domain location=384-540; Score =68.9; E_value=1.7e-17; Accession=PF00665.16; Description=Integrase core domain
  Pfam module annotation: Pfam domain module=RVT_1::rve; Domain location=12-236::384-540
MLQSGIIRPSTSPFSSPVLLVKKRDGSWHFCVDYRALNAIIVKYKFSIPTIDELLDELGGACWFSKLDLLQGYHQILMKAKDICKTAFCTHHGHYEFCVMPFGLCNAPSSFQATMNSIFGSYLCRFIIVFFNDILIYNKTFMIIWSISPKLLRCFSKDASSSNSRSAHLPNNMWNTWAILFPDEALNLFPPNYASIVAPLTRLLVKDQFQWSSEAQLAFETLKEAICTTSVMGLPDFSQPFVVETDAFGVGMGSILTQQHHPIAFFSKPFCPKLLRSSTYVRELAAITAAVKKSLKELMSQVIQTPEQQIYLACLLGYDYSIQYRSGKANSIVDALSRIHETSAAQLLTLIVPNFMFLQDLKTKLQNHAGYQELWQSIMDNPQAHPTYEEDLSLNFIEGLLVSRGYTVILVVVDRFSKGVHLGMLRPNYMASAIANLFMEIVGKLHGMSRSLVSNRDPLFVSHFWQELFKLSETKLRMSFAYHPQSDGQIEVMNRVIEQYLRSFVHHHPSSWGKFIIWAEWSYNTSVHAAIGLTPFEITFGKKPLSIPSYLAGTSNIDVVDDFLVNRDAVFVMLRKKLLKA

SEQ ID NO: 168766 - protein, 69 aa, Glycine max
  Coding DNA Sequence Number=SeqID_51988
MEDAGVTETEDAGVASVQSSNGGARRCEKPLQNPPRSAAIAAVTQNRSATEVPVADRGRSAPPRRYGRY

SEQ ID NO: 168767 - protein, 76 aa, Glycine max
  Coding DNA Sequence Number=SeqID_51989
  Homolog annotation: Hit_ID=Q10NQ3; Match level="QueryCoverage=74%, HitCoverage=11%, E-value=6e-19, Identity=77%"; Hit description =Vacuolar sorting protein 9 domain containing protein, expressed
MVGLEKYVMTKLFARVFASLPDDVKFDDQLSEKMALIQQFIRPENLDIKPVFQNESSWLHSCQYRRSGRPQKWDSG

SEQ ID NO: 168768 - protein, 71 aa, Glycine max
  Coding DNA Sequence Number=SeqID_51990
MPHVISPLNCAPTFDTMQIETDPINSLQKKPTVIKQPRHSTLEKQSCCCRHFSPKGKGKHGARIKIFTPQC

SEQ ID NO: 168769 - protein, 352 aa, Glycine max
  Coding DNA Sequence Number=SeqID_51991
  Gene Ontology: Mol. function=DNA binding; Cellular component=nucleus; Biological process=regulation of transcription
  Homolog annotation: Hit_ID=Q40880; Match level="QueryCoverage=98%, HitCoverage=99%, E-value=1e-110, Identity=61%"; Hit description=NAM protein
  Pfam annotation: Domain name=NAM; Domain location=16-144; Score =321.3; E_value=1.7e-93; Accession=PF02365.6; Description=No apical meristem (NAM) protein
MDNSSYHHLDHTEAHLPPGFRFHPTDEELITYYLLKKVLDSTFTGRAIAEVDLNKSEPWELPEKAKMGEKEWYFFSLRDRKYPTGLRTNRATEAGYWKATGKDREIYSSKTCSLVGMKKTLVFYRGRAPKGEKSNWVMHEYRLEGKFAYHYLSRNSKDEWVISRVFQKSNTATNNGGSVMSASSNSKKTRMNSTTSLIHEPSSPSSVFLPPLLDTSPYTNTANFTDRHNGSYDSITKKEHVSCFSTIAAATTAVVSPNNFNNAGFDLSPSQPLATDPFARFQRNVDFSAFPSLRSLQDNLQFPFVFSTAAPPFSGGGSGDFLSWPVPEEQRLIDGVSNMPLGVSELDCMWSY

SEQ ID NO: 168770 - protein, 85 aa, Glycine max
  Coding DNA Sequence Number=SeqID_51992
MEEWNILEAQIHITKGKKPWKRQQGGGHAFVLASSFLKFFLELLKYYSIGSVGFSKKKKELVEWNDEAACTNVFRNLLPYIESVF

SEQ ID NO: 168771 - protein, 468 aa, Glycine max
  Coding DNA Sequence Number=SeqID_51993
  Gene Ontology: Mol. function=adenyl-nucleotide exchange factor activity; Cellular component=mitochondrion; Biological process =protein folding
  Homolog annotation: Hit_ID=Q8LA37; Match level="QueryCoverage=45%, HitCoverage=76%, E-value=2e-52, Identity=49%"; Hit description =Putative heat shock protein
  Pfam annotation: Domain name=Auxin_resp; Domain location=157-226; Score=58.0; E_value=3.1e-14; Accession=PF06507.4; Description=Auxin response factor
  Pfam annotation: Domain name=GrpE; Domain location=286-441; Score =142.9; E_value=8.5e-40; Accession=PF01025.9; Description=GrpE
  Pfam module annotation: Pfam domain module=Auxin_resp::GrpE; Domain location=157-226::286-441
MPRQPPPSPPSQPGVLDPEIWRVCSGTTVEIPTLHSRVYYFPQGHFDVYLSAAELPGGPAGAEPPRHRRARLRLGVPPHLPRDAAAAPADHRLEHVREQQEARRRRRRGFHEELQGRGGDVGTRIKVDEEEEEEEEVREVFSRDGRGKLSAKVVAEAAELAARSMPFEVVYYPKGGWSEFVVKTEAVNEAMSVEWSHGMKVKIATETDDSSRVSWCQGTEMNANVKEAPQMRILTCESSCTGTNDDEDKKQVPSLMILLEAYKEAFFNGDQNTVAQIEEGIYSIANRKNKLIQKLSSLSADKAASKKSYLRLQADFDNFRKRTDKERLNIQSDAQQQVIEKLLLMVDNFERTQQQIKAATEKEKKIGVSYQGIYKQFVEVLRNHNVSVVATVGKPFNPLQHEAVAREESTEFKKGIIIKESRRGFLLRDRVLRPALVKVSLGPGNKKSPVSPDKSVEQPSTAAGIDER

SEQ ID NO: 168772 - protein, 548 aa, Glycine max
  Coding DNA Sequence Number=SeqID_51994
  Gene Ontology: Mol. function=glycine hydroxymethyltransferase activity; Cellular component=vacuole; Biological process=L-serine metabolic process
  Homolog annotation: Hit_ID=Q8RYY6; Match level="QueryCoverage=83%, HitCoverage=77%, E-value=0.0, Identity=75%"; Hit description =Putative hydroxymethyltransferase
  Pfam annotation: Domain name=Aminotran_1_2; Domain location=115-496; Score=-99.2; E_value=0.021; Accession=PF00155.11; Description =Aminotransferase class I and II
  Pfam annotation: Domain name=Beta_elim_lyase; Domain location=124 -389; Score=-132.9; E_value=0.096; Accession=PF01212.11; Description =Beta-eliminating lyase
  Pfam annotation: Domain name=SHMT; Domain location=95-496; Score =773.6; E_value=1.2e-229; Accession=PF00464.10; Description=Serine hydroxymethyltransferase
  Pfam module annotation: Pfam domain module=Aminotran_1_2::Beta_elim _lyase::SHMT; Domain location=115-496::124-389::95-496
MDSQPGLSLGLSATLSSPAAPLSDTTSVPWRLFNERHPKKEEQQEEEKEDEDGGETINFMDQRVKRKIEGHQQQPCFPSKRVAVDSSVGWWNQPLGVADPEIFDIMQKEKRRQFKGIELIASENFVCRAVMEALGSHLSNKYSEGMPGAKYYTGNQYIDEIEFLCCQRALLAFDLHPNNWGVNVQPYSCTSANFAVYTGILHPGDRIMGLDSPSGGHLSHGYYTLGGKKVSAASIFFETLPYKVNPQSGYIDYDKLEEKAMDFRPKILICGGSSYPREWDYARFRQAADKCGAVLMCDMAHISGLVAAKEVASPFDYCDIVTSTTHKSLRGPRGGIIFYRRGIKLRKQGFVHNHGDDSNYDFEEKINFALYPSLQGGPHNNHIAALAIALKQVATPEYKAYMQQVKRNAQALASALLRRNFKLVTDGTDNHLLLWDLTALGLIDRNYEKVCEACHITLNKCAIYGSISPGGVRIGTPAMTSRGCLEEDFETIADFLLRAAQITSIVQREHGKSCKDFLKGLQNNKDISELRNRVETFSSQFAMPGFDI

SEQ ID NO: 168773 - protein, 354 aa, Glycine max
  Coding DNA Sequence Number=SeqID_51995
  Gene Ontology: Cellular component=integral to membrane
  Pfam annotation: Domain name=DUF793; Domain location=1-351; Score= -236.1; E_value=0.087; Accession=PF05633.2; Description=Protein of unknown function (DUF793)
MDPSSVNGFYSFLTRGIDDLESVFLSTNFMSIQFLQRALSLLRSFHTQLTLLVQKLHLPVGDKWLDEYMDESSKLWDACHVIKSGISSIDTYYSAALNITSSLDSHRPITPQLSRQVTNFSFSLFVLTCILLRNKTKKDSFEKDCLPNKVIRAIAGCRREAVGLEEENRGLMEARIQPLSLRFEERVSIESKLNGFNGFRGVLYAMRNVSSLLLMVLLYGLVYCYGDSSDFVLGGCGYEGCLFLGSAFMMSTARLQQRVAAEIGHMGGAQGMLLHEFRRSKVAMEELRGELERRGSQGGVEWESEVAIRERVENLRACFGVLRSGADNIVAQLDDFFDEIVEGRKRLLDFCSHR

SEQ ID NO: 168774 - protein, 84 aa, Glycine max
  Coding DNA Sequence Number=SeqID_51996
MAGVIPTRRILMQHEKSQENRDTTAYTTTPNHNIQSTAQGMTQTLSAGKHLRRVMDNDDCSRDWTNSRFLLMVDRKWNLGKKLL

SEQ ID NO: 168775 - protein, 534 aa, Glycine max
  Coding DNA Sequence Number=SeqID_51997
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=92%, HitCoverage=74%, E-value=1e-113, Identity=47%"; Hit description=MAP kinase
TFVGTPFWMAPEVIQNTDGYNEKADIWSLGITAIEMAKGEPPLADLHPMRVLFIIPRENPPQRPSAKELLKDRFIRNARKSSKLSERIRERPKYQIKEDEETPRNGPSGMGEASGTVKVARDSRGEENNRPSDQGKTLKSAGWDFSIGGSQGTGTFRNVSRPPQFRDKKTEVSHNQLTQRKAPERGYQGVSVNRSALNESLESSFGRDLRVPHHDEHLDNHLEDDELSGNGSGTVVIRSPKGSRSSAFRDQSSLSSSSYASFEDASSSGTVVLRGQHDESDSPQTPRSRLGLNDRNSNASMEDSAANLAEAKAAILRKSNARERLARGKINNDRQESKRDQKASSSDSSRPHGEYDAHKSMLRSHHASDGEESAKIMSSSVPLSVLLIPSLKEAIADDPELMRAVINSLINMEGTKPKSCDVFVKKLLQRLASSKEDSLKDMQGLAGQLFSKNKSAEETQNAEADNRKKQQNKEHNSNSNLSPLARFLLSRFMEVIIFPMAGPNLTGSKPILSREDMEVIKARKSSTFEMADFG

SEQ ID NO: 168776 - protein, 111 aa, Glycine max
  Coding DNA Sequence Number=SeqID_51998
MGSLSVCGTSFACVLENACETQEKQKGMELVKGQRISILLVKKQGGLFMWAATGERVLELPFFMIVNLICDFTFNFLYLTVMRRCHMSPSLSPNADEARASDLSLAERGQL

SEQ ID NO: 168777 - protein, 79 aa, Glycine max
  Coding DNA Sequence Number=SeqID_51999
VIVGFADDGVSILEAANDDLGEMGHRGDEVHDAEAKCVPLDGMLGIDGSFRVCGEEESTFHLTMGLRIRATRLCGGAVA

SEQ ID NO: 168778 - protein, 203 aa, Glycine max
  Coding DNA Sequence Number=SeqID_52000
  Gene Ontology: Mol. function=protein serine/threonine kinase activity; Cellular component=cytoplasm; Biological process=protein amino acid phosphorylation
  Homolog annotation: Hit_ID=Q9LDN6; Match level="QueryCoverage=96%, HitCoverage=22%, E-value=5e-31, Identity=44%"; Hit description=MAP kinase
  Pfam annotation: Domain name=Pkinase; Domain location=15-179; Score= -111.4; E_value=0.063; Accession=PF00069.15; Description=Protein kinase domain
  Pfam annotation: Domain name=Pkinase_Tyr; Domain location=9-202; Score=-150.4; E_value=0.0031; Accession=PF07714.7; Description =Protein tyrosine kinase
  Pfam module annotation: Pfam domain module=Pkinase::Pkinase_Tyr; Domain location=15-179::9-202
MTSLVPRELHLAGRYRWSSIFDRELNKLVAIKVIDLEESEDEIDDIQKEISVLSQCRCPYITEYYGSYLNQTKLWIIMEYMAGGSVADLVEHYILILRASPGAAVKLCLGDLLVMGSNPETASLHMQGSNRVLPLMKCQLLAFYVTCCMLLIIYIVKEKFIETLKHLHVNYTAANILLSENGDVKVADFGVSAQLTRTISRRK

SEQ ID NO: 168779 - protein, 178 aa, Glycine max
  Coding DNA Sequence Number=SeqID_52001
  Gene Ontology: Mol. function=heat shock protein binding; Biological process=protein folding
  Pfam annotation: Domain name=DnaJ; Domain location=2-53; Score=-9.9; E_value=0.041; Accession=PF00226.21; Description=DnaJ domain
MNITSQDILTLFTLQVYDGRGTLEEGETAEARFIKIQSAYELLIDRERRRQYDMDSRVNPMKASQAWMEWLIKKRKAFDQRGDMAIAAWAEQQQRELNLRVRRLSRSKIDPDEARRILAREKKASAEYYSNTLKRHTLILKKRDLMRRKSEEEKKKTINRLLAAEGLELDDSDSDDAL

SEQ ID NO: 168780 - protein, 745 aa, Glycine max
  Coding DNA Sequence Number=SeqID_52002
  Gene Ontology: Mol. function=protein disulfide oxidoreductase activity; Biological process=intracellular signaling cascade
  Homolog annotation: Hit_ID=Q67UI1; Match level="QueryCoverage=92%, HitCoverage=99%, E-value=0.0, Identity=56%"; Hit description =Glutaredoxin-related-like protein
  Pfam annotation: Domain name=DEP; Domain location=396-467; Score =43.4; E_value=7.9e-10; Accession=PF00610.11; Description=Domain found in Dishevelled, Egl-10, and Pleckstrin
  Pfam annotation: Domain name=DUF547; Domain location=534-673; Score =222.9; E_value=7.3e-64; Accession=PF04784.5; Description=Protein of unknown function, DUF547
  Pfam annotation: Domain name=Glutaredoxin; Domain location=279-338; Score=42.8; E_value=1.2e-09; Accession=PF00462.14; Description =Glutaredoxin
  Pfam module annotation: Pfam domain module=DEP::DUF547::Glutaredoxin; Domain location=396-467::534-673::279-338
MENQQLVETNGAGFQAVENLRVDDLELDQDKQSKEAKAEKIGHEDDKLDDISDQINDGEDARSNTKDESGNLQSGTQPENLETKSETEVSTDKREYSGDKMGAGGDLEPKNQETNIDNNSGQIDLAKEVADRESTQIFDKSDEIPSEDHNLEPVFDGTEVPGMEANRSMSGRRLNDQDSPGVVEKAVALKNFVKEKSAVAVSTMMRRLSGKRDEGTEDNADDEGKDVSDIPKVGETKVVSDKAVEKFDWNPLHYIKKSSDVGVENKTEQGDSIAMKGRIILYTKLGCQESKAIRLFLRMKRLRYVEINIDVFPGRKVELEKISGSASVPKVFFNEILIGGWNELKNLDESGKLDEKVDFLITEAPLFEAPSPPLSGEDDVSSSGPLDELAIIVRKMKESIAVKDRLYKMRRFTNSFLSSEAIDFLSEDQYLERPEAVEFAQKLADKLFFQNVLDEDIFEDGNHLYRFLDDDPTVVSQCHNITRGIITLKLKPLAEIASRLRFLSRAMFEAYVYEDGRRIDYTSIHGSEEFARYLRIVEELQRVEISDSSREEKLAFFINLYNMMAIHAILVLGHPDGALERRKLFGEFKYVIGGSTYSLSAIQNGILRGNQRPPYNLKKPFGVKDKRLTVALPYPEPLIHFALVYGTRSGPALRCYSPGNIDEELLDAARNFLRNGGIAVDLTAKAVNASKILKWYSIDFGKNEVEVIKHVSNYLDSADSEVLLDLLATSELKVTYQPYDWGLNC

SEQ ID NO: 168781 - protein, 57 aa, Glycine max
  Coding DNA Sequence Number=SeqID_52003
  Homolog annotation: Hit_ID=Q1SP60; Match level="QueryCoverage=65%, HitCoverage=11%, E-value=2e-12, Identity=94%"; Hit description=MPPN
MEVIYILEEDSKVSKLPRTVEGVVQPGALITLPSPLEVARPEVQRNSLPAGNLNEEE

SEQ ID NO: 168782 - protein, 51 aa, Glycine max
  Coding DNA Sequence Number=SeqID_52004
MDILWETIDNSLKGCKWIAMENSHGHTNVVERTEEGVNFVSENHYKERGGG

SEQ ID NO: 168783 - protein, 120 aa, Glycine max
  Coding DNA Sequence Number=SeqID_52005
  Gene Ontology: Mol. function=phosphoric monoester hydrolase activity; Biological process=protein amino acid dephosphorylation
  Homolog annotation: Hit_ID=O82687; Match level="QueryCoverage=50%, HitCoverage=18%, E-value=2e-14, Identity=65%"; Hit description =Tyrosine phosphatase 1
MDSKDSPFQPKSNPRRDRRDRDSSRLCERGKPENSKILTSITMMVSMGANMQMCELLSDQVRIVELLLQKAVGLGALIDLIQSEGDSRRVIGGEIEFQILGRQFGRGGSCKVVSHGGSLA

SEQ ID NO: 168784 - protein, 62 aa, Glycine max
  Coding DNA Sequence Number=SeqID_52006
  Subcellular localization annotation: CTP_CleavageSite=36; ConfidenceScore=5.20e-01
MGSAISKVGNANSSSPTKNFAYKTSLESASVGHHVVAGYSSGHCLVAATGLDVAGEVVDVDE

SEQ ID NO: 168785 - protein, 146 aa, Glycine max
  Coding DNA Sequence Number=SeqID_52007
MCTFEYVLPRLCGLCCLRLLELPVTVKSLLLPNFLCIGHNIITEMKLVLIELEMMIGLKKKLILKIKNILETREKWGHKNISMSVKEKLEVVNLDVGHVDVSNVASSIRNCDIKNPSLKKKKWVLLPSDSNIPTNRPRRIIKRLCL

SEQ ID NO: 168786 - protein, 77 aa, Glycine max
  Coding DNA Sequence Number=SeqID_52008
MVAKKSCTHRALEVEVVRIWGRDGMVVMGWGGGTIRVLRATRYDWRCMHDAMMLGGGQQCYLVHGVREMGSRRGKGC

SEQ ID NO: 168787 - protein, 40 aa, Glycine max
  Coding DNA Sequence Number=SeqID_52009
MTKEKKPFSAKKFAQASCSSLRRVCDLVLKAPIRPGELLA

SEQ ID NO: 168788 - protein, 61 aa, Glycine max
  Coding DNA Sequence Number=SeqID_52010
MTIGTLAKSPNRIPFPVQLGKWLDDWVVVGNGGRESCWRIGQGTVVRLQQRNMENKPVLKI

SEQ ID NO: 168789 - protein, 165 aa, Glycine max
  Coding DNA Sequence Number=SeqID_52011
MASRKRARAEDIPSSSNPPPPTATMEPDAQHAPPIIPMLQSLFRGQLVIVYNQQQLAHNRPIVSMEKFLDKVARPEAQLPLGRAPEVVPPSPIPTRTKPALAESQPPVVEPPASLEVEILSPSPTPRAPPLILIPDDSDAEAAAPPDSPAYYLEDGSDFSDWMDY

SEQ ID NO: 168790 - protein, 69 aa, Glycine max
  Coding DNA Sequence Number=SeqID_52012
NKLKRLLKRLALTDPLKLLQEYNKGKGNFTKEKKHRVVTMVELNMRYPSHEKKHRLVTMLECDEHDARP

SEQ ID NO: 168791 - protein, 528 aa, Glycine max
  Coding DNA Sequence Number=SeqID_52013
  Gene Ontology: Mol. function=chromatin binding; Cellular component =chromatin; Biological process=regulation of transcription, DNA -dependent
  Homolog annotation: Hit_ID=Q946J8; Match level="QueryCoverage=54%, HitCoverage=69%, E-value=1e-16, Identity=28%"; Hit description =Protein LIKE HETEROCHROMATIN PROTEIN1
MKGGGGKRKASTSEAPNDVVVVVAAASAPSDDADLGVGDVGGVKVQNFEGNEGTQLRNTEEQEEEPHHVEGDEGGEDEEDYAEGEEEYEEENGGAVAGGQQGFPALGENFFEVEAIRRKRLRKEWVARDSQHLGASGKSRSLKSGKHRKRKRKHVVHHTQPKKRLERSTTPYSLRRFSTSTAENHTQSAPPLNDPSLPDIPAFPHTVLFSDDVGNGAEGSSLRKATPSNANRSANGSEQNIKRNEENDYDPVLSELKAMTSNGNDADRLAIRIPEAKGSGPSGSNGQMDAKSKGACMETSESDRCRGSKRRKCGSVKRFKKELYANEPANAENPVSMPVGTAEPERTRDAGSGGNTNHARPASNIVNIVKPVGYSASVASGMQDVLVTFVASKKSSLSILGSLLLMTCIVVSLIENWFDEGNNLVLGGRKNRCSKESKSELERKGRLNLKSTLWRQWAISKSQACMILSPLYIDELIDSSDPRSRLKGLELATLPVKVSNKLTTKLVCCFCQSMELRSFDLPLSIFKV

SEQ ID NO: 168792 - protein, 316 aa, Glycine max
  Coding DNA Sequence Number=SeqID_52014
  Gene Ontology: Mol. function=chromatin binding; Cellular component =chromatin; Biological process=chromatin assembly or disassembly
  Homolog annotation: Hit_ID=Q1SAV4; Match level="QueryCoverage=93%, HitCoverage=75%, E-value=1e-105, Identity=59%"; Hit description =Integrase, catalytic region
  Pfam annotation: Domain name=rve; Domain location=52-208; Score=87.4; E_value=4.3e-23; Accession=PF00665.16; Description=Integrase core domain
MGDTNTLRRLKDQFFWDNMSRDVHQLISECRVCQQTKTECRKPAGLLQPLPIPTGIWEDLSMDFVTGLPPFHGFTTILVVVDRFSRGTHLGALPPKYSAHKVAGLFIDIVCKLHGFPRSLVSDIDLLFLNAFWRELFPISGTKLRYSTAYHPESDGQIEVLNRTLEQYLRSFVHDRPALWFSFLSLAEWNNNTSTHSGTGLSPYEVTYGKPPPTLPQYIPGTSCIEAADSIITTKQAVHSKLQQRLLKAQTLMKTYVDRHRWDVQFQVGDWVYVRLRPYRQLSLRPHYSKLAKRFYGPYLVVEKIGTVAYRLQLSV

SEQ ID NO: 168793 - protein, 320 aa, Glycine max
  Coding DNA Sequence Number=SeqID_52015
  Gene Ontology: Mol. function=RNA-directed DNA polymerase activity; Cellular component=chromatin; Biological process=chromatin assembly or disassembly
  Pfam annotation: Domain name=RVP_2; Domain location=30-155; Score= -40.2; E_value=0.0014; Accession=PF08284.2; Description=Retroviral aspartyl protease
DDVEVSPSPAPPDSPFFPIDSLPPSPTADNPPHLSLNAMSGMPAPKTFRVYGTIHGHHFTILVDGGSTHNFVQLRIAKFLGLPSTPIQPLPVMVGDGGVIDCNLRFPQVSITIQGHHFINDLFGLDLHGADLVLGVQWLRELGPVTIDYTSLSMHFTHMGLLVQLIADIPAISTLFHIHPTPPSSSPLHTSPTLLEDEHLPPPEFTNLLSQFHHLFREPTTLPPAWPISHHIHLAPDSKPITVKPYHYPYSQKTELEKQVQSMLDSGLIRLSHNPFSSPVLLVKKKDGSWRCCIDYCALNAITIKHKFPMPTIDELLDEL

SEQ ID NO: 168794 - protein, 86 aa, Glycine max
  Coding DNA Sequence Number=SeqID_52016
MTNSSSSSTKEWFLWGVVVDLLHLRMVLWEEEEEEGAGAEVETMVMEEDVTSDLKEEEQEEEEGAHIWRGKVIESKKRGIQRVRKE

SEQ ID NO: 168795 - protein, 302 aa, Glycine max
  Coding DNA Sequence Number=SeqID_52017
  Gene Ontology: Mol. function=calmodulin binding; Cellular component =integral to membrane; Biological process=response to biotic stimulus
  Homolog annotation: Hit_ID=O49621; Match level="QueryCoverage=96%, HitCoverage=59%, E-value=1e-128, Identity=71%"; Hit description=MLO -like protein 1
  Pfam annotation: Domain name=Mlo; Domain location=1-292; Score=376.4; E_value=4.3e-110; Accession=PF03094.6; Description=Mlo family
LEPTVTHVHHHAFIQNRFTGLGKDSAVLGWVKSFFKQFYGSVTKLDYVTLRLGFIMTHCKGNPKFNFHKYMIRTLEDDFKKVVGISWYLWIFVVIFMLLNVHGWHAYFWISFIPLILLLAVGTKLEHVIIQLAHEVAEKHSAIEGELVVQPRDDHFWFNRPHIVLFLIHFILFQNAFEIAFFFWIWVTYGFDSCIMGRVRYIVPRLIIGVFIQLLCSYSTLPLYAIVTQMGTHFKKAIFDEQVQARLVGWAQKAKKKGQRGDNSLSGQESSRAGAGIQLGSVFRRESASEDNVIVPRNDGSE

SEQ ID NO: 168796 - protein, 212 aa, Glycine max
  Coding DNA Sequence Number=SeqID_52018
  Gene Ontology: Mol. function=RNA-directed DNA polymerase activity; Biological process=RNA-dependent DNA replication
  Subcellular localization annotation: CTP_CleavageSite=44; ConfidenceScore=5.37e-01
MVSSDKRPFSGYDFTLGSLWVLFLTRKAPSTNPSCLISLLCSCACSTFTNFARVILDKFLEFSRDAIVASNFLERDIRKDSWNLICDLVADTSLPWLIFGDFNDFVSNDEKIGWVNHPSWLLRGFHETILECNLHSLPMEGYQFTWARRLGECDGVEGKLDRDLATLEWIDLFLNFRLLSGLSSKFYHTPIILNLDGIHRRGFKMHFCFENA

SEQ ID NO: 168797 - protein, 240 aa, Glycine max
  Coding DNA Sequence Number=SeqID_52019
  Gene Ontology: Mol. function=calmodulin binding; Cellular component =integral to membrane; Biological process=response to biotic stimulus
  Homolog annotation: Hit_ID=O49621; Match level="QueryCoverage=89%, HitCoverage=39%, E-value=3e-46, Identity=48%"; Hit description=MLO -like protein 1
  Pfam annotation: Domain name=Mlo; Domain location=6-239; Score=-31.4; E_value=6.7e-17; Accession=PF03094.6; Description=Mlo family
MGGGGEEGNNLEFTPTWVVAVVCSVIVAASFAAERFLHYGGKFLKRKNQKPLYEALQKIKEELMLLGFISLLLTITQNGIIRICVPVGWTHHMLPCSLKDKEKEESTKTTSHFQTFFSFSDISGTARRLLAESESENEDHQPATGEKLCARKGKVPLLSVEALHHLHTFIFVLAVAHVTFCVLTVVFGGLKIREWKHWEDSIGNDNKNETQPAFGSHQTLSLSTHHDPVGQISVSVIANF

SEQ ID NO: 168798 - protein, 162 aa, Glycine max
  Coding DNA Sequence Number=SeqID_52020
  Gene Ontology: Mol. function=ribonuclease H activity; Cellular component=mitochondrion; Biological process=DNA integration
MVGCDPKGTFSVGAKLSRSRIFFGFLSDSPYEVASLFVDDSPPSMGIMVFVPYAFRLVKSSTQGPENDSISCLCMSVSLRMFNRGDKVLDPYPCQEVFVSLSFELSVVVGDDSIWEVVLGDKYLIMTSKYFTAPRAFGSSPSMSIPHMAKGQAPHGEGPRGA

SEQ ID NO: 168799 - protein, 110 aa, Glycine max
  Coding DNA Sequence Number=SeqID_52021
MVFVCKRIEAGLKRGKFDHPTLISEKAGANEEDENEGETHAATVIPYMAKLPTSPTMSLLNQYQLFSLPTTQSSTKAIPKSITKPVYRTPNAQTLPLAKTKKEFCSKTLV

SEQ ID NO: 168800 - protein, 104 aa, Glycine max
  Coding DNA Sequence Number=SeqID_52022
  Gene Ontology: Mol. function=ATP binding; Cellular component =mitochondrion
  Homolog annotation: Hit_ID=Q2L949; Match level="QueryCoverage=85%, HitCoverage=5%, E-value=3e-27, Identity=63%"; Hit description =Protein ycf2
MESIPNIYTMVPYLDREFFYSILFLLLVAGYLVRTHLLFVSRVYSELQTEFEKNLFLVALEQLGDSLEEIRSFAFGGNMLWGGVPLMGSNQYVLRRYICISSIS

SEQ ID NO: 168801 - protein, 79 aa, Glycine max
  Coding DNA Sequence Number=SeqID_52023
MGLGVYEKKRAPCEEHFSHHKHYITNSNGGDVRKCVLNLVSKLRDDPTVNEYGIIVLLGQVGYPRNIGFFSPCILGHLD

SEQ ID NO: 168802 - protein, 430 aa, Glycine max
  Coding DNA Sequence Number=SeqID_52024
  Gene Ontology: Mol. function=hydrolase activity; Biological process =aromatic compound metabolic process
  Homolog annotation: Hit_ID=Q3KE08; Match level="QueryCoverage=76%, HitCoverage=96%, E-value=1e-118, Identity=61%"; Hit description =Alpha/beta hydrolase fold precursor
  Pfam annotation: Domain name=Abhydrolase_1; Domain location=86-327; Score=46.5; E_value=9.2e-11; Accession=PF00561.10; Description =alphabeta hydrolase fold
  Pfam annotation: Domain name=Response_reg; Domain location=332-430; Score=93.0; E_value=9.2e-25; Accession=PF00072.14; Description =Response regulator receiver domain
  Pfam module annotation: Pfam domain module=Abhydrolase_1::Response _reg; Domain location=86-327::332-430
MFSKLAYSTLALTVSLGTVMSCQAEVTGTNFAAAFDHPQQINAGDLNVGYVDIGPKEGQPVILLHGWPYDIHSYAEVAPALAAKGYRVIVPSLRGYGTTRFLSAKTPRNGQPSAMAKDIVNLMDALNIRQAVFAGYDWGARTADIVAALWPERVKSLVSVSGYLISSQQIGKQPLPPKAEQQWWYQFYFATARGAQGYAKNTHDFARLIWSQASPDWKFSDAVFNASAKSLDNPDHVAVTLSNYRWRLGLEKGERKYDSYERKLAALPNITVPTITIEGGNNGAPHPAPQAYASKFTGKYEHRTFGATVGHNPPQEDPKDFVKAESSVEHIDHILVVDDDRDIRELIVDYLGKSGYRATGAANGKEMRAVLDKQHIDLVVLDVMMPGDDGLTLCRQLRSGKHKDLPILMLTARNEETDRILGLEMGADDY

SEQ ID NO: 168803 - protein, 63 aa, Glycine max
  Coding DNA Sequence Number=SeqID_52025
MPSFRDLEQKWAPKVEALLGNNGGGRKEEEGCLCHMSPFEWSKKGPLSLLIVTHTQPQKVRKI

SEQ ID NO: 168804 - protein, 105 aa, Glycine max
  Coding DNA Sequence Number=SeqID_52026
MHERQSMHEATNKSGEWRIVLGNHFAWLQTHWWRMHERQSIHGPPNKSGEWRMALGNHFAWFQTHWWRMHERQSMHGAPNKSGEWRIVLGNHFAWLQTHWWRMHE

SEQ ID NO: 168805 - protein, 242 aa, Glycine max
  Coding DNA Sequence Number=SeqID_52027
  Gene Ontology: Mol. function=ligase activity, forming carbon-nitrogen bonds; Biological process=tRNA processing
  Homolog annotation: Hit_ID=Q82VP4; Match level="QueryCoverage=99%, HitCoverage=46%, E-value=2e-16, Identity=27%"; Hit description =tRNA(Ile)-lysidine synthase (EC 6.3.4.-) (tRNA(Ile)-lysidine synthetase) (tRNA(Ile)-2-lysyl-cytidine synthase)
  Pfam annotation: Domain name=DUF1946; Domain location=2-235; Score =60.3; E_value=6.4e-15; Accession=PF09179.1; Description=Domain of unkown function (DUF1946)
MQDLQVCDVREEWLGQSLDISRLKALGDVRAKNLLRGWFQQLNLRMPNTEQLFEYWQQLSSVKPHRYLHLPLQGQTQSHRAYLHHYQQRLYCVGKPNALPQTPLIWQGHQSQIWGDWQVQFKVSKARGIALARLGISPAAITLNKRYGQPIPLPEGVELLLMPRSGGEALQPDAKRPRRELKVIFQMLAVPPWQRAFYPVVQVKTNQTISSPSLVGLAGLAVDHSWRPGRNAYGLEIFLTPL

SEQ ID NO: 168806 - protein, 363 aa, Glycine max
  Coding DNA Sequence Number=SeqID_52028
  Homolog annotation: Hit_ID=Q1M950; Match level="QueryCoverage=44%, HitCoverage=57%, E-value=3e-62, Identity=72%"; Hit description =Conserved hypothetical BtpA-family protein
  Pfam annotation: Domain name=BtpA; Domain location=1-166; Score=4.5; E_value=2.1e-12; Accession=PF03437.5; Description=BtpA family
  Pfam annotation: Domain name=TENA_THI-4; Domain location=154-359; Score=29.6; E_value=3.9e-06; Accession=PF03070.6; Description =TENATHI-4 family
  Pfam module annotation: Pfam domain module=BtpA::TENA_THI-4; Domain location=1-166::154-359
MRHPGNCTALAGGADFVRVNQWANAYIANEGFIEGAAAKALRYRNQLRADHIRVFADSHVKHGSHAIVADRSIQELTRDVDFFEADAVIATGQRTGDSATLSEIDEIRAATALPLLVGSGVTPDNVCQILGRTQGVIVASTLKVDGVWWNPVELARVKHFMAAMQQHRFVVDIEHDRLPASVFNRYLVFEGNFVATAIAIFALAVSKAPGIRQQRWLIGVLNALVDTQIAWFEAVLARRGIQPADYPDDLPGVSGFRDGMLKVAQQGSYAEIITLMFGAEWMYYHWCLRVSAQSQQDADVRRWVEMHAEDEFHQQAQWLKTELDQCALTLSAAQQAQLSQLYARVLQWEIDFHSAAYPESAHD

SEQ ID NO: 168807 - protein, 103 aa, Glycine max
  Coding DNA Sequence Number=SeqID_52029
  Subcellular localization annotation: CTP_CleavageSite=52; ConfidenceScore=5.10e-01
MNCLFVHVSSTFEFGAMRSDCLVQFSIVNRFGAHALRFSVMWSSTLEFGAMRSDYLGGNSPFSSLFRSPMNCVFVHVSSTFVFGAMRSDCLVQFSILNLFRAP

SEQ ID NO: 168808 - protein, 754 aa, Glycine max
  Coding DNA Sequence Number=SeqID_52030
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=71%, E-value=1e-171, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=153-268; Score=0.9; E_value=0.005; Accession=PF00665.16; Description=Integrase core domain
  Pfam module annotation: Pfam domain module=RVT_2::rve; Domain location=432-661::153-268
IEEEWWYLDTGCSNHMTGHKDWFCEIDETVKRNIKFGDGRSIMAKGIGKVAIRRVDGSKVTISDVQYVPNMESNLLSLRQLLEKGFSMHMEGEHMEVVDSNGKYVLKVVVSKNRTFKVGVSTIKQKCLTAQSNDSVWKWHRRLGHLNFNNLNKLQKKNMVVGLPSIEVPRQVCGRCCEGKQPRKAYNAAIPTRAKEKLAVIHSDMLRTDGGGEYTSLEFENFCKEEGIIHEKHLPHDFWAEAVFTTTHILNRCPTKRLDSLTPKEAWSGLKPSVKHFKVFGSLCYRHVPEQNRRKLDAMAQTLILVGYHSTGAYKLFDPLSKKIVISNDVIVDETKEWDWNIGMERQTNETVEVELEGEEIQDEVQIDNEQYVNDELGSLRQITPPVRFQDYDVFPDAAINVNGELMNLVLLAEAEPVSLEEALAIPHWRKAMEEELRSIQKHYTWEMVNLPSNKKAIEVKWVFKTKVKPSGEIAKYKAKLVAKGFLQKLGLDFNEVYAPVARIETVRLIVAIASMRKWTVSQLDVKSAFLNGPLEEEVYTRQPPDYEKIDMEDKKQKFLKCTTEHGVYLKDCGVTGVVMLCLYVDDHLVTGDSKQEIDMFKKEMMDEFEISDIGIITYFLGIKLSTGEDTNLVDSTLYRQLIGSLRYLCNSRSDITYEVGLVSRFMKKPCKDHLLAAKRILRYIGVEMLVIERAHPTEYISAAFGASQALWLGMLLEELNIKCSNVMKLRIDNKSAIDLAKHPITHGHNKHIE

SEQ ID NO: 168809 - protein, 360 aa, Glycine max
  Coding DNA Sequence Number=SeqID_52031
  Homolog annotation: Hit_ID=Q1SDS1; Match level="QueryCoverage=73%, HitCoverage=54%, E-value=1e-13, Identity=30%"; Hit description=IMP dehydrogenase/GMP reductase
MGVQIATRPIWAFQEVLQKVPSGGSNLTRLGELGGKLLPYFPINRGRREEQKCSTLLVSEIHLKLVRKIVFVKKKSKPRRFCNASVTFPWVISRRFRQGVRRAVRGLFAVLQLFMYGWFRTLFRQEVRHACPLESHRSCTEKGGANWDQLLVSKEGASVNCFPRWKEGRTGVLISCGGFPNVPLMGTRGCISYNLVLAIRQLGYPMREAPLEDELAPVISRGFNKTNMETLQKVHKAWEVLRKKDKELRGSNNGPISGCRKWLKVHMHGLDWLPSLRTTKRKEVEAPEEDKEVQALWAELEQAQTVKEKFESAALKIRKENTELRDVNVATTKALERETKRACREELGRKQFRGALWGSN

SEQ ID NO: 168810 - protein, 217 aa, Glycine max
  Coding DNA Sequence Number=SeqID_52032
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=98%, E-value=2e-18, Identity=31%"; Hit description =UPI00006A17C9 related cluster
LHVLALRGLHVLTIRGLHALTSRGLHVLALRGLHALTLGLHVLALRGLRVLTIRGLHALTSRGLYVLALRGLHALTLGTSYPHRQWTTRPRLERTTRPHHQRAARPHLQRTISPRLERATRPHLGGLHVLTLRGLNVLALRGLHVLTIRGLHALTSRGLHVLALRGLLALALGLHALTLRGLHVLTIRGLHALTSRGLHVLALRGLHALTLGTGYPH

SEQ ID NO: 168811 - protein, 425 aa, Glycine max
  Coding DNA Sequence Number=SeqID_52033
  Gene Ontology: Mol. function=transporter activity; Cellular component= membrane; Biological process=transport
  Homolog annotation: Hit_ID=Q0K423; Match level="QueryCoverage=55%, HitCoverage=99%, E-value=2e-65, Identity=61%"; Hit description=ABC -type transporter, permease component: POPT family
TLALPDWDPSHIIAVAAKLSGSDAAHWQQGQAKLKALIPNIKSFYTDDANSQQLISTGETPVQVMLSMNAYSMIAEGVNIKLAIPKEGAILGVDTVGINKGSKHADLAYKFINIALKPEIQQQVAKIYRGSPTVTNAHIDPELAKLPGMLTTPAQWNATINTDPQLRAEKTAEWPGNTYAGSNVHDEKTDIFTLVHSSRHADRDGAGRRDVCGDAVQRACIHPRLAGCRRLYAGQFQWPVQTHLWRRVSQYRAAQCQNGPVWFADELPTGLCAGAHPHCVDQIHHSDHRDYSAVSGGSGAHLFVDYRAGQPIQFMFTQTGVVVALVHVTMPIMVLMLATALSHINPDYEKAATSLGAGPRFRDAPTDWRRARQYRGYAGVSAGLLLDELPVCRSAEHCWPAADHSAAAGAEAHDALPARHGRALI

SEQ ID NO: 168812 - protein, 47 aa, Glycine max
  Coding DNA Sequence Number=SeqID_52034
  Homolog annotation: Hit_ID=O64438; Match level="QueryCoverage=76%, HitCoverage=15%, E-value=1e-13, Identity=91%"; Hit description=ARG10
CFYSTAVGGLRCYENPKNKITTVPAKEEEIWGALFKVILELKKLELN

SEQ ID NO: 168813 - protein, 85 aa, Glycine max
  Coding DNA Sequence Number=SeqID_52035
  Homolog annotation: Hit_ID=Q1SWX1; Match level="QueryCoverage=73%, HitCoverage=12%, E-value=8e-08, Identity=38%"; Hit description=IMP dehydrogenase/GMP reductase
MGQLQRQAFRKAYGKIWDLTMVEVSTEAIASLAQYYDQPLRCFTFGDFQLLPTVEEFEEILGCPLGGRKSYLSQASIPPWLESPK

SEQ ID NO: 168814 - protein, 68 aa, Glycine max
  Coding DNA Sequence Number=SeqID_52036
  Subcellular localization annotation: CTP_CleavageSite=24; ConfidenceScore=5.01e-01
MSPPPLEPHNHSQTHLKLSGRLPLQSPFSGGLRTAKSLKTLWHFAPGIRMTIIIYGVALKILAHLDIV

SEQ ID NO: 168815 - protein, 75 aa, Glycine max
  Coding DNA Sequence Number=SeqID_52037
  Homolog annotation: Hit_ID=Q9SD67; Match level="QueryCoverage=55%, HitCoverage=5%, E-value=9e-12, Identity=80%"; Hit description=FtsH metalloprotease-like protein
GIEEKTAKLKGSEKALVARHEASHAVVGTAVANLLAGQPHVEVWTLEYLILEFIDLVLWWEIKEKYKSVMCDIQR

SEQ ID NO: 168816 - protein, 70 aa, Glycine max
  Coding DNA Sequence Number=SeqID_52038
  Homolog annotation: Hit_ID=Q9FN32; Match level="QueryCoverage=83%, HitCoverage=34%, E-value=6e-11, Identity=61%"; Hit description =Protein yippee-like At5g53940
MEKTDKMRRGESAHEKCQKYKEGKFVLESVYTNNAHPLCQYNRGRIVDEVDFSTEFYIDSHASMSDAEEP

SEQ ID NO: 168817 - protein, 58 aa, Glycine max
  Coding DNA Sequence Number=SeqID_52039
MAGVGRYMAPTDILQPTLHNFFYKRWPIMCFYGRGSRLGFSVRPQPRLWFDRHWHVLI

SEQ ID NO: 168818 - protein, 362 aa, Glycine max
  Coding DNA Sequence Number=SeqID_52040
MCCVQDSLEEQASQEHPGRVRAAGAGVTIKQYFGLAERTSHTSSSITPEELEQLTQQIRDQLEESITKKMTRQLMLSFIQMQSQLQSQIQSQGLALPPEPEVGPSATCVSTKGSCIDPSATDPDTGDSDKCRLYIEENPPRLVKDTDAPIHVPTNKGAMGPAKPTDRPDLEVMWDASLFGLFNLDFPLYIKHEDLSEITHGGQCLNISVIQLWILHLTETSMRLGNSDVYGFLEPQCIQKSLQSQFESESYIKNWMQSSKWDVYLGAYLNGAHWQMVIILPKENLVVRFCSLHNRPDNYLKGIINSALKELNDTPQPKSKAAGAKWIVVKCNKQKGSTECGYYVMHWMSTIILGSFRNNWEM

SEQ ID NO: 168819 - protein, 178 aa, Glycine max
  Coding DNA Sequence Number=SeqID_52041
  Homolog annotation: Hit_ID=Q1SDS1; Match level="QueryCoverage=65%, HitCoverage=23%, E-value=4e-09, Identity=33%"; Hit description=IMP dehydrogenase/GMP reductase
MVEASVNWFPRWKEGRVGVLSSCEGFSNIPLMGTRGCINYNLVLAIRQLGYPMRGALSEESIMPFIARGFSDPKARIFQGVRKAWSVVKRKDKELRGSSNGIIGSYHKWLKARTQELVWLPKLKASSEEEAETPEESKEVQALKAELERAQAIKEKFKMIAIKVWKEYDELRDINVAT

SEQ ID NO: 168820 - protein, 550 aa, Glycine max
  Coding DNA Sequence Number=SeqID_52042
  Gene Ontology: Mol. function=binding; Cellular component=membrane; Biological process=protein folding
  Homolog annotation: Hit_ID=Q00Z58; Match level="QueryCoverage=73%, HitCoverage=85%, E-value=8e-31, Identity=27%"; Hit description=[O] KOG0546 HSP90 co-chaperone CPR7/Cyclophilin
  Pfam annotation: Domain name=TPR_1; Domain location=148-181; Score =33.1; E_value=9.7e-07; Accession=PF00515.18; Description =Tetratricopeptide repeat
  Pfam annotation: Domain name=TPR_1; Domain location=71-104; Score =4.9; E_value=1.4; Accession=PF00515.18; Description=Tetratricopeptide repeat
  Pfam annotation: Domain name=TPR_2; Domain location=148-181; Score =23.5; E_value=0.00078; Accession=PF07719.7; Description =Tetratricopeptide repeat
  Pfam annotation: Domain name=TPR_2; Domain location=71-104; Score =11.2; E_value=1.7; Accession=PF07719.7; Description=Tetratricopeptide repeat
  Pfam module annotation: Pfam domain module=TPR_1::TPR_1::TPR_2::TPR _2; Domain location=148-181::71-104::148-181::71-104
MMSNPELMRMASESMKNMSAEDFKLAAEQLKHTRPEEMAEIGEKVANASPEEVAAMRSRVDAQIKYQLSAAEMLKKQGNDLHNQGRYNDALKKYMLAKENIKEVPSFQSRKLLLACSLNLMSCYLKTSQYNECIKEGSEVLAYDAKNLKALYRRGQAYKELGLLKDAVSDLSMALEVSPDDDTITELLRDTKEKLAMEGGEHAPRRIVTEEITEVEDVPSGSSLKQSVVQLKKSGDSSKSYSTANNGIPKTKTDSLDALKKDPEAVRSFQNFISNTDPATLASLNAGQFKDVSPDMIKTTSDMVSKMSPEELQRMLDMASSFQGDNPIFRGGSPDSSFNPGSMPPNVTPDMFKAASDMISKMPADDLKRMFEMASSLKGKESTPLAAAVDENERNVSRSNLPSSSTNGTTAFGESSSHNVFSNMRNASQSNFPSSSANLQEQMRNQMKDPAMRKMFTSMVKNMSPEMMANMGEQFGVKLSPEEAAKAQQAMSSLSPESLDKMMLWADRIQRGVESARKTKNWLLGKPGMIFAILMLILAVILHRLGFIGG

SEQ ID NO: 168821 - protein, 72 aa, Glycine max
  Coding DNA Sequence Number=SeqID_52043
MDCDIIRCEIVNMSFSCDKGEGLYLNQEGKTLTDSSECRPWRWRKTLSKIAGSFTDHLIRKIFNILYGSPDP

SEQ ID NO: 168822 - protein, 123 aa, Glycine max
  Coding DNA Sequence Number=SeqID_52044
MNDKQRYTGCSGQRGSRDLRELANGDYLAFSALIWRKEVHMPHFVIPDEPQIPLITVKAHNTYHVPFEHTPRRDINHDTVVEVFEDMRDFIDEEDFTPFKIAFYRGVCNEEIPWGQMVSSDKE

SEQ ID NO: 168823 - protein, 92 aa, Glycine max
  Coding DNA Sequence Number=SeqID_52045
  Homolog annotation: Hit_ID=Q5VMT5; Match level="QueryCoverage=95%, HitCoverage=6%, E-value=2e-10, Identity=41%"; Hit description =Putative Spo76 protein
MTTLQPKDEPFVSLRPRKEPTINWKISCNEVYQRSGQRIIGASSALIQVNSQAHVATRSLTIVLKNGFIYSNVDVKGDWSNSARHMVACCIL

SEQ ID NO: 168824 - protein, 153 aa, Glycine max
  Coding DNA Sequence Number=SeqID_52046
MAHQVMVRPQPAHGHRRRGVGEVAGGVAADCAAVCCCCPCTVVNLVVLAVYKLPKRLVKKAANKRRRRLPKKNSTDVVLLQPQRSSSVDALDFAVGPMFFEEFLKNEKESENEKGKEEEEEEEEEEEEEGLEMEMWARFAGTGFWRSESQRQP

SEQ ID NO: 168825 - protein, 561 aa, Glycine max
  Coding DNA Sequence Number=SeqID_52047
  Gene Ontology: Mol. function=DNA binding; Cellular component=beta -galactosidase complex; Biological process=DNA integration
  Homolog annotation: Hit_ID=Q1SKN1; Match level="QueryCoverage=78%, HitCoverage=43%, E-value=1e-60, Identity=44%"; Hit description =Integrase, catalytic region
MDFLIIHLLEEEEVVQLVLVEEIQHGYPPGHKYHKPQGPSTNNVNVVKDKNANSNVEQNQEAQGSDVKLTAQQYKALMTLLQQQGSSSHNSSHVNQIDTMIGSGHVLIGNVSSISCSMSKAAPYEKLYGHPYDITILRVFGCFCFPSTLSANRKKLDPRAATSVFLGFKSHTKGYVTFDLKIKAISVSRNVIFYEDCFPFNVQDSHDPITVLPIPISSFHDGIEFPTSTSSILPFVPPDFSPAAFTPTEIPQTFRKSERQIQRPGKYKDFHVSYLPSTVANHSTVEPKSYSEASKDPNWIQAMNVEIQALEANHTWTLTDLPPHKTANGCKWVYKIKHKLDGSIERYKARLVAKGYTQVEVARTSIGINLFQRKYALDILTDIGMLGSKPISTPSDYTTRLHQHSGSPFSAKDASSYTRLIARQQVASQILRYIKGSPGAGIFFSVDSFIQLKGFSDSEWAGCIDTTRFITGFAVYLGSSLISWKSKKQDTFSISSSEVEYIALASATCELQWLTFLLEEFKVIFHQPVVLYCDNKSTLHIATIPVFHERTKHIEIDCHII

SEQ ID NO: 168826 - protein, 279 aa, Glycine max
  Coding DNA Sequence Number=SeqID_52048
  Gene Ontology: Mol. function=carboxylesterase activity; Cellular component=nucleus; Biological process=metabolic process
  Homolog annotation: Hit_ID=Q0ZPV4; Match level="QueryCoverage=94%, HitCoverage=80%, E-value=1e-115, Identity=75%"; Hit description=CXE carboxylesterase
  Pfam annotation: Domain name=Abhydrolase_3; Domain location=28-253; Score=282.6; E_value=7.7e-82; Accession=PF07859.3; Description =alphabeta hydrolase fold
MSETSDSKATVLRLYKPADSTGSKLPVFFYFHGGGFCIGSRTWPNCQNYCFQLTSRLRAVVIAPDYRLAPENRLPSAIEDSLLAVKWLQTQALSNEPDPWLSYVADFSRVFISGDSAGGNIAHHLAARLGFGSPELTPVRVKGYVLLAPFFGGTIRTKLEAEGPKDAFLNLELIDRFWRLSVPVGETTDHPVVNPFGPYSESLEAINFDPILVVAGGSDLLKDRAEDYARRLKEWGKDIEYVEFEGQQHGFFTIDPNSEPSNKLMLIIKQFIEKHFGKV

SEQ ID NO: 168827 - protein, 95 aa, Glycine max
  Coding DNA Sequence Number=SeqID_52049
  Gene Ontology: Mol. function=carboxylesterase activity; Biological process=metabolic process
  Homolog annotation: Hit_ID=Q0ZPV4; Match level="QueryCoverage=96%, HitCoverage=28%, E-value=3e-27, Identity=64%"; Hit description=CXE carboxylesterase
MRRYCRLCLPVGETTDNPLVNPFGPNSKSLEATKLDPILVVAAGSLFKDMTENCARRLKEWGKDVEYVEFEGQQHGFFTNDPNSELSNKLMLVVK

SEQ ID NO: 168828 - protein, 404 aa, Glycine max
  Coding DNA Sequence Number=SeqID_52050
  Gene Ontology: Mol. function=chromatin binding; Cellular component =chromatin; Biological process=chromatin assembly or disassembly
  Homolog annotation: Hit_ID=Q1SAV4; Match level="QueryCoverage=87%, HitCoverage=89%, E-value=1e-122, Identity=59%"; Hit description =Integrase, catalytic region
  Pfam annotation: Domain name=rve; Domain location=1-154; Score=113.1; E_value=7.8e-31; Accession=PF00665.16; Description=Integrase core domain
GVWEDLSMDFITHLPTSNGFSVILVVVDRFSKGVHLGALASGFTAFKVANLFLDIVCKLHGFPKSIVSDRDPIFVSKFWTELFRLSGTRLRLSTAYHPQSDGQTEVMNRIIEQYLRCFVHDNPSSWFQYLTLAEWSYNTSIHSGSGLTPFEITYGKPPPTMVDYIPGATKNEAVQTMLETRQALHSKLKHKLQKAQDTMKKHADTKRDDVSFLEGQWVYVRLRPGRQTSLTGPLHPKLSKHFFGPFQILERIGPVAYRLLLPPESLIHPVFHCFLLRPHHGSPPATTYTWPLQVRDDQPLRRPLCFLDYKDDTATTPPTRMVLTQWEGEPPEDTSWEKWSDLCQAYHLEDKVVFGEDGSVSNAGNYNSDSEHLRHDTNPRPVRIRGAPARLRDYHVQYLPGTKG

SEQ ID NO: 168829 - protein, 311 aa, Glycine max
  Coding DNA Sequence Number=SeqID_52051
  Gene Ontology: Mol. function=nucleoside-triphosphatase activity; Cellular component=intracellular; Biological process=defense response
  Homolog annotation: Hit_ID=Q84N08; Match level="QueryCoverage=87%, HitCoverage=26%, E-value=2e-92, Identity=63%"; Hit description =Replication factor C 110 kDa subunit
  Pfam annotation: Domain name=RFC1; Domain location=24-187; Score =269.6; E_value=6.1e-78; Accession=PF08519.2; Description=Replication factor RFC1 C terminal dom
PSMAGKDDSGIKRMNLIARAAESIADGDIVNVQIRRYRQWQLSQTSSVATSIIPASLLHGQREILEQGERNFNRFGGWLGKNSTMGKNLRLLDDLHVHILASRESSSGRDTIRMEYLTLLLKQMTETLRTLPKAEAVQQVVEFMNTYSISQEDFDTIVELSKFKGHPNPLDGIQPAVKSALTKEYKEQSTSRVVRVADLITLPGVKKVPKKRIAAILEPAGEEVEKGEGDALDESEEENSSDTEELEGTTKGEKLQSELQSLNSKATQVQLELKGTGNSSSKKTSGGRGKGVSVSGKKVAQAPKTTAKRKR

SEQ ID NO: 168830 - protein, 441 aa, Glycine max
  Coding DNA Sequence Number=SeqID_52052
  Gene Ontology: Mol. function=transferase activity; Biological process= cell adhesion
  Homolog annotation: Hit_ID=Q9FT45; Match level="QueryCoverage=94%, HitCoverage=91%, E-value=1e-151, Identity=66%"; Hit description =Fasciclin-like arabinogalactan protein 15 precursor
  Pfam annotation: Domain name=Fasciclin; Domain location=273-406; Score=24.3; E_value=3.4e-05; Accession=PF02469.12; Description =Fasciclin domain
  Pfam annotation: Domain name=Fasciclin; Domain location=40-179; Score= 89.7; E_value=8.6e-24; Accession=PF02469.12; Description=Fasciclin domain
  Pfam module annotation: Pfam domain module=Fasciclin::Fasciclin; Domain location=273-406::40-179
MYFRIYGVTILLFLLPTLTFSLSQGQINSNSILVALLDSHYTEVAELVEKAMLLQTLENTVMNNNITIFAPRNEALERDLDPDFKRFLLEPRNLQSLQTLLLSHIVPKRIIKPEYLTGTGNPGRSNNPTRHRTLAPNHHLTLQSLNLTHWNVDSSRVMNPDSVTRPDGVIHGIDTLLIPRSVQDEFNRRRNLISIAAVKPEPSPEVDPRTHRLKKPAPASPAGSPPALPIYDAMAPGPSLAPAPAPGPGGPRHHFNGEKQVKDFIHTLLHYGGYNEMADILVNLTSLATEMGRLVSEGYVLTVLAPNDEAMAKLTTDQLSEPGSPEQIMYYHLIPEYQTEESMYNAVRRFGKVRYDTLRLPHKVTAQEADGSVKFGHGDTSAYLFDPDIYTDGRISVQGIDGVLFPPQEEDAGPVTRSKPAKVVVKQRRVKLGKKARITCV

SEQ ID NO: 168831 - protein, 123 aa, Glycine max
  Coding DNA Sequence Number=SeqID_52053
METTAVGPVFRRFEGEGEDDGVAGIANTNNLGFSSLEPGTLLQSNLIHNWMLSVYFFTFVNALLSVVVMRHLLSLGKEAISAMYGGCNRDESGVEATVFLGRWREVEQQMDKGPLPVVIENNW

SEQ ID NO: 168832 - protein, 956 aa, Glycine max
  Coding DNA Sequence Number=SeqID_52054
  Gene Ontology: Mol. function=RNA-directed DNA polymerase activity; Cellular component=chromatin; Biological process=chromatin assembly or disassembly
  Pfam annotation: Domain name=RVP_2; Domain location=325-457; Score= -33.6; E_value=0.00041; Accession=PF08284.2; Description=Retroviral aspartyl protease
  Pfam module annotation: Pfam domain module=RVP_2::RVT_1::Retrotrans _gag; Domain location=325-457::581-750::105-195
MADHETRKTTTDRLEDAIARLTNSQASINERCNDLTDKIDSILEHLHLQASENNNNTTHHQAHHHHRHAVKIDIPRFDGHDPLGWIFKVTQLFQYQHMPEEERITVASLYLDGPALSWYQWMHSNGLITSWNGFLQALESRFAPTFYDDPKGALFKLTQTGTVNDYLTEFERLANRVVGLPPPFLLSCFISGLKPDVRREVLALQPLSFLQASALAKLQEEKLRDRALTPARNSLPPRPFVPNTSNIPAKVKPPFVQRTPAEMAFWREKGLCYNCDEKWSVNHRCKGKVLLFITNEHSSLPETTTHDTEVSTATILETDSEPPSDVDSHISLHALAGVPSSDTFRIYGMIKHARLTFLVDSGSTHNFLQPRIAQFLKLSSQHTVPLQVMVGNGSMLTCDQVCPSTQLTLQGHPFVVSFHLLQISGADAVLGVDWLRRLGPFTTNYADSVMRFKHLGHDITLTADVSTKPESTSAAQLKRLLQIGSTSALYQLHVLPINQPDPPTQSHPLPAVDHLLLQHDHLFQNPSQLPPPHQIVHRITLKPNTSPITVRPYRYPHFQKNEIERQVSELLAAGLIRPSTSPYSSPVLLVGKKDSTWRLCIDYRALNSATIRDRFPIPTIDELLDELGQASWFSKLDLRQGFHQILMNEGDIEKTAFRTHHGHFEYLVIPFGLCNAPSTFQSAMNQLLRPFLRRFATVFFDDILVYSNSLALHLHHLELVFNTLNLAEFFLKRSKCLFAQNTIEYLGHIVSGKGVSPDPSKVQVMLQWPTPASVRELRAFLGLTGFYRKFVRDYASIAAPLTSLLCKDAFEWSPESQQAFDRLKRAMTSAPVLALPNFSEPFVVETDASGIAIGVVLLQQGHPLAYFSKCLGPRMLHASAYLRELHAVVAAVRKWRKYLLGRPFTILTDHKSLRELMTQVIQTPKQHYYLSKLLGYEYSIQYKTGATNIVADALSR

SEQ ID NO: 168833 - protein, 623 aa, Glycine max
  Coding DNA Sequence Number=SeqID_52055
  Gene Ontology: Mol. function=nucleoside-triphosphatase activity; Cellular component=intracellular; Biological process=defense response
  Homolog annotation: Hit_ID=Q9C587; Match level="QueryCoverage=87%, HitCoverage=56%, E-value=1e-149, Identity=54%"; Hit description =Replication factor C large subunit-like protein
  Pfam annotation: Domain name=AAA; Domain location=461-623; Score= -28.7; E_value=0.031; Accession=PF00004.19; Description=ATPase family associated with various cellular activities (AAA)
  Pfam annotation: Domain name=BRCT; Domain location=269-346; Score =81.0; E_value=3.8e-21; Accession=PF00533.16; Description=BRCA1 C Terminus (BRCT) domain
  Pfam annotation: Domain name=DEAD; Domain location=438-593; Score= -43.8; E_value=0.028; Accession=PF00270.19; Description=DEADDEAH box helicase
  Pfam module annotation: Pfam domain module=AAA::BRCT::DEAD; Domain location=461-623::269-346::438-593
MEVIIDKTIMGKFFATVVGANLHWDQRSQYLTVVSFYGVLTIRGFQRGSQHNTLVQLVGAKFSLFSRLNLNAQMSDIRKWFMKTHDKGNNAASSKPSNQPKPSSDKPQSEKTVAGGQESSGRRITSKYFNSNKQKGKDKKEMQELPAKRKNMKDSEEIPEPKKIHEDDGDDSVLPTNKKKLADTTPTKKLKSGSGRGLPQKSAVLEESDEDDDKDAVSAAKSAGRGDGGRGAPGRSTSGRGRGGGRGGFMNFGERKDPPHKGEKEVPEGAPDCLAGLTFVISGTLDSLEREEAEDLIKRHGGRVTGSVSKKTNYLLCDEDIGGRKSEKAKQLGTSFLTEDGLFDMIRGSKPAKAPSQEDKKPVNKAVAVASQSKVSPKSQVKVPLSSRSPSNQAKPKTATTVQSSLMWTEKYRPKDPKDIIGNQSLVLQLRNWLKAWNEHFLDTGNKKQGKKQNDSGLKKAVLLSGTPGIGKTTSATLVCQELGFQAIEVAIFLVKFIYLEKVNASDSRGKADSKIEKGISGSKTNSVKELVTNEAIGINMGRSKHYKSVLIMDEVDGMSAGDRGGVADLIASIKISKIPIICICNDRYSQKLKSLVNYCLLLSFRKPTKQQLVKTLGILSSP

SEQ ID NO: 168834 - protein, 43 aa, Glycine max
  Coding DNA Sequence Number=SeqID_52056
MGRNHWRRTLTWPPLGAKFTSMGTIVVIGVVASCVADHDIYQV

SEQ ID NO: 168835 - protein, 161 aa, Glycine max
  Coding DNA Sequence Number=SeqID_52057
  Gene Ontology: Mol. function=transition metal ion binding; Cellular component=cytoplasm; Biological process=DNA integration
MKRGSQTEQVDVEMRDRLEDMIRDLGQYFFIKHMPLSVLSLVNVKVRYRWSDKSFTSLLKAVEGMLPEENMLPKRYYGAKKTLCLMGMEYQKIHACPNDCIQYKDEFEEMHKYPKGGVSRYKVKDGDECSSDESIEKGPPTKELWYLPITPRFKRLFVNGG

SEQ ID NO: 168836 - protein, 272 aa, Glycine max
  Coding DNA Sequence Number=SeqID_52058
  Gene Ontology: Mol. function=transition metal ion binding; Cellular component=endoplasmic reticulum; Biological process=intracellular protein transport
  Homolog annotation: Hit_ID=Q9FH68; Match level="QueryCoverage=96%, HitCoverage=84%, E-value=2e-69, Identity=54%"; Hit description =Arabidopsis thaliana genomic DNA, chromosome 5, TAC clone:K16E1
  Pfam annotation: Domain name=Bap31; Domain location=84-243; Score= -53.6; E_value=0.00025; Accession=PF05529.2; Description=B-cell receptor-associated protein 31-like
  Pfam annotation: Domain name=HALZ; Domain location=222-263; Score =14.1; E_value=0.011; Accession=PF02183.8; Description=Homeobox associated leucine zipper
  Pfam module annotation: Pfam domain module=Bap31::HALZ; Domain location=84-243::222-263
MLQLLYTAIFSEMLLILTLVFKTPLRKLVIVSLDSVKRGRGPVVVSTVGATLMVVLASSLYSMAKIQQRTLEAGIVNPTDQVLMSKHMLEASLMGISQKPFFRFSSLNPSFLGFLEWFKVCLRKGDVNFGLELLQLHQQEPLPTVGFLLFLSLMIDRLHHYIRELRSLRKTMEAIKKQSRSFEDGKNGNSEEHKALNEEITTLKSKIKKLESECEAKGSQAKTLETEVEALKKQSEGFLMEYDRLLEDNQSLRSQLQAIDQSPLNFDNKKSM

SEQ ID NO: 168837 - protein, 77 aa, Glycine max
  Coding DNA Sequence Number=SeqID_52059
MHITTTLTETHFRWKLVVTPIIAETIQIHTLYPLAVAALALQNDECAFYRLRSYPLGNGINGACCEPLGNWRQVIKP

SEQ ID NO: 168838 - protein, 328 aa, Glycine max
  Coding DNA Sequence Number=SeqID_52060
MLPERKVELYHTELDDFKTELERCNFHKRLTNLVDGSIDLALVKEFYANLYRSEGPSPKQSRVRGHLMKIDADNLNTFLETHVVLTEGETLPTYSRYCMLPTDYREIEVALCIPGRGFILNTNGHPGKILKKDLTTLAQVWSVLSYSNLAPTSHTSDLTVDRARLIFGLVSCMDMNIGALISGQMTSIAQSNTSRLGFPTLITALWATTELPSTFAAPTPTSTSAAPSVPAQTYSQHFKAMLQSIHQGQIILLQSLQVVATPGSNPLVEQFREMIAWPRTQPSLHREDKGPTAQVPKHMEDESSEATILEPFVLGEEEGETQVRQGIL

SEQ ID NO: 168839 - protein, 95 aa, Glycine max
  Coding DNA Sequence Number=SeqID_52061
MQSAKRDVYLRAYLNGGHWQMVVIVPKEHLVVWFCSLHNRPDNYLKGIINSALKGLHDAPQPKSKAPARWIVVKYFNDARPLEPEGLKVLRIQWA

SEQ ID NO: 168840 - protein, 182 aa, Glycine max
  Coding DNA Sequence Number=SeqID_52062
  Gene Ontology: Mol. function=transcriptional repressor activity; Biological process=negative regulation of transcription
  Homolog annotation: Hit_ID=Q6K1G0; Match level="QueryCoverage=94%, HitCoverage=69%, E-value=6e-36, Identity=52%"; Hit description=CI
  Pfam annotation: Domain name=Phage_CI_repr; Domain location=6-70; Score=59.1; E_value=1.4e-14; Accession=PF07022.3; Description =Bacteriophage CI repressor helix-turn-h
  Pfam annotation: Domain name=Phage_CI_repr; Domain location=95-144; Score=16.1; E_value=0.0039; Accession=PF07022.3; Description =Bacteriophage CI repressor helix-turn-h
  Pfam module annotation: Pfam domain module=Phage_CI_repr::Phage_CI _repr; Domain location=6-70::95-144
KGGSAQILERLMSSYGVSTQKDLAAALAIPANNISGWTHRDSVPGNSIIKCVLDTGDELQWLVTGELAKAKFDYEPNAPNGEALYSEITSNGGKPVLRRIMDAYGFTLQKQLCDSLGISSGTVSTWLATGKGLNLRKTKEETHNQVIPHKEFDIRHAERRWDLVNRHKLYSEHAKQASIYFE

SEQ ID NO: 168841 - protein, 197 aa, Glycine max
  Coding DNA Sequence Number=SeqID_52063
MVKGEMQFLLDKLVFALGCTIGTYANGLGCNDGVRGVVREWEGEVVVVVSVKESSWRIKRRWEGFKVGVMGFEIILQNKHAESVGEELLLSGYKKKKHLSVRVIIPDKVQTKQGFRNRHSTIPQNCHHVNCRCKVIARELLYVAESTSKSLHVDYFFHFGLRDAKTGLTQQIDLCSPSKRVQCWFEKFSPSTHQPDR

SEQ ID NO: 168842 - protein, 89 aa, Glycine max
  Coding DNA Sequence Number=SeqID_52064
MEDEDEIDAMLHHTGVERRHPPTFPTRNLSAIDGAKIVARFAAVGGGKGEEREKELDDTVVTVDGSGGTMVVVFVGEREEGDGVTLMCE

SEQ ID NO: 168843 - protein, 70 aa, Glycine max
  Coding DNA Sequence Number=SeqID_52065
MLGISNSGAPAKPINNYTLLQMKIIKKKEAGMLWSDLFHHLARSRNLSYNNRHHLKETKSITPPIHHYEE

SEQ ID NO: 168844 - protein, 286 aa, Glycine max
  Coding DNA Sequence Number=SeqID_52066
RRSCTEKREANWDRLLANKEGVSINWFPRWKEGRVGILFSCGGFPNVPLMGMRALAGVLQGVRKAWEMVQKKDKELRGSSNGAVGGYHRLKAAKEEEVEAPEESKEVQALKMELEKAQAVKEKFKSTAVRIRKENAELRDVNIATAKALEQETKRARKEEYGRNKFRGALWGSNSELKLRREERDQSQVEGMILKDELKTCLRSKRSLSQRLSETETNMLAIISKYKEELDLATAHEHKVVDEYAQVYTEKEARGRVIDSLHREAMMWMDRFALTLNGSQDLLRLL

SEQ ID NO: 168845 - protein, 143 aa, Glycine max
  Coding DNA Sequence Number=SeqID_52067
MAILVEVGELTFRIENLYLNHNEGNLIVELNLIEENRKVVAIRDMALKRKIVARYNKKVIPHTFEEEDLVLHKAIVDGKNNHHEKLTENWKGPYRVSQPTLRREGDARLAGCVFHERNTRGVATNVYLRKTSEKPEKTRSTNF

SEQ ID NO: 168846 - protein, 67 aa, Glycine max
  Coding DNA Sequence Number=SeqID_52068
MKRMHVTRCMRKHGAVQQKHPDYHSCTLTFARLDTTKRTTPHNTKGMQANGNIEWRLIRIARHGGIL

SEQ ID NO: 168847 - protein, 83 aa, Glycine max
  Coding DNA Sequence Number=SeqID_52069
MRYTMNSFITVLYFNGRVYEDNDGVIFEGSKKAIQIKCGISFNALKKKIGDKCQKNILSCKFVMTKTLKRCWKVLNNNNKCQF

SEQ ID NO: 168848 - protein, 260 aa, Glycine max
  Coding DNA Sequence Number=SeqID_52070
  Homolog annotation: Hit_ID=UPI0000503967; Match level="QueryCoverage =92%, HitCoverage=97%, E-value=3e-13, Identity=27%"; Hit description =UPI0000503967 related cluster
PHELIVVHASSTNESGATRSDCLVQFSILHFYSEPHELIVVHASSTNESGAMRSDCLVQFSILHFYSEPHELIVVHASSTNESGATRSDCLVQFSILHFYSEPHELIVVHASSTNESGAMRSDCLVQFSILHFYSEPHELIVVHASSTNESGAMRSDCLVQFSILHFYSEPHELIVVHASSTNESGAMRSDCLVQFSILHFYSEPHELIVVHASSTNESGAMRSDCLVQFSMLHFYSEPHELIVVHASSLPMSLEPRVVT

SEQ ID NO: 168849 - protein, 196 aa, Glycine max
  Coding DNA Sequence Number=SeqID_52071
  Gene Ontology: Mol. function=protein binding; Biological process =defense response
  Homolog annotation: Hit_ID=Q1SPY2; Match level="QueryCoverage=72%, HitCoverage=24%, E-value=4e-18, Identity=37%"; Hit description =Disease resistance protein; AAA ATPase; Zinc finger, C2H2-type
MFLGLKRLSIEGCDLQHILSVSFVGYQAKLEDIRNKETHNNFEHLQRKNIQIGQVRLKLKKLELYDLPQMTYIWVASKSSLFLQYLKTLDIEECAKLEVIFPSCVLRCLPKLKHLEIRECTELKQIIEEDVTDKKLSDHSTQPCFPKLVDLVVKECHKLKRFFSASSSSDLLNLEVLIIDGATELEEIIGFKRGKG

SEQ ID NO: 168850 - protein, 50 aa, Glycine max
  Coding DNA Sequence Number=SeqID_52072
MTNANCPQESLHSVSKGNLRLRQGDPLAPLLFDLVVEGLTGLMRVYVCGC

SEQ ID NO: 168851 - protein, 138 aa, Glycine max
  Coding DNA Sequence Number=SeqID_52073
MCVKISLLLPLANSSTLVVFVVLVEVVDTIVHCVSTKGSCVVADPSGEDNHIDTRNQCEVYVDVDLTHLVAIRKVYNLGLAIHHKKIEDHNVRVVVKKVRYADALAPFPTDEVQTVGQAHNNFIQWPRRLDKFISTKL

SEQ ID NO: 168852 - protein, 156 aa, Glycine max
  Coding DNA Sequence Number=SeqID_52074
  Homolog annotation: Hit_ID=Q9LJR0; Match level="QueryCoverage=75%, HitCoverage=82%, E-value=1e-23, Identity=45%"; Hit description =Arabidopsis thaliana genomic DNA, chromosome 3, TAC clone: K7L4
MPRPFMCKILKLPLKEESPHCNGNVKHHTPLGKETLKVYVLNKSNHQEKKSYCEQQQARERIRGVNQKLIMGCCPLKLACGLGSVAKHKDLFGVEYHQSSTSKSYCGMKNTHKGIYRRNHLSEFTSKAFNCFLTFNSMEPLPSKPTMVVEIPITSF

SEQ ID NO: 168853 - protein, 108 aa, Glycine max
  Coding DNA Sequence Number=SeqID_52075
  Homolog annotation: Hit_ID=Q9FGM1; Match level="QueryCoverage=44%, HitCoverage=25%, E-value=2e-09, Identity=63%"; Hit description =Arabidopsis thaliana genomic DNA, chromosome 5, P1 clone:MFH8
MSPEVFISAGVPCCSIKTVCRLAMRMRRAGNDGELSSTEMECIRRHHRQEAADDNQCASSLVKHIRASLPLVVWSLVKRFDEPHKYKRVLYVGDHIYGDILSRKKEGK

SEQ ID NO: 168854 - protein, 74 aa, Glycine max
  Coding DNA Sequence Number=SeqID_52076
  Gene Ontology: Mol. function=ATP binding
  Homolog annotation: Hit_ID=Q1SP80; Match level="QueryCoverage=92%, HitCoverage=22%, E-value=2e-19, Identity=51%"; Hit description=Heat shock protein Hsp70
MLWPFKVVVGINDKPMIVVKYKGQEKHLCAEEVSSMGKAIVAAIAYGLDKRTNCIGEKNIFIFDLGGGTSHDQG

SEQ ID NO: 168855 - protein, 53 aa, Glycine max
  Coding DNA Sequence Number=SeqID_52077
  Homolog annotation: Hit_ID=Q9CAE1; Match level="QueryCoverage=92%, HitCoverage=4%, E-value=7e-09, Identity=66%"; Hit description =Putative aminopeptidase; 4537-10989
MIRIFNSKLVLASPETATDADYAAILGVIIGHETLTIPHNIRAGSIKCKAWGA

SEQ ID NO: 168856 - protein, 352 aa, Glycine max
  Coding DNA Sequence Number=SeqID_52078
  Gene Ontology: Mol. function=hydrogen ion transporter activity; Cellular component=proton-transporting ATP synthase complex, coupling factor F(o); Biological process=proton transport
  Homolog annotation: Hit_ID=Q39852; Match level="QueryCoverage=49%, HitCoverage=97%, E-value=7e-87, Identity=96%"; Hit description =Putative ATP synthase subunit
MVDKYSLLGMRNEERPMGQVTKFVSGDDIEDDFMTDDIHSGDKKKASKVNRRPCKTKEEGGCKLHLDLLHSAVRVILCRKLGCRRQSSTVACSAPGSDYTVAESGLQWAGLGPRPASSASSRAAKTGASRGRNIKRLRYNAKPIYGSQILLQKEHAIPVRHFAKESAPPALKGDEMLKNIFVEVKNKFETAIGILKKEKITIDPEDPAVVSHYAKVMKTIREKASLLPESQDILSTIEIETQDIPDARTYLLTLKEIRVKRGLTDDLGAEALMIDALDKVEKDLKKPLLRNDKKGMDLLLAEFDKINKKLGIRKEDLPKYEEELELKVAKAQLEELKKDALEAMETQKKRYY

SEQ ID NO: 168857 - protein, 56 aa, Glycine max
  Coding DNA Sequence Number=SeqID_52079
MAEEPESTSATNKSLLDKITEKLHDHNSSSSSFFATSEEKHPFTPSSAPENMTAME

SEQ ID NO: 168858 - protein, 77 aa, Glycine max
  Coding DNA Sequence Number=SeqID_52080
MVQWEWQLWRGVATEISRDILGTLETILAERCRFAVVKNAFSSSVQKGIMFARDLHLINAIFEVDFLTQLVKKMKVS

SEQ ID NO: 168859 - protein, 179 aa, Glycine max
  Coding DNA Sequence Number=SeqID_52081
  Gene Ontology: Mol. function=transferase activity, transferring glycosyl groups; Cellular component=membrane
  Homolog annotation: Hit_ID=Q9FN55; Match level="QueryCoverage=94%, HitCoverage=32%, E-value=1e-60, Identity=64%"; Hit description =Arabidopsis thaliana genomic DNA, chromosome 5, P1 clone:MYC6
MNPEDRTDLRHLVFGIAVSTKLWDQRKSYIKLRYRVRDMRDIMWLNEKVKSKENNSDVLPPLRIFDDMVMFMYTNRQGHRLTIRISRIVSETLQLGMKDVRWFAMGDDDTIFVIENLIRILRKYDHNQLYCIGSLSESHLQNIFFSYNMAYGGGGFAISYPLAKALHKLQDREGGALLF

SEQ ID NO: 168860 - protein, 86 aa, Glycine max
  Coding DNA Sequence Number=SeqID_52082
  Gene Ontology: Mol. function=transferase activity
  Homolog annotation: Hit_ID=Q1SQN0; Match level="QueryCoverage=73%, HitCoverage=29%, E-value=1e-14, Identity=56%"; Hit description =Terpenoid cylases/protein prenyltransferase alpha-alpha toroid
MATPPDVAKLRRVVHRNREEDTLNNHDEYFQMRVDALRSKGLSPLQKCTTAIRILAYGPPIDNMDEYVRIGETTTVECLERFVSGM

SEQ ID NO: 168861 - protein, 57 aa, Glycine max
  Coding DNA Sequence Number=SeqID_52083
MYNSVSMFCVRLMQFEDEATSLSPLNKQCRTNQECASWLGTPLINKAGVLLLGKVFP

SEQ ID NO: 168862 - protein, 139 aa, Glycine max
  Coding DNA Sequence Number=SeqID_52084
  Gene Ontology: Mol. function=serine carboxypeptidase activity; Cellular component=vacuole; Biological process=proteolysis
  Homolog annotation: Hit_ID=Q41691; Match level="QueryCoverage=58%, HitCoverage=27%, E-value=2e-38, Identity=89%"; Hit description =Serine carboxypeptidase
MMQDWMRNLEVGIPTLLEEGIKVLMYAGEEDLICNWLGNSRWVNAMEWSGQKQFGASSTVPFLVDGAEAGTLKSHGPLAFLKARPLLGSENQKESYGKNNNEYVRFVLSNLSAKAVWTARSMSGANKKMIEALAARKKE

SEQ ID NO: 168863 - protein, 226 aa, Glycine max
  Coding DNA Sequence Number=SeqID_52085
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=94%, HitCoverage=26%, E-value=1e-101, Identity=83%"; Hit description =Lipoxygenase-4
  Pfam annotation: Domain name=Lipoxygenase; Domain location=1-210; Score=-128.2; E_value=3e-10; Accession=PF00305.9; Description =Lipoxygenase
MRMKSDGWWGRGKIWDAIKSRVEEYVSFYYKSDKELQKDPELQAWWKELVEVGHGDLKDKPWWQKMQTREELVEASATLIWIASALHAAVNFGQYPYRGDSCLRKGSPEYDALAKNPEKEFLKTITSKKETLIDLTVIEILSRHTSDEFYLGQRDGGDYWTSDAGPLEAFKRFGNNLEEIEKKLIEKNNDETLRNRYGPAKMPYTLLYPSSEEGLTFRGIPKSISI

SEQ ID NO: 168864 - protein, 142 aa, Glycine max
  Coding DNA Sequence Number=SeqID_52086
MASKLYFYYSYSYDLTRDLAEIRGWLVAFQVPELQLGTSTRTLIPMVKFQNMSQVISCESLRTIQGNICISPRTIQGNICISPRTIQGNFSSLRTKHYILSDAILPPRALDRKLQEDWARDAGEGLTVLMGLRVDFGPMGSI

SEQ ID NO: 168865 - protein, 52 aa, Glycine max
  Coding DNA Sequence Number=SeqID_52087
MVGVPVCERIDRPCSSLKAGNNLRSCESGISQGTYNGLIKADMPLSSSMFDL

SEQ ID NO: 168866 - protein, 50 aa, Glycine max
  Coding DNA Sequence Number=SeqID_52088
  Gene Ontology: Mol. function=binding; Cellular component=membrane; Biological process=transport
  Homolog annotation: Hit_ID=Q1SUF7; Match level="QueryCoverage=94%, HitCoverage=15%, E-value=4e-09, Identity=57%"; Hit description =Mitochondrial carrier protein
MKQHMEVQCTITSWSSVAVKDGIAIKPDTQIYGCPIWKTQGLKGLYGGTH

SEQ ID NO: 168867 - protein, 439 aa, Glycine max
  Coding DNA Sequence Number=SeqID_52089
  Gene Ontology: Mol. function=protein binding; Cellular component =integral to membrane; Biological process=protein amino acid phosphorylation
  Homolog annotation: Hit_ID=Q2QVS0; Match level="QueryCoverage=67%, HitCoverage=83%, E-value=4e-50, Identity=29%"; Hit description =Leucine Rich Repeat family protein
  Pfam annotation: Domain name=LRR_1; Domain location=100-122; Score =3.5; E_value=63; Accession=PF00560.23; Description=Leucine Rich Repeat
  Pfam annotation: Domain name=LRR_1; Domain location=124-146; Score =14.8; E_value=0.32; Accession=PF00560.23; Description=Leucine Rich Repeat
  Pfam annotation: Domain name=LRR_1; Domain location=148-168; Score =8.6; E_value=7; Accession=PF00560.23; Description=Leucine Rich Repeat
  Pfam annotation: Domain name=LRR_1; Domain location=172-194; Score =7.2; E_value=13; Accession=PF00560.23; Description=Leucine Rich Repeat
  Pfam annotation: Domain name=LRR_1; Domain location=196-219; Score =11.5; E_value=2; Accession=PF00560.23; Description=Leucine Rich Repeat
  Pfam annotation: Domain name=LRR_1; Domain location=263-285; Score =8.0; E_value=8.9; Accession=PF00560.23; Description=Leucine Rich Repeat
  Pfam annotation: Domain name=LRR_1; Domain location=287-309; Score =16.0; E_value=0.14; Accession=PF00560.23; Description=Leucine Rich Repeat
  Pfam annotation: Domain name=LRR_1; Domain location=30-52; Score =15.1; E_value=0.26; Accession=PF00560.23; Description=Leucine Rich Repeat
  Pfam annotation: Domain name=LRR_1; Domain location=56-76; Score=6.5; E_value=17; Accession=PF00560.23; Description=Leucine Rich Repeat
  Pfam annotation: Domain name=LRR_1; Domain location=79-98; Score=7.1; E_value=13; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=100 -122::124-146::148-168::172-194::196-219::263-285::287-309::30-52::56- 76::79-98
MVLFFVIVVTLISLRKSAYRTNWGDYTFPNLQYLDLSKNQIHGRIPKWFNSTGKDTLSVFDLSHNLLTSVGYLSLSWASIHYIDLSFNMLQGDIPIPPSGTKFFSVSHNKLTGHISSTICNASSLQMLDLSHNNLAGKLPQCLGTFPYLSVLDLRTNNLSGMIPKNSLEIEALETMNFNGNQLEGPLPRSVVMCKQLRVFYISNNNFSGNFPTACIKDFKGMMVNVDNGLQYMRGKHYSSSYYDSVVITIKGNTYELERILTTFTTIDLSNNRFGGVIPAIIGELKSLKGLNLSHNRITSVIPQNFGGLENLVLGYDQNPYFLFVLHHFHNKLVSRAQVAIKGIQDSHLNTKIKLRESCFWFFRCFTVIKNTQEIMSNTIKIEKFNGKNNFNLWHIKMRSLLKEQHGFKCSTENGVMKIQKGSTMVMKSIKRGNLYILQ

SEQ ID NO: 168868 - protein, 48 aa, Glycine max
  Coding DNA Sequence Number=SeqID_52090
MMMATGPLGCFQKGKVEFLKMNEVEESGFGMKFTLKATAAKVYANYVT

SEQ ID NO: 168869 - protein, 67 aa, Glycine max
  Coding DNA Sequence Number=SeqID_52091
QEGGLRTIGRFELVYVRVEVKAARFLDLAQFLTKFHKISSTSSNVDNRSKEQLCAYKVYVAGHLALG

SEQ ID NO: 168870 - protein, 203 aa, Glycine max
  Coding DNA Sequence Number=SeqID_52092
  Gene Ontology: Mol. function=chromatin binding; Cellular component =chromatin; Biological process=chromatin assembly or disassembly
  Homolog annotation: Hit_ID=Q1SAV4; Match level="QueryCoverage=84%, HitCoverage=62%, E-value=8e-37, Identity=36%"; Hit description =Integrase, catalytic region
  Pfam annotation: Domain name=Chromo; Domain location=126-172; Score =8.6; E_value=0.093; Accession=PF00385.14; Description='chromo' (CHRromatin Organisation MOdifier
MNRVIEQYLHAFVHRRAATWGKFLPWIELSHNTSWNSGTGSTPYEITFVRKPFSFPDYLAGSSRIDSVDDLLTTRDEVFASIRWKLIKAQAYMKKTADAKCREVTYDLVIDHVGKVANRLKLPDTARIHPVFHCSLLKPFHVLVQWKGLSPDETSWEDWAQLQQDHHLEDKVILQGPKEVDSRVATTSASKGQRGEIDNGGVK

SEQ ID NO: 168871 - protein, 570 aa, Glycine max
  Coding DNA Sequence Number=SeqID_52093
  Gene Ontology: Mol. function=RNA-directed DNA polymerase activity; Cellular component=chromatin; Biological process=chromatin assembly or disassembly
PGNAVEFDNNVDEQQGYHVSCVSLRPVMKSRERSYNGLNGIGRGHNKPVIRLVSYLVNWHSAQLATNFATSALRPGHVKFSDNLAIVFVTPVCPPMGVECLDMSPENPKCPVVAGSTAGGWPIDAIIIQGRSTRELREAKKWMQNIPVTVTKHLQLDYESLIDIEFDNQISLSMPNAYAVQGGDGKLFSNISGCCQKLLSKWFAEVSNGNWSYGQSSFEVLKSLLSLRGPMKRFNGGDSDQGINNHGIAFDKLAVMQMIFKGATVNEYVIEENNDEAAEKWLENQIHHRLKRGWSIAEPKGHDSELIVSVVSSKSSLRDICRMHSYLMVSLQKVKFRKALCSSQFIKQFINCWNWEAVLDRNQLATQFPTFGNVDNDMGEHSPAWTEAVSGCGDPWCVPAARSEVVERGHYICRARNSVFCTNDETKRKSMSSGPKDLSHCTPKTILAPEMGSTYTPSTDRYPPSLAREWCRDKVNLIESPIGATSQTNLFVVDVNAKAPLAVLDSEVPASWEGPTRSNELDEESASIWKRFKKGVQEEARGLACARLGLEKGRFSAKGEKLGRARVCYV

SEQ ID NO: 168872 - protein, 1131 aa, Glycine max
  Coding DNA Sequence Number=SeqID_52094
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=90%, HitCoverage=91%, E-value=1e-150, Identity=46%"; Hit description =Chromo
  Pfam annotation: Domain name=RnaseH; Domain location=635-756; Score= -16.6; E_value=0.002; Accession=PF00075.14; Description=RNase H
  Pfam annotation: Domain name=rve; Domain location=831-956; Score =36.4; E_value=9.8e-08; Accession=PF00665.16; Description=Integrase core domain
  Pfam module annotation: Pfam domain module=RVT_1::Retrotrans _gag::RnaseH::rve; Domain location=178-546::106-179::635-756::831-956
MAEHNERTRLQQLQSQVFALTSWMEEQRSCDQSLQDRFNQFQADNQARRNSSTLVSSPSQISINYGVKEITFGFPHFDGQTPVMEWIFKAEKFFNYHNTPDQDRVDIASIHFEKDVIPWFQMLQRMETVNTWTELRQLFKLQQQGTVADYYLKFMSLAHRYDGLTHEALLNCFISGLNKDMRRDVVAQAPNDLLRVVALAKLYEEKYVIVPITRPIPFSPRYSNLSSSNTHNNNDDAELEFHDSEDRFDSVTNNAEVILEDHRLSLNALKGGMGVGTIRFVANVDKLPVKVLVDGGSSDNFLQPRVAKFLKLPVEPAPFFKVMVGNGNYMEAEGIIRKLTIKAQNVRFQLPVFLLPVSGADLILGASWLKTIGPHIADYDKLQLKFMYDGKFTTLQGENDIIPGQAHLHHIRRMLKTDAIAETFTMQLIEPNSVQFPLLELPTDMEPKLALLLHSYIKPYRYPHSQKEEIEKLVNGMLEEGIIQPSALRRFVLVFFDDILIFSPSWKDHLSHLEIVLSILKQHQLFARFSKCAFGVREIDYLGHTLYRAGVAMETTKLQVVLDWPLPNSLKQLRGFLGLTGYYRKFVKGYATIAAPLTDLLKKDSFKWSASATTSLNKLKEVMTSAPVLSIPNFKEPFVLETDASGTGIGAVLSQNEHPIAYFSKKLSSRMQKQYAYIREFHAITEALAKFKHYLLGHKFIIRTDQKSLKELLEKRLQTPEQQQWLPKFLGNDFVIQYKSDRENIPADALSRSFSMAWSEAVGVWMTQVATLMKEDAILAALYKQCIEGTMMMIPSNEALKQKIMHEFHASKIGAKVEQALPAGLLQPLPIPQRIWEDIAMDFITHLPSSHDVFIVNIVKMHGFPKTIVSDRDRVFISAFWQQLFKAQVTTLAMSSAYHPQSDGQTEVLKKTLEMYLRCFMFDHPKAWFEMLPWAQFWYNTSFHHNIGMSPFKVVFGRDPPSVIPHELVDRIGRVAYKLKLPETARIHPVFHISALKKFVGSSNQPYLPLPLTVGESGPMVQPIAVLDSREIAGLEEAKWEDATWVKASYPHFNLEDKVVYKGEGNVTCGKQEGKLVRESVIKEGHVADDLHVNTLPVCFSDPSVNSFFSTPSLNLSTLLNLRCYSEPMMV

SEQ ID NO: 168873 - protein, 141 aa, Glycine max
  Coding DNA Sequence Number=SeqID_52095
  Homolog annotation: Hit_ID=O22490; Match level="QueryCoverage=26%, HitCoverage=35%, E-value=7e-11, Identity=78%"; Hit description =Cytochrome C
MASFDETPPRNSKNGEKIFKTKCAQCHTIDKGADNKQGIYRHSSPSVRELLCIDVEGNIMLVEATWTYQTFSAYTIEESGRKIGLMAQILLHGTLHATVYEVDKLKIGGGNFLTKISLLIILQWYQRCLCYCLLQTENKPN

SEQ ID NO: 168874 - protein, 148 aa, Glycine max
  Coding DNA Sequence Number=SeqID_52096
ENERGACHPARVGELGCFLQKAPPSGGTSWKAQVGLNLTDYAIIPSLASRMLRNFTNCTTMLAFEFRHVTELHGLPNDGCQNLWLWNTLGRCGENVFERSRNIQNPILGSLTNYTRDVDNRASMSRSPPRRDGTTFKLAGAIASPKDH

SEQ ID NO: 168875 - protein, 137 aa, Glycine max
  Coding DNA Sequence Number=SeqID_52097
  Homolog annotation: Hit_ID=Q1S5Q3; Match level="QueryCoverage=68%, HitCoverage=65%, E-value=3e-08, Identity=28%"; Hit description=Zinc finger, GRF-type
  Pfam annotation: Domain name=zf-GRF; Domain location=20-65; Score =39.6; E_value=1.1e-08; Accession=PF06839.3; Description=GRF zinc finger
  Subcellular localization annotation: CTP_CleavageSite=30; ConfidenceScore=5.37e-01
MSQRSNASSSRTRVSSQVVLFCGCGRRAVRRVAGTNINRGRAFFTCSINKDEVGYCGYFIWVDQLIEALGVDDSLGTFSMEQRRQFRREEDKTMWKAQVNSKLDCIGIEMKMFRTIVYGMFLIQLLSMVVFVCIHKY

SEQ ID NO: 168876 - protein, 77 aa, Glycine max
  Coding DNA Sequence Number=SeqID_52098
MASPGIPLSNTNHGSFFDHMLGQIVAIVIIVLVVVACAIFMALKCIKMVKVFRHNRSMARVAPEPLEPPQGEAMHQV

SEQ ID NO: 168877 - protein, 49 aa, Glycine max
  Coding DNA Sequence Number=SeqID_52099
MSMQDKNRKENRKEKPGALSATPPRSARVDCMLNARVAGLARASVGSQA

SEQ ID NO: 168878 - protein, 395 aa, Glycine max
  Coding DNA Sequence Number=SeqID_52100
  Gene Ontology: Mol. function=DNA binding; Cellular component=beta -galactosidase complex; Biological process=DNA integration
  Homolog annotation: Hit_ID=Q1S3I6; Match level="QueryCoverage=95%, HitCoverage=26%, E-value=1e-162, Identity=72%"; Hit description =Integrase, catalytic region
  Subcellular localization annotation: CTP_CleavageSite=44; ConfidenceScore=5.17e-01
MDLPPGFLPPGSSSNKVCKLHKSIYGLKQASRQWFSKLSTALISLGYSPSSADHSLFTKLHNSHFTALLVYVDDIVLTGDDLQEIQSVKQFLDSTFKIKDLGKLKYFLGLEIARSTQGIFLNQRKYALELLEDSGLLATKPSTTPFDCSLKLHDRDSPPYEDETAYRRLVGRLLYLTTTRPDIAFIVQQLSQFISQPLQVHHSAAIRVLKYLKSAPAKGLFYSSSSTLKLSGFADSDWASCPATHRSVTGYCVFLGTSMLSWKSKKQSTVSRSSSKAEYRALASLTCELQWLQYLFKDLHISLDQPISVYCDNKSAIYLAHNPIFHERTKHIEIDCHVIREKIQTGLIHLLPVSSVAQLADVLTKPLLAPSFNSLISKLGLLDIHSPACGGLLHD

SEQ ID NO: 168879 - protein, 121 aa, Glycine max
  Coding DNA Sequence Number=SeqID_52101
MTPRRGCHTHRAGTALRGFVLAHLVEGQHRLEAEFVFHAGADQAADGVAAGVGMHVYATEPPFGAQMQRLCASHDDPFLLQQRATVLLHQQAQRFHRGDAECCQFGQQLGDIGIVAIVVAA

SEQ ID NO: 168880 - protein, 302 aa, Glycine max
  Coding DNA Sequence Number=SeqID_52102
  Gene Ontology: Mol. function=protein binding; Cellular component =integral to membrane; Biological process=protein amino acid phosphorylation
  Homolog annotation: Hit_ID=Q9C637; Match level="QueryCoverage=77%, HitCoverage=24%, E-value=1e-41, Identity=39%"; Hit description =Disease resistance protein, putative
  Pfam annotation: Domain name=LRRNT_2; Domain location=28-79; Score =28.4; E_value=2.5e-05; Accession=PF08263.3; Description=Leucine rich repeat N-terminal domain
  Pfam annotation: Domain name=LRR_1; Domain location=110-133; Score =8.4; E_value=7.6; Accession=PF00560.23; Description=Leucine Rich Repeat
  Pfam annotation: Domain name=LRR_1; Domain location=135-157; Score =9.1; E_value=5.7; Accession=PF00560.23; Description=Leucine Rich Repeat
  Pfam annotation: Domain name=LRR_1; Domain location=186-208; Score =4.8; E_value=37; Accession=PF00560.23; Description=Leucine Rich Repeat
  Pfam annotation: Domain name=LRR_1; Domain location=214-236; Score =7.6; E_value=11; Accession=PF00560.23; Description=Leucine Rich Repeat
  Pfam annotation: Domain name=LRR_1; Domain location=238-260; Score =14.1; E_value=0.51; Accession=PF00560.23; Description=Leucine Rich Repeat
  Pfam annotation: Domain name=LRR_1; Domain location=277-296; Score =4.8; E_value=36; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=28-79::110-133::135-157::186 -208::214-236::238-260::277-296
  Subcellular localization annotation: CTP_CleavageSite=35; ConfidenceScore=5.47e-01
MGWFPFLVLSFLLSHFPSQTSSFMPFCNYDDASVLLSFKSSFTLDSSSLSNPWCESCHPKTESWENGTNCCLWEGVSCDTKSGHVIGIDLSCSCLQGEFHPNTTLFKLIHLQKLNLAFNYFSNSPMPNGFGDHVALTHLNLSASAFSGVIPSKISHLSKLVSLDLSFLGMRIEAATLENVIVNATDIRELTLDGLDMSSIKPSSLSLLVNFSSSLVSLSLQQTGLQGKLANNILCLPNLQKLDLSFNRYLQGELPEFNRSTPLRYLDLCYTGFTLESLNYLDFYSSDFEGTIPLFLYKKYLI

SEQ ID NO: 168881 - protein, 215 aa, Glycine max
  Coding DNA Sequence Number=SeqID_52103
  Gene Ontology: Cellular component=nucleus; Biological process=cell division
  Homolog annotation: Hit_ID=Q9LME2; Match level="QueryCoverage=98%, HitCoverage=23%, E-value=3e-67, Identity=64%"; Hit description =Synaptonemal complex protein 1
  Subcellular localization annotation: CTP_CleavageSite=35; ConfidenceScore=5.52e-01
MQKNLGFPISKSLDQFKSLYGSISATPKPLSSRPSADSVSSGSFANLKLTAEKLVKEQASVKTDLENANSKLKKSQEYVHALEEKLQNALNENAKLKVKQKEDKKMWKGLESKFSSTKTLCDQLTETLQQLAGLVQDAEKDKETLENKLSASSEALDSLNKQMDGLSLKLDSAQETISTRDNELEKIKYATEEREKFHRDEQCRVTNVIQDKGED

SEQ ID NO: 168882 - protein, 618 aa, Glycine max
  Coding DNA Sequence Number=SeqID_52104
  Gene Ontology: Mol. function=protein kinase activity; Cellular component=nucleus; Biological process=cell division
  Homolog annotation: Hit_ID=Q9LME2; Match level="QueryCoverage=99%, HitCoverage=94%, E-value=1e-143, Identity=33%"; Hit description =Synaptonemal complex protein 1
MLTSSRLATENLNSKLEEVHLQLKVKEDEIMHHLTSQEKLEKEKSDLQLWNAGLAEKLDISLQEIKNLEESLHSLAAHLSNLDKESLNLLSKFDEMNLLYASCFQLVQQERETFSKHARYQYSELNNKFFVLELENNAAQMKIHELSKNVDELQKVHESTLAKLTEDSRLAAERIQSLESEAETLISKKKDAEVLISKLEKKADFLLESSRSSENQVQGLLLKVSTLETESKENTERLQAEISKKSDEIDTLQNERMKLEQHADSLDKEVIQLQNSLEEKDKCILHSKEQEKKLEDQIAENLSLLTAAESKLSEARKQYDQMVENKQLELSRHLKEISQRNDQAINDIKRKYELEKMEIVNMEKDKVNKAIAEIEGKCGQKLAEWKEESRQQLMRIQEEHALLVTQMKQEHDKMQLSLIAEHNEQLKRTQLQAENELREKTMYMRNDHEAQIKALRCELEDECQKLEEELHLQKSKEDRQRALLQLQWKVMSDKPKEDQEVNSKQDYSISSIKRRSSFGGKRNQHDLDSPHIEATQRPVPKLLKKVENVKTGSAVSIPKHHRKDPRNGKTNTPKVNTPGSVVKMQSIKGGGHPRPSNIGDLFSEGSLNPYADDPYAFD

SEQ ID NO: 168883 - protein, 158 aa, Glycine max
  Coding DNA Sequence Number=SeqID_52105
MGTRGCVNYNPIGSYHRWLKAYAQDLDWLPSLRTTKGMEIETPEEDEEDPKGERRTERRQYSHHQVLGARDQEGPNSELKLRREKRDQSRVDALILKDELRVFLRSKRSLSQRLCETETNMLAIISKYQEELNLATAHEHKVADEYARLYAKKEARGR

SEQ ID NO: 168884 - protein, 118 aa, Glycine max
  Coding DNA Sequence Number=SeqID_52106
  Subcellular localization annotation: CTP_CleavageSite=40; ConfidenceScore=5.41e-01
MATDPMSPPQSDGQSEATSKRSRTTTRLRTLTLRTVDQPRPAVYVDPATGRASGPMREKFHSYLGVVAREKVPIIHNNWKDVPETLKDIVWNDILWSKHPLLAVEHVEISLGRKNSTF

SEQ ID NO: 168885 - protein, 278 aa, Glycine max
  Coding DNA Sequence Number=SeqID_52107
MDFKYLCEDDTMVYILFSALVLHYFCSKAVEENLGQVKGGSSILIANGLSNGFNRQLHLDTEDFSSKISSHIFISVNFGCPLEFSDKFRHHHFGGFKEVMDDTQQKMGFDDRDNVFQRFNVEKMLDMKYWFLILHHDFGNKNGHRCRYEGELFLKSGAMWTTEVGFVSWSLLGLAEFLGFREEEKLGCRKVSERENVKGLYKGEERERDRKGKLNKYGLFQIGSDPFQAMGLKSTLRLMRTLGPSPASLAQSSWSLLSNILGGRSASPFSIKNDLNFS

SEQ ID NO: 168886 - protein, 498 aa, Glycine max
  Coding DNA Sequence Number=SeqID_52108
  Subcellular localization annotation: CTP_CleavageSite=54; ConfidenceScore=5.65e-01
MDVPPSKVAPSQQSPPPTFIAPKATSVMENVTKMPTPKKKTQKPLSTTQRLRALSETKSEDALVFKKRKVAPLSDKTSMPQVKKVKPCQQAPTLTQPRTRKGEKRGAQRPKRLKGEQSYIHDDATNNPPSADIQSTKRLRKKKQTKSTSLLKTSQGIKVLPPPKWKRLHPKVSKPSSFAAQHKNIYRIPSVACREKVSYDKDIIRWFHKIDAQQIDSSSDDFLPLFLHPKHVQLFTPMSKYPLGLHIRCTTSIKFMPDRIAPRLPPLDLRKKKGKVPPHNKPMSHQGPKDNVALHPIPYDWSSYFTRDAATKTIAQEEDNEFYQRLVHDTFLLHSQFVFDLNKYFESAMRRAIVTAWTRFLMLNENPYYPNQNPWVPSQGTTFDVQRKQDKLKHHLMEMKKKDEAKQHISSTPHEITPLTLFASTVIVKYLNDYVLFNMNLLMQQRLPPSVQPPTIVVQPLPEVPTLEATISIDHVPVPPPSPPKSPPLIPQPPSAEG

SEQ ID NO: 168887 - protein, 98 aa, Glycine max
  Coding DNA Sequence Number=SeqID_52109
MTKKSDQENKGCFKLVTVQVNLFEIEHCNPVPFSTPLMAPTLTLSQVQVACYRDNCLVGVSRELGQQLDGDARRITHRKIAITLGTRRILFKIGPRRW

SEQ ID NO: 168888 - protein, 83 aa, Glycine max
  Coding DNA Sequence Number=SeqID_52110
  Subcellular localization annotation: CTP_CleavageSite=51; ConfidenceScore=5.28e-01
MALSNFGYNHFVSVAVDVRTHFFKYNISKATTPNSSNMWYEVEVTFENSVSANPTSGFSDSHPHATQSSGGCCDSEGTEVKVQ

SEQ ID NO: 168889 - protein, 241 aa, Glycine max
  Coding DNA Sequence Number=SeqID_52111
  Gene Ontology: Mol. function=sugar porter activity; Cellular component=integral to membrane; Biological process=carbohydrate transport
  Homolog annotation: Hit_ID=Q5K3W0; Match level="QueryCoverage=96%, HitCoverage=46%, E-value=7e-81, Identity=61%"; Hit description =Monosaccharide transporter
  Pfam annotation: Domain name=Sugar_tr; Domain location=1-222; Score= -59.9; E_value=5.3e-05; Accession=PF00083.14; Description=Sugar (and other) transporter
MERESFAVIFEHRYRPQLVMAFAIPLSQQLSGINTVAFYAPNLFQSVVIGNNSALLSAVILGLVNLASTLVSTAVVDRFGRRLLFIVGGIQMLLCMISVAVVLAVGSGVHGTDQISKGNSIAVLVLLCFYAAGFAWSLGPLCWLIPSEIFPMKIRSTGQSIAIAVQFLTTFVLSQTFLTMLCHFKFGAFLFYAGWLVLITIFVILFLPETRGISLDSMYAIWGKHWYWRRFVGEGQVIQPR

SEQ ID NO: 168890 - protein, 82 aa, Glycine max
  Coding DNA Sequence Number=SeqID_52112
MVGYAPSSFVDLVFASERIKVGLEKGKSDHPALMNVKTGANEEDENKGETLAMTVIPTRHNPCQGSSTFIFLRIRLECNMCI

SEQ ID NO: 168891 - protein, 42 aa, Glycine max
  Coding DNA Sequence Number=SeqID_52113
MIEAAKILANLIVMGGGILARAVVQAYRQALTRDFMGWGGGG

SEQ ID NO: 168892 - protein, 257 aa, Glycine max
  Coding DNA Sequence Number=SeqID_52114
  Gene Ontology: Mol. function=DNA binding; Cellular component =membrane; Biological process=DNA integration
  Homolog annotation: Hit_ID=Q1S1B7; Match level="QueryCoverage=77%, HitCoverage=49%, E-value=4e-54, Identity=41%"; Hit description =Integrase, catalytic region
MDLLKENLDLPIDLRKGTRSTRNPYPIYNFLSYHCLSSSYHSFVSSLSSISLPKNLCEALDHLGWRQAMIDEMKTLEHNVGANGQIDRLKARLVAKAAIRHWSLYQLDIKNEFLHGELEEEIYMEQSSGFVAQGESSLTKDLGKLKYFLGIEVARSKDGIIISQRKYALDILKETVIRILRYIKRTPGQEQLYEDKGSTQIVGFCDADWAGSPIDRRSTSGYCVSIGGNLVSWKSKKHNVVARSSAEAEYRVMVVVT

SEQ ID NO: 168893 - protein, 81 aa, Glycine max
  Coding DNA Sequence Number=SeqID_52115
SNEYRFYCPSHSTRIVELRNAKFLENDLIGGSGQFQDIAFEKDHYEAQPSGSSGRFIAIHTPHAQIKFLMRNTKFLKKITK

SEQ ID NO: 168894 - protein, 375 aa, Glycine max
  Coding DNA Sequence Number=SeqID_52116
  Gene Ontology: Mol. function=protein kinase activity; Biological process=protein amino acid phosphorylation
  Homolog annotation: Hit_ID=Q2QZ78; Match level="QueryCoverage=56%, HitCoverage=38%, E-value=1e-60, Identity=52%"; Hit description=AT hook motif-containing protein, putative
  Pfam annotation: Domain name=DUF889; Domain location=302-374; Score= -91.3; E_value=2.6e-05; Accession=PF05970.5; Description=Eukaryotic protein of unknown function (DUF889)
MNTNQVFVEGQSLTYSEFVTKFVYNQKQRCWQLRKKGYTTGRLQWVPPTTGELFYLRMMLTVCRGPISFENIRTVDGVEYSTYREACFAMGFSQDDREFIVAIQEAKDWGSAPYLRNLFVLLLLTGLFIVLTCLAFFPPLCFALEFQAVIKTRTIFMPTDQQAKIYNQIIQAVNKNEGGMFFLYGYEGTGKTFIWKTLAASLRADNKIVIMTASSSIASLLLPRGKIAHSKLKIPVPIFEDSTCNIHQGSQLAELLNEASLISWDEAPMAHKFCFEALDRSLRDVIKAKSSSDKIFGGKVMVFGGDFWQILPVIPRRSRSDIVNATINSSYLWNHFHVLTLSKNMRLEANTDATDREETAAFAEWILNIGDGIAG

SEQ ID NO: 168895 - protein, 293 aa, Glycine max
  Coding DNA Sequence Number=SeqID_52117
  Gene Ontology: Mol. function=hydrolase activity, acting on acid anhydrides, in phosphorus-containing anhydrides; Cellular component =membrane; Biological process=conjugation
  Homolog annotation: Hit_ID=P14565; Match level="QueryCoverage=100%, HitCoverage=18%, E-value=1e-47, Identity=37%"; Hit description =Protein traI
MAGTGIDAQTLKSFVLDWQTRSAAGEDVRYDNMLFLIDESSMIGNQDTAAAYRAIAAGNGRAVAVGDIAQLQSPESGAPFQLMQERSPIDVAVMKEIVRQRDTALKSAVYSIIGNDSAAALRNIESVAPDVVPRRAGTVVPGGSIVQSADPVSSIVADFMSRTDEAREQTMIMVQLHEDRRAINEGIHNAMVVAKELGGEARTVSVLDRINGGRHDFNRIKDWETGQVVMANQRYLHVTGVDHENGNVTLRDEAGRTHYWSPQELNAMEIEVFEHREIELRTGDSVRLSKTQK

SEQ ID NO: 168896 - protein, 296 aa, Glycine max
  Coding DNA Sequence Number=SeqID_52118
  Gene Ontology: Mol. function=transcription factor activity; Cellular component=nucleus; Biological process=regulation of transcription, DNA-dependent
  Homolog annotation: Hit_ID=Q1RYM8; Match level="QueryCoverage=81%, HitCoverage=68%, E-value=4e-37, Identity=41%"; Hit description =Pathogenesis-related transcriptional factor and ERF
  Pfam annotation: Domain name=AP2; Domain location=175-239; Score =145.4; E_value=1.6e-40; Accession=PF00847.10; Description=AP2 domain
GSGEFMRFTESHGGGGGGDGDGEYGYGHDDGRGGGGGGSLGLNFNQVMQQGEVTTQGGSGQRSTEWIQQSGFPMMSASSLSCLSSFSSPSSSGASWVGHKRGREEEESSSSHNMIQQQQQSAPRLFRNIGDFMVPSQGDSSSATEEAPTSTTTSVTAVATTVTETPPPPGGGERRRKYRGVRQRPWGKWAAEIRDPHKAARVWLGTFDTEEAAARAYDEAALRFRGNRAKLNFPENVRAVPPIQPFQATTRLTVSDSTTSQFRPLVTETPPFIQQPQIQGSSDLIRDYLQYSQLLQ

SEQ ID NO: 168897 - protein, 344 aa, Glycine max
  Coding DNA Sequence Number=SeqID_52119
  Gene Ontology: Mol. function=chitin binding; Cellular component =extracellular region; Biological process=chitin metabolic process
  Homolog annotation: Hit_ID=UPI000044A8F0; Match level="QueryCoverage =50%, HitCoverage=99%, E-value=9e-31, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLTFRGLHALAFRGLHILAFRGLHALAFRGLHAFTFIGLHALTFRGLHALAFRGLHVLAIRGLHVLAFRGLHALAFRRLHTLAFIGLHALTFRELHTLAFRGIHVLATRGLHALAFRGLHALAFRGPNVLAFIGLHALTFRGLHILAFRGLHALAFRGLHVLAFRGLHVLAFRGLHICAFRELKGLVGLLLSVPGPSLDIGGRPTVLAQLEDGTNIWMMLLLSNLLPGDHHSNLPLPKDRTRKTPSGPEEVQQGPGVLALIMGLCRDRAHKTPSGPEEVQQGPGVLVLITGLYQFYGVPVAPNRATDAPPPPPEFTSTHPQKGWIVAYDTWPTSRRPSPKPK

SEQ ID NO: 168898 - protein, 61 aa, Glycine max
  Coding DNA Sequence Number=SeqID_52120
MSIWQTSVHLENGEFVPPEKPVMMSQRSEIENGEIAGERWKKGEVERGEFVSGKWSKEELL

SEQ ID NO: 168899 - protein, 60 aa, Glycine max
  Coding DNA Sequence Number=SeqID_52121
MKKVQGLSSTWSYIKRHCCLQNRASAKRNTPGLSARKTLEEDELYRFAKHTASSHVSAPL

SEQ ID NO: 168900 - protein, 356 aa, Glycine max
  Coding DNA Sequence Number=SeqID_52122
  Gene Ontology: Mol. function=peroxidase activity; Biological process =glutathione biosynthetic process
  Homolog annotation: Hit_ID=UPI00005F78EC; Match level="QueryCoverage =83%, HitCoverage=67%, E-value=1e-150, Identity=89%"; Hit description= COG2308: Uncharacterized conserved protein
  Pfam annotation: Domain name=DUF404; Domain location=1-155; Score =167.1; E_value=4.4e-47; Accession=PF04169.4; Description=Domain of unknown function (DUF404)
  Pfam annotation: Domain name=DUF407; Domain location=180-309; Score =181.7; E_value=1.8e-51; Accession=PF04174.4; Description=Domain of unknown function (DUF407)
  Pfam module annotation: Pfam domain module=DUF404::DUF407; Domain location=1-155::180-309
MVRNSDGDYYVLEDNLRTPSGVSYMLENRKMMMRLYPELFAAQHIAPVERYPSHLLQTLRESSPVNDPVVVVLTPGRFNSAYFEHSFLAQQMGVELVESADLFVKDGAVLMRTTAGPCKVDVIYRRVDDAFLDPLAFRPDSMLGVPGLLSVYRSGNVVLANAIGTGVADDKSIYPYVPEMIRYYLDEDPILNNVPTWQCRKPQDLSYVLANLAQMVVKEVHGAGGYGMLIGPVASQQQLSEFRERLLARPDNYIAQDTLSLSTCPTFIDNGLAPRHIDLRPFALAAAPRTRGCWRMTHHAKPDGQWPLLDGALSGARRTTCPGAGCDPSPVADAGAQSSGRRTAVAAQPDRYASAV

SEQ ID NO: 168901 - protein, 186 aa, Glycine max
  Coding DNA Sequence Number=SeqID_52123
  Gene Ontology: Biological process=response to DNA damage stimulus
  Homolog annotation: Hit_ID=UPI00005F78ED; Match level="QueryCoverage =98%, HitCoverage=59%, E-value=2e-60, Identity=63%"; Hit description =COG2307: Uncharacterized protein conserved in bacteria
MVQPRLQAVARQAFPGAEAHLRQQDRTEIARAILAAAANLLQLAGDLLNAGVQRARTFAAQDQHFVDQRRHQLLLKDGVVGLARRHRAQQAIEAVIFPYRVGMLLQQLLVNAQQPRGAVAALHQRAKPDKTQRIAAQQRAGHRAAKQMRTLFHPVEEAVGTGRRDAAAARVAHLNPRRVNALPHFG

SEQ ID NO: 168902 - protein, 200 aa, Glycine max
  Coding DNA Sequence Number=SeqID_52124
  Gene Ontology: Mol. function=nutrient reservoir activity
  Homolog annotation: Hit_ID=Q1ASQ8; Match level="QueryCoverage=76%, HitCoverage=87%, E-value=8e-34, Identity=49%"; Hit description=Cupin 2, conserved barrel
  Pfam annotation: Domain name=Cupin_2; Domain location=68-143; Score =6.6; E_value=0.059; Accession=PF07883.2; Description=Cupin domain
  Subcellular localization annotation: CTP_CleavageSite=53; ConfidenceScore=5.42e-01
MSAQSSSLLLLMSFAAGTFSAGSSGNPQHLMLSLPSGGVPNNPLPLIIWPCVVPEEEEDSAAWFEKTFSASGWPAAWRAPIFPYTHYHPNTHEVLGVGAGWAEVLFGGDSGRMVTLREGDAVLIPAGVGHKQVFASDDFFTVGAYPEGMSPETVRDEPSRLRASKEQIQRVPLPDRDPFTGGEGAMTEIWLPVAQQLMHQ

SEQ ID NO: 168903 - protein, 187 aa, Glycine max
  Coding DNA Sequence Number=SeqID_52125
  Gene Ontology: Mol. function=porin activity; Cellular component=cell outer membrane; Biological process=ciliary or flagellar motility
  Homolog annotation: Hit_ID=Q74RH7; Match level="QueryCoverage=98%, HitCoverage=61%, E-value=5e-51, Identity=54%"; Hit description =Chemotaxis MotB protein
  Pfam annotation: Domain name=OmpA; Domain location=55-152; Score =65.9; E_value=1.3e-16; Accession=PF00691.11; Description=OmpA family
EDLDSVLSRSDAELAQLRQQIQSIINSYHAQNLLTLETLPQGLRILIQDDQDRMMFPRGSAVLTPFYQRLLTELGPVFNRIDNKIMISGHTDAAQYSGNAAYNNWNLSGDRALAARRALERGGLESTRVLQVNAMSSRMPLDKADPLSARNRRIEIMVLTEAAAETLFQFYGREGENVVKPIADRLR

SEQ ID NO: 168904 - protein, 96 aa, Glycine max
  Coding DNA Sequence Number=SeqID_52126
  Gene Ontology: Mol. function=peroxidase activity
  Homolog annotation: Hit_ID=UPI00005F78EC; Match level="QueryCoverage =95%, HitCoverage=19%, E-value=2e-30, Identity=68%"; Hit description =COG2308: Uncharacterized conserved protein
  Pfam annotation: Domain name=DUF404; Domain location=7-96; Score= -158.5; E_value=2.3e-05; Accession=PF04169.4; Description=Domain of unknown function (DUF404)
MKARDQIASTFYDEMLQSDGQHRAHYQHYWEWLQQADKEAVARKREEAELLFHRVGITFNVYGDDGGAERLIPFDSVPRIIPASEWAMLERGIRQR

SEQ ID NO: 168905 - protein, 266 aa, Glycine max
  Coding DNA Sequence Number=SeqID_52127
  Gene Ontology: Mol. function=oxidoreductase activity; Biological process=tRNA processing
  Homolog annotation: Hit_ID=Q08015; Match level="QueryCoverage=94%, HitCoverage=93%, E-value=6e-95, Identity=66%"; Hit description=tRNA -(ms[2]io[6]A)-hydroxylase
  Pfam annotation: Domain name=MiaE; Domain location=18-261; Score =494.3; E_value=1.5e-145; Accession=PF06175.2; Description=tRNA -(MS[2]IO[6]A)-hydroxylase (MiaE)
MPPGNFPASKEPPMNYASLLDPIHQFLQCRTPQAWIDEARKPENLTLLLTDHMVCELKAAQTAVWLIRKYVADKPSGDAILAWLQPYEDFIFGENHDSDFINAHKNLSKSIIVRNELPWADEMVEKMVLLIKEELHHFYQVWEIMQARGLPYRKITASRYAKGLLREVTTHEPDTLVDKLICGAYIEARSCERFASLAPYLDAQLEKFYISLLRSEARHYQDYLTLAAQISPKDIAPRVRAIGVAEARLISEPDTELRFHSGVPAF

SEQ ID NO: 168906 - protein, 160 aa, Glycine max
  Coding DNA Sequence Number=SeqID_52128
  Gene Ontology: Cellular component=integral to membrane
  Homolog annotation: Hit_ID=Q6D2T9; Match level="QueryCoverage=98%, HitCoverage=98%, E-value=5e-35, Identity=45%"; Hit description =Putative membrane protein
MDAIKQILIDEIDTLNREERRDNLPRFSFNFLKTHPGLWGVMYLCYGLCVALIFSTEMLGWPAFWFATVFVLVMSFLMLLDINPKYRFEDIDTLDLRVCYNGEWYYVQPVSQQALDKILENPGTPERVRSGIDRLMQQKGEVDFYDVYYLTWGHQRAAKI

SEQ ID NO: 168907 - protein, 616 aa, Glycine max
  Coding DNA Sequence Number=SeqID_52129
  Gene Ontology: Mol. function=ribonucleoside-triphosphate reductase activity; Biological process=metabolic process
  Homolog annotation: Hit_ID=Q66F21; Match level="QueryCoverage=53%, HitCoverage=46%, E-value=1e-132, Identity=71%"; Hit description =Anaerobic ribonucleoside-triphosphate reductase
  Pfam annotation: Domain name=ATP-cone; Domain location=289-378; Score= 90.3; E_value=6e-24; Accession=PF03477.6; Description=ATP cone domain
MAYGPARSSAPASLRRRNCGQIDFRHHAHAALGGIVHQLAHLLLAVEQAITGLLLQLRIVTGSKAPALIVGQVPVEHVHARRGDTINLPLEGFQRQEVAHRVDQHAAPREARPIVNGDKGNLRAAGGVGDQLQQGFHAAHRAKTGRCLQQYATAADLQTRIDRVGNPDLNGGTIAGRAGGQQRPAGLPRNAGAPARFGPFQVIAGDVQRKLRRQGKRATACGLRHLLWPRHQRQIACRCGLRGKRQGTQNGQQRTGQKHGGHPSAVDHCTAFRRWPRFFATAEKGKMATVVIKRDGCRVPFDARRIEAAVRAAAQAAQVDDLAWCTTVAQQVSVQLATQAEVDIRDIQCAVEEALMSGRWPQLARAYIEYRHDRDLAREQRGELHHAIRGLVEQTNAALLNENANKDSKVIPTQRDLLAGIVAKHYAQQQLLPRDVVLAHERGEIHYHDLDYSPFFPMFNCMLIDLHGMLTHGFKMGNAEIEPPKSIATATAVTAQIIAQVASHIYGGTTINRIDEVLAPFVTLSLDKHRQIAREWQIADVEAYARARTEKECYDAFQSLEYEVNTLHTANGQTPFVTFGFGLGTDWAARLIQQSILRNRIAGLGKNHKTAVFPKL

SEQ ID NO: 168908 - protein, 131 aa, Glycine max
  Coding DNA Sequence Number=SeqID_52130
  Homolog annotation: Hit_ID=UPI00006A17C9; Match level="QueryCoverage =87%, HitCoverage=97%, E-value=6e-09, Identity=32%"; Hit description =UPI00006A17C9 related cluster
MTQSLAFSKGWTLGGLHALTFRGLHALAFRGLHVLAFRGLHVLHLRRPHVLAIRGLNILAFRGLHILAFRGLHAFAFRELHALTFKGLHALNFRGLHVFALRTTCPHLQTTICPHTKRATRPRLLRTTRPR

SEQ ID NO: 168909 - protein, 57 aa, Glycine max
  Coding DNA Sequence Number=SeqID_52131
MGRNKVGAFDPRPSIDFATAPICNNCWIERSKSVLFRGFGEATKIGEGVAASIVWSW

SEQ ID NO: 168910 - protein, 193 aa, Glycine max
  Coding DNA Sequence Number=SeqID_52132
MPPTRHPLDPDKSNRALGFPTLITGLCQPFGVAVTPNAPPPPRQADPTRSLGMECYVQHLVRQQAANHCGQGQGSAPFACPTPEQFGVEVAWLGDWPEAQAGEEPARSPGEAEEARMDEDMSSLLGFLGGSGATCLAPFVAQYVKFRDMPEIKRKHCYTIWVQIATRPTWAFQDVPPEGGCFWRKQLGSPGRA

SEQ ID NO: 168911 - protein, 128 aa, Glycine max
  Coding DNA Sequence Number=SeqID_52133
RRNLGKERVPERVGIDFGSALWFALRLLGRSSSFTFCLSSSLSQTGLRFRDCNHIVEFVFVEFVSATYRLSSKKTRKGKSPGKGGKRFWKSIVVGFKTPREAIEGDLFVFFSRCQGSLLLVFCVLLSD

SEQ ID NO: 168912 - protein, 94 aa, Glycine max
  Coding DNA Sequence Number=SeqID_52134
TSFGYRKDRNGQWLKKDALPPQDERTPSPPPQRDDSALMTEVFFELRGLRTYVGECFDSLDTRFAGKDIRLTQLEEDVGYIRQSFDLPPPPPPS

SEQ ID NO: 168913 - protein, 163 aa, Glycine max
  Coding DNA Sequence Number=SeqID_52135
  Gene Ontology: Mol. function=aminocarboxymuconate-semialdehyde decarboxylase activity; Biological process=nitrogen compound metabolic process
  Homolog annotation: Hit_ID=Q9SC91; Match level="QueryCoverage=36%, HitCoverage=13%, E-value=9e-19, Identity=73%"; Hit description =Glutamine synthetase I
MIGVLVIRVPLCSHPIDILGAQTVFLEEDDLALRTTAASADLFHEGLTCVVLRRLDTFNDLEVTLRNSGVNDLEEPETPLQATSPPGTPNGLVSNFEMKSFDGSTNPYLGLTAILAAGIDGLCRKLSLPEPVEKLDLHNARYLVKKQLARGLRLNYVEILALR

SEQ ID NO: 168914 - protein, 160 aa, Glycine max
  Coding DNA Sequence Number=SeqID_52136
  Gene Ontology: Mol. function=hydrolase activity, acting on glycosyl bonds; Biological process=carbohydrate metabolic process
  Homolog annotation: Hit_ID=Q9SC91; Match level="QueryCoverage=35%, HitCoverage=12%, E-value=1e-17, Identity=70%"; Hit description =Glutamine synthetase I
MPAASMAVKPKYGLVEPSNDFISKLLTRPLGVPGGDVACNGVSLFLFPKKSYASLHVLETKNVTYKCTIDVGGATIDGNTIITCLIIKTVNVKSISVRTITRSTNINMRKCGTLTTIYVYVRFWTINHDQVGNTKRIEGIDNKNLHHPHENLSHVILRIN

SEQ ID NO: 168915 - protein, 124 aa, Glycine max
  Coding DNA Sequence Number=SeqID_52137
MATRGYKARFVLIIVLPLLLSLMCQEIVATGRLRSKKEGCVSTGIACHVKVTGSHDPLEMDEYDQAFVSPPHDDYDFYRKHGDIPSPDWLKIVIMVLGTKTCLLVKYRAEEDVRDVLYGLLWVF

SEQ ID NO: 168916 - protein, 258 aa, Glycine max
  Coding DNA Sequence Number=SeqID_52138
  Gene Ontology: Mol. function=DNA binding; Cellular component=nucleus; Biological process=regulation of transcription, DNA-dependent
  Homolog annotation: Hit_ID=Q9S7N6; Match level="QueryCoverage=53%, HitCoverage=55%, E-value=2e-09, Identity=30%"; Hit description =Putative MYB family transcription factor; 86049-87165
  Pfam annotation: Domain name=Myb_DNA-binding; Domain location=107 -154; Score=38.8; E_value=1.9e-08; Accession=PF00249.21; Description =Myb-like DNA-binding domain
  Subcellular localization annotation: CTP_CleavageSite=46; ConfidenceScore=5.19e-01
MVAEIIDLSDSPPSSPSSSHNTAARILNFDSVSNGKIQFEKVIPISLMACTNTNQPQSTLWAASGHTNEHSQIATTFQPSMQQRVATVLEPVPESITCMFPHGARLKEPWTHREHELFFVGLIKYGRGHWSKIARQFLLNKTPHQVQSYGASFFRHLPSTHLHGFRRRKPTYSTSSLMPKNNNLMAASVSMPMIVNELQQQTHMLFPENAPFLLAPSHGEASSSNNTTMYGFQMQTGGARTSMNASANGEVDLELRLG

SEQ ID NO: 168917 - protein, 760 aa, Glycine max
  Coding DNA Sequence Number=SeqID_52139
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q06XL8; Match level="QueryCoverage=90%, HitCoverage=87%, E-value=0.0, Identity=79%"; Hit description=KUP2
  Pfam annotation: Domain name=Chromate_transp; Domain location=199 -340; Score=-67.9; E_value=0.091; Accession=PF02417.6; Description =Chromate transporter
  Pfam annotation: Domain name=K_trans; Domain location=1-692; Score =1247.1; E_value=0; Accession=PF02705.7; Description=K+ potassium transporter
  Pfam module annotation: Pfam domain module=Chromate_transp::K_trans; Domain location=199-340::1-692
GTFALYSLICRHAKVSLLPNRQHADEALSTYKMEEAPEKDTSKVKMVLEKYKGLHTALLIVVLLGTCMVIGDGLLTPAISVFSAVSGLEVSMSKKHHQYAVIPITCFILVCLFALQHYGTHRVGFLFAPIVLAWLLCISTLGLYNIFKWNPHVYKALSPYYMFKFLKKTRISGWMSLGGILLCITGSEAMFADLGHFSYMAIQIAFTFLVYPALILAYMGQAAYLSHHHDSELQISFYVSVPESVRWPVLILAILASVVGSQAIISGTFSIINQSQSLGCFPRVKVVHTSDKIHGQVYIPEINWLLMILCIAVTIGFRDTKHMGNASGLAVMTVMLVTTCLTSLVIVVCWHKPPIIALCFLLFFGFIELLYFSASLTKFCEGAWLPILLALFLMIIMYLWHYATIRKYEYDLHNKVSLDWLLALGPSLGIARVPGIGLVFTDLTTGIPANFSRFVTNLPAYHRILVFVCVKSVPVPHVPAAERYLVGRVGPPAHRSYRCIVRYGYRDVHQDIDSFESELVARLADFIQYDWYRSRRSSMSIDDDASNSNESSSYRLTVIGTTGFTIQPGYESGGESMQQASVSVGFPSVQSVTDVIEMEPVVTERRVRFAIDDEPESDARSEAGVQMQEELEDLYAAQEAGIAFILGHSHVRAKQGSSVLKKLALNYGYNFLRRNCRGPDVALKVPPVSLLERHRLQCHSSVQFPKDFVNETVGVTLPLKFNGNLYKIRMLECMTEGLYRCMLPFPVLDATRKMFSKLSD

SEQ ID NO: 168918 - protein, 81 aa, Glycine max
  Coding DNA Sequence Number=SeqID_52140
  Homolog annotation: Hit_ID=Q9SHL7; Match level="QueryCoverage=79%, HitCoverage=7%, E-value=4e-25, Identity=83%"; Hit description =Putative mitotic control protein dis3
MVTSEMFKKPAISVYFQYGIEGPVYLTKAEKGSGEWYVDEQQQKIKKMDGSLSYNVLQTVQIHMEVVEPQPNRPKLQLTLI

SEQ ID NO: 168919 - protein, 481 aa, Glycine max
  Coding DNA Sequence Number=SeqID_52141
  Gene Ontology: Mol. function=ribonuclease activity; Cellular component=exosome (RNase complex); Biological process=rRNA processing
  Homolog annotation: Hit_ID=Q8H885; Match level="QueryCoverage=99%, HitCoverage=39%, E-value=1e-119, Identity=64%"; Hit description =Putative mitotic control protein dis3
  Pfam annotation: Domain name=OB_RNB; Domain location=251-312; Score= -1.9; E_value=0.041; Accession=PF08206.2; Description=Ribonuclease B OB domain
MLHNKSFVKKTKGGKVIKQVREHYLRDDIYCGAPFCTVCDSSSARLSASPSIILVVDTNVVLNQIDLLENPAIDDVVVLSIVLEEVKNKNMSVYNRIRAICSNSMRKFFVFSNEYHSITKERKGKLRMQDTYIKEMSGETKNDRNDRAIRVATQWYQNHLGGAVKVLLLTNDKENKRKASEEGILAETVESYVKSLDQPDLLDLLVRPASEDVDMEEVEDLRPSKRKVIYSEHKPMSEITSGLHRGIYHQGKLRVNRYNPFEAYVGSESIGDEIIIYGRSNMNRAFDGDIVAAELLPQDQWQGVSSLSIAHEEFVFKFLRLGRHLPSFLKSHEESNTFLEYGLLFNRVNLVFGGNGEEPVQQQRSGSDLDVIRWSVVVMGYAATVEYLHALRRPIRRLWSHGPYDLSRVTRSTLAPLLVLCASQVIGPEDEDEDEDVHLAPNSADDAPRTISQQGSSEQVNAVPSRPSGRIVGIIKRNWHS

SEQ ID NO: 168920 - protein, 187 aa, Glycine max
  Coding DNA Sequence Number=SeqID_52142
  Gene Ontology: Mol. function=protein binding
  Homolog annotation: Hit_ID=Q01GH7; Match level="QueryCoverage=67%, HitCoverage=20%, E-value=9e-13, Identity=34%"; Hit description=[S] KOG2545 Conserved membrane protein
MVGPQYDFLANPLGAVRSTFDAAVASVPDPSAFDGRDWGVLPLFQHFLSDPSRLSQVPLLTPATIQWVKPNTLVRFRGMIQDMLGNEFYVGAYKDGSVWRTNKFMDASQSLTASSADMRIWERRLLYCVPVPGLSPWTQVSTEEFGHLSMDRTSENREKRRREDDESSDMPVISGLVLLLLLIYCFL

SEQ ID NO: 168921 - protein, 198 aa, Glycine max
  Coding DNA Sequence Number=SeqID_52143
  Gene Ontology: Mol. function=metal ion binding; Cellular component =integral to membrane; Biological process=ubiquitin cycle
  Homolog annotation: Hit_ID=Q9LZV8; Match level="QueryCoverage=77%, HitCoverage=94%, E-value=6e-36, Identity=51%"; Hit description=RING -H2 finger protein ATL5A
  Pfam annotation: Domain name=zf-C3HC4; Domain location=112-153; Score= 34.8; E_value=3e-07; Accession=PF00097.15; Description=Zinc finger, C3HC4 type (RING finger)
  Subcellular localization annotation: CTP_CleavageSite=20; ConfidenceScore=5.03e-01
MALHHRLLLVDTNSSSPAPSSMNKTRETFTGDANFDTNMVIILAALLCALICALGLNSIVRCALRCSRRFAFETPEETAARLVAKGLKKSALHQIPIVVYGSGSASIAATDCPICLGEFVDGEKVRVLPKCNHRFHVRCIDTWLLSHSSCPNCRQSLLEHTTISGAVAVAAGTSHHAGNALGGRHEHESLSVAVEVVG

SEQ ID NO: 168922 - protein, 190 aa, Glycine max
  Coding DNA Sequence Number=SeqID_52144
  Gene Ontology: Mol. function=DNA binding; Biological process=DNA integration
  Homolog annotation: Hit_ID=Q60DN3; Match level="QueryCoverage=45%, HitCoverage=10%, E-value=7e-13, Identity=42%"; Hit description =Integrase core domain containing protein
MNNWHMKRLDVNNAFLHGDLNEEMYMFLPPGTTAAKPGQDLGDLRFFVGFEVARSTRAVETPQLKAFSDSDWAGCLDTRHSITAKYKAMISVTCELQGFTYLLEDFGIQFNRPVLLYYDNRSALSGFGTKDIGSKWFLFNDNDDNPLGYDSGGATRIEALELGAENVEQHGEERAKEAVGADGEAEVVVA

SEQ ID NO: 168923 - protein, 369 aa, Glycine max
  Coding DNA Sequence Number=SeqID_52145
  Gene Ontology: Mol. function=ubiquitin-protein ligase activity; Cellular component=ubiquitin ligase complex; Biological process =protein ubiquitination
  Homolog annotation: Hit_ID=Q9FLD1; Match level="QueryCoverage=31%, HitCoverage=44%, E-value=4e-15, Identity=44%"; Hit description =Arabidopsis thaliana genomic DNA, chromosome 5, TAC clone:K18I23
MSSEDITLVPDQRIENGLNSPLVFQDDPLRFNCPTPHQRRVGDPPPKTRELGAFIDDNKMFIDRDRFFAAAQNPEFRRYADCSARRDPPHARNWSATDDDEESDDDDEDDDDDEADDTEVGGLVGDGTKSELNNNNNNNGGANLPAVANGKAHSYVSGRELLVKDGGDIGQLVHSNVSGGDEDHRQEGLGKSQNSVTVAETDCEEYYSHYLHGGEGASGQKVMVDDSGCGFSGRKDAMYSSESGESLRAILSDPVTGALMDDAMILPCGHSFGGGGIEHAIRMGGFGDSVVMEPSRSRGVQFPFAVMDRVIIKDTTTLCWARSYCYNAMPEWMTLDNAESVKLQYRSLAKVMDDPSKPAASSKMPPNWL

SEQ ID NO: 168924 - protein, 423 aa, Glycine max
  Coding DNA Sequence Number=SeqID_52146
  Homolog annotation: Hit_ID=Q1RYT8; Match level="QueryCoverage=29%, HitCoverage=22%, E-value=3e-10, Identity=35%"; Hit description=IMP dehydrogenase/GMP reductase
  Pfam annotation: Domain name=zf-C2H2; Domain location=68-90; Score =23.0; E_value=0.0011; Accession=PF00096.16; Description=Zinc finger, C2H2 type
MKISKNKGLKPEQEKASNSNNGVLMDFMKLSKDDKAQEQPSSKVVVDSSLCDSKGADDEKNTKEAKTFSCNYCKREFSTSQALGGHQNAHKQERALAKCAQGFDVGGFGHFPYYPYPSFYNSHSPYGGSFNRALGVQTDSMIHKHPWTPRYGHSWLKQDRVTIPNSSIFDGFEIVKGYYPIMKSDGTLTLRQENGNGNANVGTLSLFANYATNSSSQVINSDGNANVGTLSLFANAATTPSSQLGHRAILATKKIDDYSMPEETSKGKLDLHQDFPIIQPHSTLITYDDIPQLELHSALDTPLPNDLDPHSPLAINTEPIHTIAPSFLATIVVPRQSKRQVHRLERFKDFLTQFTPTVTIDSSVSHYPLSSVLIYTKLSLSYRHAIMFISSHTKPKTYAEASKPDQWIEIMNVEIQALESNHT

SEQ ID NO: 168925 - protein, 256 aa, Glycine max
  Coding DNA Sequence Number=SeqID_52147
  Gene Ontology: Mol. function=isomerase activity; Biological process =flavonoid biosynthetic process
  Homolog annotation: Hit_ID=Q53B71; Match level="QueryCoverage=52%, HitCoverage=99%, E-value=8e-60, Identity=88%"; Hit description =Chalcone isomerase 4B
  Pfam annotation: Domain name=Chalcone; Domain location=48-255; Score =57.5; E_value=4.4e-14; Accession=PF02431.6; Description=Chalcone -flavanone isomerase
MAKGFDANQEEMRHGFIEGNIVVKWVGTMNGGTRATYRMGGLGTSHEMATEEVLVDEITYPSKITTTKPLSLLGHGITDMEIHFIHVKFYSIGIYLEPEVVGHLEQFKGISAKELEENDEFFNALISAPVEKFIRLVVIKEIKGAQYGVQIETAVRDRLAAEDKYEEEEEEALEKVIEFFQSKYFKKHSVITYHFPTNSATAEIVVSLEGKEDSKYVIENANVVEAVKKWYLGGSSAVSSSTIRSLASTFSQELSK

SEQ ID NO: 168926 - protein, 287 aa, Glycine max
  Coding DNA Sequence Number=SeqID_52148
  Homolog annotation: Hit_ID=Q9FLC9; Match level="QueryCoverage=46%, HitCoverage=71%, E-value=1e-17, Identity=36%"; Hit description =Arabidopsis thaliana genomic DNA, chromosome 5, TAC clone:K18I23
  Subcellular localization annotation: CTP_CleavageSite=40; ConfidenceScore=5.31e-01
MTWQSRFRHGIHIAPYWPSFAQSERSLCARLRNPCTFRVRARATLVIVSFIYSFAPIPSPPSILTLFTHNCSPRLASFSDGVVSGHCLRRKQQRQLRDAEAAVRSGSPAAVLRLDGPVYGEGREDHGGDADGEGARDYSDDHDGGNGAAREARARRSEKRRPRGTGEAGQVDERVGGGDREEFEGGAAAGAGFSQIGDDGDGEEGGGGGLAGGEGAVGIRRDAGSGGIDIRGGVGRGHGGGRWRREDDEGVGGGGSGEGRRVRERLQGNGSVAAQEYLAFAEPVPVE

SEQ ID NO: 168927 - protein, 95 aa, Glycine max
  Coding DNA Sequence Number=SeqID_52149
MACFTRRAYKTYCTLQLQLHLVRLPPALCAPSPACLPQLYCQVDWRNHYFASGIVVLFLSIVFTSYEKNCKVGNISISKGELEIHVFIYVTKKAG

SEQ ID NO: 168928 - protein, 155 aa, Glycine max
  Coding DNA Sequence Number=SeqID_52150
  Gene Ontology: Mol. function=two-component response regulator activity; Cellular component=nucleus; Biological process=two -component signal transduction system (phosphorelay)
  Homolog annotation: Hit_ID=Q9FPR6; Match level="QueryCoverage=91%, HitCoverage=94%, E-value=2e-45, Identity=68%"; Hit description=Two -component response regulator ARR17
  Pfam annotation: Domain name=Response_reg; Domain location=17-142; Score=85.0; E_value=2.4e-22; Accession=PF00072.14; Description =Response regulator receiver domain
MAASSSSNWVMESGDVPHVLAVDDNLIDRKLVEKLLRNSSCKVTTAENGPRALELLGLTSGGQNNMNGRSKVNMIITDYCMPGMTGYELLKKIKESSVMKEVPVVIMSSENIPTRINKCLEEGAQMFILKPLKQSDVRKLTSALQNPAFVMAVFC

SEQ ID NO: 168929 - protein, 344 aa, Glycine max
  Coding DNA Sequence Number=SeqID_52151
  Gene Ontology: Mol. function=aminoacyl-tRNA ligase activity; Cellular component=extracellular space; Biological process=tRNA aminoacylation for protein translation
  Homolog annotation: Hit_ID=Q7XJM9; Match level="QueryCoverage=99%, HitCoverage=76%, E-value=1e-76, Identity=47%"; Hit description =Putative methionyl-tRNA synthetase
  Pfam annotation: Domain name=tRNA_bind; Domain location=244-339; Score=133.2; E_value=7e-37; Accession=PF01588.10; Description =Putative tRNA binding domain
MATIESRRKSVALALSKYFSLDPVSACYGFQFATHIFIEHFKTNAEKFHGVGVALHLPSVVPADSSDSDIKSLYLNIIAVSGHRVNHSDEWVAFAEAFPVALDACFENLKRLNDELSGKAVLLGNGLNPSEADVIVYSVVHSSLINLSDTSKEKLPHVLRWMDYIQVTKPVGAVEADLKSNKTEQSIKNVNKSEADSSKDKNKAEGKATGGKSTGDKEPTKGKAKPADKVAEKENEVSVSLLNIQVGLIHKAWKHPSADSLLVEEIDVGEAKVRQVVSGLAKYYSPDELMNRRVVLITNVKPGKLRDVMSEGLVLCASNEGPTIVEPLLPPEGAKIGEHISFSG

SEQ ID NO: 168930 - protein, 84 aa, Glycine max
  Coding DNA Sequence Number=SeqID_52152
MPCSKAEFLVYTKSTCFSGSPPVYIEIYGAKQGYGGNITHYRSHGSSKLLNHKDQQLTKNMFTLPISCILQAISKRNNNTNEPE

SEQ ID NO: 168931 - protein, 177 aa, Glycine max
  Coding DNA Sequence Number=SeqID_52153
IFEKEVVVGVCHPDTDQRSRGLGLCRSYGVLVTPSKVIRPPITRAFIEKYCMPKQAQGDAHQAAGAPLPPRKADPAGPLGVEHYLQHLVRQQAVNHRGQVQIHECLYRFSLSQQGQGSAPFICPTPEQFGVVVAWPGDWPDAQAGKEAARSPGGADESHRDEDMTGLLSFLGGSGAT

SEQ ID NO: 168932 - protein, 366 aa, Glycine max
  Coding DNA Sequence Number=SeqID_52154
  Gene Ontology: Mol. function=calcium ion binding; Cellular component =mitochondrion; Biological process=embryonic development ending in seed dormancy
  Homolog annotation: Hit_ID=Q6YW98; Match level="QueryCoverage=96%, HitCoverage=85%, E-value=1e-77, Identity=29%"; Hit description=PPR protein-like protein
  Pfam annotation: Domain name=PPR; Domain location=105-139; Score =52.1; E_value=1.9e-12; Accession=PF01535.11; Description=PPR repeat
  Pfam annotation: Domain name=PPR; Domain location=140-174; Score =40.7; E_value=4.9e-09; Accession=PF01535.11; Description=PPR repeat
  Pfam annotation: Domain name=PPR; Domain location=175-209; Score=2.8; E_value=3.5; Accession=PF01535.11; Description=PPR repeat
  Pfam annotation: Domain name=PPR; Domain location=22-55; Score=32.8; E_value=1.2e-06; Accession=PF01535.11; Description=PPR repeat
  Pfam annotation: Domain name=PPR; Domain location=244-278; Score =16.0; E_value=0.095; Accession=PF01535.11; Description=PPR repeat
  Pfam annotation: Domain name=PPR; Domain location=279-313; Score =14.6; E_value=0.14; Accession=PF01535.11; Description=PPR repeat
  Pfam annotation: Domain name=PPR; Domain location=70-104; Score=0.2; E_value=7; Accession=PF01535.11; Description=PPR repeat
  Pfam module annotation: Pfam domain module=PPR::PPR::PPR::PPR::PPR::PP R::PPR; Domain location=105-139::140-174::175-209::22-55::244 -278::279-313::70-104
MAEKAQEIFNKMEKLGCFPSIVTFNALMDGLCKAGKLEEAHLLLYKMEIGRSPSLFFRLSQGSDQVLDSVALQKKVEQMCEAGQLLDAYKLLIQLAGSGVMPDIVTYNVLINGFCKASNINGALKLFKDMQNKGLSPNPVTYGTLIDGLFRVGREEDAFKIHKHMLKHGCEPSFEVYRALMTWLCRKKRVSQAFSLYLEYLKNLRGREDNSINALEECFVRGEVEQAFRGLLELDFRFRDFALAPYTILLIGFCQAEKVNEALLIFTVLDKFNININPASCVYLIRGLSENGRLDDAVNIFVYTLDKGFKLKSSVCEQLLKILSQDKKECAIDLVPRMKSAGYCLNALRTSPLRKEAMNRETQYTF

SEQ ID NO: 168933 - protein, 300 aa, Glycine max
  Coding DNA Sequence Number=SeqID_52155
  Gene Ontology: Mol. function=protein tyrosine/serine/threonine phosphatase activity; Biological process=protein amino acid dephosphorylation
  Homolog annotation: Hit_ID=Q2QYN1; Match level="QueryCoverage=73%, HitCoverage=78%, E-value=8e-87, Identity=71%"; Hit description=Dual specificity phosphatase, catalytic domain containing protein, expressed
  Pfam annotation: Domain name=DSPc; Domain location=138-255; Score =23.9; E_value=2.2e-06; Accession=PF00782.11; Description=Dual specificity phosphatase, catalytic domain
  Subcellular localization annotation: CTP_CleavageSite=50; ConfidenceScore=5.08e-01
MGTVSNIGFPSLFRVHLDSQVLSKHMKNKSSCDFMVPSNHNYSVRLSPICCKLSESGIEENHTSTSTGERPSKIKDRMEEYNIAMKKMMRNPYEYHHDLGLDISSISSMKDWISQAEVFRIEHLQKPEDIDHLKKEEGVAYILNLQQDNDVEYWGVDLQSIIRRSRELEISHTRRPAKDFDPDSLQNELPKAVSSLEWAISEGKGRVYVHCTAGLGRAPAVAIAYLFWFCDMNLNEAYDMLTSKRPCGPNKRAIRGATYDLAKNDPWKEPFETLPEYAFEDIADWERNLIQDRARSLRGI

SEQ ID NO: 168934 - protein, 463 aa, Glycine max
  Coding DNA Sequence Number=SeqID_52156
  Gene Ontology: Mol. function=protein serine/threonine kinase activity; Cellular component=membrane; Biological process=protein amino acid phosphorylation
  Homolog annotation: Hit_ID=Q8RYK7; Match level="QueryCoverage=75%, HitCoverage=90%, E-value=1e-60, Identity=41%"; Hit description =Putative disease resistance protein kinase
  Pfam annotation: Domain name=DUF948; Domain location=83-165; Score= -26.9; E_value=0.078; Accession=PF06103.2; Description=Bacterial protein of unknown function (DUF948)
  Pfam annotation: Domain name=Pkinase; Domain location=162-423; Score =28.2; E_value=3.1e-10; Accession=PF00069.15; Description=Protein kinase domain
  Pfam annotation: Domain name=Pkinase_Tyr; Domain location=162-423; Score=19.0; E_value=1.2e-13; Accession=PF07714.7; Description =Protein tyrosine kinase
  Pfam module annotation: Pfam domain module=DUF948::Pkinase::Pkinase _Tyr; Domain location=83-165::162-423::162-423
MHLLSAAEALFTFKGSIGGPQQLGCSIVKYPCQMQWPCLDCYKLKDPGGITAKIDGNNDVPTLTPLQETQVRKPGGTRAAAIVGILVAALVVIVILVTVCICLMRVKRFMRQTSEAASSMPSPTVEMGRVNNTQNVNAFPPHYTLNTRQLTILELEQATRNFSHSNIISEGGFGFVYKGLLQDGSIVAIKRRLFALTQDFVLEVNQIAHIHHTHLVKLIGYYEDSYQQLLVYEYLPNGNVGSHLYDSEGLPIGRLDLWRRISIALGASKGVEHLHSLVPPLVHTNFRTSNVLLDENYTAKVAVYGFCKLQTQVDNAGSSSHVDCFLDPELSFPQNYSEKSDVHSFGVFLLELISGCEAHRKSLSNPDENIVFKAKNSVDLDNFVDITLGEQEKHGARRMMKLALLCVDVTSRRPSMAQIVQELEQIQREIAPVYSQFNEEIGAVTLGSELFQYNWSWKDIIHL

SEQ ID NO: 168935 - protein, 155 aa, Glycine max
  Coding DNA Sequence Number=SeqID_52157
MDEGQLMYDSIMSKEIDMNEQDGDEAGVNEEHVDCSDVFNIYQVRHKQWYERKDLIGFVLIGCERSDQYKSKKKYFVRRDTDTRKCECPFKLVGNEWLEANNDSKQQPLKRRRKLTSTPKMARRWWRRPQRRQWKQRTAAARHKSKKIKEEDENM

SEQ ID NO: 168936 - protein, 214 aa, Glycine max
  Coding DNA Sequence Number=SeqID_52158
MALPPLVEWHRGRKPGKTKADNQRILTPSKFSLISVKLKHRKKVGREVKNLKTLAQCTIRAQRDAVAYASCWLLSVDYRVIQSIGPRLEIANSGHIRKRPKMRIGRIGTLVQRLPKRTDGSHQGCKVEEVGDMDVSRGLVCKYGTVHQVQKISCCSPQCRRHDTSSIVMVISSTDRSLLKDVIGHVLMQSASDASLKHHPFHVRGPRPHEKDHV

SEQ ID NO: 168937 - protein, 52 aa, Glycine max
  Coding DNA Sequence Number=SeqID_52159
MGEGEKLQLGTVGALSLSVVSSVSIVICNKALMSSLHFIFVSLNMENHGLNP

SEQ ID NO: 168938 - protein, 117 aa, Glycine max
  Coding DNA Sequence Number=SeqID_52160
  Gene Ontology: Mol. function=oxidoreductase activity, acting on single donors with incorporation of molecular oxygen, incorporation of two atoms of oxygen; Cellular component=plastoglobule; Biological process=abscisic ...
  Gene Ontology: Biological process=acid biosynthetic process
  Homolog annotation: Hit_ID=Q8LP14; Match level="QueryCoverage=98%, HitCoverage=20%, E-value=6e-45, Identity=71%"; Hit description=Nine -cis-epoxycarotenoid dioxygenase4
  Subcellular localization annotation: CTP_CleavageSite=69; ConfidenceScore=5.41e-01
MENDTGFPLIPNVFSGFNSLVASATYGSLSVARVLTGQFNPANGIGLANTSLAFIGNRLFALAESDLPYAVNVTPDGDIDRLGRHDFDEKLTFSMTTHPKIDLDTVECFAFRYGPVP

SEQ ID NO: 168939 - protein, 195 aa, Glycine max
  Coding DNA Sequence Number=SeqID_52161
  Gene Ontology: Cellular component=integral to membrane
  Homolog annotation: Hit_ID=Q6K225; Match level="QueryCoverage=77%, HitCoverage=47%, E-value=2e-35, Identity=52%"; Hit description =Phosphate translocator-like
MRRWKWICVSFSLLVNNHFPPTQLLVALVKLEVFLDTVCGNVTGSVGLLLPSNVNKISIHEEATTLTSWHLLVTFCSLHVALKMRFFEHKPFEQKAVMGFGILNGISIGLLNLSLGFNSVGFYQMTKLAIIPCTVLLETIFLGKRFSKRIQFALSILLLGVGIATVTDLQLNALGSFLSFLAVITTCVAQIVSLK

SEQ ID NO: 168940 - protein, 197 aa, Glycine max
  Coding DNA Sequence Number=SeqID_52162
  Gene Ontology: Mol. function=superoxide dismutase activity; Cellular component=mitochondrion; Biological process=superoxide metabolic process
  Homolog annotation: Hit_ID=Q56VR0; Match level="QueryCoverage=83%, HitCoverage=84%, E-value=1e-67, Identity=65%"; Hit description=Mn -superoxide dismutase
  Pfam annotation: Domain name=Sod_Fe_C; Domain location=97-192; Score =89.9; E_value=7.6e-24; Accession=PF02777.8; Description =Ironmanganese superoxide dismutases, C-term
  Pfam annotation: Domain name=Sod_Fe_N; Domain location=39-110; Score =111.9; E_value=1.8e-30; Accession=PF00081.12; Description =Ironmanganese superoxide dismutases,
  Pfam module annotation: Pfam domain module=Sod_Fe_C::Sod_Fe_N; Domain location=97-192::39-110
MAARALLTRKTLATVLRNDAKPIIGAGIAAATHSRGLHVYTLPDLDYDYGALEPAISGEIMQLHHQKHHQTYITNFNKALEQLQDAVAKKDSSAVVKLQGAIKFNGGALVQKVNAEGAALQGSGWGGHRSYWVCVPFLPDLDPLVTKGPNLVPLLGIDVWEHAYYLQYKNVRPDYLKNIWKVINWKYASEVYEKESS

SEQ ID NO: 168941 - protein, 94 aa, Glycine max
  Coding DNA Sequence Number=SeqID_52163
MSLIQAQEEMSRQTIFAIVVEELSFEQQGRQEIMGDCFILQDADRCNLFSWVDEYIDVGATEIGRIEPIPNFGLRLRLEILQREVRVLTFWGKR

SEQ ID NO: 168942 - protein, 207 aa, Glycine max
  Coding DNA Sequence Number=SeqID_52164
  Gene Ontology: Mol. function=DNA binding; Cellular component=nucleus; Biological process=regulation of transcription, DNA-dependent
  Homolog annotation: Hit_ID=Q66RN1; Match level="QueryCoverage=33%, HitCoverage=23%, E-value=8e-18, Identity=66%"; Hit description=MYB transcription factor
  Pfam annotation: Domain name=Myb_DNA-binding; Domain location=86-132; Score=42.3; E_value=1.6e-09; Accession=PF00249.21; Description=Myb -like DNA-binding domain
MSPPSETIATRVPPMLSPVEDATYVQPNLQDQLLALQNINSGNNTYDHPQTQFVNSATNQVAPMWPGSQINHSLSRKGSSSKSNECRRWSEEEHRLFLHELQKYGKGDWINISRIIKTRNPTQVASHAQKYFLRQASSNKGKRRSIHDMVLPDGPVPHRIYQQNGVSFPNLDGPITHHIDHQNEVPFQNLTMQELYEIHLAVPHYIN

SEQ ID NO: 168943 - protein, 122 aa, Glycine max
  Coding DNA Sequence Number=SeqID_52165
MEESHWENNNDHISQSRGSALDGEEHIGEWRNPIGKITKITFPSQEGPLLTVKNTLENGGIPSENNKYNISQSRGSALDGEEHLGEWRNPIGKITKITFPSQEGPFLTVKNTLENGRIQSGK

SEQ ID NO: 168944 - protein, 263 aa, Glycine max
  Coding DNA Sequence Number=SeqID_52166
  Gene Ontology: Mol. function=signal transducer activity; Cellular component=membrane; Biological process=signal transduction
  Homolog annotation: Hit_ID=Q4BAZ2; Match level="QueryCoverage=98%, HitCoverage=46%, E-value=2e-29, Identity=32%"; Hit description =Chemotaxis sensory transducer precursor
  Pfam annotation: Domain name=HAMP; Domain location=190-262; Score =14.1; E_value=0.077; Accession=PF00672.15; Description=HAMP domain
MKISTRLATGFGLLVVLFIICTGIALNALSNASKGMDDAVNVKMKKYQLVLDMRGSIRDMGIAVRNLALLTDIEAMKPEWERVQKQEAQYIASRKALAEVMQEDSTPQGREVMSRITEAEEPALASLKQAGRLGLENRAEEATAYLLNVTRPVQSTLLKALNDMTLVQMKNTQSAVEINSQATRRASLILMLLAAASALLAVGTCVMTIRVLMRQLGGEPVQAQTLAATIASGDLTTPVTLRNNDSTSLMASLDGMQANLRGL

SEQ ID NO: 168945 - protein, 285 aa, Glycine max
  Coding DNA Sequence Number=SeqID_52167
  Gene Ontology: Mol. function=RNA-directed DNA polymerase activity; Biological process=RNA-dependent DNA replication
MALKHKVQSLIEVGWLTFQEDRPSIKTNPLANHGGAAVNAIEVCRLHRPKHLKDVMTSRRFIHEALQKAGVIPCGGHKKDFCLMRSGMPQDIETCLAVGELLQQMIDQGWLEVSNEEEEEQHICMQLVDKESPQKPKPLVIHFTRNTAPQRPRHPSAVSGVRLVPFPYKNSHAVPWRYAPPGDRKEEATDIDSLLAKVTNITGLSSITRSGRVFKPPDLPTQPTNAKGESKGDRRTKHQGDPCTRQGCSDGGICQGKRGPQQERGIARGGQRVRLHYPTEQVQGH

SEQ ID NO: 168946 - protein, 138 aa, Glycine max
  Coding DNA Sequence Number=SeqID_52168
MPRIHDAILYYNGKWNMPPQNKFVGCAFTGKNPKKFQIPSTCTIDELKNLIKQVAPKGIPPLGIHESQTVRRLFFRQPARFEYSDTVIKYEINELITNEELLKVLVQSNYWKKYGPIEILAVFTKYVEDEVSGTSLNN

SEQ ID NO: 168947 - protein, 143 aa, Glycine max
  Coding DNA Sequence Number=SeqID_52169
VTRCHLEKSTPFSCGGRCCFPLECPAHVPLSCPVVEFLRRTISVGGREVARWSTVGQCAGEERQRSTVVMPVAWARSGAQSGPWIGQLGMSGTARGVRDHVSGSSPPQARTRCVNRTVRGEPQDEAGVCCERPAATRARRATG

SEQ ID NO: 168948 - protein, 133 aa, Glycine max
  Coding DNA Sequence Number=SeqID_52170
WIFVDSGNEMEHETFLATWLAEIDFSPNGLVSKEMSPHVMQDGGSSQYCIIIVILQRILLGERAVYAMMLVFPPEFSPLKTILFGNPSQDTVEPLMEALVEDYKDENEINESRQFIGGVLDLEKRINRLDTLT

SEQ ID NO: 168949 - protein, 73 aa, Glycine max
  Coding DNA Sequence Number=SeqID_52171
QKRLNLEVLKGAVALSSPFGLSVHPTLSAALARLARQKNLAEHQYQGRVLCAMVDFSQVQRITCAKLKSTYSH

SEQ ID NO: 168950 - protein, 217 aa, Glycine max
  Coding DNA Sequence Number=SeqID_52172
MGFIIQQRRSQHIININRTTESKVMAVQICMGIPYQLSSAMIYYGPQSDIRVKTSARRNFFESSLLNSEFLNRFLALCGDPEERLWSFVFVMGFIFQQRWPQHIINIYRKTESKVSDLTQRSRGKVMAVCICDWLHFSTTTVSIYHKNLSDYRVKSYDCSNLRRYLVSTFELHNILWASIGHLSQNFCPSELARVFLVDFLVSPYVTTRLVATVSTL

SEQ ID NO: 168951 - protein, 85 aa, Glycine max
  Coding DNA Sequence Number=SeqID_52173
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q8ZRJ0; Match level="QueryCoverage=100%, HitCoverage=17%, E-value=2e-32, Identity=77%"; Hit description=3 -isopropylmalate dehydratase large subunit 2
MAGKTLYEKLIEQHVVRHLDDEGHVLLYIDRSILNEYTSPQAFSGLRDRSRRVRHPATILLNVDHVNPTRPVRDAAMTDAGGQLQ

SEQ ID NO: 168952 - protein, 548 aa, Glycine max
  Coding DNA Sequence Number=SeqID_52174
  Gene Ontology: Mol. function=malate dehydrogenase (acceptor) activity; Cellular component=membrane; Biological process =tricarboxylic acid cycle
  Homolog annotation: Hit_ID=P33940; Match level="QueryCoverage=92%, HitCoverage=91%, E-value=0.0, Identity=68%"; Hit description =Malate:quinone oxidoreductase
  Pfam annotation: Domain name=DAO; Domain location=32-451; Score= -17.9; E_value=7.8e-05; Accession=PF01266.14; Description=FAD dependent oxidoreductase
  Pfam annotation: Domain name=Mqo; Domain location=27-517; Score =1148.0; E_value=0; Accession=PF06039.5; Description=Malate:quinone oxidoreductase (Mqo)
  Pfam module annotation: Pfam domain module=DAO::Mqo; Domain location =32-451::27-517
MTQTKKLVSALSLTALLVSSAVHAENAPEKTDVLLIGGGIMSASLGTWLQELQPGWKQLMVERLDGVALESSNGWNNAGTGHSANMELNYTPERADGSIDVSKALEINESFMITRQFLTSQVQRGVLHDPRSFINSTPHMSFVWGDKNVEYLTKRYAALQKTTLFQGMKFSTDHKQIEQWAPLVMEGRDPNQKVAATWTPVGTDVNYGEITRQLIGSLQKDQNFKLETSSEVTDFKRNSDNSWHVTIKDVKSGANREVDAKYVFIGAGGAAIKLLQKTGIPEADNYGGFPVGGSFLMTENPEITSRHLQKVYGQASVGAPPMSVPHIDARNLDGKKVVLFGPFATFSTKYLKNGSLFDLLSATTTSNFMPMTHVGIDNFDLVKYLIGQVMLNDDDRFAALKEYYPNARKEDWKLIQAGQRVQIIKKDAEKGGVLKLGTEIVTDQQKTVAALLGASPGASTAAPITLNVMQKLFPQQFASPEWQQKIRAIVPSFGQKLNGNTALTQQVWDNTASVLQLTKPPVINMDDQQSAPAHAKPREESAKHDMAL

SEQ ID NO: 168953 - protein, 226 aa, Glycine max
  Coding DNA Sequence Number=SeqID_52175
  Gene Ontology: Mol. function=transferase activity; Biological process= D-ribose metabolic process
  Homolog annotation: Hit_ID=Q8UBF3; Match level="QueryCoverage=49%, HitCoverage=35%, E-value=9e-40, Identity=70%"; Hit description=ABC transporter, nucleotide binding/ATPase protein
MTAAENLITGNPDLTAIYATGEPALLGAIAAVENQGRQKDIKVFGWDLTAKAISGIDGGYVTAVLQQDPKKMGEEALKALNSLTAGKTVSKTILVPATVVTKANVDSYRSLFNIGKRVQRAGATDGDRRRRAGMLQRQQVGRDAAQQGRRQQHGEEGVTGAGGIDGRDVDRRAVHALIAAYQQRTGSTLGNHQRVNAGGLQQIGFRLIDHRDVNQWPEIGEVRIDR

SEQ ID NO: 168954 - protein, 52 aa, Glycine max
  Coding DNA Sequence Number=SeqID_52176
MLQPCGISIGLKEHSNRVTPKAYTSKSPSGSLPPNSDTTHELYNTHDLTLMF

SEQ ID NO: 168955 - protein, 457 aa, Glycine max
  Coding DNA Sequence Number=SeqID_52177
  Gene Ontology: Mol. function=binding; Cellular component=integral to membrane; Biological process=electron transport
  Homolog annotation: Hit_ID=Q8XQZ5; Match level="QueryCoverage=90%, HitCoverage=12%, E-value=3e-77, Identity=41%"; Hit description =Probable hemagglutinin-related protein
GVGFTLNVAASAARGNADGKDTSWTSSTVTAGKVLGLQSGGDTSLIGAIGQADRIVASVGNNLRIETLQDISTYASKQQSAGIAGSLCYGYCTSSISGNVSQGQMKSNFKSASEQAGLKAGDGGFIVDVKNNTTLIGGLIASSDKAVAEGLNTLATGTLVTENLKNSASYKASQVGISGGYGWGGSGGKDGGKDAGLGTDAKGNVAGGSKAQPGTSVPQTSGGLGMGTPMVAAASGRDSSTTYSAISGGKVVIRDAVAQQNLSGMTVAGTIASLNRDTSSDTLNALKPIFDKEKIEAGFEIVSEANRQVGQFLTNRAKEIDSAKRRSEDASLPYAERVQAAREYADLESKWGARGSYSQWSTIIVGAASGNVMGGTSQFVQAAAVTYLQTLGAAQIKELSRQLGGEGSVGHAALHTVLGCAGAAAQGASCGAGGVGALSGVVLGQLLESAEADKTKG

SEQ ID NO: 168956 - protein, 66 aa, Glycine max
  Coding DNA Sequence Number=SeqID_52178
MTDLVSAEDDAFHLTDSKKVYTDNHSGISARQRDSKVSMTDLVSAEDDGAGDDVSLCVLSGFSSYG

SEQ ID NO: 168957 - protein, 189 aa, Glycine max
  Coding DNA Sequence Number=SeqID_52179
  Subcellular localization annotation: CTP_CleavageSite=30; ConfidenceScore=5.08e-01
ASRARARPAKLSSTTTAPTPAPTSAAPSVPAQIDSQHFEAMLQNIHQEQIILLQSLQVVAPPGSIPSVEQFTKMVAWPGTQPSLHREDGGPTAQPIIIEEEAEETQVRQVVAATPERSLEATSDPSTQGEDIPSPQPAVDPSTPLLEMSEDPTTSFLAMDTSPPATLVLHLTDKEDVQTQDTQDQSQEF

SEQ ID NO: 168958 - protein, 83 aa, Glycine max
  Coding DNA Sequence Number=SeqID_52180
MMKKNTYRLERILLSFRVFWTGLTDFKPMLVRGLTIWNIKWTHNSRRWTQGLQRFVIIKKGEIVETSFMMMNNNFDDAKSSND

SEQ ID NO: 168959 - protein, 164 aa, Glycine max
  Coding DNA Sequence Number=SeqID_52181
  Subcellular localization annotation: CTP_CleavageSite=27; ConfidenceScore=5.07e-01
MLSGMEASRTLQTSSQRSQWVLHLLPRSMSDPLKPTQDFSAHFVLTHMFSGNFPKGHTSYNYSKPRRLNYEVSQPTLRQGCKKAKIDGPNAWTCHQRLFKENVRKTKKARSADFESEGSGVVYARGSKTRHPGELLLHPEATLLAQASCLLHHEVIWWPRRARG

SEQ ID NO: 168960 - protein, 40 aa, Glycine max
  Coding DNA Sequence Number=SeqID_52182
MGELLQAQAKKVWAQAEQPRWVSPMEVELQARLLAQENVP

SEQ ID NO: 168961 - protein, 70 aa, Glycine max
  Coding DNA Sequence Number=SeqID_52183
NELEMSIEAYMMRTLMVENFVDILEMRIQRRLLIDIMLVMDDVGAYIQKHALEVHWVQHMIDVGDDHDNT

SEQ ID NO: 168962 - protein, 52 aa, Glycine max
  Coding DNA Sequence Number=SeqID_52184
MTSIHVDMIFIATSSQINIIINISITTYQLKSSIATSTENQHATGTGIYSCS

SEQ ID NO: 168963 - protein, 94 aa, Glycine max
  Coding DNA Sequence Number=SeqID_52185
MEVNEPEIDTTTQNTSLISSQLDRTIQTFESSASAQDPTSITACIAKLKDLPGLECGSELFYKATRLMKKRANMITFVALEKPELQLGWIKSDT

SEQ ID NO: 168964 - protein, 57 aa, Glycine max
  Coding DNA Sequence Number=SeqID_52186
LRMSYFYIGCPENRCKKSSFYIGRPENRCKKSSFHIGHSNNRCRMLDILHRSSPEPM

SEQ ID NO: 168965 - protein, 360 aa, Glycine max
  Coding DNA Sequence Number=SeqID_52187
  Gene Ontology: Mol. function=phosphonate-transporting ATPase activity; Cellular component=membrane; Biological process =phosphonate transport
  Homolog annotation: Hit_ID=Q1LQB5; Match level="QueryCoverage=73%, HitCoverage=85%, E-value=1e-112, Identity=79%"; Hit description =Phosphonate ABC transporter PhnC, ATP-binding
  Subcellular localization annotation: CTP_CleavageSite=8; ConfidenceScore=5.09e-01
MTDVFQLVAMAPIFPPNDSIPGPRGFNDDLRHRSTGAEQVLPSRRAGAGQRRPARGRRRDGGTAGRLGLRQVHSAAPPGRLRGGRRRAGQRDRQWPTDPAPRPPVAQCARRPRRHRLRVPAIQPGGPPAGDHQRADRPAAARADVAQPDARVPAGRSAPGARRACPGWYRRLRISARFDAVRRPAAARRHRPHPGAERPRDPGRRADRLARSGIVTSRDGHAGADQSQPQGGRGGLAAPGRCRPALLPAGGGAAPWQGGLRRSLGRADAGHAARPVRLGIERAASRIHAAGPAHAGPGAAFPTGLRGLTLPVPYPELSMLRRTFVALIAAAALSTQVHAQEAKPLNFGIISTESSTNLKS

SEQ ID NO: 168966 - protein, 78 aa, Glycine max
  Coding DNA Sequence Number=SeqID_52188
  Subcellular localization annotation: CTP_CleavageSite=47; ConfidenceScore=5.33e-01
MLAAQLAQASSARPGEQGCFLQKQPPSGGTFWRAQMGLGNPRETSPSSEEVVNNNPQERPSSQHNSLPKEWRAPKDLN

SEQ ID NO: 168967 - protein, 229 aa, Glycine max
  Coding DNA Sequence Number=SeqID_52189
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-24, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVVTFRGLQALTFKGLHVLTFRGLHVVTFRGLHVPTFRGLHVLNFKGFHALSFRGIHALSFRVLHVLTFRGLHALAFKGLHILGIKGSRTLTFRGMHALGFRRLHVLVFRGLLALAFKGLHILAIRGLHALTLRGLHVVAIRGSRTLTFRGLHILPIRGSRTLTFRSLHVLAFRGLHVLAFRGLHVLAFKGPHVVAFRGLYASPLEDYTTSPLEGYTSSPSEGYTPSP

SEQ ID NO: 168968 - protein, 152 aa, Glycine max
  Coding DNA Sequence Number=SeqID_52190
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=2e-35, Identity=51%"; Hit description =Paired amphipathic helix repeat-containing protein / transcription regulator-related
  Pfam annotation: Domain name=PAH; Domain location=18-64; Score=57.0; E_value=6.1e-14; Accession=PF02671.11; Description=Paired amphipathic helix repeat
  Pfam annotation: Domain name=PAH; Domain location=97-143; Score=35.1; E_value=2.4e-07; Accession=PF02671.11; Description=Paired amphipathic helix repeat
  Pfam module annotation: Pfam domain module=PAH::PAH; Domain location =18-64::97-143
MDALQYIKEVQCAFHDSTEKFDKFMDVMKDYKFHRIDVGIVVEKMEEILKDHGDLILGFNKFLPKGYEILLLDEGEDGFGNASKYLKKIQDRFENKDHVYKSFLNILLKYKNNGVTLYDTYHEVATLFEGHRDLVRDFTKFLPSVHLRGKST

SEQ ID NO: 168969 - protein, 109 aa, Glycine max
  Coding DNA Sequence Number=SeqID_52191
MAGDASKFIHISPKNSEHVIYGDKNKVITTKKLCPLLAMNPKAVSLLSPVITTKKLYLLLAMNPKAVSLLDPVINQEENPLLAMNPKAVSLLSPVLNQEDLLLKNSHQE

SEQ ID NO: 168970 - protein, 71 aa, Glycine max
  Coding DNA Sequence Number=SeqID_52192
MYVARSIEKLMDMTKTTPKLMKKKKNVSSVKQRLCASIAKPFYQLVGEEAAQVILRGIMKFVCQGVANGKR

SEQ ID NO: 168971 - protein, 81 aa, Glycine max
  Coding DNA Sequence Number=SeqID_52193
MEILILGQGLWWFEVLAQKACRTAGHDVCQGVGLANGSGIKGMSHIYFHDSHTTMMIWKFYAKLVMHEAMWTLKHQVFMVM

SEQ ID NO: 168972 - protein, 352 aa, Glycine max
  Coding DNA Sequence Number=SeqID_52194
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=90%, HitCoverage=15%, E-value=1e-149, Identity=81%"; Hit description =Microtubule bundling polypeptide TMBP200
MSEEEKLLKEAKKLPWEDRLFHKNWKVRNEANIDLASLCDSITDPKDSRIREFGHFFRKTVADSNAPVQEKALDALIAYLRAADADASRYGKEVCDAVVAKCLTGRPKTVEKAQAVFLLWIELEAVDAFLDAMEKAIKNKVAKAVVPAIDVMFQALSDFGAKIVPPKRILKMLPELFDHQDQNVRASSKGLTLELCRWIGKDSVKSILFEKMRDTMKKELEAELVNVTGTAKPTRKIRSEQDKEPEQEAVSEVVGPGPCEESGNDAPQEIDEYELVDPVDILTPLEKSGFWDGVKATKWSERKEAVAELTKLASTKRISPGDFSEVCRTLKKVTLMSYFLLAKYPGSGLLVY

SEQ ID NO: 168973 - protein, 510 aa, Glycine max
  Coding DNA Sequence Number=SeqID_52195
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=92%, HitCoverage=21%, E-value=1e-157, Identity=63%"; Hit description =Microtubule bundling polypeptide TMBP200
  Pfam annotation: Domain name=HEAT; Domain location=152-188; Score =33.0; E_value=1.1e-06; Accession=PF02985.12; Description=HEAT repeat
  Pfam annotation: Domain name=HEAT; Domain location=35-70; Score=1.1; E_value=32; Accession=PF02985.12; Description=HEAT repeat
  Pfam annotation: Domain name=HEAT; Domain location=389-427; Score =2.6; E_value=21; Accession=PF02985.12; Description=HEAT repeat
  Pfam module annotation: Pfam domain module=HEAT::HEAT::HEAT; Domain location=152-188::35-70::389-427
MKVNKLITDVNIAVAVEAVQAIGNLARGLRTHFSASSRFLLPVLLEKLKEKKPALAEALMQTLQAMHKAGCISLIDIVEGRLQVKGFNHWIYRILESTAYFFLIVPHYHGLALFGVFPDVKTATKNKVPLVRSLTLTWVTFCIETSNKVVITKVHKDYVPICMECLNDGTPEVRDAAFSALAGIAKSVGMRPLERSLEKLDDVRRKKLSEMISGSEDAVPGASSAASVQNTRVSASSAETSESVLVKRSAAGMLSGKRPVQSVPAVKKVGVVKLGTNKKTDGVPQVKALKSVEPPEDVEPTEMSLEEIESRIGSLIESDTITLLKSAVWKERLEAISSLKQQVEGLQDLDQSVEILIRLVCTLPGWGEKNVQVQQQVIEVITHISSTATKFPKKCVVLCLSGLSERVADIKTRAHAMKCLSTLSEAVGPGFIFERLYKIMKEHKNPKVLSEGILWMVSAVEDFGVSHIKLKPLCICKGKAAYNIPPPYLRIAKSFWAMGYEVIGSFYGLM

SEQ ID NO: 168974 - protein, 1110 aa, Glycine max
  Coding DNA Sequence Number=SeqID_52196
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=97%, HitCoverage=51%, E-value=0.0, Identity=72%"; Hit description =Microtubule bundling polypeptide TMBP200
  Pfam annotation: Domain name=HEAT; Domain location=139-175; Score =8.5; E_value=3.9; Accession=PF02985.12; Description=HEAT repeat
  Pfam annotation: Domain name=HEAT; Domain location=216-251; Score =14.5; E_value=0.4; Accession=PF02985.12; Description=HEAT repeat
  Pfam annotation: Domain name=HEAT; Domain location=507-541; Score =2.3; E_value=22; Accession=PF02985.12; Description=HEAT repeat
  Pfam annotation: Domain name=HEAT; Domain location=542-576; Score =7.4; E_value=5.3; Accession=PF02985.12; Description=HEAT repeat
  Pfam annotation: Domain name=HEAT; Domain location=56-92; Score=24.1; E_value=0.0005; Accession=PF02985.12; Description=HEAT repeat
  Pfam annotation: Domain name=HEAT; Domain location=98-134; Score=5.0; E_value=10; Accession=PF02985.12; Description=HEAT repeat
  Pfam annotation: Domain name=VHS; Domain location=56-197; Score= -35.6; E_value=0.033; Accession=PF00790.9; Description=VHS domain
  Pfam module annotation: Pfam domain module=HEAT::HEAT::HEAT::HEAT::HEA T::HEAT::VHS; Domain location=139-175::216-251::507-541::542-576::56 -92::98-134::56-197
IKGFLTDVKPALLSALDTEYEKNPFEGASAVTKRTVRAKDSSSTVVAGGLDSLPREDISGKISPTLLKSLESPDWKVRMESVDAVNKILEEANKRIQATGTGELFGALRGRLLDSNKNIVMASLTAIGNVASAMGQAVEKASKGILSDILKCLGDNKKHMRECVLNTLDAWLAAVHLDKMVPYIAIALMDSKLGAEGRKDLFDWLSRQLSGLSSFAEAAQLLKPASSAMTDKSSDVRKASEACINEILRVSGHEMIEKMVKDIHGPALTLIVEKLKPYGAFQGTFFGSFFFANVGEFVWISSLNSSFFWSLESFESGRAVSVGAISKAKAGKSTANGVSKHGNRAVSSRVVATKGAKSESISVQDIAVQSQALLNIKDSNKEDRERMVVRRFKFEDPRIEQIQDLENDMMKYFREDLHRRLLSADFKKQVDGLEMLQKALPSIAKEVIEVLDILLRWFVLQFCKSNTTCLLKFSSFPFLPCHGDVLEFLPELLDTLKDEGYSLTESEGAVFLPCLVEKLGHNIEKVREKMRELTKQFVAIYSACKCFPYILEGLRSKNNRTRIECADLVGFIIDHHGAEISGQLKSLQIVASLTAERDGETRKAALNTLATGYKILGEDIWRYVGKLTDAQKSMLDDRFKWKVREMEKKKEGKPGEARAISRRSVRENGSDVAEQSGEMTRSLAGPILRKNYGQPDSNIDRQLMPRPMTVASGPTDWNEALDIISFGSPEQSVDGMKVICHELAQATSDPEGSAMDELVKDADRLVSCLANKVARTFDFSLTGGASSRSCKYVLNTLMQTFQNKRLAHAVKESTLDSLITELLLWLLDDRVPHMDDGSQLLKALNVLMLKILDNADRTSSFVVLINLLRPLDSSRWPSPASNESLASRNQKFSDLVVKCLIKLTKVLQSTIYDVDLDRILQSIHLYLQDLGMEEIRRRAGADDKPLRMVKTVLHELVKLRGAAIKGHLSMVPIDAKPQPIILAYIELNLETLAAARMLTASGPGGQNHWGDSATNNSASGTHSADAQLKQELAAIFKKIGEKQTCTIGLYELYRITQLYPKVDIFAQLQNASEAFRTYIRDGLAQVELIYLYYHMFLIELAFCISTGDWE

SEQ ID NO: 168975 - protein, 65 aa, Glycine max
  Coding DNA Sequence Number=SeqID_52197
MANEVVDEARRKNKVVWSSSPSREFGMQRRFRQGDSLALFLFTIMAEGLSGLMRETVAKKLCSSC

SEQ ID NO: 168976 - protein, 246 aa, Glycine max
  Coding DNA Sequence Number=SeqID_52198
  Gene Ontology: Mol. function=RNA-directed DNA polymerase activity; Biological process=RNA-dependent DNA replication
MEERSKKIVWGLSDLRWFDKGVEWKVGKGDKIKFWCDACGKNKTLPIYIPDFSSFHCENLTKLTIWGGGTWRWEFSWCRNCFAWEKDLLREFQQLVSSMVIDRERLDGSYSVKTTYNLIIGNDGNQQTNKIFGARWKLNIPPKVIFFFFLEIVLEQAGHFGQLKKKNVSVAANNWLCPKCSLEETTAHILFSCKLADSVLESVYDLEKLLDQILFTSWSWLKNSSKTFQFSFAEWSMNTAACLYRS

SEQ ID NO: 168977 - protein, 125 aa, Glycine max
  Coding DNA Sequence Number=SeqID_52199
MEFCAESSHSNGKHTLKHSKSADEVKRSREKAHRSSHSNGKQNVKQTSTFVNHAAIAWHEDRTKWVGDKSQHPPRTAKDPIISLMGRIGVSPFLKTWEIIVLMPVIFYTSFMLNPIHHLIKNLGQ

SEQ ID NO: 168978 - protein, 284 aa, Glycine max
  Coding DNA Sequence Number=SeqID_52200
  Subcellular localization annotation: CTP_CleavageSite=49; ConfidenceScore=5.63e-01
MLSAIAFGFSANWWLRCHGRTPPPLSFPVSVSYSSSFNSNSTKFNYIHRASSEGLPNELVEDSKFVPLNEEDPIYGPPALLLLGFEADEALKVIYCTEDMIMRSLWEAMHTTQPNVEDVKIAKSLPRICFLSGLSGEEMMMFIDSFPETGLKPAAFAALVPNSANKPLEELIDEIMGDHEMLEEWVEDPLKVKNEASRFFHNRFSEECWDRPLLDGVHFNQITQIDNVGLVDRFGEEEVKETIWECESAKSPGSGGFNFKFIKAFWHVLKDDIIRFMEEFHRLG

SEQ ID NO: 168979 - protein, 437 aa, Glycine max
  Coding DNA Sequence Number=SeqID_52201
  Gene Ontology: Mol. function=serine carboxypeptidase activity; Cellular component=vacuole; Biological process=proteolysis
  Homolog annotation: Hit_ID=P21529; Match level="QueryCoverage=90%, HitCoverage=90%, E-value=1e-161, Identity=60%"; Hit description =Serine carboxypeptidase 3 precursor
  Pfam annotation: Domain name=Peptidase_S10; Domain location=75-421; Score=479.4; E_value=4.2e-141; Accession=PF00450.12; Description =Serine carboxypeptidase
MEHCNCYMFTLSLLLLLLLTPPSLSDDLGFDFPAKKLIRDLNLFPSEDVNIVPRHSNSHANKIVEKPLRFPNLVPSDSGISLDDLAHRAGYYLIPHSHAAKMFYFFFESRNSKKDPVVIWLTGGPGCSSELAVFYENGPFKIANNMSLVWNEYGWDKVSNLLYVDQPTGTGFSYSTDKRDIRHDEEGVSNDLYDFLQAFFAEHPEYVKNDFFITGESYAGHYIPAFAARVHRGNKAKEGIHINLKGFAIGNGLTDPGIQYKAYTDYALDMGIIQKADYERINKVMVPACEMAIKLCGVGDIDFVSCSSTVYQAMLVDWMRNLEVGIPALLEDGINMLVYAGEFDLICNWLGNSKWVHAMEWSGQQEFVVSSEVPFTVDDSEAGLLKKYGPLSFLKVHDAGHMVPMDQPKASLEMLKRWTQGTLSESAADAEKLVAEL

SEQ ID NO: 168980 - protein, 70 aa, Glycine max
  Coding DNA Sequence Number=SeqID_52202
MTPSKEKLPVSASGEFEILTRIFGSQVRGLIRVALVEICWSGSSSMNSEEYGTMTTCLESQIGSLHSRRR

SEQ ID NO: 168981 - protein, 245 aa, Glycine max
  Coding DNA Sequence Number=SeqID_52203
  Gene Ontology: Mol. function=cysteine-type endopeptidase activity; Cellular component=extracellular space; Biological process =proteolysis
  Homolog annotation: Hit_ID=Q43448; Match level="QueryCoverage=78%, HitCoverage=50%, E-value=1e-102, Identity=96%"; Hit description =Cysteine proteinase precursor
  Pfam annotation: Domain name=Inhibitor_I29; Domain location=101-157; Score=86.8; E_value=6.8e-23; Accession=PF08246.2; Description =Cathepsin propeptide inhibitor domain (
  Pfam annotation: Domain name=Peptidase_C1; Domain location=187-245; Score=-135.3; E_value=0.057; Accession=PF00112.13; Description =Papain family cysteine protease
  Pfam module annotation: Pfam domain module=Inhibitor_I29::Peptidase _C1; Domain location=101-157::187-245
MHVELQSNPAATPPFVVSYRTYRRVEWSLQIVTYTKENSVKSEEEEEDGGKARPCPHVLGTCFTLPLRSNPIRCSRKHHGSRHREKVETRGHELLRTEKKFKVFMENYGRSYSTEEEYLRRLGIFAQNMVRAAEHQALDPTAVHGVTQFSDLTEDEFEKLYTGVNGGFPSSNNAAGGIAPPLEVDGLPENFDWREKGAVTEVKLQGRCGSCWAFSTTGSIEGANFLATGKLVSLSEQQLLDCDNK

SEQ ID NO: 168982 - protein, 100 aa, Glycine max
  Coding DNA Sequence Number=SeqID_52204
MGSLMASASITLAFAIILFSLPSEISANNYIYSSPPPPKKPYHYPSPPPPVPSPPPPKAPYHYPSPPPPPKKPYKYPSPPPPGKQPYPDPHPHRHPHPHP

SEQ ID NO: 168983 - protein, 291 aa, Glycine max
  Coding DNA Sequence Number=SeqID_52205
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=8e-35, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAYKGLRVLTFNGLYVHAIRGLHALAFRGLRVLTFRGLYVLTIRGLHALTFIVLHALTFRGLHVLTFRRLHILTFRGLHALAIRGLHILTIKGLHVLTFRGLHVLTFIGLHALTFRGLDVLAFRGQHDLTIRGLHALAFRGLHVLTFRGLHALIFRGLHVLTFRGLHALAIKGLHVLTIRGLHALDFVGLHVLALRGLHVLAFRGLYALTFIGLHAFTFRGLDVLAFRGLHVLTIRRLHVLPFRGLHALAIRGLHILTIRGLHILTLRGLHVLTFIRLHALTFRGLD

SEQ ID NO: 168984 - protein, 85 aa, Glycine max
  Coding DNA Sequence Number=SeqID_52206
MIGGEKREVVAAQLAQASWVASTGRHRLLLEPPGRPKTLRIAQQCFPSTSGMSRNSTNCLTMGIKYLEAIKRGSHAIRQMVPRRN

SEQ ID NO: 168985 - protein, 514 aa, Glycine max
  Coding DNA Sequence Number=SeqID_52207
MVAEISELRFLLNGEGWHSCSIETGANRPILSKFEVFLPAIGWLLMRGVYLEQIMAACRVMDEKIAEANSDLYEEAKAKKVPLRHETFSQAYVFNHKIALSQLVSFVHSGGLSFRHSPESEFDKALKKSWKEASTHSEFYILLGITRFTKQALWAAPCVLNLLERLQSLPYHLQLATMDFCVHLRKVDDAVKAKMISALENSMDKMGMVMNSMIFEALKGLGGLDAEEENYRTVVLKEIESVLSESGTQSKTEAWNIFSRQFDHPYDSIYWEEINNLASDQKRQFLFKALKGASTDFVMFVSILIRQLAEIGDPAVSEAIEPWLRLPAKRSVMLQDTVEVFFAAHEAMGILGLPLPANATSTVDVDETMQACGELTYWACQLNNCELESSPQTLSARTKLLTYSASASAGALWSSTSRMMSSDGARIHIATSYPNTALAVCRNALINHETQKTYHEHGVMNDLVRIVSFSIQVIGQFGDADDLQRLRSLCDEEELGHEALNAIHKIEDRVRYLK

SEQ ID NO: 168986 - protein, 420 aa, Glycine max
  Coding DNA Sequence Number=SeqID_52208
  Gene Ontology: Mol. function=two-component sensor activity; Cellular component=outer membrane-bounded periplasmic space; Biological process=two-component signal transduction system (phosphorelay)
  Homolog annotation: Hit_ID=Q13Y85; Match level="QueryCoverage=69%, HitCoverage=85%, E-value=9e-82, Identity=48%"; Hit description=ABC nitrate/sulfonate/bicarbonate family transporter, periplasmic ligand binding protein
  Pfam annotation: Domain name=NMT1; Domain location=34-240; Score =70.6; E_value=5.1e-18; Accession=PF09084.1; Description=NMT1THI5 like
MNKKLNMIAALSLALSAQSMAAEKFTFMTNWYAQAEHGGFYQALAQNLYKDAGLDVSLKMGGPQVHTMQLMAAGQADCIISDNMQALESWQQGVEAMPVATTFQHSAIAFLTHPDVKDKADLQGKTFLLAAEAYTSYWPWAQSALGLKNARVRPYTFSIQPFLADKTLVQQGYITSEPFAVQKAHAQANVYPISEWGYPPYGNSIVCMKSTIEKRPQAVAAFVKASMQGWKNYLQDPRAGNALIRKENPQMSEEQIAFGIAQMKKYQMLTGGDAQTAGIGIITEPRLKQTWQLLVDNKLIDPAKVPFAGHAMNTASNITPINPDSQPRPVAPPAIEVLSAEKIYPNGTRALLPVELTVRQGEFVSLLGPSGCGKRSDTDAVEQRAQECPPAAGSGGRSARRSRYPRARDSGTGWPGPVWS

SEQ ID NO: 168987 - protein, 324 aa, Glycine max
  Coding DNA Sequence Number=SeqID_52209
  Gene Ontology: Mol. function=transition metal ion binding; Biological process=cytoskeleton organization and biogenesis
YIKKAKLVGLLESRDDKRVGGKGSRGLHVITPSSEELQQAHLYILNNSNEVLPYTVHGKALVKESNLKMTKNKVLKEHNKTFLNWFKDTIFGDDNAFVTLRKLADGPKRNVITWKGYGINKYSFYTKAQDDKITMQNSGVSLRVVSQHFASVHDDNPHLASIPYFGTIDEIWELNYVKFTVCVLKYPCDERWSVVLHGKTIGVNVEDDDSLIDTYISPLSTQISPNVIEEEEVDDVHANHNDHDEGELVNTTRKATRLRSLATRPIGAERPLVHVDLATGKADGPHRKKLRTYLGITTCDMVDVTYENLKQVPATQKDLIWDDI

SEQ ID NO: 168988 - protein, 214 aa, Glycine max
  Coding DNA Sequence Number=SeqID_52210
MARTKKTGQMTSEAAKEIANKIASQGSFVACGRQDVLIAAIGGPEHPSLVRAAGAGVTIKQYFGPVPRSSRTSLSIGPKDLEQLTQKIKDQLEESITEKPEVGPSAAHISRKESCVDPSGHDLDTGGLTTIHNIPLGNHQVKVGVEEVQDANAHILVPTQEVQLVGQEKQGAQGPVKLVDRPDPNVDPIYLMTLTIPQLFLKMLQVMWDAIVFG

SEQ ID NO: 168989 - protein, 54 aa, Glycine max
  Coding DNA Sequence Number=SeqID_52211
MAPKTCSLSASAPDRTNKCEYEQVCKLSMQKGKSRERDDVQKQVENTLAFLIGA

SEQ ID NO: 168990 - protein, 158 aa, Glycine max
  Coding DNA Sequence Number=SeqID_52212
MPYGEHRRVRAFDLISSYTGQLRWGQIVVYVRPERVLQQFGYLQMVPPPSVCDSLTGDDIDDWWLNFPDHLVPSGELCVVPGQVATDYMEWFFRISHSFVTWTEETAASRHPPPPHHEEFVEPPIPKVSVATDLRTHSVVQCEGCQGMAQDLGAIAED

SEQ ID NO: 168991 - protein, 65 aa, Glycine max
  Coding DNA Sequence Number=SeqID_52213
MASDMVPVRWGIRGSTGGNNISLRFRERQKEGFLPNLFLLNPCLLKDLEKGFEQNQSTKETILKS

SEQ ID NO: 168992 - protein, 67 aa, Glycine max
  Coding DNA Sequence Number=SeqID_52214
MSPPPLEPHNHSQTHLMLSGRLPLQALPRSVALSGWLAKPEDWLSERMQISTSQTCLTNLKLRGNDY

SEQ ID NO: 168993 - protein, 68 aa, Glycine max
  Coding DNA Sequence Number=SeqID_52215
MEHSSKLESGGHMNSPTQYHSCGSGKRAIMEHSSKLKNGGHMTSPKQYPSCGSRKRMRMEDCLEGPPS

SEQ ID NO: 168994 - protein, 68 aa, Glycine max
  Coding DNA Sequence Number=SeqID_52216
MARSVFAPCPYLRDLQGRELTRHLAITPQVPSGVANCHTLPFGGRATRDSRDACSTKGIRAESPPTFI

SEQ ID NO: 168995 - protein, 107 aa, Glycine max
  Coding DNA Sequence Number=SeqID_52217
MWSREHLAEEELKRRGATLREKGKSFVPWRKEESWREGAESDKERKEDMGARNWKPSCKIWCEWFWFLRRGKIVNRVEHQDKFIPQILSLSSSSSFFFFEFAHSMLA

SEQ ID NO: 168996 - protein, 270 aa, Glycine max
  Coding DNA Sequence Number=SeqID_52218
  Gene Ontology: Mol. function=nucleic acid binding; Cellular component= intracellular; Biological process=regulation of transcription
  Homolog annotation: Hit_ID=Q9LWA5; Match level="QueryCoverage=88%, HitCoverage=93%, E-value=4e-41, Identity=45%"; Hit description =Putative TFIIIA (Or kruppel)-like zinc finger protein
  Pfam annotation: Domain name=zf-C2H2; Domain location=145-167; Score =12.5; E_value=0.46; Accession=PF00096.16; Description=Zinc finger, C2H2 type
  Pfam annotation: Domain name=zf-C2H2; Domain location=88-110; Score =18.5; E_value=0.025; Accession=PF00096.16; Description=Zinc finger, C2H2 type
  Pfam module annotation: Pfam domain module=zf-C2H2::zf-C2H2; Domain location=145-167::88-110
MALEALNSPTAATTPFRGYQEEEEEVDLHLREPWAKRKRSKRPRFESEEEYLALCLIMLAQSGNNNNTQLPSSSQSHKEASPPLKLSHRCTVCNKAFPSYQALGGHKASHRKASSESNTTASAVAVSATANDSVSASTVGGGRMHECSICHKSFPTGQALGGHKRCHYDGGNNHSNSNANGNNSSGVTTSDGGAASSSSHAFRGFDLNLPAPLTEFWSPAGFDFGKKKVGVEQEVESPLPVGSGLGSDFVSAPLYRQNLFIAFGFLFAID

SEQ ID NO: 168997 - protein, 32 aa, Glycine max
  Coding DNA Sequence Number=SeqID_52219
MASGREFVYETEVEVSVVGFERLFPSANAAKE

SEQ ID NO: 168998 - protein, 594 aa, Glycine max
  Coding DNA Sequence Number=SeqID_52220
  Gene Ontology: Mol. function=signal transducer activity; Cellular component=membrane; Biological process=response to light stimulus
  Pfam annotation: Domain name=NPH3; Domain location=179-433; Score =427.0; E_value=2.5e-125; Accession=PF03000.5; Description=NPH3 family
MKFMKLGSKPDTFQTDGNNVSSRLQTLISLNNEENVDEVQIFDIPGGANTFEICAKFCYGMTVTLNAYNVIATRCAAEYLGMHEAIEKGNLIYKIDVFLSSSIFRSWKDSIILLQTSKSMLPLVEDLKVVSHCIESIANKACVDVSKVDWSYTYNRKKLPEENGIESNQNGLRTRLVPKDWWVEDLCELEVDLYKSVITNIKSKAVQSNEVIGEALKAYAYRRLPNFSKGMIQCGDVSKHRLIVETIVWLLPTEKGSVPCRFLLKLLKAAIFVESGDRTKEELVKRIGQQLEEASVSDILIQAPDGAATIYDVSIVQNIVRVFFIKDHNAEIESVGLDELEGIRKPGILSDASKLMVAKLIDGYLAEIAKDPNLPFSEFVNLAELVSSISRPAHDGLYRAIDTYLKEHPGISKGEKKRICKLMDCRKLSVDACLHAVQNERLPLRVVVQVLYFEQLRTAASSGTSTPDIPRGIKDLNNESNGSSRSGTTNPEDELDAVATAEELKALRKELASLRLSNGVGNNDKDGDTKPSMDKAVMGKVKGLLKSKKSFIKLWASKGGQGENSGSDSSESMSSANPEEAKSTPSRNRRHSVS

SEQ ID NO: 168999 - protein, 171 aa, Glycine max
  Coding DNA Sequence Number=SeqID_52221
  Homolog annotation: Hit_ID=Q0PN09; Match level="QueryCoverage=63%, HitCoverage=47%, E-value=1e-44, Identity=74%"; Hit description =Lateral organ boundaries domain protein
  Pfam annotation: Domain name=DUF260; Domain location=2-107; Score =90.7; E_value=4.3e-24; Accession=PF03195.5; Description=Protein of unknown function DUF260
MSCNGCRVLRKGCSDDCMLRHCLLWIENPQAQAHATLFVTKFFGRATLMSFLSTVPPNQRSALFESLLYEAVGRTINPVNGAVGLLWTGNWHLCQMGVEKVLRGGAAAALTPLIPQVITTSVVRGEIMCHQPKKQCVGTPSEDEESETSTFASRPQDSAPQPQTNLLTLFF

SEQ ID NO: 169000 - protein, 50 aa, Glycine max
  Coding DNA Sequence Number=SeqID_52222
MGMEGRTMLEPWMRGTSLEQGGKSEAIGLEGLVGCGIFATFGELGGSSST

SEQ ID NO: 169001 - protein, 372 aa, Glycine max
  Coding DNA Sequence Number=SeqID_52223
  Gene Ontology: Mol. function=diacylglycerol kinase activity; Cellular component=intracellular; Biological process=protein kinase C activation
  Homolog annotation: Hit_ID=Q1RTM0; Match level="QueryCoverage=99%, HitCoverage=85%, E-value=1e-162, Identity=76%"; Hit description =Tetratricopeptide-like helical
  Pfam annotation: Domain name=PPR; Domain location=110-144; Score =36.2; E_value=1.1e-07; Accession=PF01535.11; Description=PPR repeat
  Pfam annotation: Domain name=PPR; Domain location=181-215; Score =11.4; E_value=0.33; Accession=PF01535.11; Description=PPR repeat
  Pfam annotation: Domain name=PPR; Domain location=44-78; Score=4.1; E_ value=2.5; Accession=PF01535.11; Description=PPR repeat
  Pfam annotation: Domain name=PPR; Domain location=9-43; Score=7.6; E _value=0.95; Accession=PF01535.11; Description=PPR repeat
  Pfam module annotation: Pfam domain module=PPR::PPR::PPR::PPR; Domain location=110-144::181-215::44-78::9-43
MLAAYAQSASHVSYSTSFEDADMSLEALHLFCDMQLSQIKPNEVTLVALISACSNLGALSQGAWAHGYVLRNNLKLNRFVGTALVDMYSKCGCLNLACQLFDELSDRDTFCYNAMIGGFAVHGHGNQALELYRNMKLEDLVPDGATIVVTMFACSHGGLVEEGLEIFESMKGVHGMEPKLEHYGCLIDLLGRAGRLKEAEERLQDMPMKPNAILWRSLLGAAKLHGNLEMGEAALKHLIELEPETSGNYVLLSNMYASIGRWNDVKRVRMLMKDHGVDKLPGFSLVEINGAMHEFLTGDKAHPFSKEIYSKIGEINRRLLEYGHKPRTSEVLFDVEEEDKEDFLSYHSERLAIAFALIASSSSMPIRIIKNT

SEQ ID NO: 169002 - protein, 57 aa, Glycine max
  Coding DNA Sequence Number=SeqID_52224
MRFGGGGERTTGWLRRECNGEIWEWNEGSTMGLRSDGSRDDGEGCMVVVDWKGEGRR

SEQ ID NO: 169003 - protein, 115 aa, Glycine max
  Coding DNA Sequence Number=SeqID_52225
  Gene Ontology: Mol. function=protein binding; Cellular component =kinetochore; Biological process=mitotic spindle checkpoint
  Homolog annotation: Hit_ID=Q10IP1; Match level="QueryCoverage=70%, HitCoverage=34%, E-value=2e-33, Identity=77%"; Hit description =Mitotic checkpoint protein BUB3, putative, expressed
  Pfam annotation: Domain name=WD40; Domain location=48-83; Score=0.4; E_value=33; Accession=PF00400.22; Description=WD domain, G-beta repeat
  Pfam annotation: Domain name=WD40; Domain location=7-45; Score=19.1; E_value=0.016; Accession=PF00400.22; Description=WD domain, G-beta repeat
  Pfam module annotation: Pfam domain module=WD40::WD40; Domain location=48-83::7-45
MASAVPATGRELSNPPSDGITNLRFSNHSDHLLVSSWDKSVRLYDASANVLRGEFMHAGPVLDCCFHDDSSGFSVAADNTVRRSLTLLTLFFNFKPTCLSCSSPCDLVVLFFVPG

SEQ ID NO: 169004 - protein, 237 aa, Glycine max
  Coding DNA Sequence Number=SeqID_52226
  Gene Ontology: Mol. function=DNA binding; Biological process =regulation of transcription, DNA-dependent
  Homolog annotation: Hit_ID=Q1SCZ2; Match level="QueryCoverage=91%, HitCoverage=53%, E-value=2e-21, Identity=29%"; Hit description =Transcriptional factor B3
  Pfam annotation: Domain name=B3; Domain location=158-231; Score=8.1; E_value=0.009; Accession=PF02362.12; Description=B3 DNA binding domain
  Pfam annotation: Domain name=B3; Domain location=25-110; Score=56.5; E_value=9e-14; Accession=PF02362.12; Description=B3 DNA binding domain
  Pfam module annotation: Pfam domain module=B3::B3; Domain location =158-231::25-110
MLFNVSENKGGATDRGETSGSKAPSFGVRLKPSYVNGFSLEKRRDDILLQVSDGSDGRTWLIEFRRDRFYRGWRNFASDNHLETGDICVFELTKNQGQCFNLKIIRISEETPSSSLEYINGYSFLPLNRFKGDADPWGIPDLKSITTLPIEAMREAKKFTPENPIKENQKGDFRSKSWHVNLGGHVPTKLSKGWPEFAKECMLQPRDVCLFELLNKEDVVFDVHVFKGDSFGPPFQS

SEQ ID NO: 169005 - protein, 189 aa, Glycine max
  Coding DNA Sequence Number=SeqID_52227
  Gene Ontology: Mol. function=protein binding; Cellular component =kinetochore; Biological process=mitotic spindle checkpoint
  Homolog annotation: Hit_ID=Q9LJN8; Match level="QueryCoverage=90%, HitCoverage=50%, E-value=2e-87, Identity=90%"; Hit description =Mitotic checkpoint protein
  Pfam annotation: Domain name=WD40; Domain location=5-43; Score=35.3; E_value=2.1e-07; Accession=PF00400.22; Description=WD domain, G-beta repeat
  Pfam annotation: Domain name=WD40; Domain location=52-87; Score=3.6; E_value=14; Accession=PF00400.22; Description=WD domain, G-beta repeat
  Pfam module annotation: Pfam domain module=WD40::WD40; Domain location=5-43::52-87
LVFSSNKEDILGRHDAPVRCVEYSYAAGQLITGSWDKTLKCWDPRGASGQERTLVGTYPQPERVYSLSLVGHRLVVATAGRHVNIYDLRNMSQPEQRRESSLKYQTRCVRCYPNGTGYALSSVEGRVAMEFFDLSEASQAKKYAFKCHRKSEAGRDIVYPVNAIAFHPILSTCGSKIASHISTLSARLQ

SEQ ID NO: 169006 - protein, 77 aa, Glycine max
  Coding DNA Sequence Number=SeqID_52228
MRFDIPLGCSIEKLKDVIKQLAHLGVSPYGIHEQQVVRQLYFQQSGHAKYSEKLIEYEITELKNDEDMLKVLVESNY

SEQ ID NO: 169007 - protein, 355 aa, Glycine max
  Coding DNA Sequence Number=SeqID_52229
  Homolog annotation: Hit_ID=Q10Q83; Match level="QueryCoverage=90%, HitCoverage=67%, E-value=4e-71, Identity=50%"; Hit description =Expressed protein
  Pfam annotation: Domain name=DUF566; Domain location=1-351; Score =445.1; E_value=9.4e-131; Accession=PF04484.3; Description=Family of unknown function (DUF566)
  Subcellular localization annotation: CTP_CleavageSite=27; ConfidenceScore=5.35e-01
VSSGSTSGAHDSSGAAKGTKEPRGIVVSARFWQETNSRLRRLQDPGSPLSTSPASRIGVPNRNAQLKRYNSDGPMLSPRTMASPVRGNVNARPASPSKLWAGSSPSRGVSPARVRSTVASSINSGSGNTPSILSFSADVRRGKIGEDRIFDAHTLRLLYNRYVQWRFVNARADATFMVQKLNAERHLWNAWVTISELRHSVILKRIKLVLMRQKLKLTSILKGQISYLEEWALLDRDHSTSLLGATEALKASTLRLPVVEKAIADVPNLKDALGSAVDVMQAMASSIYSLSSKVEETNCLVAEILKVTSKERFLLEHCKEFLSSLAAMQVKDCSLRTHMLQLSRVPTSSCLTTRV

SEQ ID NO: 169008 - protein, 103 aa, Glycine max
  Coding DNA Sequence Number=SeqID_52230
  Gene Ontology: Mol. function=protein binding; Cellular component =nucleus; Biological process=mitotic spindle checkpoint
  Homolog annotation: Hit_ID=Q9LJN8; Match level="QueryCoverage=72%, HitCoverage=22%, E-value=8e-34, Identity=89%"; Hit description =Mitotic checkpoint protein
MEFEIKLCCQLCMLGYGTFATGGCDGYVNVWDGNNKKRLYQYSKYPTSVAALSFSRDGRLLAVASSYTFEEGPKSQEQDAIFVRSVNEIEVKPKPKVYPNPPA

SEQ ID NO: 169009 - protein, 341 aa, Glycine max
  Coding DNA Sequence Number=SeqID_52231
  Gene Ontology: Mol. function=nucleic acid binding; Cellular component= ribonucleoprotein complex; Biological process=RNA processing
  Homolog annotation: Hit_ID=Q6K6X2; Match level="QueryCoverage=99%, HitCoverage=79%, E-value=9e-79, Identity=42%"; Hit description =Putative RNA recognition motif (RRM)-containing protein
  Pfam annotation: Domain name=RRM_1; Domain location=249-302; Score =2.3; E_value=0.088; Accession=PF00076.12; Description=RNA recognition motif. (a.k.a. RRM, R
  Pfam annotation: Domain name=RRM_1; Domain location=68-133; Score =15.0; E_value=0.0059; Accession=PF00076.12; Description=RNA recognition motif. (a.k.a. RRM, R
  Pfam annotation: Domain name=RRM_3; Domain location=240-341; Score =102.4; E_value=1.3e-27; Accession=PF08777.1; Description=RNA binding motif
  Pfam module annotation: Pfam domain module=RRM_1::RRM_1::RRM_3; Domain location=249-302::68-133::240-341
MRTNLNLGDVKLDGVTKDTVKAVAQALKNSALVRVSEDGTKVGRATELLKPEEVIEQVEIRTIAALPFEYDVKLEDVETFFAQYAKVNSVRLPRHVGDKKFFCGTALVEFSSDEETEKVLKQSLVYAGAELQLKLKKDFDAQREKELEEQEKFRPPLGSGHQNNTNTEANYPKGLLIAFKLKSISDQVPLDQNNIDQQANDSNVVKDNADNDKENNGVSEGKDTEGEEKSKETDGKNYAAAYKDNNDVVSREDLKGVFEKFGTVKYIDFKIGEESGYIQFEEPEAAQKARAAAVLSEKEGLVVKNYIATLDPVTGEAEREYWTLLRGNQGKIRGCTNNRGR

SEQ ID NO: 169010 - protein, 86 aa, Glycine max
  Coding DNA Sequence Number=SeqID_52232
MPVSYDVFGVILEILGLKGHGRNLENGIGKICNVMLITELEVGDVGITERYDLTNGKAKKKRCWRGNQKGAVENNETLGLWTTFTL

SEQ ID NO: 169011 - protein, 123 aa, Glycine max
  Coding DNA Sequence Number=SeqID_52233
  Subcellular localization annotation: CTP_CleavageSite=2; ConfidenceScore=5.70e-01
MVAAISEDPLTSSNGTIPRRPKGRQVSSRYMSHSPSPSSTTTTTTTTSTSTSTSTTSSSSRRFPSPLLSHSTNSSTPLLPKRSQSVDRRRPRPATPLPEAAKLLVTSTRSLSVSFQGEAFSLP

SEQ ID NO: 169012 - protein, 176 aa, Glycine max
  Coding DNA Sequence Number=SeqID_52234
  Gene Ontology: Mol. function=nucleic acid binding; Biological process= DNA integration
  Homolog annotation: Hit_ID=Q1SIQ0; Match level="QueryCoverage=87%, HitCoverage=44%, E-value=4e-20, Identity=35%"; Hit description=Zinc finger, CCHC-type
MDLITILVVHQLVALKGSYVLIRQDKLIYLDLLVLCDFEARSVMVAADTSCDAWLALACSFSNRSHSIIMSLRERLSSITKGSSSISTYLPSIRNIADKLALIGHPIDNLEMVIQALNGLGPTFREFTASIHTRDSPIAFNELYDKMVDFEMFLQRQEHILTSDPNTSNLTQHHYN

SEQ ID NO: 169013 - protein, 224 aa, Glycine max
  Coding DNA Sequence Number=SeqID_52235
  Gene Ontology: Mol. function=receptor activity; Cellular component =integral to membrane; Biological process=signal transduction
  Homolog annotation: Hit_ID=Q851U1; Match level="QueryCoverage=89%, HitCoverage=87%, E-value=1e-71, Identity=64%"; Hit description =Putative leucine-rich repeat protein
  Pfam annotation: Domain name=LRRNT_2; Domain location=23-63; Score =46.8; E_value=7.4e-11; Accession=PF08263.3; Description=Leucine rich repeat N-terminal domain
  Pfam annotation: Domain name=LRR_1; Domain location=127-149; Score =14.8; E_value=0.31; Accession=PF00560.23; Description=Leucine Rich Repeat
  Pfam annotation: Domain name=LRR_1; Domain location=151-173; Score =17.7; E_value=0.041; Accession=PF00560.23; Description=Leucine Rich Repeat
  Pfam annotation: Domain name=LRR_1; Domain location=175-196; Score =7.2; E_value=13; Accession=PF00560.23; Description=Leucine Rich Repeat
  Pfam annotation: Domain name=LRR_1; Domain location=67-89; Score=8.6; E_value=7.1; Accession=PF00560.23; Description=Leucine Rich Repeat
  Pfam module annotation: Pfam domain module=LRRNT_2::LRR_1::LRR_1::LRR_ 1::LRR_1; Domain location=23-63::127-149::151-173::175-196::67-89
MAPFVSLSLLLLFLNHPLLSLSTNPEGNALHALRSRLSDPNNMLQSWDPTLVNPCTWFHVTCDSNNHVIRLDLGNSNVSGTLGPELGQLQHLQYLYEFFPLPVTAEKELYRNEITGKIPKELGNLKSLISMDLYDNKLEGKIPKSFGKLKSLKFLRLNNNKLTGSIPRELTRLTDLKIFDVSNNDLCGTIPVEGNFESFPMESFKNNRFSGPELKGLVPYDFGC

SEQ ID NO: 169014 - protein, 97 aa, Glycine max
  Coding DNA Sequence Number=SeqID_52236
  Gene Ontology: Mol. function=structural constituent of ribosome; Cellular component=ribonucleoprotein complex; Biological process =translation
  Homolog annotation: Hit_ID=Q10E81; Match level="QueryCoverage=55%, HitCoverage=6%, E-value=2e-27, Identity=96%"; Hit description =Ribosomal protein S14p/S29e containing protein, expressed
  Pfam annotation: Domain name=Ribosomal_S14; Domain location=44-97; Score=100.5; E_value=4.8e-27; Accession=PF00253.11; Description =Ribosomal protein S14pS29e
MKKTLIRVVVYKLISAEYKEGSPTDSSATAILDRNLFCGVAMGHSNVWNSHPKNYGPGSRTCRVCGNPHGLIRKYGLMCCRQCFRSNAKEIGFIKYR

SEQ ID NO: 169015 - protein, 354 aa, Glycine max
  Coding DNA Sequence Number=SeqID_52237
  Gene Ontology: Cellular component=nucleus
  Homolog annotation: Hit_ID=Q2QN39; Match level="QueryCoverage=92%, HitCoverage=92%, E-value=3e-38, Identity=37%"; Hit description =Expressed protein
MTISNHSFSRIDTLELKALIVRKVGRQRADKYFDQLRRLLSSKISKSEFYRICTVIIGRENIPLHNRLIRAILKNACLAKVPPVRGSARVGSATSVKDSNGSQRGSIQSLFGEAFPPSMRRISSLAARDHRFKGRQNAFGPLGKPHFGLASEELVYKTLEQQSATELNSLGSRPPISVEEGEEVEQMAGSPSIQSRSPVTAPLGVSMHFGRRLHFNVSLCSKDYPETCHSNGSLPDTRSLRSRLEQKLEKEGLTATVDSVNLLNNALDLYLKRLIESFMDLAGSRFGNEHLRQQNRQLGTSSNVLLPGRCMQTATRSTSASVLDFRLAMELNPQVLGPDWPIQLEKICIRASEE

SEQ ID NO: 169016 - protein, 137 aa, Glycine max
  Coding DNA Sequence Number=SeqID_52238
  Homolog annotation: Hit_ID=O82324; Match level="QueryCoverage=37%, HitCoverage=20%, E-value=8e-11, Identity=67%"; Hit description=22 kDa peroxisomal membrane protein
  Subcellular localization annotation: CTP_CleavageSite=99; ConfidenceScore=5.41e-01
MSSAFLMNPAKIPHAMMQRQFMLVNRAIHPIKTPSFHFLKKPRQYGISSSFCSSSSSSSSSSSAAISISKVGFVGWYLGMIKSWPILTKSVTSSLIYIAADLSSQLWNYDSESSCFLVLLALSSSAYCYMWNYDSES

SEQ ID NO: 169017 - protein, 74 aa, Glycine max
  Coding DNA Sequence Number=SeqID_52239
  Homolog annotation: Hit_ID=Q9SWG3; Match level="QueryCoverage=96%, HitCoverage=8%, E-value=6e-14, Identity=49%"; Hit description=Far -red impaired response protein
MEPPQDGYYVNQHSMQGLGPLNSMGPSHDGFFGTQQGIHGLGGQLEFRPATTFGYSLHQDEPDPQFHGNSSRNT

SEQ ID NO: 169018 - protein, 930 aa, Glycine max
  Coding DNA Sequence Number=SeqID_52240
  Gene Ontology: Mol. function=zinc ion binding; Cellular component =nucleus; Biological process=transcription
  Homolog annotation: Hit_ID=Q9SWG3; Match level="QueryCoverage=75%, HitCoverage=85%, E-value=0.0, Identity=67%"; Hit description=Far-red impaired response protein
  Pfam annotation: Domain name=2OG-FeII_Oxy; Domain location=69-187; Score=23.0; E_value=0.00067; Accession=PF03171.10; Description=2OG -Fe(II) oxygenase superfamily
  Pfam annotation: Domain name=FAR1; Domain location=248-457; Score =358.4; E_value=1.1e-104; Accession=PF03101.5; Description=FAR1 family
  Pfam annotation: Domain name=SWIM; Domain location=735-771; Score =32.6; E_value=1.3e-06; Accession=PF04434.8; Description=SWIM zinc finger
  Pfam annotation: Domain name=Transposase_12; Domain location=455-561; Score=-41.2; E_value=0.1; Accession=PF01610.8; Description=Transposase
  Pfam module annotation: Pfam domain module=2OG-FeII_Oxy::FAR1::SWIM::T ransposase_12; Domain location=69-187::248-457::735-771::455-561
MAKPKLEPSKLALRKGETAESTKDTRTRYFNEQADNSSGTFISASEDKSGILDLVERKIAKVTMIPRTHGEIFNILKYEVGQKYDSHYDAFNPDEYGSVESQRIASFLLYLSNVEAGGETMFPYEGGLNIDRGYDYQKCIGLKVKPRQGDGLLFYSLLPNGKIDKDFCLLYFSVTGSTQSAIYIVAGIQKAVHCSAVSENMGDALNEVQHRGGAPAASPKRDIALLEGDKDFELHNGIEFESHEAAYSFYQEYAKSMGFTTSIKNSRRSKKTKEFIDAKFACSRYGVTPESDSGSSRRPSVKKTDCKACMHVKRKPDGKWIIHEFIKEHNHELLPALAYHFRIHRNMKLAEKNNIDILHAVSERTRKMYVEMSRQSSGCQNIGSFMGDINYQFDRGQYLALDEGDAQVMLEYFKHVQKESPNFFYSIDLNEEQRLRNLFWIDAKSINDYLSFNDVVSFDTTYIKSNDKLPFAPFVGVNHHSQPVLLGCALLADETKPTFVWLMKTWLRAMGGQAPKVIITDQDTTLKTAIEEVFPNVRHCFSLWHILERIPENLSFVIKKHQNFVRKFNKCIFKSWTDEQFDMRWWKMVTRCELHDDIWFQSLYEDRKKWVPTYMGDTFLAGMSTPQRSESMNSFFDKYIHKKITLKEFVKQYGIILQNRYDEEAIADFDTLHKQPALKSPSPWEKQMSTVYTHAIFKKFQVEVLGVAGCQSRIEAGDGTIAKFIVQDYEKDEEFLVTWNELSSEVSCFCRLFEYKGFLCRHGLSVLQRCGCSSVPSHYILKRWTKDAKIKESMADRTRRTQTRVQRYNDLCKRAIDLSEEGSLSEENYNVVFRALVDALKNCVLVNNSNNNGAETSSNAYGHREAEENQVPLALKLNKKRNAARKRKAQLEQDVILVDAQDTLQQMDNLSSDAITLNGYYGTQQNVQGL

SEQ ID NO: 169019 - protein, 94 aa, Glycine max
  Coding DNA Sequence Number=SeqID_52241
GIISFLYWGFIPRKYIHLSDLHERDIDIFEGIKTGRCQASPSCHHIVPQLLDEWDYGRMVEETLVENERDDTSLVISLDNVAKALGYKEKKLGL

SEQ ID NO: 169020 - protein, 120 aa, Glycine max
  Coding DNA Sequence Number=SeqID_52242
  Gene Ontology: Mol. function=metal ion binding
  Homolog annotation: Hit_ID=Q8LJR8; Match level="QueryCoverage=91%, HitCoverage=45%, E-value=6e-26, Identity=60%"; Hit description=RING -H2 finger protein
MTSASELFHTRRHRLGRNALDLGLDTELHAADSLRQLRLRHYYLRRHHPERASDRIDGRYRRSFVSESVDSEENVRSSLRGSSSERLPVGVVLARARLLQRLRGEPLSTNRFAFHLNLCL

SEQ ID NO: 169021 - protein, 179 aa, Glycine max
  Coding DNA Sequence Number=SeqID_52243
  Subcellular localization annotation: CTP_CleavageSite=48; ConfidenceScore=5.39e-01
MQNSPIVIAVPPSLPLPLSPCPVDQINAIHFPSLPPFAGALTPSSKPPSSHSRRRRHSLESSVDLSPPPPLELLLALLAVLRPPSTVTKLVAALIWAKIWRSDERGTSDMKKMGQNIAKANEHCRNGVVLKARLCQCPFHAVVGFLLYRTPPLLRGGPAHQLERWRRSRWWGRWVGAGG

SEQ ID NO: 169022 - protein, 424 aa, Glycine max
  Coding DNA Sequence Number=SeqID_52244
  Gene Ontology: Mol. function=transition metal ion binding
MEKAKPIVVSKSRHDKRVGGKDSRGLHIITPSLEEFQQAHLCILNNSSEVLSYIVRHEALVKQNNPKMSKDRVFKEHNKSFVNWFKDTIFDDDNASEMLKKLADGPKKCYNLEKYKWVDSNMGVRTDDFGFNLIDLKKLTYKNKSFIMVEQAKQIFYVQDPCDERWSMVLPRKTIALNIEDDDSTHDSCLTYFSTQISANVNGEEVDDRPVVHVDLVTGKANGPHKKKLRTYLGMITCDKVNVTYDNWKQVLVTQKDLIWEDIQFELDLTFKWAMADNKDDKDEKEVRKKVQAIQKQNIAPQVLSHGGRTNTVVDLPSPIRRHVKWKMVCTKKTGQMTSEVAKEITDRIVRFLGGAGLTGKLCRPWTLGCTDYCHWATGGLRPRADDTEDRRPAGGGLTLPPEVEVGPSTARVNTKESCVDPSG

SEQ ID NO: 169023 - protein, 209 aa, Glycine max
  Coding DNA Sequence Number=SeqID_52245
  Gene Ontology: Mol. function=protein dimerization activity; Cellular component=nucleus; Biological process=regulation of transcription, DNA-dependent
  Homolog annotation: Hit_ID=Q0GPF3; Match level="QueryCoverage=99%, HitCoverage=100%, E-value=2e-93, Identity=86%"; Hit description=BZIP transcription factor bZIP69
  Pfam annotation: Domain name=bZIP_1; Domain location=126-190; Score =43.5; E_value=7.3e-10; Accession=PF00170.11; Description=bZIP transcription factor
  Pfam annotation: Domain name=bZIP_2; Domain location=126-180; Score =45.3; E_value=2e-10; Accession=PF07716.5; Description=Basic region leucine zipper
  Pfam module annotation: Pfam domain module=bZIP_1::bZIP_2; Domain location=126-190::126-180
  Subcellular localization annotation: CTP_CleavageSite=65; ConfidenceScore=5.05e-01
MSLPRPSEGKAPSQLKEGVAPAAAAASSSSSWNNRLHTFPPLSLHNKSSKIEHNTNQLFKGLNLRAILLEDSDEDMFTVPDVETTPVSVHSAATLQNSNLTQRNVTDPQFQTGFPGKRRRGRNPADKEHRRLKRLLRNRVSAQQARERKKVYVNDLESRAKELQDKNAILEERISTLINENTMLRKVLMNARPKTDDSIEQKQDQLSKS

SEQ ID NO: 169024 - protein, 67 aa, Glycine max
  Coding DNA Sequence Number=SeqID_52246
MRCLCMSSDFPSLDQKGVDNYEVSPCLRCLCVSSDLSSLDDKDLPSLDDKRADNHDLSSRDIGLDCL

SEQ ID NO: 169025 - protein, 148 aa, Glycine max
  Coding DNA Sequence Number=SeqID_52247
  Gene Ontology: Mol. function=transition metal ion binding; Biological process=cytoskeleton organization and biogenesis
MEKAKPIVVSKSRHDKRVGGKDSRGLHIITPSLEEFQQAHLCILNNSSEVLSYIVRHEALVKQNNPKMSKDRVFKEHNKSFVNWFKDTIFDDDNASEMLKKLADGPKKCYNLEKYKWVDSNMGVRTDDFGFNLIDLKKLTYKNKSFIM

SEQ ID NO: 169026 - protein, 191 aa, Glycine max
  Coding DNA Sequence Number=SeqID_52248
  Gene Ontology: Mol. function=protein serine/threonine kinase activity; Biological process=protein amino acid phosphorylation
  Homolog annotation: Hit_ID=Q1S890; Match level="QueryCoverage=83%, HitCoverage=18%, E-value=2e-45, Identity=57%"; Hit description =Protein kinase; Hydroxymethylglutaryl-coenzyme A reductase
MMSMILALWQYLKVGHYLVNVFEMQYWYAKGFLSLSCGGRTSFRDTSNISWVPDTSYITTGKTTTITYSDDSSALNISARFFLNSRRRKCYRIPVNNSTTLVLVRATFLYKNYDGLGKPPKFSASIGTAIAATINLAESDPWSEEFLWTVNKDTLSFCLNAIPKGGSPVISSLEIRPLSSRSLHKWHGRFS

SEQ ID NO: 169027 - protein, 123 aa, Glycine max
  Coding DNA Sequence Number=SeqID_52249
MTHRDTSWLSAPLSSRDDKSNDTQRHLMVICTFFNQRQASPLTRRDQYGHLLPLSKTRCLSTETTLVSTRHPETSKFDAPRPIWALQKIPPEGGCFWRKQPCSPGRAELAWASWAATTSPILL

SEQ ID NO: 169028 - protein, 392 aa, Glycine max
  Coding DNA Sequence Number=SeqID_52250
  Gene Ontology: Mol. function=protein serine/threonine kinase activity; Cellular component=integral to membrane; Biological process=protein amino acid phosphorylation
  Homolog annotation: Hit_ID=Q1S890; Match level="QueryCoverage=91%, HitCoverage=42%, E-value=1e-166, Identity=79%"; Hit description =Protein kinase; Hydroxymethylglutaryl-coenzyme A reductase
  Pfam annotation: Domain name=Pkinase; Domain location=143-382; Score =129.5; E_value=9.4e-36; Accession=PF00069.15; Description=Protein kinase domain
  Pfam annotation: Domain name=Pkinase_Tyr; Domain location=144-382; Score=90.2; E_value=6.4e-24; Accession=PF07714.7; Description =Protein tyrosine kinase
  Pfam module annotation: Pfam domain module=Pkinase::Pkinase_Tyr; Domain location=143-382::144-382
MGVVPDSLGELEDLHLLNLENNKLQGPLPQSLNKETLEIRTSGNLCLTFSTTSCDDASFSPPIEAPQVTVVPQKKHNVHNHLAIILGIVGGATLAFILMCISVLIYKTKQQYEASHTSRAEMHMRNWGAAKVFSYKEIKVATRNFKEVIGRGSFGSVYLGKLPDGKLVAVKVRFDKSQLGADSFINEVNLLSKIRHQNLVSLEGFCHERKHQILVYEYLPGGSLADHLYGTNNQKTSLSWVRRLKIAVDAAKGLDYLHNGSEPRIIHRDVKCSNILLDMDMNAKVCDLGLSKQVTQADATHVTTVVKGTAGYLDPEYYSTQQLTEKSDVYSFGVVLLELICGREPLTHSGTPDSFNLVLWVTLHSFYCLKNGLKPMVIVKKFKSIQPKSLSN

SEQ ID NO: 169029 - protein, 102 aa, Glycine max
  Coding DNA Sequence Number=SeqID_52251
  Gene Ontology: Mol. function=transporter activity; Cellular component= membrane; Biological process=transport
  Homolog annotation: Hit_ID=Q2A0M6; Match level="QueryCoverage=97%, HitCoverage=19%, E-value=6e-29, Identity=57%"; Hit description=Root uracil permease 1
MFILGVSLGFGLSVPKYFNEHGPVHTGSTWFNNIVQAIFSSPATVAIIDAYILDLTVSRGERSTRRDGGRHWWEKFRTFNQDIRTEDFFSLPLNFNRFFPSH

SEQ ID NO: 169030 - protein, 235 aa, Glycine max
  Coding DNA Sequence Number=SeqID_52252
  Gene Ontology: Mol. function=catalytic activity; Cellular component =mitochondrion; Biological process=lipoate biosynthetic process
  Homolog annotation: Hit_ID=Q9SXP7; Match level="QueryCoverage=98%, HitCoverage=96%, E-value=2e-83, Identity=67%"; Hit description =Lipoate-protein ligase
  Pfam annotation: Domain name=BPL_LipA_LipB; Domain location=52-147; Score=24.9; E_value=0.00026; Accession=PF03099.9; Description =Biotinlipoate AB protein ligase family
MKGLRSLEVWKLGVVNSLDALKLQEKLALDRKLHRRCDTILLSLQHPPTYTVGKRQTVHNLLIPQSEFLASELDKIGAELHYMRRGGDITFHGPYQAILHPIISLRTMGLDARCFVEKIELTMIELAATYCVKACPGQSGETGVWIGERKIGAIGVRISSGITSHGMAFNIDPDLSYFKHIVPCGIADIEVTSLRRETDSVLPEEEIIQEQLISCFARIFSYRDLIWKEDASIFF

SEQ ID NO: 169031 - protein, 83 aa, Glycine max
  Coding DNA Sequence Number=SeqID_52253
MVLIGGTVDFSFLIGLPRLPLILIRSLVPRIYLLYRGVAIVFVLLLRSLSEDRLFNDRRLQHRSSEESVAVFFAFRCRFMLWY

SEQ ID NO: 169032 - protein, 307 aa, Glycine max
  Coding DNA Sequence Number=SeqID_52254
  Gene Ontology: Mol. function=transporter activity; Cellular component= membrane; Biological process=transport
  Homolog annotation: Hit_ID=Q6ZIE6; Match level="QueryCoverage=92%, HitCoverage=63%, E-value=8e-79, Identity=48%"; Hit description =Putative permease
  Pfam annotation: Domain name=Xan_ur_permease; Domain location=41-307; Score=-153.6; E_value=0.021; Accession=PF00860.11; Description =Permease family
MEACSCGGEKQNMDEFEFELHRVKQQLPSVQYCVASSPSWPEGIRVGFLHCLVALGTNVMASSTLVPLMGGDNEEKAQVIETLLFVAAINTLPQTWFGTRLPVVMVASYTFLIPAVSVAVSKRMSVLQDPHQKFIHSMRAIQGALITASVFQISIGFFGFWRLFARCLGPFSVMVDCAEIGLPAFLILVIVSQLVHTKKRSSITQSSCRTDRSGLISAAPWIRVPYPFQWGPPSFSAGDIFATVAASLVAIVESTGTFIAAWRLSKATPILPSVLGRGVGWLGIATLWMAFLAQEPNPLHQCTFCYL

SEQ ID NO: 169033 - protein, 115 aa, Glycine max
  Coding DNA Sequence Number=SeqID_52255
MSVVTMTVSVTLMVVVVTMSAVMVLSMESIVTVTVVGYGSGDSDDDNDNNSDSDTNSGEGGSNAGDNDDSGGNVRDNDDDDSDNNGGGISSGACDKDNGSDDDSHNGNKKCHYQT

SEQ ID NO: 169034 - protein, 36 aa, Glycine max
  Coding DNA Sequence Number=SeqID_52256
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=94%, HitCoverage=13%, E-value=1e-08, Identity=80%"; Hit description =Probable F-actin capping protein subunit beta
MKLSVADGHLCNMGRMIEEMESKLRNSLDQVIVSKE

SEQ ID NO: 169035 - protein, 123 aa, Glycine max
  Coding DNA Sequence Number=SeqID_52257
MENKGQDVNRPPLFKGSFKSAKDMWDTLTILYKGSTKKGKSPVLNIQKTKRDSSSKALSKALSVDNSSNDEFEKETNKDDEFSFMSRKIKKMWKNKNESRWKNSSKKFFNKRKDKKEESSHFL

SEQ ID NO: 169036 - protein, 377 aa, Glycine max
  Coding DNA Sequence Number=SeqID_52258
  Gene Ontology: Mol. function=transcription regulator activity; Cellular component=nucleus; Biological process=regulation of transcription
  Homolog annotation: Hit_ID=Q10Q90; Match level="QueryCoverage=39%, HitCoverage=38%, E-value=4e-29, Identity=52%"; Hit description=Helix- loop-helix DNA-binding domain containing protein
  Pfam annotation: Domain name=HLH; Domain location=292-339; Score =27.8; E_value=3.7e-05; Accession=PF00010.16; Description=Helix-loop -helix DNA-binding domain
MEPVQLISEEWGSLCGFHTTEEADFMAQLFGCNTLVTEKHCGNTTLGFWPGHDESTIVAMTDTNSNSYLPPNVTDTNFLCFSQGSSSSTDNSGNNIFSITSSGAYSCDPEANFDSVSMVLCLGDAKFSPHSFQCDDNSSQQINENTDEESSLDPWKLAIADNNSQAKREYEMMVSEPVEVDRSRNLENLAKRLKSSIEVSKTLRSAKSGKNSKSASVSNDEDDRSLSLQAQRNSCFSQSDSNAYLEPNGGASKDPAPPNLHRKSRATTGAATDPQSLYARVCHPLERPFFNKITMSTAHKRRERINERLRILQNLVPNGTKVDISTMLEEAVQYVKFLQLQIKLLSSDDLWMYAPIAYNGINIGLDLSISPTKGISM

SEQ ID NO: 169037 - protein, 339 aa, Glycine max
  Coding DNA Sequence Number=SeqID_52259
  Gene Ontology: Mol. function=transcription regulator activity; Cellular component=nucleus; Biological process=regulation of transcription
  Homolog annotation: Hit_ID=Q6AV35; Match level="QueryCoverage=95%, HitCoverage=95%, E-value=6e-35, Identity=35%"; Hit description =Putative transcription factor
  Pfam annotation: Domain name=HLH; Domain location=256-303; Score =34.9; E_value=2.8e-07; Accession=PF00010.16; Description=Helix-loop -helix DNA-binding domain
MDPVEQISEEWSSLSGFYTAEEANFMSQLLGNCSLPENLCGNFNLGIPSAIWPGHESTIVSVTGINESPYFHANGSSSTADSSNIFPTTSGNSYTLNDPVANIGYMSTDFANLGPCNVQGSDSQQLNENTHEELGLEVIADKKLQDRQECEVLVSEAAEEDINTNLEKSGKRSRCSMQVRKSKKNVKPVKKPKSDSISNSEEGRSPHLQGCCSENDDSSASQELNGGGSSSLSLEDSTSLKLKGKKSTANRGSATDPQSVYARRRRERINERLKILQNLVPNGTKVDISTMLEEAVQYVKFLQLQIKLLSSDDLWMYSPIAYNGMNIGLDLNITPTKQP

SEQ ID NO: 169038 - protein, 61 aa, Glycine max
  Coding DNA Sequence Number=SeqID_52260
MAAAKGTAPETLERRTAKISEASFWEHPESDQHWVFRIPKWVGFRDRFWEEKRKMKYRAAV

SEQ ID NO: 169039 - protein, 358 aa, Glycine max
  Coding DNA Sequence Number=SeqID_52261
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LJN4; Match level="QueryCoverage=99%, HitCoverage=45%, E-value=1e-134, Identity=62%"; Hit description=Beta- 1,4-xylosidase
  Pfam annotation: Domain name=Glyco_hydro_3; Domain location=1-172; Score=-34.2; E_value=5.3e-07; Accession=PF00933.12; Description =Glycosyl hydrolase family 3 N terminal domain
  Pfam annotation: Domain name=Glyco_hydro_3_C; Domain location=227 -358; Score=-8.5; E_value=3.9e-06; Accession=PF01915.12; Description =Glycosyl hydrolase family 3 C terminal domain
  Pfam module annotation: Pfam domain module=Glyco_hydro_3::Glyco_hydro_ 3_C; Domain location=1-172::227-358
MGQVVSTEAKAMYNVDLAGLTFCSPNVNVFRDPRWGRGQETPGEDPLVVSRYAVKYVRGLQEVKDEASAKAYRLKVSSCCKHYTAYDLDNWKGIHRFHFDAKVTKQDLEDTDQPPFKSCVVEGHLPHVSCFPYRCIVSDCDSVEVYYNAIHYTATPEDAVALALKAVNLEKVDVATVDQALVYNYIVIMRLGFFDDPKSLPFANLGPSDVCTKDNQQLALDAAKQGIVLLENNNNGTFALSQTNIKKMAVIGPNANATTVMISNYAGIPCRYTSPLQGLQKYTSSVNYAPGCSNVKCGNQSLIASAVKAAASADAVVLVVGLDQSIEAEGLDRENLSLPGFQQKLVKDVASATKGKVI

SEQ ID NO: 169040 - protein, 183 aa, Glycine max
  Coding DNA Sequence Number=SeqID_52262
  Gene Ontology: Mol. function=protein binding; Cellular component =nucleus; Biological process=mitotic spindle checkpoint
  Homolog annotation: Hit_ID=Q9LJN8; Match level="QueryCoverage=66%, HitCoverage=38%, E-value=3e-32, Identity=58%"; Hit description =Mitotic checkpoint protein
MWYGMPPIQFSSMSISVVEGFDFQVHVCVYSDADAHYTRLRDQSLSFLISTTQRSPLGVLMRQGYALSSVEGRVVMEFFDLSEASQAKIYAFKCHRKSEAGRDIVYPVNAIAFHPIYGTFATGVCDGTQNILPALLHCRLAEMDAFWALVVASSYTFEEGPKAGTTAEALSLSLFSVYLWNTC

SEQ ID NO: 169041 - protein, 185 aa, Glycine max
  Coding DNA Sequence Number=SeqID_52263
  Gene Ontology: Mol. function=metal ion binding; Cellular component =integral to membrane; Biological process=regulation of transcription
  Homolog annotation: Hit_ID=Q339K7; Match level="QueryCoverage=60%, HitCoverage=33%, E-value=4e-41, Identity=69%"; Hit description=Zinc finger, C3HC4 type family protein, expressed
  Pfam annotation: Domain name=zf-C3HC4; Domain location=73-123; Score =20.2; E_value=0.0013; Accession=PF00097.15; Description=Zinc finger, C3HC4 type (RING finger)
  Subcellular localization annotation: CTP_CleavageSite=36; ConfidenceScore=5.32e-01
MSQGSALFSFFSYSSRLFLSLSKTLTCVCPTTLDLLAGLLSYIASCTKFLSVGNVRTYSEWVIDGEYDWPPKCCQCQSVLEEGDGSQTTRLGCLHVIHTNCLVSHIKSFPPHTAPAGYACPSCSTSIWPPKSVKDSGSRLHSKLKEAIMQRLHAHLGRGDVKGYEILSGKLFQGTMSDSLLNGQY

SEQ ID NO: 169042 - protein, 99 aa, Glycine max
  Coding DNA Sequence Number=SeqID_52264
MGEAHEVPRDHTLADFESHLIYATEGKAFGEREKLDHIKERMRAIKGSEDSAFVDMAELCLVPDVIIPPKFKVPDFDKYKGITCPKNHLKMYSRKMGAY

SEQ ID NO: 169043 - protein, 177 aa, Glycine max
  Coding DNA Sequence Number=SeqID_52265
  Gene Ontology: Mol. function=enzyme inhibitor activity; Cellular component=cell wall; Biological process=cell wall modification
  Homolog annotation: Hit_ID=P93674; Match level="QueryCoverage=97%, HitCoverage=87%, E-value=3e-29, Identity=44%"; Hit description =Putative 21kD protein precursor
  Pfam annotation: Domain name=PMEI; Domain location=1-167; Score =129.4; E_value=1e-35; Accession=PF04043.6; Description=Plant invertasepectin methylesterase inhibitor
MTYIESSCSGTLYPNLCIRCLAQYAKSTINGPQHLAQYALSVSLSRALHTREYLLKVVKEIKAKGVKNNKREYLIVQDCVNQISDSVDQLSQAIKELSRLNQHQHGSTINDNMLWHISNVETWVSTALTDASSCVYSFPGHRMSKRAASIKVKAMNVAEVTSNALALFLRYASRYRK

SEQ ID NO: 169044 - protein, 1545 aa, Glycine max
  Coding DNA Sequence Number=SeqID_52266
  Gene Ontology: Mol. function=RNA-directed DNA polymerase activity; Cellular component=chromatin; Biological process=chromatin assembly or disassembly
  Pfam annotation: Domain name=Chromo; Domain location=1373-1423; Score= 25.2; E_value=0.00023; Accession=PF00385.14; Description='chromo' (CHRromatin Organisation MOdifier
  Pfam annotation: Domain name=RVP_2; Domain location=378-504; Score= -45.9; E_value=0.0038; Accession=PF08284.2; Description=Retroviral aspartyl protease
  Pfam annotation: Domain name=rve; Domain location=1069-1225; Score =115.6; E_value=1.4e-31; Accession=PF00665.16; Description=Integrase core domain
  Pfam module annotation: Pfam domain module=Chromo::RVP_2::RVT _1::Retrotrans_gag::rve; Domain location=1373-1423::378-504::632 -801::153-243::1069-1225
MRVLQNVRELIGDSRLGVKNALVVALNGVPLAGGTQEVDSSAGVRRFSNLVAVSMAVRPLEDSWVSNTKRSIGAFIEQQWWKQHVLGFLQIAGQQPPQSSLSSSAGQTPQAHNAVHRMKLDVPRFDGSDPTGWTFKITQFFEYHATPDQERLTIASFYMEGPALAWFQWMHRNAQLSSCSAFLHALHSRFASSTYEDPTGLLCKLQQRSSISAYLSEFECLANHVVGLPATFVLSCFISGLNPSIRREVQVLQPVSLAQAVAYARLQEEKIMDSRRQQTSRPLMSTANSKTITGTTPPSFANNSSRGSNPSIPFKRLTPEELAVRREKGLCFHCEEKYLWGHKCAPSLFLLVAEDDQLTSEVVSTRPSSPTEELLMEPPPAQRCLHALSGHSAPETLRLKGTINGFHVSILIDGGSTHNFLHHRVVATLGFTTKGVAPLKVMVGNGEEIRCQELCTAVNVQVQEHTFMVDFHILPLCGTDVVLGVEWLKTLGPVLTDYTSPSMKFITEGKLVELQGEREQIGEPVSPSQLRRLLHRSPSSTFFHIRVETNTQSATTPPILPEISELLTKYSCLFQPLTNLPPSRSTDHAINLLPNATPVNVKLYRYPYYQKQEIEDQVSAMLAKGFIQPSSSPFSSPVLLVSKKDETWRFCVDYWALNAITVRDRFPIPTVDELRDEMGGACWFSKLDLMQGYHQILMNKEDVGKTAFQTHQGHYEFRVMPFGLCNAPSSFQATMNQLFQPYLRKHIIVFFDDILVYNKTIVDHLLHLENAFRTLVSGQFSLKLSKCMFAQQQLEYLGHVVTVAGVKPVPEKLLSHGQFQWSPDATDAFQKLKDAITTAPVLTLLDFTIPFVVETDASNIGMGVVLSQGGHPIAFFSKQFCPRMANASTYVRELAAITAAVKKWRQYLLGHKFTILTNHRSLGELMSQAIQTPEQHHYLVRLLGFDYTIQYRSGQTKTVADALLRVNEDTQASLYMLTMPRLLFMEDLRKELANTPAFKELYEQIQADPAKYSDYLVTSGLILHKGRIWLPPTSSFIKLLLEEFHQTPVGGHMGYDNRKPGGLLCPLPVLTLPWEDLSMDFIVGLPAYKGNTCIFVVVDHFSKGLHLGMLPPHHTAYTVAMMFMEIIGKLHGMPRSIISDRDPLFVSKFWKELFALSGTRLRLSSAYHPQMDGQMEVANRAIEQYLRAYVHHKPATWGRYLLWAEWSYNTPCHSATGMTPFEVTYGRKLPSFPQYITGTSWIDAVDDILKQREEVFAFLRKKLSKAQGRMKETTDKRRWDQEFDVGDWVLVKLRPHIQTSAKGAPYSKLAKRYYGPFQIIARMGKVAYKLKLPDHSRIHLVFHVSLLKAYIAGANTSSSADLPSEAIDNHPVIKPLTIVASKIIPSDAGPRLMVLVQWAGLPPEDSSWEDWSEFKALHDLEDKVLFEEGVTRKAQKESNPSLSPRDYVRRFSSLVAVSMAVRLLECQTIDRMQHTMRAPIVGEVVAALEEVVNVFGGGGDHKVVVVDEGDGVDEGGEKRDNGVFIGKTQRELELGANLYESDRNS

SEQ ID NO: 169045 - protein, 106 aa, Glycine max
  Coding DNA Sequence Number=SeqID_52267
MEDMKVGAVKYKGMGYQKNMRIHDVGYNVQDILPENTGIAKSIEAAGSTMSDTMSRTSCPKILELLKALKLQDPRCRIRCPGHLARKYWTYKSVISLTDYCAVSKR

SEQ ID NO: 169046 - protein, 108 aa, Glycine max
  Coding DNA Sequence Number=SeqID_52268
SRPENAEIFGKGAEDADIYGEDVDILGKGEANETLSKSRLEDAKISGKGVDPDIFGEGASDDTSLGEVLVTTLVTACFRALSLTDSKCDFTQSRSEHTNIYGKGAGDD

SEQ ID NO: 169047 - protein, 72 aa, Glycine max
  Coding DNA Sequence Number=SeqID_52269
  Homolog annotation: Hit_ID=Q1S890; Match level="QueryCoverage=91%, HitCoverage=7%, E-value=4e-23, Identity=82%"; Hit description =Protein kinase; Hydroxymethylglutaryl-coenzyme A reductase
AKPYLQAGAFEIVDEDIRGSFDPLSMRKAAFIAIKSVERDASQRPSIAEVLAELKETYNIQLRFLESCQNEN

SEQ ID NO: 169048 - protein, 202 aa, Glycine max
  Coding DNA Sequence Number=SeqID_52270
  Homolog annotation: Hit_ID=Q0GLE3; Match level="QueryCoverage=78%, HitCoverage=62%, E-value=2e-07, Identity=29%"; Hit description=Dof9
MGLMGTVVELDYPKMGFIYTVFESQVNFILFPCVLAVYSSLLPEKNWIWRPAPPDKVRVEGSLSFHIGSNFSYLPKADHQPSSNSSFQRPIGPIHPPHLYHQMGSGEREMVSLYEQGLVNPYSSNMANTDTNSSGVSQHDWPMSFINNNNVSNRASDASLWSTISTTIGGNSERTSTSGVGAGSSSFVKNQWPNLPGYGPPP

SEQ ID NO: 169049 - protein, 82 aa, Glycine max
  Coding DNA Sequence Number=SeqID_52271
MPQIFIHRQNYSQKFRNNANISASLSSQTLMLLTQISGDFILLCMPETGPRSHYGETNEVPETRKGKESEDVKMGDGERNEG

SEQ ID NO: 169050 - protein, 210 aa, Glycine max
  Coding DNA Sequence Number=SeqID_52272
MDVQRILKYGPWSFDKHLLIRGVIKPCESPSQVPLFTIPFWVQNNNNLFRPFMRIGILLDLGHVDELCEMLFSKGVDDGNYHWGPNLKGLQAWMITNNMLPARDKVINEAGIFKNPKIISPQSNQESLHIKTPNNDEMNVEESVVNDLVEDKPIWRIIGFYGHPDRENREDSWNLLRFLAEDTSLPWFTIGDFNDLLNNDEKIGLVDLDY

SEQ ID NO: 169051 - protein, 222 aa, Glycine max
  Coding DNA Sequence Number=SeqID_52273
MASYDGSFFLAHLLLEVDSIDEEDPRPTSSTWSYIKIDSSYDDFLLPFLCPNYPLGIHIIPTTTIKFMLDHIAPRFPPLDLMKKKGKVPPHSKPMPYPGPMDNVALRLIPYHWSRYFTRDVAKKIFAFKPDVEFDQNDVMLFYFKDMYENSRLVYTSKYNKEDTSNHIHMEIMSSINVSSMIFLLFALDLSLTCTSAQKLNPWVPGQGMAAELQRKQDKPNC

SEQ ID NO: 169052 - protein, 107 aa, Glycine max
  Coding DNA Sequence Number=SeqID_52274
  Subcellular localization annotation: CTP_CleavageSite=38; ConfidenceScore=5.88e-01
MGFNDAPSAMVSRKSSLMKTRGHSSSSLSCSSNFKPTRARALVLVVTLNVTFVRISRVFLAPPSPSPLFYLASLIESKFQKHGLAFHHSPNAKVSGINFVKEKEYFV

SEQ ID NO: 169053 - protein, 271 aa, Glycine max
  Coding DNA Sequence Number=SeqID_52275
MFWRNTKFSNKKFIISKVLGTKATRCLRDGSTYQEGWEKNYDTHVTRTLYKENVDKAGDQETIMYNMLCEKAKIWTNILKNSVLHKVGSKTTLSVLHKFVLFHLMENLPFDLPHTIYINMLRNLKGLGGLDNIYYATLINKLLWDQDVYHVFNEMDDDSHHTLMAKAAPAPKRAKTVQPALELKEFVIPFVILKCIKTRATKANPKFGEKEWTISFTSNKEYQASSSSNNESTNETPISHSSLNTTASTSIPHPSQEVQKSIPTKGILDKC

SEQ ID NO: 169054 - protein, 107 aa, Glycine max
  Coding DNA Sequence Number=SeqID_52276
  Subcellular localization annotation: CTP_CleavageSite=63; ConfidenceScore=5.38e-01
MGKGVALAPTYPQQKKGIWDHGSSLRLTPEVTGSPRRVGSFRLKSSKGPSEPEASLVLNSTVRLARIKTLVNDSPRTKLGSNNVDHYFSLQTLCLFAYDKKGRRRNF

SEQ ID NO: 169055 - protein, 138 aa, Glycine max
  Coding DNA Sequence Number=SeqID_52277
MSSAATSHQDATALVCTWHPRIGSSINRATVYLPGLHISRATDVKIVANKMEVVNYPRNWSSLFSGNKLASIFGSDGSNNTKHHNFIQVLCPFRNYHFDDACVYFTKDVDGYSFIQHLLQLPTIQSEWTYNLLKMTKV

SEQ ID NO: 169056 - protein, 237 aa, Glycine max
  Coding DNA Sequence Number=SeqID_52278
  Gene Ontology: Mol. function=magnesium ion binding; Cellular component=chloroplast; Biological process=metabolic process
  Homolog annotation: Hit_ID=Q5UBY0; Match level="QueryCoverage=97%, HitCoverage=41%, E-value=7e-73, Identity=57%"; Hit description=Wound- inducible putative cytosolic terpene synthase 1
  Pfam annotation: Domain name=Terpene_synth_C; Domain location=78-234; Score=159.2; E_value=1.1e-44; Accession=PF03936.6; Description =Terpene synthase family, metal binding domain
MLSLYEAAELRMHGEDILEEAHNFALVQLTKSLTTQLSPSMIAQVKHSLRRSLRKGLPRLEATYYMSFYEEDSSHDEKLLTFAKLDFNMLQELHQKEVNNVTRWWIKNLNVSTKLPFVRDRIAECYFWILGIYFEPQYSLARRITTKVIALCSVIDDMYDAYGTIDELELFTNAIERWDICCLDDLPEYMKVCYIEILNVYEEIEEEMRKQGKVYCIKYAKKEQQPNFIEGKVNHKQ

SEQ ID NO: 169057 - protein, 74 aa, Glycine max
  Coding DNA Sequence Number=SeqID_52279
MPRSIENECLVELETNLFEFLNIEKVFNMDGRLIIFVYGGNLYGWDELDNKGVTDGHCREFESSEVGFRFQRRR

SEQ ID NO: 169058 - protein, 243 aa, Glycine max
  Coding DNA Sequence Number=SeqID_52280
  Gene Ontology: Mol. function=zinc ion binding
  Homolog annotation: Hit_ID=Q1SXX9; Match level="QueryCoverage=73%, HitCoverage=18%, E-value=6e-65, Identity=69%"; Hit description=Zinc finger, RING-type
MFGCFLSLPHFAVFALPAQTFLVALASFVAADFCISLLRDWLAWPQILKLKDWPPSNLFEEQLPRHCAEFISSLPFKEYTDPHKGSLNLAVKLPNGSLKPDLGPKTYIAYGFLQELGRGDSVTKLHCDMSDAVNVLTHIAEVKLDSDQLTVIEKLKQKHLEQEKRELLGDDQDGETNVDMLNNSSSTINALDRQSSVEVMEQEGGLCDGKEVDQFHQPSGSNEVAIANEDGISYGSELIEVDK

SEQ ID NO: 169059 - protein, 170 aa, Glycine max
  Coding DNA Sequence Number=SeqID_52281
MEVADPTCITARTCSGTLLSFKRLAKILLKHKHLDNEGKLELLHMMIHDVGYNVQDILPENTGIAKSIEAAGSTMSDTMSRTSCPKILELLKALKLQDPRCRIRCPGHLARKYWTYKSVISLTDYCADNDRSHPAQVVAAQIRTLLYKHGGCTSSVPSPGLKSYFVSFGT

SEQ ID NO: 169060 - protein, 454 aa, Glycine max
  Coding DNA Sequence Number=SeqID_52282
  Gene Ontology: Mol. function=transferase activity; Cellular component= nucleus; Biological process=paclitaxel biosynthetic process
  Homolog annotation: Hit_ID=Q5I2Q5; Match level="QueryCoverage=96%, HitCoverage=95%, E-value=0.0, Identity=76%"; Hit description =Putative alcohol acyl-transferases
  Pfam annotation: Domain name=Transferase; Domain location=7-439; Score=573.2; E_value=2.5e-169; Accession=PF02458.6; Description =Transferase family
MDTSLVFTVRRREPELIAPAKPTPREVKLLSDIDDQDGLRFQIPVIQIYRHDPSMAGKDPVEVIRKALARTLVFYYPFAGRLREGRDRKLMVDCTGELGVLFIEADADVTLKHFGDALQPPFPCWEELLYDVPGSQGVLNTPLLLIQVTRLKCGGFILTLRLNHTMSDAAGLVQFMSALGEIARGRHEPSVPPVWRRELLNARDPPRVTCTHREYEQVPDTKGTIIPLDDMAHRSFFFGPSEVSAIRRLIPRADQCSSSNFEVLTACLWRCRTIALQPDKDEEVRILCIVNARAKFDPPLPSGYYGNAFAFPAAVTTAGKLCENPLGYAVELVRKAKADVTEEYMHSVANLMVAKGRPHFTVVRSYVVSDVTRAGFGNVEFGWGKAVYGGPAKGGVGAIPGVASFYIPFKNAKGEEGLVIPVCLPSEAMERFQKELNSVLNNHIVQPSIIVSSL

SEQ ID NO: 169061 - protein, 544 aa, Glycine max
  Coding DNA Sequence Number=SeqID_52283
  Gene Ontology: Mol. function=helicase activity; Cellular component =membrane; Biological process=regulation of transcription, DNA -dependent
  Homolog annotation: Hit_ID=Q9FGC2; Match level="QueryCoverage=100%, HitCoverage=72%, E-value=0.0, Identity=80%"; Hit description=DNA helicase-like
  Pfam annotation: Domain name=DEAD; Domain location=151-372; Score= -14.6; E_value=9.6e-05; Accession=PF00270.19; Description=DEADDEAH box helicase
  Pfam annotation: Domain name=ResIII; Domain location=147-350; Score= -26.8; E_value=0.0081; Accession=PF04851.6; Description=Type III restriction enzyme, res subunit
  Pfam module annotation: Pfam domain module=DEAD::ResIII; Domain location=151-372::147-350
MHLVLFKVEGNHRLPPTTLSPGDMVCVRTYDSMGAITTSCIQGFVNSFGDDGYSITVALESRHGDPTFSKLFGKSVRIDRIQGLADTLTYERNCEALMLLQKNGLRKKNPSISVVATLFGDGEDVAWLEKNHLADWAEEKLDGRLGNETFDDSQWRAIAMGLNKKRPVLVIQGPPGTGKTGLLKQLIACAVQQGERVLVTAPTNAAVDNMVEKLSNVGLNIVRVGNPARISKTVGSKSLEEIVNAKLASFREEYERKKSDLRKDLRHCLRDDSLASGIRQLLKQLGRSLKKKEKQTVIEVLSSAQVVVATNTGAADPLVRRLDTFDLVVIDEAGQAIEPSCWIPILQGKRCILAGDQCQLAPVILSRKALEVGLGISLLERAATLHEGILTTRLTTQYRMNDAIASWASKEMYGGLLKSSETVFSHLLVDSPFVKPTWITQCPLLLLDTRMPYGSLSVGCEEHLDPAGTGSLYNEGEAEIVLQHVFSLIYAGVSPTAIAVQSPYVAQVQLLRDKLDEFPEAAGTEVATIDSFQGREADAVILSM

SEQ ID NO: 169062 - protein, 176 aa, Glycine max
  Coding DNA Sequence Number=SeqID_52284
  Homolog annotation: Hit_ID=Q15KJ0; Match level="QueryCoverage=31%, HitCoverage=17%, E-value=2e-07, Identity=50%"; Hit description =Truncated PHYLLO protein
MKKDSTCRNPLERTSETRSQVMHDYCQLVPITSCSSPSAALSPALTLEEGLEKLKEALQILNSPSPSSPTGFLRFQVALPPSPKTFTLFCSQPHSSSVFPLIYVSKNDADSKSLYVNLDDNVSHRKESRSQIELDELESVSILSMTLAWDEFSFSTFQEAHYSLQDSLDQVPDMPF

SEQ ID NO: 169063 - protein, 111 aa, Glycine max
  Coding DNA Sequence Number=SeqID_52285
MNPHSHFRLYHATTSKVLFIMVICCAPRQFLSPKNWKFSLSREIQVSCEVDETLLLVSLSVVKALLEVICILEGIVFTAILVMRVIWAAVSYIQSSGNSFNQGTNSFGGVA

SEQ ID NO: 169064 - protein, 126 aa, Glycine max
  Coding DNA Sequence Number=SeqID_52286
  Homolog annotation: Hit_ID=Q1S238; Match level="QueryCoverage=30%, HitCoverage=8%, E-value=3e-08, Identity=79%"; Hit description=IMP dehydrogenase/GMP reductase
MEKYIKDVIRVVEASGLHLTAPSTLGIRWAPLSGGTRAAIAPDSPNRARLSAWFFANSLNLAIADRFTATDGECRLVLRLGLVVDVRSSRRRLGGGDGGEPLELAGDIATTGREIAQSLRELEELL

SEQ ID NO: 169065 - protein, 698 aa, Glycine max
  Coding DNA Sequence Number=SeqID_52287
MALVSSLSPATPSSVQTNTLNPLGWTDDQILEKVYITHVHTAERYDVESLFNVTANIIKRSTALADSVAVKTGTPVGLIEDKVPLSTFDPPFLKLKHIASQMMNTPHGEHHAHSTAMSILDQLRTYTWDGKAILVLAALALEYGNFWHLVQTPSGDHLGRSLAQMSRVHIVERNRQAVADYNSLVKNLLIAVECITELERLSTKGYDLKDVPALAEAMQEIPVAVYWAIVTTVVCANHFDFLLGESDSRYEIANFDDKLAAVISKLKANLTRSRKKIGDLEDYWRRKKLLQTPTEIVEVLKVLIYHNEVHDPHVYDGLTRQMVSIEVFRKKHVLLFISGLDSIRDEVRLLQSIYEGLQEDPREVKGYRKEDFRILWVPVVDEWNLLHRAEYDNLKLEMPWYVTEYFYPLAGIRLIREDLNYKNKPIIPVLNPQGRVVNYNAMHMIFVWGIDAFPFRPSDDDVLTQKWNWFWAEMKKVNPKLQDLIKADSFIFIYGGSDKKWLQDFAQAVERIKRHEIIKRADAVIEHYPFGREDHRIVPRFWIGIESLFANMIQKTHKDPTIEEIKSLLCLKQQQPGWVLLSKGSNVKLLGSGDPMLATAADFEIWKEKVLEKAGFDVAFKEYYEQKRRNYPQECSNMQLANYPADILHPINCPDAACGRSMEIASVSYKCCHGQAAHHKAEVPESGDVMIEKKLYAS

SEQ ID NO: 169066 - protein, 877 aa, Glycine max
  Coding DNA Sequence Number=SeqID_52288
  Gene Ontology: Mol. function=nucleic acid binding; Biological process= fatty acid biosynthetic process
  Homolog annotation: Hit_ID=Q1SL15; Match level="QueryCoverage=96%, HitCoverage=89%, E-value=1e-143, Identity=34%"; Hit description =Ovarian tumour, otubain
  Pfam annotation: Domain name=FAR1; Domain location=44-254; Score= -43.8; E_value=0.0019; Accession=PF03101.5; Description=FAR1 family
MEDHVSNMYEVVNMPIDGAANKSDDCSDAFNTTEVFPSREAMLNWARDVAKENGFVLIILRSETSTTCTRSTRCNQRKTFVIMGCDRSGKYRGPYKNELSRKVSGTRKCECPFKLKGKALKKAEGWIVKVMCGCHNHDLEETLVGHPYAGRLSAEEKSLVDALTKSMMKPKDILLTLKDHNMGNVTTIKQIYNARQAYRSSKKGSEMQHLLKLLEHDRYVYWHRKVDDSDAIRDIFWTHPDAIKLLGAFNTVLVIDSTYKTTRYQLPLLEIVGVTSTELTFSAAFAFVESERAENFTWALKKLRGLIAKDDDMPQVIVTVGDIALMSAVQVVFPSSSNLLCRFHINQNVKAKCKSIVHLKEKQELMMDAWDVVVNSPNEGEYMQRLAFFENVCLDFPILCDYVKNTWLIPHKEKFVTAWTNQVMHLGNTATNRVEATHWRLKTLLQDSKEDMCSYWDAMKNIITLQHKEIEASFEKSINVVEHRHNTPFYIKLVGFVSRSALSHIIDEYDRVKTAGIDSSICGCIVRTTHGLPCACELARYNTMCHPIPLEAIHVHWRKLKFSDHVSNDEGTELSLQPEIGALYNRFQELDYAGKIILMAKLHEIAFPVKISKCPPLEEVGTKHALEGPRLKSDGSTKFDPSYWEHVHALHPTHDITKSLPSSQKPVHESKRRRVLPMMDQFPVEIHPFIEDIIDVKGDSNCGYRAVAAQLGMGEESWALVRQDLIRELQQWQDNYAKLFGSNDRVAELRQSLYVGKQASVASWMTIPDMGYVIASRYNVVLVTLSLQECMTFFPLRGRPPLSQSSYRLISIGFVHKCHFVQVVLKADSVLPPTALQWSRYCNAESRSWETSYVSRMQQFRSLFPQKEIGYVDIIED

SEQ ID NO: 169067 - protein, 135 aa, Glycine max
  Coding DNA Sequence Number=SeqID_52289
  Gene Ontology: Mol. function=enzyme inhibitor activity
  Homolog annotation: Hit_ID=P93674; Match level="QueryCoverage=74%, HitCoverage=51%, E-value=2e-10, Identity=37%"; Hit description =Putative 21kD protein precursor
  Pfam annotation: Domain name=PMEI; Domain location=35-135; Score= -2.6; E_value=0.024; Accession=PF04043.6; Description=Plant invertasepectin methylesterase inhibitor
  Subcellular localization annotation: CTP_CleavageSite=58; ConfidenceScore=5.19e-01
MAQLNLTLLLIFLSLLFSFLVTPIEPSSLTRHKNSQTMTYIESSCSSTLYSNLCIRCLAKYVKSTLNGPGHLAQYTLSMSLSRAIHTRGYLLKVVKEMKAKGVKNNKREYLIVQDCVNQITDSVKQLSQATKELR

SEQ ID NO: 169068 - protein, 147 aa, Glycine max
  Coding DNA Sequence Number=SeqID_52290
MVVITIIMIVNAISIVIVTTIIMIHCPHHSSPASDVEVVMTVMRVVPTVIIVVIAAKVVIMMYGHRSSSDNDDNNHKVMVLTKTIVVVTIMTVVVRIIIKIVIIMTMMTVRVAMTIISSVNYNIMIPINGSHFSFYGSNKKMRRESF

SEQ ID NO: 169069 - protein, 667 aa, Glycine max
  Coding DNA Sequence Number=SeqID_52291
MSISNTQLKPLLPNPFNLSNTEIVEKVYVSHTYDDEMFDNEPLFNVVSNIIKLSTRIVGALLKIDEPNGFLGNPITISSFKPEFSTLKLMSCQMMTLPWGPENAHQTTLRILQQLRKYSWDAKALIALAAFALEYGNFWNLQQASDPLGNSLRLLNQIQHRQLPVTDINATVKLVMEAVEKIRRWGTLSSDETYETEDVPALSDALQLIPLLVYWVVASLVACNTNIQGVSNYALSDFRGKLSTALDEFKHHLEICEQQKASIEDYRRRKKAFKKPKDIVDFLKLLINQNGYKSQIYDGNANRNVNVEVFKEKYVLLFISGLDRIEDEIRLLNSIYERLVEDPNDKSGFKKEEFKILWIPIENKWGDARRELFNTLKSDIKWYVVEYAQVPLPGIRLIEEDLRFHGKPILPVVKPQGVLLNDDALDIIFEWGIHAFPFRKSDAYLLAQKWKWFWDEVKKTNLHGIQVKGDRYIFIYGGSDKWTREFTVAVDKIKRHDTIRRADAIIDYYHLGKDDPKIVPRFWIGIEGKRQKKHSENLDCEIQEIIRSLLCLKQDTQGWAILSKGSNVRILGHGQPMYQTVADFEKWKERVLVKEGFDIAFQEYYDTQRDLPAPQPCEFNTLDVLATITCPNASCGRVMEVTSVNYKCCHGGNVADHAIKSRSTTAT

SEQ ID NO: 169070 - protein, 197 aa, Glycine max
  Coding DNA Sequence Number=SeqID_52292
  Homolog annotation: Hit_ID=Q6EUE9; Match level="QueryCoverage=37%, HitCoverage=34%, E-value=5e-15, Identity=52%"; Hit description =Antigen receptor-like
  Pfam annotation: Domain name=DUF565; Domain location=132-174; Score =28.4; E_value=4e-06; Accession=PF04483.3; Description=Protein of unknown function (DUF565)
  Subcellular localization annotation: CTP_CleavageSite=5; ConfidenceScore=5.47e-01
MRSSSCMTRAQVKSLDCVGSGVSKVGLAVFFYKTTFGQKQCCPSFFGFAQPCLTVNFKRMIWSVRSSLNDSSFSPSTSNGSNGRTRIIRVIQEFQTKLGSKIQEVKKNLPMKLLFFLVGFYCATAFATVIGQTGDWDILSAALAVAVVEGIGALMYRASLPLAEVTIQCMKVGASSSSKVKILESQFSYPEAMSFKL

SEQ ID NO: 169071 - protein, 231 aa, Glycine max
  Coding DNA Sequence Number=SeqID_52293
  Gene Ontology: Mol. function=DNA binding; Cellular component =mitochondrion
  Homolog annotation: Hit_ID=Q1T4X2; Match level="QueryCoverage=95%, HitCoverage=40%, E-value=3e-26, Identity=35%"; Hit description =Pentatricopeptide repeat
MWTLRRASFRLSTRRGVNAGASRASAVKLVATTSEENEAGIPQSRQITYGRFLSAGMGRVSLKFAVGRHELSSQAGASSTKDDDDDLEIHGSNDESDADLSDGDEDGEKPHDELELSDAEIDPTKKKSQARWTQLKLFKVILNAPGLSVDSALSKWAGQGKELSRKEIFLAVRELRRRKMYGRAFQNKSENFKLKIYTLLRFKSEKHYRFSKVPRRAKLEIVGDPTSTSDL

SEQ ID NO: 169072 - protein, 67 aa, Glycine max
  Coding DNA Sequence Number=SeqID_52294
MVVAHANAGVRGQVTRDYNGVGRRVAHIYRGDSVWRVVVGFGGYDVMKVVVSSARWLVLVAAKVVVA

SEQ ID NO: 169073 - protein, 445 aa, Glycine max
  Coding DNA Sequence Number=SeqID_52295
  Gene Ontology: Mol. function=RNA splicing factor activity, transesterification mechanism; Cellular component=ribonucleoprotein complex; Biological process=RNA splicing
  Homolog annotation: Hit_ID=O22212; Match level="QueryCoverage=99%, HitCoverage=81%, E-value=1e-161, Identity=63%"; Hit description =U4/U6 small nuclear ribonucleoprotein PRP4-like protein
  Pfam annotation: Domain name=PRP4; Domain location=22-51; Score=56.7; E_value=7.8e-14; Accession=PF08799.1; Description=pre-mRNA processing factor 4 (PRP4) l
  Pfam annotation: Domain name=WD40; Domain location=144-182; Score =14.6; E_value=0.36; Accession=PF00400.22; Description=WD domain, G -beta repeat
  Pfam annotation: Domain name=WD40; Domain location=186-224; Score =32.7; E_value=1.3e-06; Accession=PF00400.22; Description=WD domain, G-beta repeat
  Pfam annotation: Domain name=WD40; Domain location=226-264; Score =40.9; E_value=4.3e-09; Accession=PF00400.22; Description=WD domain, G-beta repeat
  Pfam annotation: Domain name=WD40; Domain location=268-306; Score =34.4; E_value=4e-07; Accession=PF00400.22; Description=WD domain, G -beta repeat
  Pfam annotation: Domain name=WD40; Domain location=310-348; Score =50.2; E_value=7.1e-12; Accession=PF00400.22; Description=WD domain, G-beta repeat
  Pfam annotation: Domain name=WD40; Domain location=352-391; Score =33.1; E_value=9.5e-07; Accession=PF00400.22; Description=WD domain, G-beta repeat
  Pfam annotation: Domain name=WD40; Domain location=395-433; Score =47.0; E_value=6.3e-11; Accession=PF00400.22; Description=WD domain, G-beta repeat
  Pfam module annotation: Pfam domain module=PRP4::WD40::WD40::WD40::WD4 0::WD40::WD40::WD40; Domain location=22-51::144-182::186-224::226 -264::268-306::310-348::352-391::395-433
MQELMMKRRAAALAVPTNDMAVRARLRHLGEPITLFGEREMERRDRLRMIMAKLDAEGQLEKLMKAHEEEEAAASASIDEAEEELQYPFYTEGSKALLDARIYIAKYSLTRAALRIQRAQRRRDDPDEDMDAEMNWALKQAGNLSLEFSEIGDDRPLSGCSFSRDGKWLATCSLTGASKLWSMPKIKKHSSFKGHTERATDVAYSPVHDHLATASADRTAKYWNQGSLLKTFEGHLDRLARIAFHPSGKYLGTASFDKTWRLWDIETGDELLLQEGHSRSVYGLAFHNDGSLAASCGLDSLARVWDLRTGRSILALEGHVKPVLGISFSPNGYHLATGGEDNTCRIWDLRKKKSFYTIPAHSNLISQVKFEPQEGYFLVTASYDMTAKVWSGRDFKPVKTLSGHEAKVTSVDVLGDGGYIVTVSHDRTIKLWSSNTTDEQAMDVD

SEQ ID NO: 169074 - protein, 803 aa, Glycine max
  Coding DNA Sequence Number=SeqID_52296
  Gene Ontology: Mol. function=serine-type peptidase activity; Biological process=proteolysis
  Homolog annotation: Hit_ID=Q84LM4; Match level="QueryCoverage=91%, HitCoverage=97%, E-value=0.0, Identity=56%"; Hit description =Acylamino acid-releasing enzyme
  Pfam annotation: Domain name=Abhydrolase_3; Domain location=603-783; Score=-61.2; E_value=0.001; Accession=PF07859.3; Description =alphabeta hydrolase fold
  Pfam annotation: Domain name=Peptidase_S9; Domain location=592-802; Score=82.7; E_value=1.2e-21; Accession=PF00326.11; Description =Prolyl oligopeptidase family
  Pfam module annotation: Pfam domain module=Abhydrolase_3::Peptidase _S9; Domain location=603-783::592-802
  Subcellular localization annotation: CTP_CleavageSite=57; ConfidenceScore=5.67e-01
MACSRVANWCVAVAVSPSTLFPRISPTLNPNPNYLSSSVAPTPLSLSLTGFSSSPVSAMDKEDAAAAEQEYALHSTLLQEFTAISAIDKAWLFKSHTHTASASSSHAMFCVSQPNLLVNKRKKSIVSATILTQNDASSVTFQWAPFPIQVSGVSAMVPSPSGSKLLIVRNPESDGPCRFEIWSSSQLQKEFHIPPSKHGSVYTDGWFEGISWNSDETCIAYVAEEPAPTKPTFNDLGGYKKAGSSEKDCGTWKGQGEWEEDWGETYAGKRQPAPFVININSGEVQAVKGIDKSLSVGQVVWAPSTEGSAQHLVFVGWTFETRKLGIKYCYNRPCALYVVKAPHHESKANETEIHSTEDVQAVNLTQTISSAFFPRFRLMTKMIGKLANGESKGLLTSDGKFLVFVSARSSVDSGVHSATDSLHRIDWPEDSKLYKSAKIHEVIPVVLFAEDGGFPGLYCSTILSDPWLSDGYTLVIASIWHSSQVLLSINVLSGELLRITPADSNFSWSLLALDGNNILAVSSSPVDVPQIKYGAIVKKAANNKEWSWSDVANPIFKCSDKVRSLISSLTFSIMKISVKDISASLTKDEDISSSSLFQASYMIIFLRGSLGFGEEALQSLPGKAGSQDVNDVLTAIDHVINLGLASPSKIAVLGGSHGGFLTTHLIGQAPEKFVAAAARNPVCNLALMVGTTDIPDWCYVETYGTKGRDKFTEAPSAEDLTLFYSKSPIAHLSKVKTPTIFLLGAQDLRVPISTGLQYARALREKGGQVKVIVFPNDVHGIERPQSDFESYLNIAMWFNKYCK

SEQ ID NO: 169075 - protein, 109 aa, Glycine max
  Coding DNA Sequence Number=SeqID_52297
MVSKSDSDPPSPSSAKLMTSLAKQMDKLLRNVERRVIEDIERRRHHRSPYPSQGSDDGYEEGRRHRHRRNKDGMDDVKVKISKFLGTDDLERSEPSVHGLDCITFKFKV

SEQ ID NO: 169076 - protein, 163 aa, Glycine max
  Coding DNA Sequence Number=SeqID_52298
  Gene Ontology: Mol. function=oxidoreductase activity; Cellular component=membrane; Biological process=electron transport
  Homolog annotation: Hit_ID=Q9C9D1; Match level="QueryCoverage=99%, HitCoverage=33%, E-value=3e-37, Identity=46%"; Hit description =Putative cytochrome P-450; 4810-6511
MVKELVDLVGKYGVVEVRKVLHFGSLSNVIKSVFGRSYVFGEGVMDVSLRSCDHFPLFGWLDLQGVRKRYKSLVDKVNAFVGKIILKHRVKMVAQGEDKTRVTESSGDFIDVTLDLEKEKRLQHHDMVVVLWEMIFRGTYIATIILEYILARMILHPDIQAKA

SEQ ID NO: 169077 - protein, 84 aa, Glycine max
  Coding DNA Sequence Number=SeqID_52299
  Gene Ontology: Mol. function=translation initiation factor activity; Biological process=regulation of translational initiation
  Homolog annotation: Hit_ID=P48724; Match level="QueryCoverage=98%, HitCoverage=25%, E-value=6e-24, Identity=53%"; Hit description =Eukaryotic translation initiation factor 5
  Pfam annotation: Domain name=W2; Domain location=3-84; Score=54.5; E _value=3.6e-13; Accession=PF02020.8; Description=eIF4-gammaeIF5eIF2 -epsilon
MSALVEALFEGTEKEFSCKSTSNALKEVALVLKALYDADVLEEEHIVQWYQKGLKGENKNSKIWKNVQPFIDWLQSAESETEEE

SEQ ID NO: 169078 - protein, 49 aa, Glycine max
  Coding DNA Sequence Number=SeqID_52300
MKSFHQLLGLKVSTFHSLYHFNVGGPVFDKRIMSLSAYPALMLMLKAAL

SEQ ID NO: 169079 - protein, 659 aa, Glycine max
  Coding DNA Sequence Number=SeqID_52301
  Gene Ontology: Mol. function=serine-type peptidase activity; Biological process=proteolysis
  Homolog annotation: Hit_ID=Q84LM4; Match level="QueryCoverage=99%, HitCoverage=97%, E-value=1e-128, Identity=61%"; Hit description =Acylamino acid-releasing enzyme
  Pfam annotation: Domain name=Abhydrolase_3; Domain location=459-639; Score=-59.5; E_value=0.00078; Accession=PF07859.3; Description =alphabeta hydrolase fold
  Pfam annotation: Domain name=Peptidase_S9; Domain location=450-658; Score=60.4; E_value=5.8e-15; Accession=PF00326.11; Description =Prolyl oligopeptidase family
  Pfam module annotation: Pfam domain module=Abhydrolase_3::Peptidase _S9; Domain location=459-639::450-658
MHKETEDDYAYLSNLLQDLTMIPNMDKAWLFSSPGSQLQGMFVVSQPDLLTNKRRTSIMSCNILKQSDSSVKFLWAPFPIEMSGVSMIVPSPSGSKLLVIRNPENEAPCCFEIWSSSRMEKEFHIPQSLHGSVYNDGWFEGVSWNLDETCIAYVAEESSPAKPTFNDLGGYKKGGCADKDLGYWKGQGDWEEDWGETYAGRRRPALFVININSRDVQEVKGIDKSLSIGQVVWAPFTEGSEQYLVFVGWSSKPRKLGIKYCSNRPCALYTVRVRALHHESKPNEPVVHPDGKFLVFLSARSAVDSGVHNATNSLHRIDWPTDGKLFQSSKIYDIIPVVMCAEDGCFPGLYCTTIHNNPWLSDNCTMIISSIWHSSEVLLSVNVLSPVDVPQIKYGMAIEKATSNTTWSWSNISSPIFRCSDKVVSLLSSLQCSILSISVKDVHDGQTKGFQVTLVACMLLFLRGSLGFGEEALQSLPGKVGSQDVNDVLSAIDHVINLGLASPSKITVMGISHGGFLTTHLIGQAPDKFVAAAAINPVCNLALMIGTTDIPDWCYVEACGTIAKNCFTEPPSADDLTLFQSKSPISHVSKVKAPTLFLLGAQDIRVPIFDGLQYARALKEKGVEVKIIMFQNDVHALKRPQSDLECFLHIGVWFNKYCK

SEQ ID NO: 169080 - protein, 124 aa, Glycine max
  Coding DNA Sequence Number=SeqID_52302
MGVKVDGQRVGLPTGRLILEVQAVRLASLTLAQHTCIGHHLPGSSMRSASHAAPSGSCAQPEEDGISQKFDITFNTSSSAYNLPPSSFCYHPSLSTQMYGMGYDDEEEDDDNNNTNNNDDGWSW

SEQ ID NO: 169081 - protein, 246 aa, Glycine max
  Coding DNA Sequence Number=SeqID_52303
  Gene Ontology: Mol. function=oxidoreductase activity; Cellular component=integral to membrane; Biological process=electron transport
  Homolog annotation: Hit_ID=Q43071; Match level="QueryCoverage=100%, HitCoverage=81%, E-value=1e-30, Identity=40%"; Hit description =Cytochrome P-450
MGFAPYGEYYKNLMRIYATHMFYLRRIVAFGEFWAQVGAQMVKEIMGLVRKYNVVEVRKELVTEGYDLLGVLNWSDHFPILDWLDLQGVRKRYGSLVDKVNVVVRKIILEHGVKRVVEGKDKTRFTKSSTDFVDVMLDLKKEKRLRHSDMVVVLWFKPKHFLKDKDMPIMGFDFRLIPFGSRRKEHSKPKFNNDQARGFYKADPSSRSRRPNILVVSDSPHVDHSSGANYTKVVLNLLVVYGKSSP

SEQ ID NO: 169082 - protein, 571 aa, Glycine max
  Coding DNA Sequence Number=SeqID_52304
  Gene Ontology: Mol. function=zinc ion binding; Cellular component =nucleus; Biological process=proteolysis
  Homolog annotation: Hit_ID=Q1S4D5; Match level="QueryCoverage=91%, HitCoverage=95%, E-value=1e-159, Identity=86%"; Hit description =FAR1; Zinc finger, SWIM-type
  Pfam annotation: Domain name=FAR1; Domain location=62-279; Score =307.8; E_value=2e-89; Accession=PF03101.5; Description=FAR1 family
  Pfam annotation: Domain name=SWIM; Domain location=425-469; Score =27.0; E_value=6.5e-05; Accession=PF04434.8; Description=SWIM zinc finger
  Pfam module annotation: Pfam domain module=FAR1::SWIM; Domain location=62-279::425-469
MSEEAGSMLVVYDDPSDQRSLSLDDASSTEESPDETRLSLETTNDAIPYIGQRFATHDAAYEFYSEFAKRSGFSIRRHRTEGKDGVGKGLTRRYFVCHRAGNTPVKTSTESKPQRNRKSSRCGCQAYMRISKTTEFGAPEWRVTGFANHHNHELLEPNQVRFLPAYRTISDADKNRILMFAKTGISVHQMMRLMELEKCVEPGYLPFTEKDVRNLLQSFRKLDPEEESLDLLRMCRNIKEKDPNFKFEYTLDANNRLENIAWSYASSTQLYDIFGDAVVFDTSHRLTAFDMPLGIWVGINNYGMPCFFGCTLLRDETVSHFLAGMTTTGQSKSINAFIQRFLSAQTRLAHFVEQVAVAVDFKDQTGEQQTMQQNLQNVCLKTGAPMESHAATILTPFAFSKLQEQLVLAAHYASFSIEDGFLVRHHTKAEGGRKVYWAPQEGIISCSCHQFEFTGILCRHSLRVLSTGNCFQIPDRYLPIRWRRINMPSSKLLQSAPNDHAERVKLLQNMVSSLMTESAKSKERVFVYGVMVREGDDIVKVARAVDSAAIMEYSGVSACSGLVYGEDDGMG

SEQ ID NO: 169083 - protein, 230 aa, Glycine max
  Coding DNA Sequence Number=SeqID_52305
MIMRVQDIYSSQDEATTSPSSSESEEAKGEESSKEIYPHEEGQPLMVKEECKEVSVSSKRLAKKERNFEIKTNIKEISPLRQSPHFLFCKKTLVSIATPGLEFIPQVKELLDEGLVRKSLNSCALLVPKKGVEEKSPEFQEPQDLRSNPFQGGDFRALFEQRNPLMKKILGLQASMELTLREFAFAKKDFNLAKHPEIDAELQIQREVEEVGGLEKLEKEISRRARSQNS

SEQ ID NO: 169084 - protein, 343 aa, Glycine max
  Coding DNA Sequence Number=SeqID_52306
  Gene Ontology: Mol. function=DNA binding; Cellular component=nucleus; Biological process=regulation of transcription, DNA-dependent
  Homolog annotation: Hit_ID=Q84PP5; Match level="QueryCoverage=97%, HitCoverage=98%, E-value=5e-72, Identity=45%"; Hit description =Transcription factor MYB101
  Pfam annotation: Domain name=Myb_DNA-binding; Domain location=14-61; Score=57.3; E_value=5e-14; Accession=PF00249.21; Description=Myb -like DNA-binding domain
  Pfam annotation: Domain name=Myb_DNA-binding; Domain location=67-112; Score=55.1; E_value=2.3e-13; Accession=PF00249.21; Description=Myb -like DNA-binding domain
  Pfam module annotation: Pfam domain module=Myb_DNA-binding::Myb_DNA -binding; Domain location=14-61::67-112
MGRPPCCNESGVKKGPWTPEEDEKLMDYISKHGRGTWRTLPKHAGLNRCGKSCRLRWENYLRPDIKRGKFTEEEEQLIINLHSVIGNKWAKIATHLPGRTDNEIKNYWNTNLRKKLLQMGIDPETHKPRTDFNHLLNLSQLLGLSNLGTSTSPWTNPLGLQADVTQIAKLQLLQNMLQLFNGTSLVNIGNPYLLGNQILNPLDTFLNGTNILPDKDSILRGLEYANPVGNNSGLFLSQTYSDSSVFKSRTEKENETNQEFLGYNQSINTFPENQAENLLPALVASGPRSSTFNQMDFNYNAARMSTQSPSTTFEAWEKFLIDDDESSGSYWKEILDLTYPLSW

SEQ ID NO: 169085 - protein, 143 aa, Glycine max
  Coding DNA Sequence Number=SeqID_52307
MVIFSRFQTSIRLSKKFAWANWPTPLDSFLYIVMQRLEKRHTRTREKCEKHHRRKKLVEKKPLVVDSMAGRGGKGNRPPRRTFGGCTYQQGPKHYNSISIPPFSNKVVELKLALLNLIASHPFAGMDHEDPYTHLLDKWPQKF

SEQ ID NO: 169086 - protein, 278 aa, Glycine max
  Coding DNA Sequence Number=SeqID_52308
MVIDESLFFELTQFSSDGVPFEGTIDEDWKFDFSSHDARRLVCTNQANMTGRLLVGSLAFECRIMHYLIVRILLPRSSNLAQALRSNTPLPYPHLIILFLHHFNVPLDSEPFVQVKISFSIGAGAVSSFGYRKKRDGSWVKKDAQPQAADDRSPSPPPQMDDSSSLMQNILDKLDGLHTFAGERFDSLDSCIDAIDARFARMDTRITQLEEDVCHHQKGRDCGSKASKLILMMPKTQVKNQDSSRFQELKNHSIKNQDSSEDSREDSRYARTSRKASR

SEQ ID NO: 169087 - protein, 107 aa, Glycine max
  Coding DNA Sequence Number=SeqID_52309
MCSYYYIEGFGTWPSRKTKGKTMKEKNLKTQYEVKKQRDKTVRRTKAWIEKQRLGKRGFWSNSEESKKEEYIYVEKLKLVFEKMLAIFDLRYPLVQIHVHHKWFLFR

SEQ ID NO: 169088 - protein, 167 aa, Glycine max
  Coding DNA Sequence Number=SeqID_52310
  Gene Ontology: Mol. function=nucleic acid binding
  Homolog annotation: Hit_ID=Q9M2L7; Match level="QueryCoverage=95%, HitCoverage=10%, E-value=2e-26, Identity=41%"; Hit description =Helicase-like protein
MSRECDSNGNVHEKEVNLFKKRRWSLYSDNEENNSFYGAHMTGERYQSMLGKHIQKYKRRFKGTLSSLAQNQAATPLVKSNTGLKAPKSGNEHMGGGLHVAKSTWEWMNDSSSQKLGNYHDVDFLPQYGTDRIMYEHASLDIGDGIIYKIPPIYDKLAGALNLPSFS

SEQ ID NO: 169089 - protein, 108 aa, Glycine max
  Coding DNA Sequence Number=SeqID_52311
  Subcellular localization annotation: CTP_CleavageSite=58; ConfidenceScore=5.23e-01
KDPQGMYPPLFSLNNLVDVPSTRTDPQEMYPLLFSVTTTPVDVPSTCTTKDVPSNVLRQSSQAVSPSKLCEGGNKRIPRREKGDNKEFRRLVLGEFFLAKGEGNEKDE

SEQ ID NO: 169090 - protein, 130 aa, Glycine max
  Coding DNA Sequence Number=SeqID_52312
  Gene Ontology: Mol. function=DNA binding; Biological process=DNA integration
  Homolog annotation: Hit_ID=Q1SKC8; Match level="QueryCoverage=95%, HitCoverage=35%, E-value=3e-29, Identity=48%"; Hit description =Integrase, catalytic region
MKFASTPSNGVRNKSLLAMKFLNFDSTKFREKRKLYKERTKRYHDKKILHREFRPGQEVLLYNSILKLFPKKLKSRWSGPITVKDVKSYGAIEIEDQSKDCSWLVNCQRLNIYLGGEVPQHTIVINLEDP

SEQ ID NO: 169091 - protein, 76 aa, Glycine max
  Coding DNA Sequence Number=SeqID_52313
  Subcellular localization annotation: CTP_CleavageSite=66; ConfidenceScore=5.51e-01
MASHIFKSMASIRICIRNSFTTRDPRSLNPFSKRVALAKRLYTAHPSSRIVPTLSHQMMCLADDTLSQMMSGLASS

SEQ ID NO: 169092 - protein, 179 aa, Glycine max
  Coding DNA Sequence Number=SeqID_52314
  Subcellular localization annotation: CTP_CleavageSite=61; ConfidenceScore=5.45e-01
PSSSAPPAPSTSATPTPAPPGPSSQDSQHFEAMLQSLHQGQILLMQSLQVVAPLGSIRLVEQFMEKVPQQVHDASSEATIPGAFDFSGGGLEMRPDEASSPEPVPVPADPSSLVVDPSFPMPKEALPSTPLIISEDPTVPVPRLATTPPVTPVLHFSDEEEGQTTTPPGTPMLHFDDEE

SEQ ID NO: 169093 - protein, 173 aa, Glycine max
  Coding DNA Sequence Number=SeqID_52315
  Gene Ontology: Mol. function=motor activity; Cellular component =dynein complex
  Homolog annotation: Hit_ID=UPI0000E478AA; Match level="QueryCoverage =44%, HitCoverage=22%, E-value=3e-09, Identity=37%"; Hit description =PREDICTED: similar to cortical granule protein with LDL-receptor -like repeats
MTPIFLSGMLQNFTDLCKKLVFLPKRCETYRLRNDACFEGSEWTKQGSRANRKYSRTKSGYDNVLAFRGMHALNFRGLHATHPQLQRATRPRLLRASRPRLQRATRPCLQRVAHPRLQRASRSRLQKATRPRLSRATHSRLWRATCHRLQRASRPRLQRAARPHLQRTACPRL

SEQ ID NO: 169094 - protein, 69 aa, Glycine max
  Coding DNA Sequence Number=SeqID_52316
MATRPTTHMRAQRSAARITTKSDSTAAAASGGGAAADWRSLSPRVMCDGRYYQVRDKGEVVKTFDSKRL

SEQ ID NO: 169095 - protein, 103 aa, Glycine max
  Coding DNA Sequence Number=SeqID_52317
MLGLYTHFSRKMIENHVNMVVEVLVIKIFILANIGSHQAHAFKKRFSSSQGQVWKKKCTLRCPYRTRAKARVMSELEEVQEQTKVDMEAMKEQMTKMMEAMMS

SEQ ID NO: 169096 - protein, 209 aa, Glycine max
  Coding DNA Sequence Number=SeqID_52318
  Gene Ontology: Mol. function=metallopeptidase activity; Biological process=proteolysis
  Homolog annotation: Hit_ID=Q35QX8; Match level="QueryCoverage=90%, HitCoverage=46%, E-value=9e-65, Identity=61%"; Hit description =Similar to Acetylornithine deacetylase/Succinyl-diaminopimelate desuccinylase and related deacylases
REEAVDAIAAAVELIPQINNITFSGAKSAEHRKINRGHIGTVHGALGRDLQEWRPPQVADFVRLKGSARFAPGQTVDGVLADLQALLDALCQRYPGLQAQLFDDGLRDKPTMLPFEVSPESPIVQAVNRGWQTVRGTPQPTGVITPPAFYGTDAAHLYQHAGMEGIVCGPGGKYNTMPDERVEISEFLDMVRIYLLAILDICQPVEPAS

SEQ ID NO: 169097 - protein, 70 aa, Glycine max
  Coding DNA Sequence Number=SeqID_52319
MVLRQLDAAPCRAQSPQLAIDAYRDEDDPWLAVAQSLTRRGYQRARLGADYASYGMTVHSWQQLARHLPE

SEQ ID NO: 169098 - protein, 122 aa, Glycine max
  Coding DNA Sequence Number=SeqID_52320
  Gene Ontology: Mol. function=3-phosphoshikimate 1-carboxyvinyltransfer ase activity; Cellular component=chloroplast; Biological process =aromatic amino acid family biosynthetic process, shikimate pathway
  Homolog annotation: Hit_ID=Q1T6A9; Match level="QueryCoverage=75%, HitCoverage=17%, E-value=8e-48, Identity=95%"; Hit description=3 -phosphoshikimate 1-carboxyvinyltransferase
MEGTRVQCILHKVLVVSIKGAELGGQLFCLASWRVKETERMIAICTELRKLGATVEEGPDYCVITPPEKLNVTAIDTYDDHRMAMAFSLAACGDVPVTIKDPGCTRKTFPDYFEVLERLTKH

SEQ ID NO: 169099 - protein, 153 aa, Glycine max
  Coding DNA Sequence Number=SeqID_52321
MAAIYAQVKSKNSQIHAQMPLRHFTEHLVGACLGMKIWGMGAKSIKNESKMQQKVAWGRKNGKSRSFGVFESGGKFKGRHKYALSTGRRSLTRTPFRVDEASDIYFKDTTPLLASVPKYLKEGNDIALQTVAALPFYLDWLLPSDPSQQLTTA

SEQ ID NO: 169100 - protein, 78 aa, Glycine max
  Coding DNA Sequence Number=SeqID_52322
  Gene Ontology: Mol. function=ribonuclease H activity; Biological process=DNA integration
MKNAFDKKVHSHKFHEGDLVLKKMSHAVKDNRGKWAPNYKGPFIVKKDFSGGALVLTNMDGEELPSPVNSDVVKRYYA

SEQ ID NO: 169101 - protein, 399 aa, Glycine max
  Coding DNA Sequence Number=SeqID_52323
  Gene Ontology: Mol. function=3-phosphoshikimate 1-carboxyvinyltransfer ase activity; Cellular component=chloroplast; Biological process =aromatic amino acid family biosynthetic process, shikimate pathway
  Homolog annotation: Hit_ID=Q1T6A9; Match level="QueryCoverage=92%, HitCoverage=70%, E-value=1e-132, Identity=67%"; Hit description=3 -phosphoshikimate 1-carboxyvinyltransferase
  Pfam annotation: Domain name=EPSP_synthase; Domain location=88-398; Score=250.7; E_value=3e-72; Accession=PF00275.10; Description=EPSP synthase (3-phosphoshikimate 1-carboxyvinyltransferase)
  Subcellular localization annotation: CTP_CleavageSite=71; ConfidenceScore=5.80e-01
MAQVSRVHNLAQSTQIFGHSSNSNKLKSVNSVSLRPRLWGASKSRIPMHKNGSFMGNFNVGKGNSGVFKVSASVAAAEKPSTSPEIVLEPIKDFSGTITLPGSKSLSNRILLLAALSEGTTVVDNLLYSEDIHYMLGALRTLGLRVEDDKTTKQAIVEGCGGLFPTSKESKDEINLFLGNAGTAMRPLTAAVVAAGGNASYVLDGVPRMRERPIGDLVAGLKQLGADVDCFLGTNCPPVRVNGKGGLPGGKVKLSGSVSSQYLTALLMAAPLALGDVEIEIVDKLISVPYVEMTLKLMERFGVSVEHSGNWDRFLVHGGQKSPGNAFVEGDASSASYLLAGAAITGGTITVNGCGTSSLQNQILKKDLQEQHQDVSCAKQAHLQKSVYKHLYTCKKFLN

SEQ ID NO: 169102 - protein, 81 aa, Glycine max
  Coding DNA Sequence Number=SeqID_52324
  Gene Ontology: Mol. function=3-phosphoshikimate 1-carboxyvinyltransfer ase activity; Cellular component=chloroplast; Biological process =aromatic amino acid family biosynthetic process, shikimate pathway
  Homolog annotation: Hit_ID=Q1T6A9; Match level="QueryCoverage=73%, HitCoverage=11%, E-value=1e-24, Identity=91%"; Hit description=3 -phosphoshikimate 1-carboxyvinyltransferase
MGAKVTWSENSVTVSGPPRDFSGRKVLRGIDVNMNKMPDVAMTLAVVALFANGPTAIRDVVQPGLWAGPVLTHDCLLQQTG

SEQ ID NO: 169103 - protein, 186 aa, Glycine max
  Coding DNA Sequence Number=SeqID_52325
MILRGQDIYSSQDEATTSPSSNEREEAKWEESSEEIYPQEEGQPLIVKEECKEVMVSSKMLAKKESHFTIKTNIKETSPLRQPPHCLLCKRTLVSIATLLGLEFIPQVKELLDEDLVRKSLNPCALLVSKIAPLIELVRNHVPSWEDAQEMGVEEKSPEFQEPRDLRSNPFQGGGNDAILPRKGIG

SEQ ID NO: 169104 - protein, 86 aa, Glycine max
  Coding DNA Sequence Number=SeqID_52326
MEAYLDEEQKSRSSWKNGRSALEGGRSSSSRWRSTTTSWKNEEGGRKGRRRKSLAEGEDARRKERRRRVSREEGKKEEEETFFKKK

SEQ ID NO: 169105 - protein, 73 aa, Glycine max
  Coding DNA Sequence Number=SeqID_52327
MEGYLTKAEAKTSKKVVQRLIMEVKAKEDLAKLEPNPRHVSYLQFEDYFNKLEGNTLERKISPTLNTEDAYVS

SEQ ID NO: 169106 - protein, 191 aa, Glycine max
  Coding DNA Sequence Number=SeqID_52328
  Homolog annotation: Hit_ID=Q00M75; Match level="QueryCoverage=21%, HitCoverage=6%, E-value=1e-08, Identity=78%"; Hit description=PPR -repeat containing protein
  Subcellular localization annotation: CTP_CleavageSite=40; ConfidenceScore=5.09e-01
MSKYIRIMSGSNTYETNASMPNCDHTPTHQQQNTSPLPPRSNNGNTIKTTTAVTSKEANLGDNNSNSETTARTLPSKPTAATHLQSPQWQRRCCSLEMVGFSVFMFGSSGDVAGNGGFNIQQPKLKYSLREGRWRASPGAAVKLCLGDLLVMGSNPETAFLHMQSKLTEANQTMSRRIDHHKEGSLSKSNN

SEQ ID NO: 169107 - protein, 320 aa, Glycine max
  Coding DNA Sequence Number=SeqID_52329
  Gene Ontology: Mol. function=methyltransferase activity; Cellular component=cytosol; Biological process=methylation
  Homolog annotation: Hit_ID=Q2HS71; Match level="QueryCoverage=76%, HitCoverage=25%, E-value=1e-110, Identity=79%"; Hit description =Methyltransferase small domain, putative
  Pfam annotation: Domain name=MTS; Domain location=117-292; Score= -41.0; E_value=8.9e-06; Accession=PF05175.4; Description =Methyltransferase small domain
MDLERVIAVALPPLAWKEESLPSSLPLRESPCGGFAVAVVVAQVGFFRCHCCGGFDSVAVVGSWGQRREQFRAGVNKGHQYITAKVNNMASHKELPRTAQIHLVSSHQEVYEPCDDSFALVDALLADRNNLLEHHPTLCMEIGCGSGYVITSLALILGQEVCGINYIATDINPHAVRVTHETLEAHGVGAELIVTDIASGLEDRLAGLVDVMVVNPPYVPTPEDEVGVEGITSSWAGGENGRSVINKILPVADRLLSEKGWLYMVTLTENNPSEICHQMRKKGYASKIVVQRSTEEESLHIIKFWRDFDTEANETDQSAS

SEQ ID NO: 169108 - protein, 594 aa, Glycine max
  Coding DNA Sequence Number=SeqID_52330
  Gene Ontology: Mol. function=methyltransferase activity; Cellular component=nucleus; Biological process=protein kinase C activation
  Homolog annotation: Hit_ID=Q2HS71; Match level="QueryCoverage=92%, HitCoverage=56%, E-value=0.0, Identity=81%"; Hit description =Methyltransferase small domain, putative
  Pfam annotation: Domain name=PPR; Domain location=134-168; Score =50.3; E_value=6.4e-12; Accession=PF01535.11; Description=PPR repeat
  Pfam annotation: Domain name=PPR; Domain location=169-203; Score=2.4; E_value=3.8; Accession=PF01535.11; Description=PPR repeat
  Pfam annotation: Domain name=PPR; Domain location=266-300; Score =37.8; E_value=3.7e-08; Accession=PF01535.11; Description=PPR repeat
  Pfam annotation: Domain name=PPR; Domain location=301-335; Score=7.5; E_value=0.96; Accession=PF01535.11; Description=PPR repeat
  Pfam annotation: Domain name=PPR; Domain location=32-66; Score=22.4; E_value=0.0016; Accession=PF01535.11; Description=PPR repeat
  Pfam annotation: Domain name=PPR; Domain location=367-401; Score =40.1; E_value=7.8e-09; Accession=PF01535.11; Description=PPR repeat
  Pfam annotation: Domain name=PPR; Domain location=402-436; Score =16.3; E_value=0.087; Accession=PF01535.11; Description=PPR repeat
  Pfam annotation: Domain name=PPR; Domain location=438-472; Score=6.3; E_value=1.4; Accession=PF01535.11; Description=PPR repeat
  Pfam annotation: Domain name=PPR; Domain location=504-538; Score =12.1; E_value=0.28; Accession=PF01535.11; Description=PPR repeat
  Pfam annotation: Domain name=TPR_4; Domain location=335-360; Score =6.5; E_value=6.2; Accession=PF07721.5; Description=Tetratricopeptide repeat
  Pfam annotation: Domain name=TPR_4; Domain location=437-462; Score =10.0; E_value=2.4; Accession=PF07721.5; Description=Tetratricopeptide repeat
  Pfam module annotation: Pfam domain module=PPR::PPR::PPR::PPR::PPR::PP R::PPR::PPR::PPR::TPR_4::TPR_4; Domain location=134-168::169-203::266- 300::301-335::32-66::367-401::402-436::438-472::504-538::335-360::437- 462
MSRLVAFCALSESRALEYCTKILYWIHEPNVFSWNVTIRGYVESEDLEGAVLLYKRMLRCDVLKPDNHTYPLLLKACSCPSMNCVGFTVFGHVLRFGFEFDIFVHNASITMLLSYGELEAAYDVFNKGCVRDLVTWNAMITGCVRRGLANEAKKLYREMEAEKVKPNEITMIGIVSACSQLQDLNLGREFHHYVKEHGLELTIPLNNSLMDMYVKCGDLLAAQVLFDNTAHKTLVSWTTMVLGYARFGFLGVARELLYKIPEKSVVPWNAIISGCVQAKNSKDALALFNEMQIRKIDPDKVTMVNCLSACSQLGALDVGIWIHHYIERHNISLDVALGTALVDMYAKCGNIARALQVFQEIPQRNCLTWTAIICGLALHGNARDAISYFSKMIHSGIKPDEITFLGVLSACCHGGLVQEGRKYFSEMSSKYNIAPQLKHYSGMVDLLGRAGHLEEAEELIRNMPIEADAAVWGALFFACRVHGNVLIGERVALKLLEMDPQDSGIYVLLASLYSEAKMWKEARNARKIMKERGVEKTPGCSSIEINGIVHEFVARDVLHPQSEWIYECLVSLTKQLELIVFTHDIPADGDNLFS

SEQ ID NO: 169109 - protein, 95 aa, Glycine max
  Coding DNA Sequence Number=SeqID_52331
MAPKRSETVVIPRINTEEKAKNVFPLDSFIPRRWVDIENLEDKSLPIKGLFDRVGWTIFLGNFSSWHYGSGTVKGKKVVILPTTTVVASGCAEEV

SEQ ID NO: 169110 - protein, 59 aa, Glycine max
  Coding DNA Sequence Number=SeqID_52332
MVSEMSNEDGTPRSLSSGTASWWSMRQFLGLLSSQVPRMGSCSDGGGGGDAGGDPRLPP

SEQ ID NO: 169111 - protein, 75 aa, Glycine max
  Coding DNA Sequence Number=SeqID_52333
MGPADRETLEEVMLQLVIEAFLVEIVDNIIETNLGVIPIRLRPEAIDLAFKTTCSKETRHSSASHPSHQIVSLLM

SEQ ID NO: 169112 - protein, 102 aa, Glycine max
  Coding DNA Sequence Number=SeqID_52334
MVMPRLGSQDYVSNKYKFFAYKIMVGEKAKLDETFEKNAAFELEDGVLVYVKTLNEEEHKRKLEEDAMMEIDRELVQEAIVNESIQAQSAQEMKNAQMEELN

SEQ ID NO: 169113 - protein, 56 aa, Glycine max
  Coding DNA Sequence Number=SeqID_52335
MVEDARTTLGNQFVGLRTQWWRMHVGNQLMGLRAINSWGSGLNGGGCMNDNQFMGL

SEQ ID NO: 169114 - protein, 70 aa, Glycine max
  Coding DNA Sequence Number=SeqID_52336
MAGGLSICLTLKFSCSPTVIFSLSMAIAQFPQQTKETHFFYVRIPMFACTTYEDSFLLSTLRGTSKSHVP

SEQ ID NO: 169115 - protein, 123 aa, Glycine max
  Coding DNA Sequence Number=SeqID_52337
MAFSQPVLGAPAKLLGGLVVLDFKVWVFIEMDLSDYRQAIGGGLLGAPSIIVGAPNILTSSSPSGAVCFPWRFVCRALGGSSSALRTCNSILLFHRQGIQININFTIQSCSPTTGFPRNLKGH

SEQ ID NO: 169116 - protein, 77 aa, Glycine max
  Coding DNA Sequence Number=SeqID_52338
GIPQFAKVGRCVQSIQGILASVTSVEVKVLRVGGDCCGGWFVVEEIDMDDENGVNEHVDCSDVFNTSQVFATRDDAL

SEQ ID NO: 169117 - protein, 87 aa, Glycine max
  Coding DNA Sequence Number=SeqID_52339
MATIALVSRYGNMQQAGFVAALGVAFVDDWVFLVDTVGFQGSEVEGIERIKKEEEERRGNEAEALLKCNRYHSLHRSLFNVLRATVG

SEQ ID NO: 169118 - protein, 91 aa, Glycine max
  Coding DNA Sequence Number=SeqID_52340
  Gene Ontology: Mol. function=DNA binding; Biological process=DNA integration
  Homolog annotation: Hit_ID=Q1SIT1; Match level="QueryCoverage=67%, HitCoverage=17%, E-value=2e-15, Identity=58%"; Hit description =Integrase, catalytic region
MAFTFSGSTDEIEHKAYWAVKTCNFSIDQAGEERKLQLSELDDIHLEAYENSKFYKEKTKKFHDSLIANKDFVLRSKVNPQIRASRSMDTG

SEQ ID NO: 169119 - protein, 1135 aa, Glycine max
  Coding DNA Sequence Number=SeqID_52341
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=298-503; Score=1.9; E_value=0.0092; Accession=PF03372.13; Description =EndonucleaseExonucleasephosphatase family
  Pfam module annotation: Pfam domain module=Exo_endo_phos::RVT_1; Domain location=298-503::735-1002
MKTLHEAEEDIAWEIGTDIAPKYIGENMFLLLGLSDTRAELSTKESRYGSTPFHTLEKWNSNMKTGQRLIWVQVWVIGEPVEVDDDVEDLRRLDRARLLVKTSWRPLLQHAVNLHIAEKMHQVHIVEETRLDKHLCKCQARHNAGSSEEVESEDSNNGGEFPNILEAKDADHAKFDSDDDRSGGRTCTGHKQNQLLTNGPCDEPRDNNQVAQKVSASPNAPIAPDLEAKKGKVTASQTMVEADPGYENMERGRAHMDDELVTVDHPFCPQPHANIDPGGSAQFISTGPCVLYTGNKDSKIVYRNVATARDKDICEDYCGRDAGLSGPPIETKKQHIDIKMCQSIWGDPDVRWEVQPATNTAGGTWNNEDQKICIINIYAPCDTQNKRELWESLKQLKNLDPNRLWCMVGDFNSVRNAAERVGISQRRMDDTPINDFNEWLEDLEMVEPPRIGKKFTWFRPNGTAKSKLDRAFVSSEWLTKWPASSQLVLERNFFDHCLVLFKSKNVEWGPKPFRILDFWLKDKSFGKMIKECWTQTQQSGWGGFVLKEKIKCLKERMKTWNKEQFGDTFKRVQKIEVELNKLESESEDRQLTFQESMNRKKLQQELWTAGQAHESLMRQKARSRWIKKGDCNSRYFHLLINSHRRFNQRFQETMYSRPTLNGISFHTIGHQDNQMLVGSFSEEEIRKAVWDCDSEKSPGPDGLNFKFIKQFWQILKPDVLRFIDEFHANGVIPRGANASFITLIPKVSDPHCLNDFRPILLIGCVYKIVAKLLANRVKRVMPSIIDECQSAFIAGRHLLHSVVITNVVEEARRGKKLCMIFKVDLERAYDFVSWNFLSYMLRRLGFCNKWILWIEGCLKSASVSVLVNGSPTVEFVPQRGLRQGDPLAPLLINIVAEGLIGLMREAIKKQIYANFLVGEKYVPISILKYANDTIFFGEASMQNVKTIKSILRAFEMASGLKINYAKSCFGAMGQSEQWKMQAASYLNCRILPLPFTYLGIPIGANPRHSELIPNKVVEKLTQIQQRFLWGGGLDQKKIAWVKWDTICLPKDKGGPEIKDIRTFNRALLGKALDEGKPATNESIWWQDLMAMIHEQQMNTMLQTAIEWKAVSNFLSTAKSYSGYGKPYQNSLGMES

SEQ ID NO: 169120 - protein, 108 aa, Glycine max
  Coding DNA Sequence Number=SeqID_52342
  Gene Ontology: Mol. function=hydrolase activity, acting on ester bonds; Biological process=lipid metabolic process
  Homolog annotation: Hit_ID=Q1SQA1; Match level="QueryCoverage=78%, HitCoverage=22%, E-value=2e-27, Identity=76%"; Hit description =Lipolytic enzyme, G-D-S-L
MFLSQLRKCELTNCINSGFPIRKPSRRSTKEVNPIRQLISPSQRLELVVVPIINQRITKNEVAWNLWCTFNTTPQAKRKNNNYECQHAYCEIQSYHWSKKRCGLLGKE

SEQ ID NO: 169121 - protein, 93 aa, Glycine max
  Coding DNA Sequence Number=SeqID_52343
  Gene Ontology: Mol. function=O-sialoglycoprotein endopeptidase activity; Biological process=proteolysis
  Homolog annotation: Hit_ID=Q2HS64; Match level="QueryCoverage=78%, HitCoverage=19%, E-value=3e-26, Identity=72%"; Hit description =Glycoprotease family, putative
MDFRGSISGYLEITFSVEKETGVMIAWTGIEHFRMGRYDPPPPAEEPEDFLYDIRPRWPLGEEYAEGKSVARSLRTARIHPSLTSVIQASLQQ

SEQ ID NO: 169122 - protein, 527 aa, Glycine max
  Coding DNA Sequence Number=SeqID_52344
  Homolog annotation: Hit_ID=Q1RV36; Match level="QueryCoverage=32%, HitCoverage=88%, E-value=2e-65, Identity=72%"; Hit description =Ribosomal protein L19e
  Pfam annotation: Domain name=Ribosomal_L19e; Domain location=2-135; Score=254.9; E_value=1.6e-73; Accession=PF01280.10; Description =Ribosomal protein L19e
MVSLKLQKRLAASVLKCGRGKVWLDPNEVNEISMANSLQNIRKLVEDGFIIRKPTKIHSCLRARRMKEAKKKGRHSGYGKRKGTREARLPTKILWMRRMRVLRRLLRKYRESKKIDKHMYHDMCMKSIHKSKAEKAREKTLSDQFEAKRAKNKASRERKLARRKERLAQGPVDKTSTAPSAPVATAPQSTQAPKKFKKVPNRVVDKLVSLQRKFLWGGGPEQNKIAWIKWKTVCQPKEKGGLGLKDIKTFNLALIGKWKWNLFQHQGELRARVLDSKYGGWRSLDASSRVSHESVWWRDLKMTLLHSHQGQVLQNGTMWKVGCGDRIKFWEDKWLGTYKDIGWEWDFKWRRPLFDNEIDSTVSFLRDVEGKIIQQQGSDDWVWKADPSGYQAKFQSSPGGYLEIDANKKKLGEAAGADHGYVLPFLQKHGGGCSPLTHPLQQNPTYLVGILVLAEYQSAEKREGGFGKKFRRESVEGDASVERESNIVDAEKKRTESVPEALHSEDNYQFYQKEGYGHFHFSESPPN

SEQ ID NO: 169123 - protein, 273 aa, Glycine max
  Coding DNA Sequence Number=SeqID_52345
  Gene Ontology: Mol. function=O-sialoglycoprotein endopeptidase activity; Biological process=proteolysis
  Homolog annotation: Hit_ID=Q2HS64; Match level="QueryCoverage=45%, HitCoverage=42%, E-value=2e-48, Identity=66%"; Hit description =Glycoprotease family, putative
MELKIQDGNAGGHNVLVLARDLGQYIQLGTTIDNAIGEAYDKTAKWLGLDLRRSGGPAIEKLAMEGNAESVNDAKIPISSASNEDRLSRADIAASFQERCERAILWAFKMEPSIRHLVVSGGVASNQYVRARLHYGQGFWIQSMEDGGVSMQQQATITSLYGGLTWKVGNGAKIKFWEDVWSYGDTPLLAKYPRLYLISDQQNKNIQEMGQQTDNGSTKKDEWIWKPEPSGQYSVRTAYNMLKGVDVEEDNMWVIKGEATNKDKLEEEKGDNQ

SEQ ID NO: 169124 - protein, 76 aa, Glycine max
  Coding DNA Sequence Number=SeqID_52346
MAKIQGPKEGKPILIYTKKNGLNLGPMGSGVYPEVHENPMAFFSSSSTILLKPLAHGSELNANAQPIEDDTYVEPN

SEQ ID NO: 169125 - protein, 67 aa, Glycine max
  Coding DNA Sequence Number=SeqID_52347
MAHTTLKRTTKLASMRGVKGGKDVAGERRWGYEGAVGEVVRVACSTMSHKGDEGSTRVFQLQEQRGN

SEQ ID NO: 169126 - protein, 88 aa, Glycine max
  Coding DNA Sequence Number=SeqID_52348
MVHTKRRNYICFDDEWISEENAKEKIVVLPFEEIHVGSVKYANVKIGNLSHTNLDGIDNFNLEASEEEFDEAVRKKRTIVMKILNLND

SEQ ID NO: 169127 - protein, 130 aa, Glycine max
  Coding DNA Sequence Number=SeqID_52349
  Gene Ontology: Mol. function=hydrolase activity, acting on carbon -nitrogen (but not peptide) bonds, in linear amidines; Cellular component=mitochondrion; Biological process=arginine metabolic process
  Homolog annotation: Hit_ID=P46637; Match level="QueryCoverage=87%, HitCoverage=33%, E-value=1e-51, Identity=85%"; Hit description =Arginase
  Pfam annotation: Domain name=Arginase; Domain location=7-130; Score= -90.1; E_value=8.5e-05; Accession=PF00491.12; Description=Arginase family
MDFCDVACSPVSSKELQDARVLTDVGDVPIQEIRDCGVDDHRLMNVIGESVKLVMEEDPLRPLVLGGDHSISFPVIRAVSEKHGGPVDVLHLDAHPDNYDAFEGNIYSHASSFARVMEGDYVRRLLQAIL

SEQ ID NO: 169128 - protein, 246 aa, Glycine max
  Coding DNA Sequence Number=SeqID_52350
  Gene Ontology: Mol. function=ATPase activity, coupled to transmembrane movement of substances; Cellular component=integral to membrane; Biological process=transport
  Homolog annotation: Hit_ID=Q8LKU6; Match level="QueryCoverage=72%, HitCoverage=38%, E-value=2e-34, Identity=38%"; Hit description =Putative ABC-transporter-like protein
MSSSFGELLELSQKGDNSNTDMLVGDIYGGMDYSKGMWVVAWADMGDPNASMSSTVLALVVVPILSIVVHKFGRYLRELAHKIQIAATIASSIAEKVVGLFFGALNVAPTLSIIIVGSFDFVVGSSISGMPGFDQDGEVELDDVWFAYPSHPSHLVLKGITLKLHPRSKVALVGPSGGGKVYSSFHNVHINVLGLKRNRKLSKSTIANLIERFYDPTKGKILLNEVPLDFSYFYNPKNENSHKAMM

SEQ ID NO: 169129 - protein, 92 aa, Glycine max
  Coding DNA Sequence Number=SeqID_52351
  Subcellular localization annotation: CTP_CleavageSite=74; ConfidenceScore=5.50e-01
MKASIAFLIFTICFHASANIGSSQGDGNSSQLNGSTSQSADSCGSNLNLSVPLLFDTTNLNCLPVWNAQGYILRDNACSSSHPYKLDNDVAV

SEQ ID NO: 169130 - protein, 127 aa, Glycine max
  Coding DNA Sequence Number=SeqID_52352
MGEIEEVQEHMKADMEAMKEQMTIMMSMKKIMENKHAFPPSGLPPNYNRPNVVHTPDENVNNSTSILIEGQQLQSDHAHVSQPMGETHAIPHHNLADFKPGLRYATKGQAVGGVPLQKTLEGPQFCP

SEQ ID NO: 169131 - protein, 221 aa, Glycine max
  Coding DNA Sequence Number=SeqID_52353
MPLRDRIASLAGYATIEDDIWWDNGQNISPKYISGDMVLLLGITEEKAKTMLNGIPIVAWDTLYIKQILFGIGEVVDVDDKVEERSRLDVARILIKTTWKPWIQHKVNVRIHGETFLVHVAEESGPPSDMWHTKRQYAYSSSEEIISEEDDDEGEEKAWRNIPKVADTMEDKVEDRRAIDEGTGAEARRLDSELSEAALMKDGSDSGGRSERGSAQFHTGG

SEQ ID NO: 169132 - protein, 43 aa, Glycine max
  Coding DNA Sequence Number=SeqID_52354
MDGTSTLPTPASPTLLCTPPGSSQKKICLFVCYASSFQFPSHP

SEQ ID NO: 169133 - protein, 115 aa, Glycine max
  Coding DNA Sequence Number=SeqID_52355
  Homolog annotation: Hit_ID=Q1SP02; Match level="QueryCoverage=66%, HitCoverage=16%, E-value=5e-10, Identity=41%"; Hit description=IMP dehydrogenase/GMP reductase
MAAKVVVTLGWAINIQKDMVALPPLVKWHMGGKPDKTKADAMNITKLLQHPLQKIQPHVRPTHDEAREKSLLGEKFNTFVVLIRTPDNNIHLEVIQLLPNRMSLPSASCWLPSAG

SEQ ID NO: 169134 - protein, 103 aa, Glycine max
  Coding DNA Sequence Number=SeqID_52356
  Gene Ontology: Mol. function=protein-tyrosine kinase activity; Cellular component=integral to membrane; Biological process=protein amino acid phosphorylation
  Homolog annotation: Hit_ID=Q9AWX9; Match level="QueryCoverage=78%, HitCoverage=21%, E-value=3e-24, Identity=55%"; Hit description=Extra sporogenous cells-like
  Pfam annotation: Domain name=LRR_1; Domain location=19-41; Score=7.2; E_value=13; Accession=PF00560.23; Description=Leucine Rich Repeat
  Pfam annotation: Domain name=LRR_1; Domain location=43-65; Score=8.4; E_value=7.5; Accession=PF00560.23; Description=Leucine Rich Repeat
  Pfam annotation: Domain name=LRR_1; Domain location=67-87; Score=8.0; E_value=9.3; Accession=PF00560.23; Description=Leucine Rich Repeat
  Pfam module annotation: Pfam domain module=LRR_1::LRR_1::LRR_1; Domain location=19-41::43-65::67-87
LCYKQLTGRIPTQLGDLKKLSVLALQSNLLGGAIPASLGDLGKLMRLDLKSNNIFGFIPIKLADLPSLQVLDVHNNTLSGNVHPGKHDATPLILFYCYYPFLH

SEQ ID NO: 169135 - protein, 190 aa, Glycine max
  Coding DNA Sequence Number=SeqID_52357
  Gene Ontology: Mol. function=nucleic acid binding
  Homolog annotation: Hit_ID=Q1T555; Match level="QueryCoverage=56%, HitCoverage=82%, E-value=4e-09, Identity=33%"; Hit description=RNA -binding region RNP-1
  Pfam annotation: Domain name=RRM_1; Domain location=58-128; Score =39.5; E_value=1.2e-08; Accession=PF00076.12; Description=RNA recognition motif. (a.k.a. RRM, R
MTTIAGIKVRVRNERDRRESARVRATRGSSLIIGRKTIGNHQTYTRENWRDHKDVTTFYFTRFPEGATTEDLWLHFKQSGDVREVFIPERRNSQGRRYGFVRFKGVRDTQQLQKKLDNMVFRGLKINVNVPKYGRAKSGESSTTKGVRTEVTYPQKGKRVVYLSKIPGDKEGVQRRSYAEVVSRHIPRPK

SEQ ID NO: 169136 - protein, 340 aa, Glycine max
  Coding DNA Sequence Number=SeqID_52358
  Gene Ontology: Mol. function=methyltransferase activity; Cellular component=intracellular; Biological process=protein kinase C activation
  Homolog annotation: Hit_ID=Q2HS71; Match level="QueryCoverage=97%, HitCoverage=45%, E-value=1e-105, Identity=44%"; Hit description =Methyltransferase small domain, putative
  Pfam annotation: Domain name=PPR; Domain location=181-215; Score =47.7; E_value=3.8e-11; Accession=PF01535.11; Description=PPR repeat
  Pfam annotation: Domain name=PPR; Domain location=216-250; Score=4.6; E_value=2.1; Accession=PF01535.11; Description=PPR repeat
  Pfam module annotation: Pfam domain module=PPR::PPR; Domain location =181-215::216-250
MDMRGFEHLPSVLCCLHARSLPPYVKAINWNTSHSFVQNNPLLSLLERCKSLDQLKQIQAQTVLTGLVNDGFAMSCLVAFYALLESGYVESEDLEGTGLLYKRMLRCGVLKPDNLTYPLLIKDCSCPSMNCVGFTVLGHVLRLGFEFDIFVHNASITMLLLYVELEAAYDVFNKGCVRDLVTWNAMITGCVRRGLANEAKRLYREMEAEKVKPNQITMIGIVSACSQVQDLNLGREFHDYLKEHGLELTIPLNNSLIDMHLKCGDLLAAWVLFANKAYQTLVSWATMVLGYARFCFWVLLPSFCIEFQKRVLCLGMQSLVVVSKLRMIRKIDLDNATSTV

SEQ ID NO: 169137 - protein, 75 aa, Glycine max
  Coding DNA Sequence Number=SeqID_52359
MGKHVTILIPHPDTLKCSLRIVILDLLMWWWCDVNDGFGVKGDDGASREERFVRKLVKRSPYNFKTGEKWSSLFR

SEQ ID NO: 169138 - protein, 76 aa, Glycine max
  Coding DNA Sequence Number=SeqID_52360
MAVPDLILGHTGTGQHAQNTVSVLTVHLMVLRMCFLGNNPIKHMIWKLKDSRLNLLHWPGRQMCQTWNCRLLGSKL

SEQ ID NO: 169139 - protein, 671 aa, Glycine max
  Coding DNA Sequence Number=SeqID_52361
  Pfam annotation: Domain name=RRM_1; Domain location=46-114; Score =29.0; E_value=1.7e-05; Accession=PF00076.12; Description=RNA recognition motif. (a.k.a. RRM, R
MSALFRKTQNNISYNTYMHIWDIVFEFLLLKERVNIPPIEGNVREITRFPEDVTEKDLWVQFKRWGDVREVFISKKRNKGGRRYGFVRFSGVTDVHRLERQLDNLIVGGLKLYVNVPKYERGKGRDAVRRPEPKTQTEGDHQGKTTPYQNHSRYREPQMSYAKALLTNPTTSTPRRYTENASPRSEGSQSSVHLEIPTGTKQWYVEAWMGRIKKLANLETAEDDIAWELGTDVVPKYLGDDLFLLLGLSDNRAEEVVEEEARHGTTPFHTLEKWNPKLRAGHRLTSVLCWGIPLNAWETANIRKIVAPIGEFMEVDDDADEMRRLDRARVLIRTSWKPILQHTVNLHIAGELHKVHIVEETGLINGRCSCKLRSICGSSDAIASDDSVIASPRSDAIEVLDSTLTPRDIDGNTTARGTNTDNRENPLLPSGTPHDDDPADKTPARWTICKNSKADRPIPREGNEKPTGRLLTSKMETTFANEETPSTHFKPRDESNGDQNAARSSRDTEIVDPMHGQGTQNEWGVGNLQMASSKATRVPLAADRGQTIDYKETMPTLVTESKKEACDISDAICGPLLVGLNNPILVEPDTQQNINSAANKPETLGTRKVYLRNKGCRKQKALISVNVCQTDESPETNNLKQTTVDIATNSLSNKGAESPSNKAMKSTACQF

SEQ ID NO: 169140 - protein, 54 aa, Glycine max
  Coding DNA Sequence Number=SeqID_52362
MGSLVLIKLVPATRFGLGLAGGCGFPSQPIDPTVQTRIACRLCGASSKSHSHGF

SEQ ID NO: 169141 - protein, 65 aa, Glycine max
  Coding DNA Sequence Number=SeqID_52363
MSFGSWQQPWPLFRISLCHRRPGRKKMDKVEDEKNIGFMNKNESESERKTFQVGSRLTFTFLTSS

SEQ ID NO: 169142 - protein, 40 aa, Glycine max
  Coding DNA Sequence Number=SeqID_52364
MAGIELNKNFVKLVSWYDNEWGIQLVLIPSLSSVLQLTCH

SEQ ID NO: 169143 - protein, 82 aa, Glycine max
  Coding DNA Sequence Number=SeqID_52365
MLQCLRYFSQLKHDIKIPNCENARRWAVNVVLKFHDDPTVNESEIIIFLRQVRWPTGKREDFGRREKKRNCEERRLRNQSEN

SEQ ID NO: 169144 - protein, 404 aa, Glycine max
  Coding DNA Sequence Number=SeqID_52366
  Homolog annotation: Hit_ID=Q1SYN8; Match level="QueryCoverage=23%, HitCoverage=59%, E-value=5e-10, Identity=37%"; Hit description=RNA -directed DNA polymerase (EC 2.7.7.49) (Clone AmLi2)-garden snapdragon-related
MVDEEMKNLPRLDYAKVLARTSRLGVIPERKLVITTQDNDKDGDPVTKTGTSVKVVSNFESEVKEASQCLLHHDEGAKATQGVGMDEVAKDSAERVGQIIEDGVKGVGINLDNEITEDQHNRGSMGQTLEGQNDKGRLTTEAVGNKRKRELKNKEGRIIIKERHYPSSKEKVDASSNNSGIQARLKRRTHGAKGPGEKREYLMKILSQNVRGLGEKFMWRAIRECLIQEECEWRESPAINLAGGLLCIWSKELMKVTMTFIGKGYMGVQRVWTEVMEERKDNYNVPIGGRDMGMFNEFINDMEVDNVPLDGDKSPDLDGLNFNFVKNCWDTLKPEDDPQGLNEFRPIPLIGIMLDNVLVANKMVNDAECRKKPCLVFKVDFEKSCLETISISILVNGNPMEEFN

SEQ ID NO: 169145 - protein, 245 aa, Glycine max
  Coding DNA Sequence Number=SeqID_52367
  Homolog annotation: Hit_ID=Q1T6B2; Match level="QueryCoverage=97%, HitCoverage=30%, E-value=1e-119, Identity=90%"; Hit description =Exocyst complex component Sec6
MESDVNFEDTCKGFLEVAKEAVHQTVSVIFEDPGVQELLVKLYQKEWSEGQVTEYLVATFGDYFGDVKILLRKTKFQLSIYSRYIEERSFRRFVEACLEETVVVYVDRLLTQKNYIKEETIERMRLDEEVIMDFFREHISVSKVENRVSVLSDLRELASAESLDTFTLIYTNILEHQPDCPPEVVEKLVGLREGIPRKDAKEVIQECKEIYENSLVDGRPPKAGFVFRRVKCLTATKGGLWRKLT

SEQ ID NO: 169146 - protein, 51 aa, Glycine max
  Coding DNA Sequence Number=SeqID_52368
RLRGFGRIDRTSCSQGASLELNHPGCLFSEDDSFAEGHDYVNQPQGCAEMA

SEQ ID NO: 169147 - protein, 250 aa, Glycine max
  Coding DNA Sequence Number=SeqID_52369
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=4e-31, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPLEDYTSSPSEDNMSRPSEGCTPSPLEDYTGLYALALVGLHALTFRGLHVLAFRGLHALTFRGLYILAFRGQHVPAFRRLHAFTFRGLHVLAIRGLHALAIGGLHVLAIRGVHVLAIRGLHAPAIRELHVLAIRGLHALTFRGLHVLAFRGLHVLANRGLHVLAFRGLHTLAFRGLHALTFRGLRALTFRGLHVLANRGLHVLTFRGLHVLAIRGLHVLTTRGLHVLKGLHVVRSSGGLNKLLLDLY

SEQ ID NO: 169148 - protein, 219 aa, Glycine max
  Coding DNA Sequence Number=SeqID_52370
  Gene Ontology: Mol. function=helicase activity; Biological process =viral genome replication
  Homolog annotation: Hit_ID=Q1SN45; Match level="QueryCoverage=99%, HitCoverage=12%, E-value=5e-56, Identity=49%"; Hit description=AAA ATPase
MKNGIELDNRFVVPYNPQLLLKYKTHLNVEWCNQSTSIKYLLKYINKGSDRITAAPGNHHNSNGDNTQVQDEIKQYLDYRYVSPPEACWKIFAFPMHVRSPAVERLYFHLENQQHVYWTDDQQIGEVLSKNTIKESMFTALMHSNKIYSYGRDITYHQYISRFVYVARKRCWQPRKQGNTIGRLIWVPPSVGELFYLRMMLFTAKGAQSYSDIRTINGV

SEQ ID NO: 169149 - protein, 59 aa, Glycine max
  Coding DNA Sequence Number=SeqID_52371
MTTLCKSKGRKSEHFHKDYLKCKSWFEKKSELNARRFLTIQTISPNEKFIFMGNKVKLQ

SEQ ID NO: 169150 - protein, 115 aa, Glycine max
  Coding DNA Sequence Number=SeqID_52372
MEAMKDQMTSMMEAMMSIRRMMEDNVAAIATTSAATEVDPTHLSVINQTSHPAPYMVGQGGEVLGSMGGPHMVQSKNSFPPYGLPPKYTPPNAVHVPSENANHSILVLFESQQPQ

SEQ ID NO: 169151 - protein, 411 aa, Glycine max
  Coding DNA Sequence Number=SeqID_52373
  Homolog annotation: Hit_ID=Q1S0F5; Match level="QueryCoverage=31%, HitCoverage=24%, E-value=5e-16, Identity=36%"; Hit description=IMP dehydrogenase/GMP reductase
MHHIYLVIFVTGIQKVRIAFLITCIGHYGNACEQTMIRNALWGVKVLFIRIFILANIGSNQAPSFKKRFYHVKVKSLELASLRELGQRMDQVLRQAFRKAYRKIWDLAMIEVSIEAIASLAQYYDQSLRCFMFGDFQLSKESPIDGVLADAYDTFDLRCEKSSARIVCCMPTHYVWLVSHVLHHEGRPVCPLQGHHMCAEKGKANWNELLAGMLGASVSWFPRWKEGGAGVLCSCEGFPNIPLMGTRGGINYNPMLAIRQLGYPMRGAPSEETIVPFVARGFIEGNAKILQRICKAWSIVERKDKELRGSSNDVIGGYHKWLKARTQGVTWLSKLKDPSGKEAEVLKENEEVQALKVELERTSVVKEKLKTIVTRVQKECDKLRDVNMTMDEALEWETKRARKEEWGRNKF

SEQ ID NO: 169152 - protein, 53 aa, Glycine max
  Coding DNA Sequence Number=SeqID_52374
MGSWICDERREESWFDNWKLGDGRSSLQKEDLVGDVGLWKDGSWCWRLEWTRQ

SEQ ID NO: 169153 - protein, 370 aa, Glycine max
  Coding DNA Sequence Number=SeqID_52375
MFRTEHKTYAEVTANNNPMVVGQRRQPRPTYSGQTQSQSTIQLQVDWGKKEWLKEAWVGRLEKANDFERVEDEITWDLGLNVVPKYIGNDMVLILGLSDSKTRKLQHLFHSLEKWNPNMKPGYRVIWAQCLGVPLQVWDTDNIRKIVAAVGDLIDVDDDFEELTRLDRARVLIRTPWRPLLQHTVVATIDGAEHHIAIVEEGAVNGSTQNRRANSESIMSEDVQSEDIDIDSVGVAPSINLGFFNLLKGTAGEGGDGGEENALYGPLTESPFLVKSSTDIVQQKVEIIRRPQQRTRPEKPQQPSAEMTEDTQKKEVEGSRRKMSGTESAEEEMSVGSDRGYETDVLEAVNGNIKLNKKEDVEDFNQITFF

SEQ ID NO: 169154 - protein, 523 aa, Glycine max
  Coding DNA Sequence Number=SeqID_52376
  Homolog annotation: Hit_ID=Q1RVN3; Match level="QueryCoverage=32%, HitCoverage=25%, E-value=9e-11, Identity=26%"; Hit description =Nucleotide-binding, alpha-beta plait
MGNVVESIIIQTKKEKTKWLDNVWVGRLENKGMFERVEEEMQGMFGMDVKPAYWGEDMVILHEMDDDTADKINQQELGNGGTPFSSIQKWTPELTSSYRLTWLLIWGVPLEAWETEHFATIVETCGELVELDAATEDKVRMDIARVLVRTKEKPFIALSVNVVVDGIRHCLEIHEDMASGWRRTARFEPEEVFPPSPFSTDMEVSDVEPNILVPRGVSPDRRSGNYLGDFPTQWFSPWYGGNGLETPGPWFPSVAETRWHETVHGPVKLTPRREDQQHCNGHFPMDLHGKGTPDPKLSCPNQNQTPFAEIVAAEKVKDVSEVGSIHRALEEYPVAMNSEEYPVVNHDSKLPGLTERDNSSQGLEGDGVKKILGLENSGPGTNGGKTSSVFKVYRRKNECGTAKSTAQLNLNPVFNKTGEVGESEKLGTVSNTKHNNEGGISRALDTAPLTPTQERPSHSPISPSSFNNDYYGVEDDAHWEIARDLGLSFAENTTNMVKKKREVDSSCNTSVVAVEMGKHHHDA

SEQ ID NO: 169155 - protein, 232 aa, Glycine max
  Coding DNA Sequence Number=SeqID_52377
  Homolog annotation: Hit_ID=Q1T6B2; Match level="QueryCoverage=55%, HitCoverage=17%, E-value=2e-62, Identity=94%"; Hit description =Exocyst complex component Sec6
MIDIRKVSRRDLRISYKAIESKCGDRWLNLLSPEVAPEFAEAMRMDQKVLKPCREDIREKKERKGICIIDVEGNTKPLRSLTRVANDAQLSTMVAEQVEQSQAGLKSLSFSEKTINQLRENFVSIENLCQECQTLIDNHDQIKILSNARNNLNTTLKDVEGMMSISDEAAEARDSLSDDKEIVNTYERLTALDGKRRFALAAAGSHKEEIGRLRSVSSLVHCHIHWLGEQES

SEQ ID NO: 169156 - protein, 194 aa, Glycine max
  Coding DNA Sequence Number=SeqID_52378
  Homolog annotation: Hit_ID=Q1T6B2; Match level="QueryCoverage=83%, HitCoverage=21%, E-value=1e-71, Identity=83%"; Hit description =Exocyst complex component Sec6
MLGKLFVCACPQTLVRAVRVVEMQEILDQQIAEEAAEAEGDGAMASVANPRNNGIKSTSSMASSKNLMQQKLKVQGKGYKDKCYEQIRKTVEGRFNKLLNELVFEDLKAALEAARAIGEELGDVYDYVAPCFPPRYEIFQLMVNLYTERFIQMLRLLSDRANELTNIEILKLEVLNNLAVTNRNRLSLYSLYSP

SEQ ID NO: 169157 - protein, 68 aa, Glycine max
  Coding DNA Sequence Number=SeqID_52379
MAFECGTKSIDVQNTLHNGILRGHRNIEDRVNVEDGHMELITMLIQEAHPLVAEKYASNSSMYFVRQG

SEQ ID NO: 169158 - protein, 332 aa, Glycine max
  Coding DNA Sequence Number=SeqID_52380
  Gene Ontology: Mol. function=protein-tyrosine kinase activity; Cellular component=integral to membrane; Biological process=protein amino acid phosphorylation
  Homolog annotation: Hit_ID=Q1SSI2; Match level="QueryCoverage=95%, HitCoverage=41%, E-value=1e-100, Identity=54%"; Hit description =Tyrosine protein kinase, active site
  Pfam annotation: Domain name=Pkinase; Domain location=43-304; Score =101.3; E_value=2.9e-27; Accession=PF00069.15; Description=Protein kinase domain
  Pfam annotation: Domain name=Pkinase_Tyr; Domain location=43-302; Score=75.6; E_value=1.6e-19; Accession=PF07714.7; Description =Protein tyrosine kinase
  Pfam module annotation: Pfam domain module=Pkinase::Pkinase_Tyr; Domain location=43-304::43-302
MFSAPPYNEFGNEERRKNGDMLSIWNHDGKISFEDIIKATKDFDIRYCIGTGAYGNVYKTQLPSGRIVALKELHKSESENPCFYKSFSNEAKILTEVRHHNIIRLYGFCLHNKCMFLVYEYMERGSLFYNLSIDMEAQELNWSKRINIVKGIAYGLAHMHHDCTPPIVHRDISSNNILLNSELQAFVSDFGATRLLDYYSSNQTLPAELAYTLTVTTKCDVFSFGVVVLETMMGRHPTELISSLSEPSIQNKKLKDILDSRIPLLFSRKDMQEIVLIVTLALTCLCPHPKSRPSMQEIANELLVSQPPFVWHFDGISIHQLMKQKIYIIGRS

SEQ ID NO: 169159 - protein, 46 aa, Glycine max
  Coding DNA Sequence Number=SeqID_52381
MAEDLGVEAKEAAVREVAKLLPLPELLQSISSIKADYISRQQVLLS

SEQ ID NO: 169160 - protein, 53 aa, Glycine max
  Coding DNA Sequence Number=SeqID_52382
MSTMKGHKKGREIRGKGVCKDKLRCVEEVLDESERKKMRGYEAQSTEEKQRLL

SEQ ID NO: 169161 - protein, 135 aa, Glycine max
  Coding DNA Sequence Number=SeqID_52383
  Gene Ontology: Mol. function=structural constituent of ribosome; Cellular component=ribonucleoprotein complex; Biological process =translation
  Homolog annotation: Hit_ID=Q6L4B2; Match level="QueryCoverage=79%, HitCoverage=65%, E-value=2e-49, Identity=89%"; Hit description=40S ribosomal protein S13, putative
  Pfam annotation: Domain name=Ribosomal_S13_N; Domain location=18-55; Score=18.2; E_value=7.3e-05; Accession=PF08069.3; Description =Ribosomal S13S15 N-terminal domain
  Pfam annotation: Domain name=Ribosomal_S15; Domain location=60-131; Score=58.3; E_value=2.5e-14; Accession=PF00312.12; Description =Ribosomal protein S15
  Pfam module annotation: Pfam domain module=Ribosomal_S13_N::Ribosomal_ S15; Domain location=18-55::60-131
MPNLRFYVAVVVVILWQSLILRKIEDKVEENICKFAKKGLTPSHIGVILHDSHGIAQVKSVTGSKILRILKAHRLAPEISKDLYHLIKKVVYIRKHLERNKKDKDSKFKLILVESRIHRLAHYYKKTKKLPPVWK

SEQ ID NO: 169162 - protein, 411 aa, Glycine max
  Coding DNA Sequence Number=SeqID_52384
  Gene Ontology: Mol. function=RNA-directed DNA polymerase activity; Cellular component=chromatin; Biological process=chromatin assembly or disassembly
  Pfam annotation: Domain name=rve; Domain location=139-295; Score =125.6; E_value=1.4e-34; Accession=PF00665.16; Description=Integrase core domain
MESPTQTHYFLFSMPHPDFMTKLKETLAASLEFRKQHDDIQARPNDFPDFSISDDFILYKGTIWVDLQNPFIPALLHEYHSTPLGGHFGVKKTLHHLRSNFQWTSMLKDIKSFIRSCTTCQQVKHVTRKSAGLLQPIPMPTGVWEDLSMDFVTHLPNSHGFTTVLVVVDRFSKGVHLGTLPTQFTAFKVANLFLEIVCKQHGFPRSIISDRDPIFISSFWRELFKLSGTSLRMSMAYHPQTNGQTEVMNRTLEQYLRSLVHQQPTEWQKFLALVEWSYNTSQHLGTSLTPYEVVFGKPPPSAPDYTKGSSRNDADMKHFADKSRRDIQYEVASSSWPLRVTNLTLPPDALDNQPILKPLAILDSSLDSSTTPPTRFVLGGIMIAPAVNKKRKTLWFYTKIDHEGTACAPNT

SEQ ID NO: 169163 - protein, 758 aa, Glycine max
  Coding DNA Sequence Number=SeqID_52385
  Gene Ontology: Mol. function=RNA-directed DNA polymerase activity; Cellular component=chromatin; Biological process=chromatin assembly or disassembly
  Pfam annotation: Domain name=RVP_2; Domain location=218-351; Score= -55.3; E_value=0.02; Accession=PF08284.2; Description=Retroviral aspartyl protease
  Pfam module annotation: Pfam domain module=RVP_2::RVT_1::Retrotrans _gag; Domain location=218-351::476-670::15-93
  Subcellular localization annotation: CTP_CleavageSite=49; ConfidenceScore=5.03e-01
MCDRISRMNPTPPPPPPLHQSQNNFITSWPTLLQAIETRFTPSFYDDPRGALFKLVQRGTFIDYLTEFERLANRIVGLSPPILLSFFIYGLNLEIRRKVQVFQPISVPQATALARLQEDKLNHRRKHSKPPFTTHQPSPLTIPNPTPSQPPRRKQPFVQRTQEDMALRREKGICYNCEEKWSPSHHCKGRLTTLELASSPDPTLNTTSANPHPPFDPTPLQPHISLHAMAGVPAINTFRLYGLINNTHITILVDNGSTHNFVQPRVAKFLNLCMQDTVPLRVMVGNDSVLDCRQLCPDTIILIQDHTFVVTLHVLPLTGADAVLGVEWLRTLGPIMTDYSMFTMQFTHSGQPVNLHADVQINENLASAHQVKRMLTTNATSGLFHLSLLPITKPKPVLGQPYPIPAINDLLLKYQSLFQQPSTLPPPRQHDHYINLIPFSNPVNVRPYRYPHFQKTEIEKQVTTLLDSGLIQPSRSPFSSLVLLVKKKDGTWRMCIDYHALNSITIRDRFLLPTIEELLDELGSVSWFLKLDLRQGFHQILMSDQDIPKTAFRTHHGHYEYRVMPFGLCNAPSTFQVAMNVVLSPFLRKFAAYYLKRSKCIFRQHQLDYLGHVVSGSEVQPDPSKGYAAIAAPLTKLLCKDAFKWVPESQSAFERLKGVVTTAPVLALPNFALPFAVEIDASSYAMGVVLHQQGHPIAFFNKPFCSRLQHASAYVRELHAIVATVCKWRQYLLGHKFTVYIDHRSLYELMSQIVQTPE

SEQ ID NO: 169164 - protein, 73 aa, Glycine max
  Coding DNA Sequence Number=SeqID_52386
MASSRQSVVVRRVPCSAMAAGQTKMIGARGKGEDALVRGQVILKEKKITYQDGALKGDMVVLVVTWMHGLHDY

SEQ ID NO: 169165 - protein, 484 aa, Glycine max
  Coding DNA Sequence Number=SeqID_52387
  Gene Ontology: Mol. function=binding; Cellular component=nucleus; Biological process=mRNA editing
  Homolog annotation: Hit_ID=Q9FJY7; Match level="QueryCoverage=75%, HitCoverage=64%, E-value=9e-55, Identity=32%"; Hit description =Selenium-binding protein-like
  Pfam annotation: Domain name=PPR; Domain location=125-159; Score =34.3; E_value=4.2e-07; Accession=PF01535.11; Description=PPR repeat
  Pfam annotation: Domain name=PPR; Domain location=168-202; Score =28.0; E_value=3.3e-05; Accession=PF01535.11; Description=PPR repeat
  Pfam annotation: Domain name=PPR; Domain location=204-238; Score =11.9; E_value=0.29; Accession=PF01535.11; Description=PPR repeat
  Pfam annotation: Domain name=PPR; Domain location=270-304; Score =12.2; E_value=0.27; Accession=PF01535.11; Description=PPR repeat
  Pfam annotation: Domain name=PPR; Domain location=50-84; Score=13.1; E_value=0.21; Accession=PF01535.11; Description=PPR repeat
  Pfam module annotation: Pfam domain module=PPR::PPR::PPR::PPR::PPR; Domain location=125-159::168-202::204-238::270-304::50-84
MITTGFIKNPSLAAKLVLSFISSPHEPLVEFARYVFYMHHAFHDFCNDPFFWNPLIRSHSHGREPRGALVLLCLMIEYGVHGLLWKMNFGSDVFLQNCLIVLFVRCGCVELARQVFDRMPDRDVVSYNSMIVGYVKCGAVERARELFDGMEERNLITWNSMIGGRDVNSCNSMMAGYVQNGCCIEALKIFYDMKRSTNVVPDDTTLLIVITAFAQLGHVEDGVVVRHYIMEKGYSLNGKLGVALIDMYSKCGSIENAISVFENVEQKCVDHWSAMIGGLDIHGMDEMTFEFLMEMGRISVIPDDITFIGVLSACRHAGMLKEGLIWHVEEAKKLIEEMPVEPNDVIWKTLLSACQNYENLSIGEPVVIFQDQGLFGYGLCIRNSHGAFVLAKTDCRMESPDAYEAEALSWIKELNYQHVIIELDSKHMVDSVHSNNLNLSDCGVVLQNSITPRDSTRTVVDRSDSFRLDSQERPDEYVGVGKRT

SEQ ID NO: 169166 - protein, 64 aa, Glycine max
  Coding DNA Sequence Number=SeqID_52388
MDTRLRVIGDPMNGVQRYTKMKFDGAVPFLIPMMRGGGHNPLFEDSPSECGGGAVTVRYGLISK

SEQ ID NO: 169167 - protein, 42 aa, Glycine max
  Coding DNA Sequence Number=SeqID_52389
RVLDLALSVLLSLNDTVLVYALSATASFVLSLCFTLSEILGW

SEQ ID NO: 169168 - protein, 76 aa, Glycine max
  Coding DNA Sequence Number=SeqID_52390
MSEYHPTIDVEEPQLFRRRKGKSFNMKGRFILQKRGENLLMEACLWGFYGGWIFELQLGPLMVIFHHGDAAEDKGK

SEQ ID NO: 169169 - protein, 729 aa, Glycine max
  Coding DNA Sequence Number=SeqID_52391
  Gene Ontology: Mol. function=DNA binding; Cellular component=beta -galactosidase complex; Biological process=DNA integration
  Subcellular localization annotation: CTP_CleavageSite=38; ConfidenceScore=5.07e-01
MKLTSQQYQALMSLLQQTSTNGSSSSTQTAHINQLGIVSKADSIIGSVLPIICNINNDSDLNTWFLDSGATDHIASSLDLYSECKQIPPITVSLPNGEQLIARYYGTVNISEFLVLTNVLYLPNFNFNLISISKLTNSMHYQLIFLANKCLIQEISTKKMIGTVDVESDSPSPPPLPPQSEPVPIDQPNTDHTSSTPTPRRTDRIRTRPTKYTDYQTSFTSATVTNHPGTKHPISFVISYNKLSSSYHSFILNISANSEPKSYNEACKHDSWVQAMHDEISALERNNTWVLTDLPQHKNVIGLEYLDTFSLVAKITTVRLLLALAASNNWYLKQLDVNNAFLHGDLHEEVYMVLPPGMKSAKPGQVCKLQRSLYGLKQASRQRYARLSTFLAHHGFKQSVADYSLFTLKRANSFTALLVYVDDIVLSGNDLSVISSITKLLDDTFKIKDLGNLKYFLGFEVARGTSGINICQRKYALDLLIDTDMLHCKPVSTPFDYCTRLHQASGSMLSDSQISSYRCLIGRLIYLTNTRPDITFVVQHLSQFIASPTTAHYTTLYRILRYIKAAPGLGLFFPSTSELQLKAFSDSDWAGFVDTRKSITGFSVYLGSSLISWKSKKQATVSRSSSKVEYRALASVTCEIQWLTYLLHDFGITHKPTLVFCDNKSALHIAANPVFHERTKHIEIDCHIVRDKLLSGLIKLLPIASQQQLADVYTKALAPGAFRFICSKL

SEQ ID NO: 169170 - protein, 120 aa, Glycine max
  Coding DNA Sequence Number=SeqID_52392
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RSR9; Match level="QueryCoverage=97%, HitCoverage=24%, E-value=1e-42, Identity=67%"; Hit description =Glycoside hydrolase, family 1
MTVLYNDKSQRTASNSSLQDVTRVKYLHGYIGSVLDALRDGSNIKGYFAWSFLDLFELLDGYKSSFGLYYVDRDDPELKRYPKLSAKWYNRFLKGRRTSIVGTIELEKDPSLVFVSQLFE

SEQ ID NO: 169171 - protein, 83 aa, Glycine max
  Coding DNA Sequence Number=SeqID_52393
  Homolog annotation: Hit_ID=Q9FT11; Match level="QueryCoverage=71%, HitCoverage=39%, E-value=2e-08, Identity=36%"; Hit description =Hypothetical protein homologue of SPH
  Pfam annotation: Domain name=Self-incomp_S1; Domain location=22-83; Score=3.3; E_value=0.00039; Accession=PF05938.2; Description=Plant self-incompatibility protein S1
MGEKANSVQDCLSDDGFFSQKNTVRVYNRMNDNILVYLHCQSKDDDLGQHVLAVGEHQEWSFNDRVIGTTLFWCTMNANNVHV

SEQ ID NO: 169172 - protein, 437 aa, Glycine max
  Coding DNA Sequence Number=SeqID_52394
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RSR6; Match level="QueryCoverage=94%, HitCoverage=83%, E-value=1e-171, Identity=67%"; Hit description =Glycoside hydrolase, family 1
  Pfam annotation: Domain name=Glyco_hydro_1; Domain location=13-422; Score=247.8; E_value=2.2e-71; Accession=PF00232.9; Description =Glycosyl hydrolase family 1
MGTTNISYAFFNSTNNLWKYKKSVMQEDVLLMVETGLEAYRFSISWSRLIPRIQPHVTLHNFDLPQALEDEYGGWISRDIIRDFTNYADVYFREFGDRVQYWTTVNEANVFALSGYDQGSCPPQRCSPPFCVTNITRGGNSTYEAYLAVHHILLSHSSAVRLYRRKYRDEQHGFVGISVYTLGFIPLTNTEKDRAASQRARDFFIGCCYLAGDDYDNNFRIVEPLVHGDYPISMKTNAGARIPAFTNRESEQVKGSYGFIGIIHYNNANVTDNPNALKTELRDFNADMAAQLILLQDLFSEEEYPVTPWSLREELKKFKLHYGNPPIFIHENGQRTGTNSSLQDVSRVKYLHGYIGGVLDALRDGSNIKGYFAWSFLDVFELLAGYKSSFGLYYVDRNDPELKRYPKLSAKWYSRFLKGSIELQKDASLVSVGHLFQ

SEQ ID NO: 169173 - protein, 57 aa, Glycine max
  Coding DNA Sequence Number=SeqID_52395
  Gene Ontology: Mol. function=zinc ion binding; Cellular component =integral to membrane
  Homolog annotation: Hit_ID=Q1RSS3; Match level="QueryCoverage=97%, HitCoverage=18%, E-value=7e-18, Identity=84%"; Hit description=Zinc finger, RING-type; SPX, N-terminal
MSSMPRGKSLRRCCAFGRIKYSARPKYWEQRLQMERVERVKQVKEHWETQCRAFMGI

SEQ ID NO: 169174 - protein, 122 aa, Glycine max
  Coding DNA Sequence Number=SeqID_52396
MHFAQDSEENRDFLFRMECFMPVLVGFLDNVNGGVKFGYQQNGTSREAEKLDTEEAGGGRKIERGFSASRSVKWNLRERNSLSTRERRHWVWFRRWTHLLESLGKMKETLEKGKQAKRGDRN

SEQ ID NO: 169175 - protein, 234 aa, Glycine max
  Coding DNA Sequence Number=SeqID_52397
  Homolog annotation: Hit_ID=Q38JH9; Match level="QueryCoverage=37%, HitCoverage=59%, E-value=9e-46, Identity=97%"; Hit description =Glycine rich protein-like
  Pfam annotation: Domain name=LSM; Domain location=32-98; Score=83.3; E_value=7.7e-22; Accession=PF01423.12; Description=LSM domain
MVVVLSLSLSLSLSLSKFVPFSNGYKDLLPLSLLKTAQGHPMLVELKNGETYNGHLVNCDTWMNIHLREVICTSKDGDRFWRMPECYIRGNTIKYLRVPDEVIDKVQEETKSRTDAYGFMLEPNSFRVRLISYSYINQQWKFHHCEQIANPLVWDVEGEEVGMMVLVDVNLKELGEVLMRVELKDKEDEAGVVQVENPVETEVQGEVEVDLGADMELQMGQLLLLEALVPIQNI

SEQ ID NO: 169176 - protein, 209 aa, Glycine max
  Coding DNA Sequence Number=SeqID_52398
  Homolog annotation: Hit_ID=Q7Y3Z0; Match level="QueryCoverage=75%, HitCoverage=23%, E-value=9e-17, Identity=34%"; Hit description=Tail fiber protein
MVAAGTVPVVPEADWLADPLKRGSYTTGDGSSTIRVPDFNGKAAGSLGALFQRGDGAVANGIITRDAMQGHFHAARNPGAAYGGGSSIQAIQSNAGSYAFADGGVGAPTSDGTNGTPRTSAETRPINVSGVWTIHAFGAVTNPGSADAAQLASDYAVLNAAFQTMRGQVFGPGQTLQDMTASRAFGTNYVNSTGKPIFIFVYSESTTAQ

SEQ ID NO: 169177 - protein, 89 aa, Glycine max
  Coding DNA Sequence Number=SeqID_52399
  Subcellular localization annotation: CTP_CleavageSite=63; ConfidenceScore=5.16e-01
MDQVWGWLSCLQGLCQQKSEGVDRPQWSTFSHVNYSGSLSSTFGSKATHCKVDSRRNMLLTVSCNAEDMLLPRGNFTFSDSVYIPRISI

SEQ ID NO: 169178 - protein, 112 aa, Glycine max
  Coding DNA Sequence Number=SeqID_52400
  Gene Ontology: Mol. function=oxidoreductase activity, acting on the CH-OH group of donors, NAD or NADP as acceptor; Biological process =malate metabolic process
  Homolog annotation: Hit_ID=Q9SIU0; Match level="QueryCoverage=50%, HitCoverage=9%, E-value=1e-22, Identity=89%"; Hit description=Malate oxidoreductase
  Pfam annotation: Domain name=malic; Domain location=35-112; Score= -57.1; E_value=0.0012; Accession=PF00390.9; Description=Malic enzyme, N-terminal domain
MGSKNLFFFVVCMFLLMVFTLCFSLLIDFRFKRDWKKIEAFVGLVLIAKIEEYAPIVYTPTVGLVCQNYSGLFRRPRGMYFSTQDCGEMMSMVYNWLAEQVVNYPYFCINFC

SEQ ID NO: 169179 - protein, 71 aa, Glycine max
  Coding DNA Sequence Number=SeqID_52401
MAGKTQYVGLKVWLLDCIWDLDWGQTASRAKTRGKNNPLLISICIAPRMELIVLLIRSNAQITNTRPTNYY

SEQ ID NO: 169180 - protein, 210 aa, Glycine max
  Coding DNA Sequence Number=SeqID_52402
  Gene Ontology: Mol. function=ubiquitin-protein ligase activity; Cellular component=ubiquitin ligase complex; Biological process =protein ubiquitination
  Homolog annotation: Hit_ID=Q9AV81; Match level="QueryCoverage=45%, HitCoverage=18%, E-value=1e-28, Identity=63%"; Hit description =Putative WD-repeat containing protein
  Pfam annotation: Domain name=WD40; Domain location=120-158; Score =19.9; E_value=0.0091; Accession=PF00400.22; Description=WD domain, G- beta repeat
  Pfam annotation: Domain name=WD40; Domain location=78-116; Score=4.8; E_value=10; Accession=PF00400.22; Description=WD domain, G-beta repeat
  Pfam module annotation: Pfam domain module=WD40::WD40; Domain location=120-158::78-116
MLQQEEEGSSSKKEETSSTEEEEEDPFYQNEDDCFVPVKETGTVATSTLTDFKKRPQTYCEIPATLAHVEALEAYTQISSHPFHKTNKQDIISLDILYSKDLIATGGIDTNVVIFYRPSGQILSTLSDHSKKVTSVKFVAQGESFITASANKCLALLSFKRLAKILLKHKHLDNEGKLELLHMMSNVMSRTSCPKILELLHNAQGKIKVK

SEQ ID NO: 169181 - protein, 70 aa, Glycine max
  Coding DNA Sequence Number=SeqID_52403
  Gene Ontology: Mol. function=UTP:glucose-1-phosphate uridylyltransfera se activity; Biological process=metabolic process
  Homolog annotation: Hit_ID=Q2PEV2; Match level="QueryCoverage=76%, HitCoverage=8%, E-value=2e-15, Identity=70%"; Hit description =Putative UDP-glucose pyrophosphorylase
MCFDSPKSAIDTSDGLTYLDLIINQIETLNSKYGSRVPLLLFNKDDIHDSSLKVKCHFQFPYAIVDLSHY

SEQ ID NO: 169182 - protein, 372 aa, Glycine max
  Coding DNA Sequence Number=SeqID_52404
  Gene Ontology: Mol. function=oxidoreductase activity; Cellular component=peroxisome; Biological process=electron transport
  Homolog annotation: Hit_ID=Q76DL0; Match level="QueryCoverage=97%, HitCoverage=96%, E-value=1e-144, Identity=67%"; Hit description=LEDI- 5c protein
  Pfam annotation: Domain name=Oxidored_FMN; Domain location=10-346; Score=308.6; E_value=1.2e-89; Accession=PF00724.10; Description =NADH:flavin oxidoreductase  NADH oxid
MAEQKNHVIPLLTPYGMGNFNLSHRIVLAPLFRARSYNNVAQPHAILYYSQRATKGGLLITEANSISPTCQYHPNAVGIWSKEQIEAWKPIVDAVHAKGGIFFCQILHTGRVSDPDFKPNRQTLISSTNKPLTHNGIEPRALRTDEIPHIVNDFRLAARNAIEADIQFLTAIAIVGFDGVEIHGAHGFLIDQFLKDQVNDRTDKYGGSTENRCRFALEVVEAVVEEIGADRVGIRLSPFSDYNECNDSNPQALGLYMAKSLNKHGVLYCHMVEPRWDISGENKETPHTLAPMKKAFNGTFIVAGGYDRKEGNKAVAEEKANLVAYGRLFLANPDLPKRFEVDAPLNKYNRETFYTPDPVVGYTDYPFLEGSS

SEQ ID NO: 169183 - protein, 177 aa, Glycine max
  Coding DNA Sequence Number=SeqID_52405
MSDDVLDYSSTSEVGRGGGRGGDFLASAELLQLGSLLLGGLFADLGLRRCCGSGEIVYSRPRHVEIHLFARTAWIVYSRASPFCERKHKRRKGSKEVQETRLKEALASFKVYEPLKKRKLYEPLPVPPPSLPGGTRMKFEACKKATSGLSVACFGKTLTPPCLNSNKVISLSSLLPE

SEQ ID NO: 169184 - protein, 574 aa, Glycine max
  Coding DNA Sequence Number=SeqID_52406
  Gene Ontology: Mol. function=enzyme inhibitor activity; Cellular component=cell wall; Biological process=cell wall modification
  Homolog annotation: Hit_ID=Q43111; Match level="QueryCoverage=99%, HitCoverage=98%, E-value=1e-138, Identity=47%"; Hit description =Pectinesterase-3 precursor
  Pfam annotation: Domain name=PMEI; Domain location=66-220; Score =136.9; E_value=5.6e-38; Accession=PF04043.6; Description=Plant invertasepectin methylesterase inhibitor
  Pfam annotation: Domain name=Pectinesterase; Domain location=268-560; Score=713.2; E_value=1.9e-211; Accession=PF01095.10; Description =Pectinesterase
  Pfam module annotation: Pfam domain module=PMEI::Pectinesterase; Domain location=66-220::268-560
MSFFKFYGKVDEAEHAMLEARRKTRKRVTIIALSTIVLVGVVCAAVFGTVAHNNNNSNNDGVNNAPSLSNSVKAVCDVTLYKGACYSSLGPLVHSGQVRPEELFLLSIEVALAEASRAVEYFSQKGVFNGLNVDNRTMEGFKNCKDLLGLAVDHLNSSLASGGKSSLFDVLEDLRTWLSAAGTYQQTCIDGLEEAKEALKTSVVNNLKNSTEFTSNSLAIVTWLNKAASTVNLRRLLSTLPHHMVEPKWLHSKDRKLLQKDDLKRKAHIVVAKDDSGKFKTITAALKQVPDNSDKRTVIYVKKGVYDENVRVEKTKWNVMIIGDGMNATIVSGSLNFVDGTPTFSTATFAVFGRNFIARDMGFRNTAGPQKQQAVALMTSADQAVYYRCQIDAFQDSLYAHSNRQFYRECNIYGTVDFIFGNSAVVLQNCNIMPRVPMQGQQNTITAQGKTDPNMNTGISIQNCNITPFGDLSSVKTYLGRPWKNYSTTVFMQSTMGSFIHPNGWLPWVGNSAPDTIFYAEFQNVGPGASTKNRVNWKGLRVITRKQASMFTVKAFLSGERWITASGAPFKSSI

SEQ ID NO: 169185 - protein, 69 aa, Glycine max
  Coding DNA Sequence Number=SeqID_52407
MEEKGEAQELGKEKCKLTLMEHFFYRRKKRCVPTSFSTIFLKAVHLVICSPKHKVQDHHRIQTQIVNWE

SEQ ID NO: 169186 - protein, 75 aa, Glycine max
  Coding DNA Sequence Number=SeqID_52408
MEAGCKNKKEVTTTTVEDEKMAFGPSKLGKQPLWSSKSSQWPQAMEENNMDIDAIKKEMRMMNTNVIKRNGSDGY

SEQ ID NO: 169187 - protein, 75 aa, Glycine max
  Coding DNA Sequence Number=SeqID_52409
MLAESDHYRVEFRACKDDAWYTARVSLEGETLTVKYLNLPDEYDNAFRASEFGERFRPLSKQLLLGSRDHLAIAL

SEQ ID NO: 169188 - protein, 101 aa, Glycine max
  Coding DNA Sequence Number=SeqID_52410
  Gene Ontology: Mol. function=transporter activity; Cellular component= integral to membrane; Biological process=transport
  Homolog annotation: Hit_ID=Q2PF04; Match level="QueryCoverage=97%, HitCoverage=20%, E-value=5e-39, Identity=78%"; Hit description =Putative transporter-like protein
MMISIPLLQSYPFIALLSGLALYIVLSVASILKNLLSVTINTGLFLLQNRAVEQHQRGAANGISMTGMSLFKSIGPATGGAILTWSQKRMDASFLPGMMLN

SEQ ID NO: 169189 - protein, 429 aa, Glycine max
  Coding DNA Sequence Number=SeqID_52411
  Gene Ontology: Mol. function=nucleic acid binding; Cellular component= nucleus; Biological process=DNA integration
  Pfam annotation: Domain name=rve; Domain location=142-275; Score=6.6; E_value=0.0017; Accession=PF00665.16; Description=Integrase core domain
  Pfam module annotation: Pfam domain module=RVT_2::rve; Domain location=354-429::142-275
MEEHALKASTNSTHSNNSRGRGRGRGESSNFIKEKEVETLLMAIKDAKDSEVEIWYVDTGCSNHMSGMMGKGDIKMKTKNGFVETISNVLYVPNLKNNLLSAGQLQEKGYDIFISKGTCEIFDPVRVAIAVIKKNSNSGLNTLEQKNMVIGLPQITGPSQEKSEALSSFKSFNARVETESKKTIKSLRTDRGGEYCSDEFSTFCVNHVIRKELTTAYTPQQNGVSKRKNRVILNMSQAYKLYNPTTKKIIISCDVVFDEEIFFENNIDETKQILANFDEDNEDEELQTRELEEQQIPAITVEDERPQRARRRPAWMSDYEVTEIEDPITHFALFSDCDPTTFESVVKEEKWRKAMDDEIDSIERNNTWELCDLPNGHNTIGVKWVFKTKLKRNGEVDKYKACLVAKGYKQQYGVDYTKVFSPVGRHDTI

SEQ ID NO: 169190 - protein, 132 aa, Glycine max
  Coding DNA Sequence Number=SeqID_52412
MWNNPWLRDKDNSYVTIAPDPNLHKLRDVKAILSIPLVNIEGEDRRVWRTHGHFNQERLHVFESIPDVKKREALALLEVIHWIGDLGQTRVIIELDCKQVVDVIHKPIIDAPEFGVITSIAKDSFIISKLAL

SEQ ID NO: 169191 - protein, 83 aa, Glycine max
  Coding DNA Sequence Number=SeqID_52413
  Gene Ontology: Mol. function=DNA binding; Cellular component =mitochondrion; Biological process=DNA integration
MAWSIELSEFDIRYEPRGPIKTHFMVDFLAEFVENHQTTPNWWALYVDGASNVKGGGEGIILEGPDNVILKQALKLNFKALNN

SEQ ID NO: 169192 - protein, 572 aa, Glycine max
  Coding DNA Sequence Number=SeqID_52414
  Gene Ontology: Mol. function=identical protein binding; Cellular component=cytoplasm; Biological process=negative regulation of enzyme activity
  Homolog annotation: Hit_ID=Q9LJ20; Match level="QueryCoverage=98%, HitCoverage=72%, E-value=1e-177, Identity=56%"; Hit description =Putative subtilisin-like protein
  Pfam annotation: Domain name=PA; Domain location=182-275; Score=63.3; E_value=7.8e-16; Accession=PF02225.12; Description=PA domain
  Pfam annotation: Domain name=Peptidase_S8; Domain location=1-405; Score=19.7; E_value=7.7e-08; Accession=PF00082.12; Description =Subtilase family
  Pfam module annotation: Pfam domain module=PA::Peptidase_S8; Domain location=182-275::1-405
DNQTHIEATKGSPRDSVGHGTHTASIAAGVHVNNASYFGLAQGTARGGSPSTRIAAYKTCSDEGCSGATILKAIDDAVKDGVDIISISIGLSSLFQSDFLSDPIAIGAFHAEQKGVLVVCSAGNDGPDPFTVVNTAPWIFTIAASNIDRNFQSTIVLGNGKYFQGTGINFSNLTHSKMHRLVFGEQVAAKFVPASEARNCFPGSLDFNKTAGSIVVCVNDDPTVSRQIKKLVVQDARAIGIILINEDNKDAPFDAGAFPFTQVGNLEGHQILQYINSTKNPTATILPTTEVSRLKPSPIVASFSSRGPSSLTENVLKPDVMAPGVGILAAVIPKTKEPGSVPIGKKPSLYAIKSGTSMACPHVTGAAAFIKSVHTKWSSSMIKSALMTTATNYNNLRKPLTNSSNSIADPHEMGVGEINPLRALNPGLVFETDVEDYLRFLCYFGYSQKIIRSMSKTNFNCPKNSSEGLISNVNYPSISVSTLKKQQKAKVITRKVTNVGSLNATYTAKVLAPEGLVVKVIPNKLVFSEGVQRMTYKVSFYGKEARSGYNFGSLTWLDGHHYVHTVFAVKVE

SEQ ID NO: 169193 - protein, 510 aa, Glycine max
  Coding DNA Sequence Number=SeqID_52415
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=37%, E-value=1e-174, Identity=56%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam module annotation: Pfam domain module=RVT_1::RVT_2; Domain location=39-254::15-272
MSFEEALKNDKWVNAMKEELKSIETNHTWQLMELPKLKRPIAVKWVFKVKRNPTGEVVKHKARLVAKGFLQKEGVDYGEIFAPVARIETVRLVVVIASMKGWSMYQLDVKSAFLNGHLEEEVFVKQPPGFEVVGHEGKVYKLKKALYGLKQAPRAWNKKIDSVLIQIGFSKCISEHGVYVKGEYESDLVILCLYVDDLLITGNNKIEIDKIKQLLKNQFEMTDLGSLSYFLGIEFKETGAGIVMHQSKYATDLLKKFRMTNCNAAATPAETGLALSLRDEGEPVDETQYRQIVGSLSYLCNTRPDLAFSVGLISRFMQAPKTPHMMAAKRILRYIRGTINYGILLPNTITNSNMELVGYTDSDWRRDNDDRKSTAGYIFLLGDALVSWSSKKQDSVALSTCEAEYIAASMCSCQGLWLRKLLKEMKIQKTEAINILVDNKSAISLAKNPFDHGGSKHIETRYHFIRDKVSKGKVKLLYCKLEDNLADLLTKPFKKNKFEDLRNKMMIMIE

SEQ ID NO: 169194 - protein, 86 aa, Glycine max
  Coding DNA Sequence Number=SeqID_52416
MEILCKGSKRIYLKPGKACKRLSEGVFLSMGMLDPLERVLTDEDLDRELKLEVNEILTFLHSQHSLGLPSCERLEWGNVPKLKPPN

SEQ ID NO: 169195 - protein, 153 aa, Glycine max
  Coding DNA Sequence Number=SeqID_52417
MDIGRCSYLNWLEFPSSSNQELHSHCHNLPYDGTTKDKKDKPKSPSPAKKMNAVATNGNGSSPRRASSFSPKSFEGPGEPEASLGELGSKSKVKQVPKNQASRIKSQRIKIQEQLSFKIQDSRTIKIMIQDYRFKIQEKLISRFKRRNREATV

SEQ ID NO: 169196 - protein, 105 aa, Glycine max
  Coding DNA Sequence Number=SeqID_52418
  Gene Ontology: Mol. function=RNA-directed DNA polymerase activity; Biological process=RNA-dependent DNA replication
MDDMLVDAAAKHGVITFMDGHFGYNQIFMAVKDVCKMTFKCLGALGIYEWMEVYIGDVVVNINWEFPRILGISEGIKVDKSKVKDKEEFVWGEEHDKHLSISSKC

SEQ ID NO: 169197 - protein, 120 aa, Glycine max
  Coding DNA Sequence Number=SeqID_52419
  Subcellular localization annotation: CTP_CleavageSite=89; ConfidenceScore=5.04e-01
MKSKKWSGSKKKLPSSEQQEDTIQRLVKPKGSSLKSLKKTQDKHVPSLNSEGSSNPRSAFSESRFSKGLRNPKSALGESRFSKGLQNPRSALGESQFSKGRLTKLNPHDHCFSHTRKCFR

SEQ ID NO: 169198 - protein, 202 aa, Glycine max
  Coding DNA Sequence Number=SeqID_52420
MAELCLVPDVIIPLKFKVPNFDKYKGTTCPKNPLKMYCRKMGAYAKDEKLIMHFFQESLTGAAVTWYTNLEPSRVHSWKDLMVAFDRQYQYNFDMAMDRMQLQNMGDYNNDSRHITSVLLWKDGKFDYPALMNGKTRENGENEKQEGTHVVTVIPTWPNFSSAQQCHDKKIAIDTSEPYTGAMKGTVHEPQANLGADQKFSL

SEQ ID NO: 169199 - protein, 241 aa, Glycine max
  Coding DNA Sequence Number=SeqID_52421
  Gene Ontology: Mol. function=DNA binding; Biological process=DNA integration
MADNNWTLKELATPIVVYQSYCIQYNETEVSCELKPGLIHLLPKFHGLAGLMLMDKSMIHAASGSAFMDKTSAAIRKLISNMAANYKQFGTKEVAISKDRTLTNAMLDLGVSINAMSAFVYRSLRLGNLEPTGVIIQLANRSVANLLGISEYVLIQVKDQIFLADFYVLDMEDELSNHGATLMLGRPFLMTTRTMIDVHARTLFIEFDDNMVQLNIFEAMKHLTENHSVLCLDVIDLLADE

SEQ ID NO: 169200 - protein, 74 aa, Glycine max
  Coding DNA Sequence Number=SeqID_52422
  Gene Ontology: Mol. function=DNA binding; Biological process=DNA integration
  Homolog annotation: Hit_ID=Q1SKC8; Match level="QueryCoverage=62%, HitCoverage=11%, E-value=2e-11, Identity=65%"; Hit description =Integrase, catalytic region
MEHKACWALKFLNFDEVLLGEKRKLQLSELEEKRLNAYESSKLYKQKERSVEESELEEWGWSQVGLKSHGYVKS

SEQ ID NO: 169201 - protein, 197 aa, Glycine max
  Coding DNA Sequence Number=SeqID_52423
  Homolog annotation: Hit_ID=P33030; Match level="QueryCoverage=98%, HitCoverage=60%, E-value=7e-61, Identity=61%"; Hit description =Hypothetical protein yeiR
  Pfam annotation: Domain name=CobW_C; Domain location=112-195; Score =17.8; E_value=0.00072; Accession=PF07683.4; Description=Cobalamin synthesis protein cobW C-ter
LADTRVTENENFRDQLIAADIIIANKSDKWDAEDRQRLASWQQQHLGDRQLVEASWGNIDPALLSQPALADRAVPDAAHHHHSPRPQGLAALKLEGEARWRRALNEGQGYASCGWIFDGDTVFDTIPALEWARLAPVDRVKGVLRTADGLVSINRQGEDLFIETRPVTPPDSRIELIHHQAADWNALQTALLKIRLN

SEQ ID NO: 169202 - protein, 162 aa, Glycine max
  Coding DNA Sequence Number=SeqID_52424
  Gene Ontology: Cellular component=integral to membrane; Biological process=transport
  Homolog annotation: Hit_ID=UPI00005F74E3; Match level="QueryCoverage =100%, HitCoverage=69%, E-value=1e-60, Identity=66%"; Hit description= COG0671: Membrane-associated phospholipid phosphatase
GKEHHNQQAHQEGAEAEIAPHKAGEDNQHHAVVAGEAVSGRIFCRNTGQFADAMHVIKEQRRAGMLNRQQVAQLVKNHRRQQHGDTNRQHTTSALRRFAAPEPQIEQAHRQQRHRIKTAEIGDRHQQRKAVMVDHLVVKAKKDAFVESEPEPVLRRQIPRHK

SEQ ID NO: 169203 - protein, 119 aa, Glycine max
  Coding DNA Sequence Number=SeqID_52425
MRIPIFTGQGSKRSKVVFRWSLSSWEPNLDIWGKTNLGDEVSVSGRTSTLFHKARVTMMIWKLRAKLVIATARWALKHPVYGIVILRLGIYTNRPNVSKLCSFISSMHSSILISVHSGK

SEQ ID NO: 169204 - protein, 56 aa, Glycine max
  Coding DNA Sequence Number=SeqID_52426
MVTLGHFSVPGPTRKLRDEATSLSKSNLARPGELLCNLHPSFVINKREGAEGKRFQ

SEQ ID NO: 169205 - protein, 77 aa, Glycine max
  Coding DNA Sequence Number=SeqID_52427
MFSEVLLWWCHGNVETWYKAEVPWWWHDENVRDQDGEIMKALKWMHCDGNNIARGDNASGQRETREGVRVQRETLIV

SEQ ID NO: 169206 - protein, 645 aa, Glycine max
  Coding DNA Sequence Number=SeqID_52428
  Gene Ontology: Mol. function=transporter activity; Cellular component= integral to membrane; Biological process=transport
  Homolog annotation: Hit_ID=Q7WET0; Match level="QueryCoverage=59%, HitCoverage=96%, E-value=1e-153, Identity=72%"; Hit description =Putative integral membrane signal transducer protein
VQQHQARQRDHHRHQEEPGPPQVLDQRRRQGSGQVGATHRRQRGQQRELRGREALAAQGHQEPDERRRAQAAAQVFQPDRGAHEPNALGADRDHPVAQVGHRLQQPEHHQRPVQRPARHDEAAGKGADDGRGHAHDLVDRAHLGRGIARAADQERGRKRAGKGVAQLVQHNQQQHRQRAAPGEEFLQGRRHGLAQAARRLGHVLRLGRPQCRQRAQQHQAAHHHIGIAPADPLVGQDQRQPARDDHRHPVAHDLDGRARAALFLAQHVGAVGVEGDVLGGRQEGHQHRQQGQRLQGRRRRQRAHDHDRQPQQHLRHQHPAAAPAQQRRRIAVHQRRPQELERVGRAHQGQETDLLQGHAGHRGPRLQGAAGQGQRQSAGEPQDQQGRDAGTGVDVGYSGNDGLLKRAGRAHGRARRACGILGAGARAVSRRFRMSGRGEAVHRQGAAPAGEGLDLAPFVESGALQDAQAQLAGQLFEVAQRAQVDVGRVVPLVGHLARHRHAPAQDGPAVRPVAEVGKRHHAVARHPRHLAQDVLGAVHGLQRLRQHHGVELLVVEQGQAVFQVLLDHLDPAPHAGDDAGVVQLDARAAHLAVIAQVRQQRAVAATQVQHPAAGFDPAGDARQVGAQRIDGGTGSHGIHAERPSV

SEQ ID NO: 169207 - protein, 88 aa, Glycine max
  Coding DNA Sequence Number=SeqID_52429
MDEPRLGQQNEKKTYPIASLTGVGLKIRSRIRVKSTFPLISGAEPHLAVGRSSLLGRVQTGLKGGGMKDSDLTGDSSLARANQSMGIC

SEQ ID NO: 169208 - protein, 153 aa, Glycine max
  Coding DNA Sequence Number=SeqID_52430
MESWGFRFEGYKMRCGFISLDQFRFKGRSVVGRPGKDGLDREAMPTLLVTTKRRSQERKEGLEPSTSALARLCSTIKLFPPATVVAKHYGAINAGGGAAAFSINLRPLSAAIGASCKESWSRVELGRHFILVTGVSAPQDQTSYSLAAVASVF

SEQ ID NO: 169209 - protein, 330 aa, Glycine max
  Coding DNA Sequence Number=SeqID_52431
  Gene Ontology: Mol. function=hydrolase activity; Cellular component =integral to membrane; Biological process=lipid metabolic process
  Homolog annotation: Hit_ID=Q0XAJ8; Match level="QueryCoverage=72%, HitCoverage=63%, E-value=7e-90, Identity=71%"; Hit description =Patatin
  Pfam annotation: Domain name=Patatin; Domain location=47-205; Score =160.3; E_value=5.1e-45; Accession=PF01734.12; Description=Patatin -like phospholipase
MSLFRPRMLLSLALIGLLAGCGGDPVRPTPPPAPTVVPQAKPVKIGIALGGGAAKGFAHIGVIKMLEANGFEPAVVSGTSAGSVVGALYASGMDAFQMQSKAVALDEASIRDVRLFSGGLVQGQKLQDYVNEQVANRPAERLKKPFAAVATQLETGERAIFVRGNVGQAVRASSSIPGVFEPVKIGGRNYIDGGVVSPVPVDAARQLGADFVIAVDISSKASGKAPTDMLGIVNQSISIMGQRLGEQELARADIVIRPKVLDIGAADFSQRGTAILEGEKAAMAAMPQIRAKIQQLQRARAAAAAPAPVAAPKCEEASRLGKLMGRKDKC

SEQ ID NO: 169210 - protein, 320 aa, Glycine max
  Coding DNA Sequence Number=SeqID_52432
  Gene Ontology: Mol. function=RNA-directed DNA polymerase activity; Biological process=RNA-dependent DNA replication
MSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTVESTPAASNAKKFGGHFAKKKDQEVGMVAHGKPQQNFTPYRQVANVASTIPNPSYHQQRPHYPQQYPPQQYPPQQYPPQQYPPQQYPPQQYHQPQYPQNRPQTPQQPYHSQNRQKTTFDPIPMKYADLLPALLAKNLVQVRTPPRTPDVLPPWFRHDLTCAFHQGAPGHDVENCYVLKNE

SEQ ID NO: 169211 - protein, 287 aa, Glycine max
  Coding DNA Sequence Number=SeqID_52433
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=6e-41, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDPRVLEPITFRGLHALAFRGLQALTFRELHVLTLRGLHVLTLRGLHVLALRGLHVLIFKGLDVLTFRGLHVLAIRGLHAHAFRGLHVLTFRWLHALTSRGLRVLAIRGLQFLACRGLDTLTFRGLQVLAIRGLHAFTFRGLHVLAIRGLHALTFRGLHVLTFRGLHVLAIRGLHALNFRGIHVLAIKGLHTLTFRGLHVLAFRGLHVLLIRGPHALTLRGLHFLTIRGRHTLTSRGLHVLAIRGLHVLVFRGLHTLTFRGLHALTFRGLHALAFRGLHVLTFRGLN

SEQ ID NO: 169212 - protein, 208 aa, Glycine max
  Coding DNA Sequence Number=SeqID_52434
MVMKHTRGNPNIPTTTRSRSPKSRMGKDHGDWNGGKKCLRQHGASLPTSPRKRTHYQKPHGESSMRRSRRLDDLSVYQGLLNRTSRVATAHTYGGVRDERHYGNECTLRARKTITREREITDTARRLDKLHKSATLAPVEVTTLNIGQHLSKLWGLEKLVTLLLVKATALDTRQSPSTPDNLFHSQAGSKLGGLMYCPGSTKWMWQLT

SEQ ID NO: 169213 - protein, 57 aa, Glycine max
  Coding DNA Sequence Number=SeqID_52435
MQVIGVSKKLHSRKTQRKGVVTSTLLLIEYIRLGRKVKGKARVMIHISQSRGGKQHA

SEQ ID NO: 169214 - protein, 44 aa, Glycine max
  Coding DNA Sequence Number=SeqID_52436
MLCLAQFLFPHTPYQAITTKSFEEALKSIEKAKPYKEDNIEEDP

SEQ ID NO: 169215 - protein, 96 aa, Glycine max
  Coding DNA Sequence Number=SeqID_52437
MTKHVKRGYEIEMKENGEEACHPARPGELDCFLQKQPPSGGVFWKAQVGLNFTDCALTLSFNFRHVTELHELPNDGCQVPRSGQTRVASQQRMVPG

SEQ ID NO: 169216 - protein, 129 aa, Glycine max
  Coding DNA Sequence Number=SeqID_52438
MNPFKEGGNDGGATSSSNDPLLGIGGPMTRSKTKKMKKALQGLVLKIKKKEDQCELRATPNWVTPLQVDEYVLRSQLGSCSFFITLVLSTVAIRIKFLSLNTCFQDNPKCSLIKMPPNRQTLNSSKYLS

SEQ ID NO: 169217 - protein, 273 aa, Glycine max
  Coding DNA Sequence Number=SeqID_52439
MLEMKLDQIHIKNIKMNVNIPRFRGPQGRYNTDYFEDEWKAKGKKISNQGKEKQGTFLDKGEQIAGDKCMGDRGNVKLQYIGENMVLISEFLKRFLIEKWKRLLIKVRSVNVGDGEDESTKEDSAGSIYRVEMFILSLNMKGCNSQRGPSTAQYRGTKERHGQHPINNWRQDKEIQNRKGKYGEDEGDGPHMVTINIEKVEEVKVVFGQNEEVICIDNTTHRQKSSGPFVCHIDCRQRIKLNVLMMTKVHMRLKALFKTKKLKIFKMDDQDSL

SEQ ID NO: 169218 - protein, 94 aa, Glycine max
  Coding DNA Sequence Number=SeqID_52440
MLDLLSGFYRQRLFRLASFLQAKCLIYGGMNLDLEPLCVSLSERREQHNKENKVAICHYLRFKTFWCLKIFSSDHYDYLKATGSLRIEVCCLPS

SEQ ID NO: 169219 - protein, 100 aa, Glycine max
  Coding DNA Sequence Number=SeqID_52441
MGSFIVGTQSRYLGQNKLGCQGVGLGPNFHIIPQGMRDNDDLETMCKISHGHSQVGTQASHLRRCDTTVENLHKQTQRFPIMFFHQFNEFIHSYLVYSGK

SEQ ID NO: 169220 - protein, 101 aa, Glycine max
  Coding DNA Sequence Number=SeqID_52442
MAVGNDVCMIHDFEGELYVYDVEGETAAADDDCCKLIEDAAVRAWRQGEQKQKADVTRDVLTSWRRLVDVQLEEFPLCLITLIMEVADPTCITARTCSGSV

SEQ ID NO: 169221 - protein, 94 aa, Glycine max
  Coding DNA Sequence Number=SeqID_52443
MGGCAEKSTGHPEAKHRPPRVVSRVRVAGAGVTIKQYFGSAPRSSCISSFIPPEELEQLTQQIRDQLEESITEKVIGQLMASFSQMQPQLQSQM

SEQ ID NO: 169222 - protein, 58 aa, Glycine max
  Coding DNA Sequence Number=SeqID_52444
MNNIRTRRVEIGFEEEKGEKNEGCVEEKEFFGLGVEKLCHMIRCRAVEIALLVYEIMD

SEQ ID NO: 169223 - protein, 73 aa, Glycine max
  Coding DNA Sequence Number=SeqID_52445
  Gene Ontology: Mol. function=transporter activity; Cellular component= membrane; Biological process=transport
  Homolog annotation: Hit_ID=Q1H112; Match level="QueryCoverage=86%, HitCoverage=23%, E-value=5e-15, Identity=60%"; Hit description =Binding-protein-dependent transport systems inner membrane component
MTKIGNTQPRHSLPGDQPDLCPLKHLVYAEPNQAGNHHADHDYIEPEHFTAKLHHLPDATIGCQQFCCHQNGP

SEQ ID NO: 169224 - protein, 230 aa, Glycine max
  Coding DNA Sequence Number=SeqID_52446
  Gene Ontology: Mol. function=transporter activity; Cellular component= membrane; Biological process=transport
  Homolog annotation: Hit_ID=Q1H113; Match level="QueryCoverage=99%, HitCoverage=88%, E-value=6e-69, Identity=58%"; Hit description =Binding-protein-dependent transport systems inner membrane component
  Pfam annotation: Domain name=BPD_transp_1; Domain location=31-225; Score=78.5; E_value=2.2e-20; Accession=PF00528.12; Description =Binding-protein-dependent transport s
MSRLDANHAYAFASLGQIWSGVVELSRSGELLVNVQASVQRALTGLLLGASAGFLVGSLVAVSRTANILITPIYHAIRQVPLLGLVPLFALWFGNGDTSKLIVVSLSAFYPVVLSTFEGMLQVDRKFHEVGQVYGLSRWQIYRRITLPAALPQVFTGFSLALAFAWLSTIGSELLFTAGAGLGNLMMNAQEASRMDVLIIVTFVIGVLGYGMSLLIKLASSHLFKWRQVA

SEQ ID NO: 169225 - protein, 210 aa, Glycine max
  Coding DNA Sequence Number=SeqID_52447
MKADMESMKEKMTTMMEAMMSMRKIMEVNTTIVVAASNATEVDPTHPSGLNPVNHSISDMVGQGGKALGSIGGPHFMQSQQLQSGHAQVPQPMGEAHEVPRDHTLADFEPHLRYATEGQAFDGIPLPNTLGGPQYRPQIQPLHFALERLPPAMVETEKLDHIEERLRAIEGGGDYAFVDMAELCPTPLSLRSSRCWILISTRGLLAPRIT

SEQ ID NO: 169226 - protein, 1070 aa, Glycine max
  Coding DNA Sequence Number=SeqID_52448
  Gene Ontology: Mol. function=protein serine/threonine kinase activity; Cellular component=integral to membrane; Biological process=protein amino acid phosphorylation
  Homolog annotation: Hit_ID=Q9C7S5; Match level="QueryCoverage=97%, HitCoverage=94%, E-value=0.0, Identity=53%"; Hit description=Leucine- rich receptor-like protein kinase, putative; 84911-81624
  Pfam annotation: Domain name=LRRNT_2; Domain location=27-67; Score =32.4; E_value=1.6e-06; Accession=PF08263.3; Description=Leucine rich repeat N-terminal domain
  Pfam annotation: Domain name=LRR_1; Domain location=120-142; Score =12.8; E_value=1.2; Accession=PF00560.23; Description=Leucine Rich Repeat
  Pfam annotation: Domain name=LRR_1; Domain location=147-170; Score =11.6; E_value=1.9; Accession=PF00560.23; Description=Leucine Rich Repeat
  Pfam annotation: Domain name=LRR_1; Domain location=17-40; Score=1.9; E_value=1.3e+02; Accession=PF00560.23; Description=Leucine Rich Repeat
  Pfam annotation: Domain name=LRR_1; Domain location=178-200; Score =11.1; E_value=2.4; Accession=PF00560.23; Description=Leucine Rich Repeat
  Pfam annotation: Domain name=LRR_1; Domain location=208-230; Score =5.1; E_value=31; Accession=PF00560.23; Description=Leucine Rich Repeat
  Pfam annotation: Domain name=LRR_1; Domain location=232-255; Score =7.7; E_value=11; Accession=PF00560.23; Description=Leucine Rich Repeat
  Pfam annotation: Domain name=LRR_1; Domain location=256-278; Score =9.2; E_value=5.4; Accession=PF00560.23; Description=Leucine Rich Repeat
  Pfam annotation: Domain name=LRR_1; Domain location=280-302; Score =17.6; E_value=0.044; Accession=PF00560.23; Description=Leucine Rich Repeat
  Pfam annotation: Domain name=LRR_1; Domain location=304-326; Score =9.8; E_value=4.2; Accession=PF00560.23; Description=Leucine Rich Repeat
  Pfam annotation: Domain name=LRR_1; Domain location=328-351; Score =8.4; E_value=7.5; Accession=PF00560.23; Description=Leucine Rich Repeat
  Pfam annotation: Domain name=LRR_1; Domain location=353-375; Score =16.0; E_value=0.14; Accession=PF00560.23; Description=Leucine Rich Repeat
  Pfam annotation: Domain name=LRR_1; Domain location=377-399; Score =6.2; E_value=20; Accession=PF00560.23; Description=Leucine Rich Repeat
  Pfam annotation: Domain name=LRR_1; Domain location=401-425; Score =3.7; E_value=58; Accession=PF00560.23; Description=Leucine Rich Repeat
  Pfam annotation: Domain name=LRR_1; Domain location=427-447; Score =2.8; E_value=87; Accession=PF00560.23; Description=Leucine Rich Repeat
  Pfam annotation: Domain name=LRR_1; Domain location=456-478; Score =11.5; E_value=2; Accession=PF00560.23; Description=Leucine Rich Repeat
  Pfam annotation: Domain name=LRR_1; Domain location=480-502; Score =21.4; E_value=0.0032; Accession=PF00560.23; Description=Leucine Rich Repeat
  Pfam annotation: Domain name=LRR_1; Domain location=504-526; Score =5.8; E_value=23; Accession=PF00560.23; Description=Leucine Rich Repeat
  Pfam annotation: Domain name=LRR_1; Domain location=589-611; Score =11.4; E_value=2.1; Accession=PF00560.23; Description=Leucine Rich Repeat
  Pfam annotation: Domain name=LRR_1; Domain location=613-635; Score =23.1; E_value=0.001; Accession=PF00560.23; Description=Leucine Rich Repeat
  Pfam annotation: Domain name=LRR_1; Domain location=637-658; Score =0.9; E_value=1.9e+02; Accession=PF00560.23; Description=Leucine Rich Repeat
  Pfam annotation: Domain name=LRR_1; Domain location=71-93; Score=3.8; E_value=55; Accession=PF00560.23; Description=Leucine Rich Repeat
  Pfam annotation: Domain name=LRR_1; Domain location=95-118; Score =18.0; E_value=0.034; Accession=PF00560.23; Description=Leucine Rich Repeat
  Pfam annotation: Domain name=Pkinase; Domain location=787-1058; Score= 110.8; E_value=3.9e-30; Accession=PF00069.15; Description=Protein kinase domain
  Pfam annotation: Domain name=Pkinase_Tyr; Domain location=787-1058; Score=101.5; E_value=2.5e-27; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=27-67::120-142::147-170::17-40::178-200::208-230::232 -255::256-278::280-302::304-326::328-351::353-375::377-399::401 -425::427-447::456-478::480-502:...
  Pfam module annotation: Domain location=:504-526::589-611::613 -635::637-658::71-93::95-118::787-1058::787-1058
MVSKLMVSIIVPLFLLSLFVFQVSSCDQIDKLSLLAFSGNISTSPPYPSLDWSDSLDCCSWEGITCDGDLRVTHLLLPSRGLTGFISPSLTNLSSLSHLNLSHNRLSGTLQHHFFSLLNHLLVLDLSYNRLSGELPPFVGDISSDGVIQELDLSSNLFNGALPNSLLEHLAASAAGGSFVSLNVSNNSLTGHIPTSLFCINDHNNSSSLRFLDYSSNEFDGAIQPGLGACSKLEKFRAGFNFLSGPIPSDLFHAVSLTEISLPLNRLTGTIGDGIVGLSNLTVLELYSNHFTGSIPHDIGELSKLERLLLHVNNLTGTMPQSLMNCVNLVVLNLRVNVLEGNLSAFNFSGFLRLTTLDLGNNHFTGVLPPTLYACKSLSAVRLASNKLEGEISPKILELESLSFLSISTNKLRNVTGALRILRGLKNLSTLMLSKNFFNEMIPQDVNIIEPDGFQKLQVLGFGGCNFTGQIPGWLAKLKKLEVLDLSFNQISGPIPPWLGKLSQLFYMDLSVNLLTGVFPVELTELPALASQQANDKVERTYFELPVFANANNVSLLQYNQLSGLPPAIYLGSNHLNGSIPIEIGKLKVLHQLDLKKNNFSGSIPVQFSNLTNLEKLDLSGNQLSGEIPDSLRRLHFLSFFSVAFNNLQGQIPTGGQFDTFSNSSFEGNVQLCGLVIQRSCPSQQNTNTTAASRSSNKKVLLVLIIGVSFGFASLIGVLTLWILSKRRVNPGGVSDKIEMESISAYSNNGVHPEVDKEASLVVLFPNKNNETKDLTIFEILKSTENFSQENIIGCGGFGLVYKATLPNGTTLAIKKLSGDLGLMEREFKAEVEALSTAQHENLVALQGYCVHDGFRLLMYNYMENGSLDYWLHEKPDGASQLDWPTRLKIAQGASCGLAYLHQICEPHIVHRDIKSSNILLNEKFEAHVADFGLSRLILPYHTHVTTELVGTLGYIPPEYGQAWVATLRGDVYSFGVVMLELITGRRPVDVCKPKMSRELVGWVQQMRIEGKQDQVFDPLLRGKGFEVQMLKVLDVTCMCVSHNPFKRPSIREVVEWLKNVGSDNQPTQK

SEQ ID NO: 169227 - protein, 58 aa, Glycine max
  Coding DNA Sequence Number=SeqID_52449
MADHFNLAKLERSFSFVLIKICVNWYPSTPLMDDVTLLYGIINNLEDKFLVIFRGNLK

SEQ ID NO: 169228 - protein, 87 aa, Glycine max
  Coding DNA Sequence Number=SeqID_52450
MVFTRVERKDRNCRRKWQKKRAKVKKKLRDLNSSTMLHKVVMKVKRKSGNSGNTESGGEKEVVLTPKKLREEQRHPCPRGGQYSSRS

SEQ ID NO: 169229 - protein, 125 aa, Glycine max
  Coding DNA Sequence Number=SeqID_52451
MSVLGMQQVSLVQSGRGSGEKEITFYPRAREREIPAFFPTEATNNRAEGEGEASAYQTDSLGSGAERDGFPIGFRDEYGKSESKSQRTSSATSFAIDGTSRSRSAASAVEAVDGRAKANKSHVCI

SEQ ID NO: 169230 - protein, 96 aa, Glycine max
  Coding DNA Sequence Number=SeqID_52452
MRVIMEMDGSGIDGASHIGRRNEFLEGLCGFEEVATANADLDEFRVELGVQEVRDHVGDLGDEIRVEGVVGGEGFGGEGLRWNRCVLLRAWKAETE

SEQ ID NO: 169231 - protein, 143 aa, Glycine max
  Coding DNA Sequence Number=SeqID_52453
  Pfam annotation: Domain name=zf-CCHC; Domain location=56-73; Score =10.4; E_value=0.019; Accession=PF00098.13; Description=Zinc knuckle
MLQSNESGGEFKFKLEVKNEESKRSNESTNNSSNDDEVSIMSRKFKKSLKEKGKDIFYFECKKLGHMKVECLKLKKRWTLRRRRKLRNLFVSDGSFLERKNSGSSDVILNRKIILVEENRNDFGVSMKWGNRGFIVDVLLQIQ

SEQ ID NO: 169232 - protein, 410 aa, Glycine max
  Coding DNA Sequence Number=SeqID_52454
  Gene Ontology: Mol. function=protein binding; Cellular component =integral to membrane; Biological process=response to DNA damage stimulus
  Homolog annotation: Hit_ID=Q708X5; Match level="QueryCoverage=80%, HitCoverage=90%, E-value=1e-131, Identity=67%"; Hit description =Leucine rich repeat protein precursor
  Pfam annotation: Domain name=LRRNT_2; Domain location=24-64; Score =50.4; E_value=6.2e-12; Accession=PF08263.3; Description=Leucine rich repeat N-terminal domain
  Pfam annotation: Domain name=LRR_1; Domain location=131-153; Score =19.7; E_value=0.01; Accession=PF00560.23; Description=Leucine Rich Repeat
  Pfam annotation: Domain name=LRR_1; Domain location=155-177; Score =12.8; E_value=1.1; Accession=PF00560.23; Description=Leucine Rich Repeat
  Pfam annotation: Domain name=LRR_1; Domain location=179-201; Score =21.7; E_value=0.0027; Accession=PF00560.23; Description=Leucine Rich Repeat
  Pfam annotation: Domain name=LRR_1; Domain location=203-225; Score =4.5; E_value=42; Accession=PF00560.23; Description=Leucine Rich Repeat
  Pfam annotation: Domain name=LRR_1; Domain location=227-249; Score =14.3; E_value=0.44; Accession=PF00560.23; Description=Leucine Rich Repeat
  Pfam annotation: Domain name=LRR_1; Domain location=251-274; Score =6.0; E_value=22; Accession=PF00560.23; Description=Leucine Rich Repeat
  Pfam annotation: Domain name=LRR_1; Domain location=275-294; Score =4.0; E_value=51; Accession=PF00560.23; Description=Leucine Rich Repeat
  Pfam annotation: Domain name=LRR_1; Domain location=299-321; Score =7.9; E_value=9.3; Accession=PF00560.23; Description=Leucine Rich Repeat
  Pfam annotation: Domain name=LRR_1; Domain location=323-346; Score =4.2; E_value=47; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=24 -64::131-153::155-177::179-201::203-225::227-249::251-274::275 -294::299-321::323-346
MASSLFFFLTLLLLSVISAVTPCPPSERAALLAFKAALIEPYLGIFNTWSGTDCCRSWYGVACDPTTGHVTDVSLRGESQDPMFQKLGRSGYMTGKISPEICNLSNLTTLVVADWKAVSGEIPACVASLYSLQILDLSGNRISGEISADIGNLRSLTLLSLADNEISGKIPTSVVKLIRLKHLDLSNNQLSGEIPYNFGNLAMLSRALLSGNQLTGSISKSVSKMKRLADLDVSSNRLTGSIPVELGKMRVLSTLKLDGNSMTGPVPSTLLSNTGMGILNLSRNGFSGTIPDVFGSGSYFMVLDLSFNNFSGRIPGSLSASKFMGHLDLSYNHLCGTIPIGSPLNTLMRRRLGKLKWTKSYEGAPGCMCIQVSIGQESSEYALCCMWVSELHVSLRAGYNVKDLDHDSIS

SEQ ID NO: 169233 - protein, 158 aa, Glycine max
  Coding DNA Sequence Number=SeqID_52455
FLEEARQHGKEAKLKSSSVHPEESRKTGSEKEKKGKKSWKSSLASWWKADKKSKHSEKTSNNSKLKDSGKKHAHSSGPMYRSSRSSDGKHWRPSSGPLVSLFKSTKKDENEIPYISLHQHNNSPPAEQNYGPLYVNFAGQCNRTTLCEKKNIIAFDFE

SEQ ID NO: 169234 - protein, 319 aa, Glycine max
  Coding DNA Sequence Number=SeqID_52456
  Gene Ontology: Mol. function=zinc ion binding; Cellular component =integral to membrane; Biological process=ubiquitin cycle
  Homolog annotation: Hit_ID=Q1SR68; Match level="QueryCoverage=99%, HitCoverage=96%, E-value=2e-81, Identity=52%"; Hit description=Zinc finger, RING-type
  Pfam annotation: Domain name=zf-C3HC4; Domain location=108-149; Score= 33.7; E_value=6.4e-07; Accession=PF00097.15; Description=Zinc finger, C3HC4 type (RING finger)
MSASDDTWGESGTIEITGKIMVVAIIFLFMVVVFVLVLHLYAKWFWWSMEENAAPQPRRRRRRRRFVFAPGQDPVIYETHQVGLDPSVLKSLAVLVFQPEEFKEGLECAVCLSEIVEGEKLRLLPKCNHGFHVDCIDMWFHSHSTCPLCRNPVTFESSKIEENNNVLGSSEDSSSSHEENSGGGSGLEPSNFPTNVLVWGNQTQVSSFGVSLEDSLEEKQEQGTSQCQQPPPCSPSPTPSSSSSSARGNVNGRCHGMLVIDIPNECTSSSLSPSGSRCAEDEVKSPMAVTLRSFKRLLSREKKLSPCSPSSVDVEQAQS

SEQ ID NO: 169235 - protein, 145 aa, Glycine max
  Coding DNA Sequence Number=SeqID_52457
MARTMLNDNLTPKHLWAEHTRKKGIQRLNKYEICIVEDDLMELIGTSYTNKMHLLFGSLSLKNSTVKKRLCHELLKVTVELSSSVGLSVHPLLNAASVRQENLAEHQYQLSSARLSAQLTLSSNPLTHAKREGGAKRNIADLEPI

SEQ ID NO: 169236 - protein, 142 aa, Glycine max
  Coding DNA Sequence Number=SeqID_52458
  Gene Ontology: Mol. function=lipid binding; Biological process=lipid transport
  Homolog annotation: Hit_ID=Q07A24; Match level="QueryCoverage=67%, HitCoverage=64%, E-value=6e-13, Identity=44%"; Hit description=LTP -like protein 2
  Pfam annotation: Domain name=Tryp_alpha_amyl; Domain location=35-117; Score=31.9; E_value=2.2e-06; Accession=PF00234.12; Description =Protease inhibitorseed storageLTP f
MVRDVKNGRALLVAFLMFLLASEVLILEAEGAGECGKTPIGSAAASLSPCLGAVSNVRAKVPLACCARVGALLKTAPRCLCAVLLSPLAKQAKINPATAITIPKRCNIRNRPAGKKCGNRRISSGSLLLAEMKLRLWRSQKP

SEQ ID NO: 169237 - protein, 126 aa, Glycine max
  Coding DNA Sequence Number=SeqID_52459
  Gene Ontology: Mol. function=small conjugating protein ligase activity; Cellular component=endoplasmic reticulum; Biological process=ubiquitin-dependent protein catabolic process
  Homolog annotation: Hit_ID=Q9SHI7; Match level="QueryCoverage=100%, HitCoverage=48%, E-value=5e-61, Identity=88%"; Hit description =Similar to Ubiquitin Conjugating Enzyme
  Pfam annotation: Domain name=UQ_con; Domain location=9-126; Score =64.3; E_value=4.1e-16; Accession=PF00179.16; Description=Ubiquitin -conjugating enzyme
MAEKSCIKRLQKEYRALCKEPVSHVVARPSPSDILEWHYVLEGSEGTPFAGGYYYGKIKFPPEYPYKPPGISMTTPNGRFMTQKKICLSMSDFHPESWNPMWSVSSFILMFSISECSILTGLLSFM

SEQ ID NO: 169238 - protein, 93 aa, Glycine max
  Coding DNA Sequence Number=SeqID_52460
  Homolog annotation: Hit_ID=Q69KL6; Match level="QueryCoverage=42%, HitCoverage=12%, E-value=4e-09, Identity=77%"; Hit description =Putative UDP-glucuronic acid/UDP-N-acetylgalactosamine dual transporter
MNYYKQAMMQPSLYHEEVSHSESLIGKRKEEEALHVSGLPYTVNHSESLILTTPKCRVALSVILTAAGVLIAALGDFSFDLFGYSMAFVSVLF

SEQ ID NO: 169239 - protein, 94 aa, Glycine max
  Coding DNA Sequence Number=SeqID_52461
MHLHSKNVVLVKVAWQGTTDKEMTWELKKVMREKYPQMFETQGYFDDAKESRVKKIFKQRFRNQVSSFKNQESRIIKIKIQDSRFKNQEKTQSR

SEQ ID NO: 169240 - protein, 435 aa, Glycine max
  Coding DNA Sequence Number=SeqID_52462
  Gene Ontology: Mol. function=aspartyl esterase activity; Cellular component=cell wall; Biological process=cell wall modification
  Homolog annotation: Hit_ID=Q43111; Match level="QueryCoverage=83%, HitCoverage=61%, E-value=1e-141, Identity=72%"; Hit description =Pectinesterase-3 precursor
  Pfam annotation: Domain name=PMEI; Domain location=71-233; Score =158.0; E_value=2.5e-44; Accession=PF04043.6; Description=Plant invertasepectin methylesterase inhibitor
  Pfam annotation: Domain name=Pectinesterase; Domain location=278-416; Score=-73.5; E_value=4.3e-16; Accession=PF01095.10; Description =Pectinesterase
  Pfam module annotation: Pfam domain module=PMEI::Pectinesterase; Domain location=71-233::278-416
MDTIKSFKGYGKVDELEQQAYQKKTRKRLIIITVSSIVLIAVIIAAIAGVVIHKRNTSSSPSSDSPPQTELTPAASLKAVCDVTQYPNSCFSAISSLPDSNTTDPELLFKLSLRVAIDELSKLSSFPSKLRANAEHDARLQKAIDVCGNIFGDALDRLNDSISALGSSGGAGKIISPASVSDVETWISAALTDQDTCLDALGELNSTAASGALREIETAMRNSTEFASNSLAIVTKILGLLSQFAAPIHHRRLLGFPEWLGAAERRLLQVNSSETTLDAVVAQDGSGQFRTIGEALKLVKKKSEKRFVVHVKEGRYLENIDLDKNTWNVFIFGDGKDKTVVVGSRNFMDGTPTFETATFGLMEKHVACGMWFSASGEHVKADPLSQNWLPATSFFYYYDPPSIMLFCASCMASHVNVCFTFTYVISSLSIHAVLS

SEQ ID NO: 169241 - protein, 378 aa, Glycine max
  Coding DNA Sequence Number=SeqID_52463
  Homolog annotation: Hit_ID=Q1RTC8; Match level="QueryCoverage=98%, HitCoverage=84%, E-value=1e-133, Identity=64%"; Hit description =Remorin, C-terminal region
  Pfam annotation: Domain name=Remorin_C; Domain location=322-376; Score=-21.5; E_value=0.058; Accession=PF03763.4; Description=Remorin, C-terminal region
MSMYGKSKDNPFADDFPDPLCKLNLKETSEFVKSLPLPLPMPNGRAESRGHSVSQQRRLLDSPSTPGRPVFTFSSGLPRKSFPSKWDDAEKWLMSTSCHDSPAHNNTTLKVSVSDSSKITTRQQHCGDDVVGFKQQMEGFSEKSRVTEERVSSKAVPNFPWSPSLDHHHNTLGSFNGVKDIVLKDKFTDSIEPVLPNLRYLEPAKEGFLFRNQGGGAMQDACTEVVQHRDIGTEMTPLGSSTTSRCHTPVKISSPPRHNTPASRSGPLALASSACTLDVIQLEECHFSKLQLGTQYDLVPLNWSSSEEEEKEISKSLRHNGSHKADSDCIAAAWEEEEKTKCCLRYQREEAKIQAWVNLQNAKAEARSRKLEVFYCHS

SEQ ID NO: 169242 - protein, 122 aa, Glycine max
  Coding DNA Sequence Number=SeqID_52464
MEVERICGWGGPWHGTVNLIESVGQGKVTVEAEGTEQKTEQGKSVLDLVGTGVYNNKYTNDLTHMKGAKNTVLSCVFTLQATMCCVVCHGSQTLLSLTLSFPISRTWMGRGRERKSTSSTQE

SEQ ID NO: 169243 - protein, 1789 aa, Glycine max
  Coding DNA Sequence Number=SeqID_52465
  Gene Ontology: Mol. function=phosphatidylinositol phosphate kinase activity; Cellular component=mitochondrion; Biological process =phosphatidylinositol metabolic process
  Homolog annotation: Hit_ID=Q1RTC2; Match level="QueryCoverage=99%, HitCoverage=99%, E-value=0.0, Identity=77%"; Hit description =Chaperonin Cpn60/TCP-1; Phosphatidylinositol-4-phosphate 5-kinase; Zinc finger, FYVE/PHD-type
  Pfam annotation: Domain name=FYVE; Domain location=31-103; Score =75.7; E_value=1.4e-19; Accession=PF01363.12; Description=FYVE zinc finger
  Pfam annotation: Domain name=PIP5K; Domain location=1521-1756; Score =183.6; E_value=4.7e-52; Accession=PF01504.9; Description =Phosphatidylinositol-4-phosphate 5-Kinase
  Pfam module annotation: Pfam domain module=FYVE::PIP5K; Domain location=31-103::1521-1756
MDAVDKTFSELVSIVKSWLPWRSEPVNVSRDFWMPDQSCRVCYECDSQFTLFNRKHHCRLCGRIFCNKCTTNSVPAPFSNQRNSWDELEKIRVCNYCYKQWEQGVVALDKSIPVSNLDNSASGSTSSVASSKTSATANSSNITLCSMPYSVGSYQPMQQGSVLNLHKSPVKEKDPDTDREGLSANGGRSDLVADLGDPLPKQYGFSINRSDDDEDEYGVYRSDSDMRHYPQVNNYYERAELDGIGNIDGSQKVDHDGESINAKLPSNYSFDTQGLEEAPVIAKIEDEPYICDENEAPSSLYVSEDVDAEPVDFENNGLLWLPPEPEDEEDEQEAILFDDDDDHDGNATGEWGYLRSSSSFGSGEYRHRDRSSEEHKTVMKNVVDGHFRALVSQLLQVENLPVEDNDKNSWLEIVTSLSWEAATLLKPDMSKGGGMDPAGYVKVKCITCGSRIESVVVKGVVCKKNVAHRRMTSKVDKPRLLILGGALEYQRVTNLLSSVDTLLQQEMDHLKMAVAKIASHQPNILLVEKSVSRYAQEYLLAKDISLVLNVKRPLLERVARCTGTQIVPSIDHLSSQKLGYCETFRVEKFLEDLNSAGQGADKDELKKVKHVVQYGVFAAYHLALETSFLADEGVSLPEIPLNSLALPDKSSFIQRSISTVPGFGVADNETPQGQEPDTEPQRTRSLTVADLASSTCSTGPCVSNGAFQSMPLGSSINHSTALYSSIVASGKSIPESHRNKLLSCTSRDTNEMDSKQPVVEETSRADNTVVGDDPTVDDLGSSEKLYQGMSADTPQNWNSKISKNQLSGSGSLSPIDVQNHPENLGITNEEPVLIKEEFPPSPSDHQSILVSLSSRCVWKGTVCERSHLFRIKYYGSFDKPLGRFLRDHLFDQSYQCHSCEMPSEAHVHCYTHRQGTLTISVKKLPEIILPGERDGKIWMWHRCLRCPRINGFPPATQRIVMSDAAWGLSFGKFLELSFSNHAAASRVASCGHSLHRDCLRFYGFGRMVACFRYASIDVHSVYLPPHTLIFDYGNQDWIQQESDEVVNRAELLFSEVLNGLSQIVEKRSNAVQVSNGHKSPELRRQVAELEGMLQKEKLEFEETLQKILNQEKRNGQPGIDVLEINRLWRQLLFQSYMWDHRLIYAANLVHSNNESGSCSPISEDKEKPTDENQMSINSIYGDLKLNDSPSHGGGSVVFDGKFSLDAVHQEIDMAKNKNHEKDAEHNLSNSKSINDQSNLLEPELGVRRALSDGPFPVIPSLSETLDAKWTGENHSGYGIQKDNSSVNPDILMADALTTSAQKEIYYLGDRTEDQKGHDNMEDSSSWLGMPFLNFYRQFNKNLFASTQKFDTLVDYNPVYVSCFRKQELLGGARLLLPIGVNETVIPVYDDEPSSIIAYALMSPEYHLQLTDEGERPREGNEFISSYFSDSGTLQSFSSVDETAFDSQKSFGSIEEMIFSMSGSRNSSILDPMLYTKAMHARVSFGVDGPLGKVKYSVTCYYAKRFEALRRVCCPSELDYIRSLSRCKKWGAQGGKSNVFFAKTLDDRFIIKQVTKTELESFIKFGPEYFKYLSESIGTGSPTCLAKILGIYQVTSKHLKGGKESRMDVLVMENLLFRRTVTRLYDLKGSSRSRYNADSTGKNKVLLDQNLIEAMPTSPIFVGNKAKRLLERAVWNDTGFLASVDVMDYSLLVGVDEEKHELVIGIIDFMRQYTWDKHLETWVKASGILGGPKNTPPTVISPKQYKKRFRKAMTTYFLMLPDQWSPPSIIPSHSQSDFGEDSTQPRTPAE

SEQ ID NO: 169244 - protein, 68 aa, Glycine max
  Coding DNA Sequence Number=SeqID_52466
  Subcellular localization annotation: CTP_CleavageSite=39; ConfidenceScore=5.62e-01
MHPIPYSAGPPRTSNTWVNPNSKSTGSVHNQPSAMLTNLASHGTAPAGSTWIPDSGASFHVIGDSQNI

SEQ ID NO: 169245 - protein, 156 aa, Glycine max
  Coding DNA Sequence Number=SeqID_52467
  Gene Ontology: Mol. function=protein serine/threonine kinase activity; Cellular component=nucleus; Biological process=response to high light intensity
  Homolog annotation: Hit_ID=P19243; Match level="QueryCoverage=87%, HitCoverage=91%, E-value=1e-28, Identity=47%"; Hit description=18.1 kDa class I heat shock protein
  Pfam annotation: Domain name=HSP20; Domain location=48-153; Score =81.3; E_value=3e-21; Accession=PF00011.11; Description=Hsp20alpha crystallin family
MSLLSSGGFFGRRRNEPPPHQPTWDPYQAQEHHPPPFMSPVLDTFHIEWKETPEAHVYKAHLPSYKRNDVRLEVDEDRVLCIVCDKSVEKEEQREGWHRVELSNGQFVQRLTLPENSMVDLVKAYMDNGVLTINVPKKHHRGVNNRVRNINISSRP

SEQ ID NO: 169246 - protein, 81 aa, Glycine max
  Coding DNA Sequence Number=SeqID_52468
MVEAEGGGVFVGFEGEGVEGVDVDVLVGLDDAAMETEGGGVFVEVTTMVQVGDIHKEDIFVDANLDLSDEIRRLDMTRIHS

SEQ ID NO: 169247 - protein, 312 aa, Glycine max
  Coding DNA Sequence Number=SeqID_52469
MVELERRNLHKCLANLQDRSIDVAVVKEFYANLYNLEDQSPKQVRVKGHLIKIDADSLNTFLETPVVLEEDGHPWKLLRKDLTTLAHTWSVLSYNNLTPTSHTSNLNMDRARLVYGLVTSMDMNIGALISAPSTSTTPTPAPPTSATPTPATQDSQLFEAMLQSIHQGKILLLQSLQLVAPPGSLLSVEQFIEKVTWLGTLPSAVREGEGPSAQATIPGAFDFLGAGVEMRLFFLSQLCQLYMRLLKQVADPLTPVHERQADPPTPIMEMPEDLTTPVLRLSSTPPATPVLHLTDEEGMQDTQGTQDQSQEF

SEQ ID NO: 169248 - protein, 184 aa, Glycine max
  Coding DNA Sequence Number=SeqID_52470
  Gene Ontology: Mol. function=sugar porter activity
  Homolog annotation: Hit_ID=Q1RTB8; Match level="QueryCoverage=80%, HitCoverage=23%, E-value=3e-57, Identity=72%"; Hit description=Sugar transporter superfamily
MDKYYKQQTRNNTSCQSTKQPDPSNKAIDKQTRENGTWNKPCTLKRNSKDGRAMIGGIVIEIHNQRLDELIVKRRNLQVILHDESELVIGIGPPGLQPLGLQAHIGRSVMHNLIPKLPIEAIDELQNSMRLEELGVDVGSVVGGEMVNVEMEVDAVGEVVGGGEGAEAAGERGEAVEGEELDEE

SEQ ID NO: 169249 - protein, 431 aa, Glycine max
  Coding DNA Sequence Number=SeqID_52471
  Gene Ontology: Mol. function=sugar porter activity
  Homolog annotation: Hit_ID=Q1RTB8; Match level="QueryCoverage=83%, HitCoverage=63%, E-value=1e-160, Identity=72%"; Hit description =Sugar transporter superfamily
MDYMVALVVALCLFNTSVQFIDNITGFWLQPWKEFRLWYDENKAKGNRPFLEGMVTTGWYKKMGERIWAPWFIKFIQSRGYFNIYTNLLHERALSVSHRDAGVNYGKTAGPDSKLLEEKEVHPGKVVTNLEELGSLLHSLQKQSSVFLVNLFGVSDAIARNLLCHFKRLDIRNYILMGPPSGSLFDLARRGHPVINVDQFISSVGLSKFTSHGSSFETIKGILTKAYVVKKCIENRYNMWVMDGSMLLTSDLLSESEPPNDDFFVANNLEVFYAKSSTFNQKIWVDGFVSRVVAMARKDSATHSSLSFVYVVTKLLEQNGARIRRVDETSFAAKIGSGSETSLRDKKLVYWSSEMELNSIQKWLEEFNLWSIDSVLSCTAVHSPEEYKRWGRGKARRGIEWRTRRHRRTTTTIDVPVNLVIDSARGGVYYG

SEQ ID NO: 169250 - protein, 98 aa, Glycine max
  Coding DNA Sequence Number=SeqID_52472
PNFLLLALEFGQESSNSSICRERNPADLNVKLLKPLCDERKFDQASNSSVTPQNAIIEGLDLNVKPSCDDQNSDQQVSSSSTPLNEEEEEKLDLNLKL

SEQ ID NO: 169251 - protein, 106 aa, Glycine max
  Coding DNA Sequence Number=SeqID_52473
  Pfam annotation: Domain name=DUF581; Domain location=59-103; Score =20.2; E_value=6.2e-05; Accession=PF04570.5; Description=Protein of unknown function (DUF581)
MLPKFIISPFKVESQEGKHVNKRRKHVRSFESTNMDVGLRLLPQITSSKNTSNVLLKSAMRKTNQQSIPQDFCFLKTCNLCNKQLSPDKDIYMYSILGWEIKASAV

SEQ ID NO: 169252 - protein, 605 aa, Glycine max
  Coding DNA Sequence Number=SeqID_52474
  Gene Ontology: Mol. function=protein binding
  Homolog annotation: Hit_ID=Q4FX62; Match level="QueryCoverage=74%, HitCoverage=94%, E-value=3e-09, Identity=26%"; Hit description =Proteophosphoglycan 5
  Pfam annotation: Domain name=zf-C2H2; Domain location=46-68; Score =18.8; E_value=0.02; Accession=PF00096.16; Description=Zinc finger, C2H2 type
MEKTEMLKGEVQENVEKVQQQAPNEPPPPSPPPPPPPPPPGDNKSFRCWYCNAKLDSNNAVRRHMKFHQEQIEAEMMRIHIEGGGSSHQQPLVSYSEASSSSSRSLPHPGNQAYGESTSPQTPQFLSVMAHQVISGSSHQPLVSYSVGNHGQERINTSILSQARNTAMHQFQSLSDQEFGPENSSIWHLARNIAIHHRLQLFRAQRNTGSSHQPLVSYSSQNFGQETSSNASILPQTQNISMRQFQSLMAQGISGSSHQPLLSNSAVPVRVQGLPSSRSHPNGNFGQESSNNASILPQTQNISMHEFQSLMARGISGPSHQPFLSNSAVPVRVQGLPSSRSHPDGNFGQESRNNASTLPQTQNISMHEFQSLMARGISGPSHQPFLYNSAVPVRVQGLPSSRSHPNGNFGQESSNNASILPQTQNISMHEFQSLMARGISGPSRQPFLSNSAVPVRVQGLPSSRSHPNGNFGQESRISSIRPQIASIGSASHQQYHNSHQPLVTSSSRSHPSLSYEGSSGQESDSSAIRPQNASIEWRCDKRKFGQERSPADSNADKRLKPLCDDREFDQIRSSSVIVPQNEITEGEGPDYDLNVKPSCNDENSG

SEQ ID NO: 169253 - protein, 914 aa, Glycine max
  Coding DNA Sequence Number=SeqID_52475
  Gene Ontology: Mol. function=zinc ion binding; Cellular component =intracellular
  Homolog annotation: Hit_ID=Q7Y245; Match level="QueryCoverage=11%, HitCoverage=98%, E-value=1e-50, Identity=88%"; Hit description=Fiber protein Fb21
  Pfam annotation: Domain name=ARID; Domain location=725-847; Score =9.3; E_value=1.9e-05; Accession=PF01388.11; Description=ARIDBRIGHT DNA binding domain
  Pfam annotation: Domain name=PHD; Domain location=838-892; Score=5.2; E_value=0.017; Accession=PF00628.19; Description=PHD-finger
  Pfam module annotation: Pfam domain module=ARID::PHD; Domain location= 725-847::838-892
  Subcellular localization annotation: CTP_CleavageSite=30; ConfidenceScore=5.28e-01
MITQTIIKRTTGEDVNPESASSLPSIFFLVQSSSSNPNPSIALGFSQFQFPSPAPPLPLPFILDRQLSASKRCNAPSQFLRSFAKRRFSSVEETSELSRVGVQSSALGISPSFFFSLSVRVCVCSVLRFARTMFPFHSQGTPKHTCTLLAVTCRTSSAEHKLSHAQRTYPFPELVSAGRLEVQTLCSPEKEQFRKVLESFQPNFVYLRGDQLENGEVGSLVWQGVELSTCEDITELFGSTLPTAVYLEIPNGESFAEALHLKGIPYVIFWKNTFSCYAACHFRQAFLSVVQSSSTHTWDAFHLARASFELYCVQNNQVLPSDSDDASSEMGPHLLGDCLKINVDPPEIDEEDDDESSSGSLPAIKIHEDEVNLRFLICGAPSTVDESLLRSLEDGLRALLTIEIRGCKLHGKFSAPPPPLQAAAFSRGVVTMRCDISTCSSAHISLLVSGSAQTCFNDQLLENHIKNEIIEKSQLVHAQLNNEGNKENICEPRRSASIACGASVFEICMKLPQWALQILRQLAPEVSYRSLVALGIASIQGLPIASFEKDDAERLLFFYQNCEKDSCTNKNNIIFSSPPGWLKPPPPTRKRCEPRQEASPGLHEGVFAGQGGVCKLNEEEKDRKIVNGISMPLTPARQRLKVSAMRPIPHIRRHRMTPFCGPSETDGFDGTQVEAILPLVAPTKRTSIGSTSGTHRKSFSSAAQSKQVISLNPLPLKKHGCGRGPVQTCSEEEFLKDVMEFLILRGHNRLIPQGGLTEFPDAILNGKRLDLYNLYKEVVTRGGFHVGNGINWKGQIFSKMRNYTTTNRMTGVGNTLKRHYETYLLEYELAHDDVDGECCLLCHSSAAGDWVNCGICGEWAHFGCDRRQGLGAFKDYAKTDGLEYICPHCSVTNFKKKQNVANGYSQGSMSSRPL

SEQ ID NO: 169254 - protein, 535 aa, Glycine max
  Coding DNA Sequence Number=SeqID_52476
  Gene Ontology: Mol. function=metal ion binding; Cellular component =integral to membrane
  Homolog annotation: Hit_ID=UPI00001633C9; Match level="QueryCoverage =49%, HitCoverage=93%, E-value=1e-61, Identity=45%"; Hit description =ubiquitin-protein ligase/ zinc ion binding
  Pfam annotation: Domain name=C1_4; Domain location=443-483; Score= -11.4; E_value=0.063; Accession=PF07975.2; Description=TFIIH C1-like domain
  Pfam annotation: Domain name=IBR; Domain location=419-481; Score =41.3; E_value=3.2e-09; Accession=PF01485.11; Description=IBR domain
  Pfam annotation: Domain name=SRF-TF; Domain location=19-71; Score =66.6; E_value=8e-17; Accession=PF00319.9; Description=SRF-type transcription factor (DNA-binding and dimerisation domain)
  Pfam annotation: Domain name=zf-C3HC4; Domain location=351-400; Score= 10.5; E_value=0.013; Accession=PF00097.15; Description=Zinc finger, C3HC4 type (RING finger)
  Pfam module annotation: Pfam domain module=C1_4::IBR::SRF-TF::zf -C3HC4; Domain location=443-483::419-481::19-71::351-400
MNVIATRTANKKRGEIEMKEVEQRNRRHVTFSKRKLGLFNKLTELSVLCQVEAAVIITSQNGKFYSCGYPDPDAVVRRYLTGGPPLRRNPADNRGQHDLLEKQRLEYEAIQNQLKEEKKRLEEIQGTRNNNGFFFAAPWWNLPAEDIGFEDLQQFKTSLECLKFNLIGALQEKQMNSVPSMQPSTVPPPMPYTVVPPMSSTMVPPISQFFSAQRFSRNQVQGDDYRRSGAIASTSSSTFASSGFGSQENYSTQGTSTASMTLPSTPEDHHLLVDDFYFSALYDAEEIFPISDEKYAEELQLQEALYSSIISSTTKVKNEVIQVNVDVDGDTPLRTLKKKHKEIGESSQVYCGICMDAKSGEEIFRNRNCSHSFCSDCIGKYVTAKIQENISTVKCPDTKCKEVVEPQYCRSIIPKEVFDRWENAIFENSVLRSQKFYCPFKDCSAMYIRDAGEVVTVSECPYCNRLFCAQCKVPWHSEIGCNEFQNLKKYEREREDLMVMELAKNKNVAMNFAMSVDPLGVVNTITVNLFKKYAG

SEQ ID NO: 169255 - protein, 776 aa, Glycine max
  Coding DNA Sequence Number=SeqID_52477
  Gene Ontology: Mol. function=identical protein binding; Cellular component=cellulose and pectin-containing cell wall; Biological process=negative regulation of enzyme activity
  Homolog annotation: Hit_ID=Q8LGA0; Match level="QueryCoverage=98%, HitCoverage=98%, E-value=0.0, Identity=72%"; Hit description =Subtilisin-like serine protease
  Pfam annotation: Domain name=PA; Domain location=363-467; Score =105.6; E_value=1.4e-28; Accession=PF02225.12; Description=PA domain
  Pfam annotation: Domain name=Peptidase_S8; Domain location=113-607; Score=62.7; E_value=1.2e-15; Accession=PF00082.12; Description =Subtilase family
  Pfam annotation: Domain name=Subtilisin_N; Domain location=29-105; Score=71.8; E_value=2.2e-18; Accession=PF05922.7; Description =Subtilisin N-terminal Region
  Pfam module annotation: Pfam domain module=PA::Peptidase _S8::Subtilisin_N; Domain location=363-467::113-607::29-105
MAPFGSLVILPFLLIATVTCSTSEKENSKTFIVQVHHQTKPSIFPTHKHWYDSSLSSISTTASVIHTYDTVFHGFSAKLSPSEAQKLQSLGHVITLIPEQLRSLHTTRSPEFLGLTTADRTGLLHETDFGSDLVIGVIDTGIWPERQSFNDRDLGPVPAKWRGKCVAGQNFPATSCNRKLIGARWFSGGYEATNGKMNETTEFRSPRDSDGHGTHTASIAAGRYVSPASTLGYAKGVAAGMAPKARLAVYKVCWNGGCFDSDILAAFDAAVSDGVDVASLSVGGVVVPYHLDVIAIGAFAAASAGVFVSASAGNGGPGGLTVTNVAPWVTTVGAGTLDRDFPANVKLGSGKIVPGISIYGGPGLTPGRMYPIVYAGVEQFGGGGDGYSSSLCLEGSLDPKFVKGKIVVCDRGINSRAAKGEQVKKNGGVGMILANGVFDGEGLVADCHVLPATAVGATAGDEIRSYIGNSRTPATATIVFKGTRLGVRPAPVVASFSARGPNPVSPEILKPDVIAPGLNILAAWPDHVGPSGVPSDGRRTEFNILSGTSMACPHVSGLAALLKAAHPDWSPASIRSALMTTAYTVDNKGDPILDESTGNVSSVFDYGAGHVHPVKAMNPGLVYDISSNDYVNFLCNSNYTTNTIRVITRRNADCSGAKRAGHSGNLNYPSLSAVFQLYGKKRMATHFIRTVTNVGDPSSVYKVTVKPPRGTVVTVKPDTLNFRRVGQKLNFLVRVQIRAVKLSPGGSSVKSGFIVWSDGKHTVTSPLVVTMQQPLD

SEQ ID NO: 169256 - protein, 99 aa, Glycine max
  Coding DNA Sequence Number=SeqID_52478
ETAASRHPPPPHHEEFVEPPIPEVSVTTDLPTHSVVHCEGCQGMAQDLGAIAEDLERVINLRMVTEGTNIHDIMTRCLMRARGDTVDGSLRPRQRRRID

SEQ ID NO: 169257 - protein, 141 aa, Glycine max
  Coding DNA Sequence Number=SeqID_52479
  Gene Ontology: Mol. function=methyltransferase activity
  Homolog annotation: Hit_ID=Q012S8; Match level="QueryCoverage=70%, HitCoverage=28%, E-value=3e-18, Identity=42%"; Hit description=[R] KOG2782 Putative SAM dependent methyltransferases
MKQVIRGHPELKYLVGMDVDSLAHDIAQPRLDAVLNAGVKAITVLRNFRDVKSVLREIAELHLLGVDAILMDLGMSSMQVDDPARGFSVLGDGPLDMRMDPQSLCYVSMVKSIPRHTSMSKWFGFSRQGCMLEGKYGVYNH

SEQ ID NO: 169258 - protein, 235 aa, Glycine max
  Coding DNA Sequence Number=SeqID_52480
  Gene Ontology: Mol. function=ferric iron binding; Cellular component =nucleus; Biological process=aromatic compound metabolic process
MNLEGKTKDSIKSRFDLECMGIRPGLHATMVEEVDLKVPDGYSSNVSRCIDVQDGKISGMKCHDSHVFLHRYLPLVICGVLRKEVYEARIVGPVQCRWMYPIERYLRRLKSYVKNKARPEGSIAEGYIAQECLHFYSRCLHGVETRLNRPGRNYEGDLDKLEISKLKIFSQVGKPLLRKKYVELSLVECMQARIYVLQNCDEVSPFIKLHKEELEKANSQNMEQSDAILPPKGIG

SEQ ID NO: 169259 - protein, 61 aa, Glycine max
  Coding DNA Sequence Number=SeqID_52481
EGDILTTCVFAVFHLVLLFVVKEVFGLWKAKSSVGSSLGNWSDSKVLDRTGLSCCAITRNR

SEQ ID NO: 169260 - protein, 137 aa, Glycine max
  Coding DNA Sequence Number=SeqID_52482
IMETRGLGRVLSRVIGRALEREDNHHLDDVPQQRRPTTSARRQQEVAAIVEDVPHVDDVAEEEHPELKLSSHGRKVQKFGKPATEIKGLVAVTGLSPLIACSLNTDDRGLILAFFREVAQGDEQFPSSSRRGHHHPR

SEQ ID NO: 169261 - protein, 294 aa, Glycine max
  Coding DNA Sequence Number=SeqID_52483
  Homolog annotation: Hit_ID=Q6ZQQ3; Match level="QueryCoverage=76%, HitCoverage=75%, E-value=4e-10, Identity=23%"; Hit description=CDNA FLJ46317 fis, clone TESTI4041832
MEIALGNHFAWLQTHWWRMHERQSIHGAPNKSGEWRIALGNHFAWLQTHWWRMHERQSIHGAPNKSGEWRIALINHFARLQTHWWRMHERQSIHGAPNKSGEWRIALGNHFAWLQTHWWRMHERQSIHGSPNKSGEWRIALGNHFAWLQIHWWRMHERQSIHGAPNKSGEWRIALGNHFAWLQTHWWRMHERQSIHGAPNKSGEWRIALGNHFVWLQTHWWRMHERQSIHGVPNKSGWQDRMRKLGVSVFSSLFMWGGISPVENDFEWQFERKNHQKWVFLCPQSLTLPKIYLV

SEQ ID NO: 169262 - protein, 133 aa, Glycine max
  Coding DNA Sequence Number=SeqID_52484
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=9%, E-value=2e-33, Identity=50%"; Hit description=Chromo
TSIEDHLQHLELAFQTQVEYLGHLVSQRGVEPLAAKVAAIQQWVSPRTTKALRSFLGLAGFYHRFIRGYATIAAPLVKATTIDPFQWSSTTQSAFDQLKLALSTAPVLALPDFQSPFTVETDASGIGMGVVLS

SEQ ID NO: 169263 - protein, 49 aa, Glycine max
  Coding DNA Sequence Number=SeqID_52485
MCEVLKVPFLQIVEKLSIKEKKTLKPRALREEGYPISLEQDHFGIYRVT

SEQ ID NO: 169264 - protein, 203 aa, Glycine max
  Coding DNA Sequence Number=SeqID_52486
MVGKDLGSTGNPHFVQVQNKHAFLPYGLPPNYTPPNENVNNSTPILIESQKPQSDHAHVSQPMGGTHEMPHHNLVNFEPCLKYATEGQIVGGEPLPNTSEGPHFRPQPQPLHFVVGRAPPAMAENRKLDRIEERLRVVEGSRDYAFANMAELCLVHDVIIPSKFKVSEFDKYKGTTCPKNHLKLYCWKMEAYAKDEKLLMHFF

SEQ ID NO: 169265 - protein, 106 aa, Glycine max
  Coding DNA Sequence Number=SeqID_52487
RERLRAIKGGGDYAFADIAKLCLVPNVVIPPKFKVPDFDKYKGTTCPKNHLKMYCREMGAYAKDEKLLMHFFQESLTGAAITWYTNLELSRVHSRKDLMVAFIRQY

SEQ ID NO: 169266 - protein, 189 aa, Glycine max
  Coding DNA Sequence Number=SeqID_52488
  Gene Ontology: Mol. function=helicase activity
  Homolog annotation: Hit_ID=Q1SRJ5; Match level="QueryCoverage=83%, HitCoverage=21%, E-value=4e-39, Identity=45%"; Hit description =Probable helicase [imported]-Arabidopsis thaliana-related
MLRKYKQIVTAVVVYDANGALEKPITQNDEIKEYLDCRYISPCEATWRIFGFPIHARKPVVERLHFHLSGQHSVLYEDDDDIDDILSKPSISNSKFLAWMNSNKCFSEDRSWNLRKKGNTIGRLIWVPPTTGELFYLRMMLTTCKGPTSFEDIRTVENVLYPTYREACFAMGFLQDDREFVEAIKEAKD

SEQ ID NO: 169267 - protein, 86 aa, Glycine max
  Coding DNA Sequence Number=SeqID_52489
MSDANGEIEPSTNRVEWELRVLVCRDCYDNSVAVSRPGYPGQLPRLWLRHWSEDQAGQELKLPDLLNSDAVREIHANIEKEWDFLQ

SEQ ID NO: 169268 - protein, 699 aa, Glycine max
  Coding DNA Sequence Number=SeqID_52490
  Gene Ontology: Mol. function=RNA-directed DNA polymerase activity; Cellular component=chromatin; Biological process=RNA-dependent DNA replication
  Pfam annotation: Domain name=rve; Domain location=377-533; Score =104.2; E_value=3.8e-28; Accession=PF00665.16; Description=Integrase core domain
  Pfam module annotation: Pfam domain module=RVT_1::rve; Domain location=1-162::377-533
LLVKKKDGTWRMCVDYRSLNAVTVRDRFPIPTIDELLDELGNASWFSKLDLKQGFHQILMHEADVEKTSFQTHQGHYEYLVMPFGLCNAPSTFQATMNLLLAPFLCRFAAVFFDNILNQLEYLGHIVFGKGVTPEPSKLQAITEWPIPTTAKELRAFLGLTGFYRKFIQKYAAIASPLTRLLCKDSFEWDTESQAAFDHLKSAMTSALVLALPNFNEPFTIETDASGSTMGAVLMQQGHPLAFFSKNFTLRLLHASTYVKELHAIIAAVRKWRQYLLGRPFTILTDHKSLRELLPPDSGQLLLLSVPPLDFLHDIQHALEADPTFQELVRNIKDDPSAFFWEGLRHDVKKFIRECKVCQQHKSSTKRMAGLLQPLPAPTGVWEDISMDFITHLPPSHGFTVIFVVVDRFSKGVHLAALPMGFSAFKVATVFLDIVCKHHGFPRSIVSDRDPVFLNTFWKELFRLSGTRLRLSMAYHPQSDGQTEVMNRVLEQYLRCFVSSQPSTWFRYLSLAEWSYNTLLHSSSGLTPFEVIYAKPPPAIPHYIPGSTNNEAVESLVTSRQAIHVKLLKTLQKAQDSMKKYADTKREEVTFSEGQWVYVKLHLARQRSVTGATHSKLSKCYFGPFRILARVGVVAYRLDLPDEARIHPAGQPPEDTSWEPWKELQVVYHLEDKVVFVGGGIVSNHAASIEDEPHTTIRP

SEQ ID NO: 169269 - protein, 84 aa, Glycine max
  Coding DNA Sequence Number=SeqID_52491
  Subcellular localization annotation: CTP_CleavageSite=34; ConfidenceScore=5.46e-01
MTMRPISHFSSLSLYSSPNLHHSSHSSSSSQCLSSSLVLNELPSDFELNNGVIGLTWKAKDQRDSTNSSMNYDFGSVIRAEAHC

SEQ ID NO: 169270 - protein, 87 aa, Glycine max
  Coding DNA Sequence Number=SeqID_52492
  Subcellular localization annotation: CTP_CleavageSite=13; ConfidenceScore=5.18e-01
MVTIVVRTTIMTMAMMVGNDSCEALCRASTSSSLFPHQKITSPLMCLMPRSERSEVRISGPNPIWVIKVVGAMKVVMCVIEKWRIWV

SEQ ID NO: 169271 - protein, 110 aa, Glycine max
  Coding DNA Sequence Number=SeqID_52493
MEIALGNHFAWLQTHCWTMHERQSIHGATNKSGEWRIALGNHFAITSRGSRLIGGGCMNDNQFMGLRIKAENGELHLAITSRGSRLIGGGCMNDNQFMGLRIKLENGELH

SEQ ID NO: 169272 - protein, 185 aa, Glycine max
  Coding DNA Sequence Number=SeqID_52494
  Gene Ontology: Mol. function=protein binding; Cellular component =nucleus; Biological process=defense response
  Homolog annotation: Hit_ID=Q2L360; Match level="QueryCoverage=82%, HitCoverage=21%, E-value=4e-23, Identity=39%"; Hit description =Putative CC-NBS-LRR resistance protein
  Subcellular localization annotation: CTP_CleavageSite=52; ConfidenceScore=5.05e-01
MAHADSKRLLDAEDVWDGFECQNLRKQVVKASGSTRMKVGHFFSSSNSLVFRLSMARQIKHVRCRLDKIAADGNKFGLERISVDHRLVQRREMTYSHIDASGVIGRDNDREEIIKLLMQPHPHGDGDGDKSVCVIPIVGLGGMGKTTLAKLVFNDKRIDELFQLKMWLLPQLHQLLLLTMKALTT

SEQ ID NO: 169273 - protein, 290 aa, Glycine max
  Coding DNA Sequence Number=SeqID_52495
  Homolog annotation: Hit_ID=UPI0000E450BE; Match level="QueryCoverage =40%, HitCoverage=37%, E-value=1e-18, Identity=45%"; Hit description =putative phage replication protein
MSSRSSHLDNRKQGHFAMFRSALNAPWSKDTAKLALWVRLLGEARYKPGINEFAGREWKLEAGQLVTTTTVLARKLRDQDGKEKSPKAVERMLNFFCKENMITKEGNPFGLVISITNYCEYQGISGVEPSVVPSVEPKSSNGAALKLVAVEGFVEPSVEQNKKVLNKNNKTPLNPPEGVEALALDCLDYYNSLAGARCSSPEAFVKVLSTVKAKGICYSVDDLKLVIKWAVTCWDARKTPPKPNNICRMTRFDGYLSDALGWADGQGSNPAACPHAEIIALWNEKFPAKA

SEQ ID NO: 169274 - protein, 109 aa, Glycine max
  Coding DNA Sequence Number=SeqID_52496
MMIGCGITWMLWKLGRIDGDPTLRGTRIRATWEYVSSVGGGQQGMEAKRASGNRLPGLEMRAACFGGPGNRLPGCVIDYTEEHATGNRLPVRCNRLHSAFLQVSCPEAV

SEQ ID NO: 169275 - protein, 210 aa, Glycine max
  Coding DNA Sequence Number=SeqID_52497
MRVELETKDKVLEMARIKEEATKLQASRRYSTKAQLGGPIQGRIKPRQQSIQATGPRWFQRGSKGLSNPRSALGESPFSKGSSTSRSALGESRFSKGSSNPRSSLGESRFSKYSSKPRSALGEFHSSKGSPNLSEKLEECQGIIRDSAIAAGTHVSLLRGVATYPSAGGRRETRGMRVPRKEYARSRHQRLFEENVGKTGKDAIYELLSE

SEQ ID NO: 169276 - protein, 158 aa, Glycine max
  Coding DNA Sequence Number=SeqID_52498
  Gene Ontology: Mol. function=RNA-directed DNA polymerase activity; Cellular component=mitochondrion; Biological process=RNA-dependent DNA replication
  Pfam annotation: Domain name=RnaseH; Domain location=35-148; Score= -33.9; E_value=0.084; Accession=PF00075.14; Description=RNase H
MKFPTLTGEIVTAKADQKQARQCYAESLKMAPYPPTREDGGMVYRTFRVRSSAPKLNFKASNNQVEYETLIVGLNLAKEVRAKKLRFYTGSQLVQGQAAKRYQPKEIVLIKYYHIAKTLIDNFKCFEKYCIPTKRNTRVYLLSKMASTKKIRHLKTII

SEQ ID NO: 169277 - protein, 154 aa, Glycine max
  Coding DNA Sequence Number=SeqID_52499
MAGEVLIEPCALLGFKSKMLLDKLFDGFGTLSQPTLSGRATRGLTSASSKEGKRVESPPTFIRWFKSKMLLDKLFDGFGTLSQPTLGGKATRGLTSASSKEGKRAESPPTFIRWFKSKMLLDKCHTLISSGDYYLMTCNLWLAALRYLASFVAQ

SEQ ID NO: 169278 - protein, 32 aa, Glycine max
  Coding DNA Sequence Number=SeqID_52500
MAKRCSAGLSYFDSWSWGSSIAFYKMRMHVLP

SEQ ID NO: 169279 - protein, 113 aa, Glycine max
  Coding DNA Sequence Number=SeqID_52501
MKKTRGVATNVYSRPKRGLRILKVRVRELFTHGEERIVKALDLETISSDDEDMTKSKGKDPLEGLGGPMTRARARKSKEALQQVLSILFEYKPKFQGEKSKLVSCIMAQMEED

SEQ ID NO: 169280 - protein, 98 aa, Glycine max
  Coding DNA Sequence Number=SeqID_52502
MADETESLVSFPEAHKGLMADASSSNFTPQFDYITEDYNMGFTPREKVITLWTSAVIRHYRVNHESHVSNNQDMIARAETYIGDIARACWESFKQTFP

SEQ ID NO: 169281 - protein, 70 aa, Glycine max
  Coding DNA Sequence Number=SeqID_52503
MVFWFSCTMWMKKKCLKEGSIGEEARSGHFHCHIRTRPGQGDKVEGEAVEGAAQTAEGVEGMRALIAGLS

SEQ ID NO: 169282 - protein, 465 aa, Glycine max
  Coding DNA Sequence Number=SeqID_52504
  Gene Ontology: Mol. function=transporter activity; Biological process= transport
  Homolog annotation: Hit_ID=Q1RF90; Match level="QueryCoverage=96%, HitCoverage=79%, E-value=1e-124, Identity=50%"; Hit description =Hypothetical protein ybaE
  Pfam annotation: Domain name=SBP_bac_5; Domain location=56-387; Score= 76.4; E_value=8.7e-20; Accession=PF00496.12; Description=Bacterial extracellular solute-binding proteins, family 5
MLRPLMGGQWQNQAPVLRIPYYRAMEALDPLQLTGRAEQHLVRQIFSGLTRFNADDVEGDLAHHWQHDAQGREWYFWLRPLLSWHNDEPVQAAQLVQQLQRIMQTPQGGRLLAAVEHIDAPHPLALRIRLRTSDYWLPQRLAHQFCLLPHPEHADIGSGPWRLTHFTRELVRLESHARWHHQRPLIQVVEYWITPQLFDRGLGTSCRHPVQIAIGDPDELDTLRPVDRSISLGFCYLAPRFSARFSQAQAKTLLALIQHSGVIQQLPLDEGLITPTAELLPGWPLPAPHRPEGTLPATLTLHYHLPIELHVMAQALVPLLAAQGCTLTCVFHDVKSWRDDIDLSDADIIMGDRLIGDAPQFTLVNWLENDAAWQPLRPAVLQAPLHAIARQASPALRSAAIHQLFQQLMRDGHLLPLFNYRYQVFAPPGVEGIQLNSMGWFDFTRAWIPPPAAGGAVQPAPEPVP

SEQ ID NO: 169283 - protein, 158 aa, Glycine max
  Coding DNA Sequence Number=SeqID_52505
MFKKECETFKEYAHRWRDLAAQVAPPMVERGMITMMVDTLPMFYYEKMVGYMPSSFADLVFAGERIEVGMKRGKFDYVSSTSTHAKRVGATGAKRKEGVATCPFAGGRRVTRGMRVPRKEYARSRHQCLFEENVGKTEGKPVKKKILSSGVVFTLEEG

SEQ ID NO: 169284 - protein, 115 aa, Glycine max
  Coding DNA Sequence Number=SeqID_52506
MAPDKTQLQNMSKREHESFKEYAQRWRDLAALSVFYYEKLVGYMPSSFADLVFAGERIEVGLKRGKFDYVAPAGTSNRRFGATGAKKKEGDAHAVISTPTWPKPQQTPHNTYQYA

SEQ ID NO: 169285 - protein, 684 aa, Glycine max
  Coding DNA Sequence Number=SeqID_52507
  Gene Ontology: Mol. function=RNA-directed DNA polymerase activity; Cellular component=chromatin; Biological process=chromatin assembly or disassembly
MTEEVLDSICGQLQVSKQCDDIKDLRKMMKMLMEQKDIMYNDANNASTEQNSGLEDEESATESEPLSTSEDEASESETDSILNSSRHYWAKGVKMPMFEGENPLGWITEMPCTGSSIGGIRRSGKEISTKIRPHKPKDLSSAMELVADFKEAEKEGNPVVELRSRGFHFQHKGGMWIHSVGGSVTNTFHNTQRQNRTLRGDVRSSSNVMAANQRPFVAGHKCLEKNLRLLILAEDEWINNEGEIIRLEGELENTVDNTGETEVEYQWMDLFVCSAGGFTQPQTMKLEGLIQGKRVLILIDSGACHNFISQELVQQLSLKVTPTQTDGVRLGDGNRKNAQGCCEQMELGDVKLNWKSLTMEFKQQGKLVKIQGDPKLLRTKVSLQSICKHTDVELAMFLWVLDTADTQETVQYGVDHAIPIRTGTDPINVRPYRYPYLQKNEIEKQVSGMLEAGIIRTNNSPYSSPMILVKKKDGSWRFCTDYRALNKVTIPDKFPILVIEELLDELKGARYFAKIDLKAGYHRIRMKLEDIHKTAFRTHQGHYEYVAMPFGLSNALATFQCAMNSTLQPFLRKFVLVFFDDILIYRASWEDHLQHLRTVLATLVQHEFTANLKRCNFGQQEIEYLGHIISTKGLAMDTRKIEAVLQWPLPKSVKSLRGFLGLAGYYRRFIEGYGKIARPLTNLL

SEQ ID NO: 169286 - protein, 83 aa, Glycine max
  Coding DNA Sequence Number=SeqID_52508
MNTSAHAKEQDDNKPLWNYVTILRVLGSGNFEIKDNMCEDITKDEFGSRDENGIVEVANLSLDEPELEVVFFNEDDQEGSGRT

SEQ ID NO: 169287 - protein, 57 aa, Glycine max
  Coding DNA Sequence Number=SeqID_52509
MIWEPCAKLVMATARWVLKHPVYGIVILRLGIYTRRRSKMKTLHGSGISTNTIDNNE

SEQ ID NO: 169288 - protein, 219 aa, Glycine max
  Coding DNA Sequence Number=SeqID_52510
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-27, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MRGLHAFAFRGLHVLTFRGLHVLAFRGLHVLAFVGLHALTFRGLHVLAIRGLHVLTFRWLHVLAFRGLHVLTFRGLHALTFRGLHVLTFRGLHVLAFRGLHTLSFRGLHALTFRGLRVLTFRGLHPLAFRGLHVLTVRGLHAIAFVGLYALTFRGLHVLIVRGRNILFFRGPNIVIFRGLHVLTVRGLHALASEGYMSSPSEDYMSSPSKDNTSSHLPS

SEQ ID NO: 169289 - protein, 552 aa, Glycine max
  Coding DNA Sequence Number=SeqID_52511
  Gene Ontology: Mol. function=calmodulin binding
  Homolog annotation: Hit_ID=Q1T1F5; Match level="QueryCoverage=99%, HitCoverage=83%, E-value=1e-110, Identity=39%"; Hit description =Calmodulin-binding, plant
  Pfam annotation: Domain name=CaM_binding; Domain location=4-77; Score= 95.1; E_value=2.2e-25; Accession=PF07839.2; Description=Plant calmodulin-binding domain
  Pfam annotation: Domain name=CaM_binding; Domain location=476-552; Score=63.0; E_value=9.8e-16; Accession=PF07839.2; Description=Plant calmodulin-binding domain
  Pfam module annotation: Pfam domain module=CaM_binding::CaM_binding; Domain location=4-77::476-552
MGTKPDQRTPRSWSNLKKLILLKRFVNALEKHQTAEEKKNAEEWMLDYALQKVVSKLAPAQRQKVTLLVKAFETILPFQVAENSPRFSPTMEPQANLVQPLDNSSNHSEEETSFSHDSSMELTENTSDDPMPELHNPTTLKERCLESLDFPGTETVKNMPAFGATEEDLSGKQSLAGSYDNEEKISSDSDNIYLGEIKDTTSSSLNEPVEIIRSSHEEALTNETVNDVPEDLLSSVNTENPDIKSESPGRDVETKNLNGDNGEKFSMSKSLVLEGLVRSLRSNLIGLGAPVNEPTANDRKEGIENVKQETETLEEFPTKEQYEAHISAVVEPETPVEKHNNTGLWYLVYKHMASNMDENNSESLIDGADKNESGFDGSRKRGASFSHESTPVTDQEMKFKDHVVADPEVAHQQNEAIKMVEEAIDSILPDDQDDLSDKESLNDSTISDNSKQSNRTERVYSEGLNQKEEKMESGNRMIQKQEESAPKEQNKTNQKMSTSWSNLKKVILLRRFIKSLEKVRKFNPRGPRYLSLEPDSEAEKVNLRHQDVEERK

SEQ ID NO: 169290 - protein, 86 aa, Glycine max
  Coding DNA Sequence Number=SeqID_52512
MTWVKCNTYESAKGNPIIVGSGALLKNAIDWASRPPNVWAGKAAAIVRAGAKFNDDGDLIDEEAKDKLKQVLLSLQAFTLRLQGKS

SEQ ID NO: 169291 - protein, 169 aa, Glycine max
  Coding DNA Sequence Number=SeqID_52513
  Gene Ontology: Mol. function=transferase activity, transferring hexosyl groups; Cellular component=integral to membrane
  Homolog annotation: Hit_ID=Q5TIM8; Match level="QueryCoverage=69%, HitCoverage=34%, E-value=2e-25, Identity=60%"; Hit description =Putative glycosyltransferase
MQWNLLQLLTRMCLSQGLGGESIRSEMRGVVRVEQLLVVGIKKVNVGSDLSEDVLGLLDEILVDNVIVGGAKVDTNGAAEDEDGNEAVDNGDLDVVESLLDLPVIGKHVFVVALRVVGWQAHASAALTMEPNESPTPMISSGGVPKLSHPVRPELQRYPLVVLTKVVKV

SEQ ID NO: 169292 - protein, 187 aa, Glycine max
  Coding DNA Sequence Number=SeqID_52514
  Gene Ontology: Mol. function=transferase activity, transferring hexosyl groups; Cellular component=integral to membrane; Biological process=electron transport
  Homolog annotation: Hit_ID=Q5TIM8; Match level="QueryCoverage=78%, HitCoverage=33%, E-value=1e-65, Identity=79%"; Hit description =Putative glycosyltransferase
  Pfam annotation: Domain name=Glyco_transf_34; Domain location=55-186; Score=2.6; E_value=2.2e-07; Accession=PF05637.3; Description =galactosyl transferase GMA12MNN10 family
MRMSKGRKPQQGVSQVPPKKRFHENRRYWMRDFLLVKENKNWLHQNPKYPNFVRGKPRILLLIGSPPKPSDNPIENHYLFKSIKNKIDYCRLHEIEIVYNLAHLDVEVVGYWAKLPMIQRLMLSHPEVEKIWWMDSDVFIIDMVFELLMSKYDEHNLVLHGYPDLLFEHKSWIAVNTYILQFKHSFS

SEQ ID NO: 169293 - protein, 265 aa, Glycine max
  Coding DNA Sequence Number=SeqID_52515
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LJN4; Match level="QueryCoverage=95%, HitCoverage=29%, E-value=8e-74, Identity=57%"; Hit description=Beta -1,4-xylosidase
MGQVVSTEARAMYNVDLAGLTFWSPNVNVFCDPRYVVMYVRGLEKVEDETSAKADRLKVSSCCKHYTAYDLDNWKGFDRFHFDAKVLLYHYSNFGSVCCHIIGLVASDKARLGGLVPTSVNSCVVEGHVNGIPTCADPGLLKWIIRGQRGLERYIVSDCDSVEVYYDVIHYIATPEDAMALALKVAFNMNWGDFLKKYTANAVNLKKSRCSNCRLGLALVYNYIVLMRLGFFDDPKSLPFANLGTSDDSKHHKGSKCIPGSVLDG

SEQ ID NO: 169294 - protein, 76 aa, Glycine max
  Coding DNA Sequence Number=SeqID_52516
  Homolog annotation: Hit_ID=Q9FKA2; Match level="QueryCoverage=93%, HitCoverage=54%, E-value=7e-18, Identity=72%"; Hit description =Arabidopsis thaliana genomic DNA, chromosome 5, P1 clone:MIJ24
MKKENVEVLVESENRVQRVEPANGVVYGVSGAMQLAEGEGVELGVRSGGEARAPPEITMTLVNGVEEVFDATATAS

SEQ ID NO: 169295 - protein, 51 aa, Glycine max
  Coding DNA Sequence Number=SeqID_52517
SHVQSGGYEYGYYVMHWMCNIRFGDGTPLDRETITTIHNKWAAYFVKVKDN

SEQ ID NO: 169296 - protein, 132 aa, Glycine max
  Coding DNA Sequence Number=SeqID_52518
NEDKGYVGVRELNLKVGNWGWRPWGRQIAMTTQLIHDRVVMECLEGVWETLEGNERCRFRGTIRLTATSLVSSSEEDPEEDPEELPPELAVDALDFPEDDEDPLPDVDSPEDIMTASEADSTEESGPGGTAN

SEQ ID NO: 169297 - protein, 125 aa, Glycine max
  Coding DNA Sequence Number=SeqID_52519
FLQKAVASGGSNPARLGELGFRPFFDVLHSFFTILQSSTGKYLKPSFSIHSMYPWWSTFGFIWPHENAERCPHKEGNPPGIPLASLLRQLDTVTKLLEKQIDVTLVKEFYSNIYDPEGGAQKYCK

SEQ ID NO: 169298 - protein, 89 aa, Glycine max
  Coding DNA Sequence Number=SeqID_52520
MITANTLPQTRSRLKAEFGSKMHENSFGHELSKQINNLIIGRNVYNSGGKASEMRRSCKRKMKAISCREDLNAKEVMKRPQVLHGEFRL

SEQ ID NO: 169299 - protein, 617 aa, Glycine max
  Coding DNA Sequence Number=SeqID_52521
  Gene Ontology: Mol. function=binding; Cellular component =mitochondrion; Biological process=metabolic process
  Homolog annotation: Hit_ID=Q6H7X0; Match level="QueryCoverage=66%, HitCoverage=97%, E-value=1e-137, Identity=45%"; Hit description =Putative pentatricopeptide (PPR) repeat-containing protein
  Pfam annotation: Domain name=PPR; Domain location=167-201; Score =24.5; E_value=0.00039; Accession=PF01535.11; Description=PPR repeat
  Pfam annotation: Domain name=PPR; Domain location=202-236; Score =30.1; E_value=7.9e-06; Accession=PF01535.11; Description=PPR repeat
  Pfam annotation: Domain name=PPR; Domain location=237-271; Score =40.4; E_value=6.1e-09; Accession=PF01535.11; Description=PPR repeat
  Pfam annotation: Domain name=PPR; Domain location=272-306; Score =45.9; E_value=1.4e-10; Accession=PF01535.11; Description=PPR repeat
  Pfam annotation: Domain name=PPR; Domain location=307-341; Score =52.0; E_value=2e-12; Accession=PF01535.11; Description=PPR repeat
  Pfam annotation: Domain name=PPR; Domain location=390-424; Score =36.2; E_value=1.2e-07; Accession=PF01535.11; Description=PPR repeat
  Pfam annotation: Domain name=PPR; Domain location=425-459; Score =29.0; E_value=1.6e-05; Accession=PF01535.11; Description=PPR repeat
  Pfam annotation: Domain name=PPR; Domain location=460-494; Score =22.7; E_value=0.0013; Accession=PF01535.11; Description=PPR repeat
  Pfam annotation: Domain name=PPR; Domain location=495-529; Score =40.9; E_value=4.2e-09; Accession=PF01535.11; Description=PPR repeat
  Pfam annotation: Domain name=PPR; Domain location=530-564; Score =41.7; E_value=2.5e-09; Accession=PF01535.11; Description=PPR repeat
  Pfam module annotation: Pfam domain module=PPR::PPR::PPR::PPR::PPR::PP R::PPR::PPR::PPR::PPR; Domain location=167-201::202-236::237-271::272- 306::307-341::390-424::425-459::460-494::495-529::530-564
MLPIVSCYMLSWLNSICTLSHTLIEPRACMNDSEWKANDSNSVALEKFKRDSVYIDKNGRLRNFNHKKVSRKKCGSLRGRGWKYGSGFVDGIFPVLSPTAQQILDYVEKGVESESIWGSLDMLPPTLDAWDDIFTVAVQLRMRKQWDSIISICRWILLRSSFKPDVICYNLLIEAFGQKLLYKEAESTYLQLLEARCIPTEDTYALLIKAYCISGLLEKAEAVFAEMRNYGLPSSAVVYNAYINGLMKGGNSDKAEEIFKRMKKDACKPTTETYTMLINLYGKAGKSFMALKLFHEMMSHDCKPNICTYTALVNAFAREGLCEKAEEVFEQMQEAGLEPDVYAYNALMEAYRLLRKNQEFSSPNSRAGYPYGAAEIFSLMQHMGCEPDRASYNILVDAYGKAGFQDDAEAVFKDMKRVGITPTMKSHMVLLSAYSKMGSVNKCEEILNQMCKSGLKLDTYVLNSMLNLYGRLGQFGKMEEVLRVMEKGSYVADISTYNILINRYGQAGFIERMEDLFQLLPSKGLKPDVVTWTSRIGAYSKKKLYLKCLEIFEEMIDDGCYPDGGTAKVLLAACSNEDQTEQTNPKDKVQFLAISSTIIPTMATCLRKGGQTLDSTI

SEQ ID NO: 169300 - protein, 282 aa, Glycine max
  Coding DNA Sequence Number=SeqID_52522
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O81149; Match level="QueryCoverage=54%, HitCoverage=61%, E-value=7e-73, Identity=92%"; Hit description =Proteasome subunit alpha type 5-A
  Pfam annotation: Domain name=Proteasome; Domain location=153-282; Score=51.1; E_value=3.8e-12; Accession=PF00227.16; Description =Proteasome A-type and B-type
MVVTLLGEYHITWVDSWRLKGEEILLMPELSLLCKKIKMRGKKNQRVRESRFVKFRARFVVVRRVLVSIVRSTNVLKVVNSNQGGEGKTHPRPIAMPTNPIISLNLIEDVSHKVNLPPLLLQTCISWTEYDRGVNTFSPEGRLFQVEYAIEAIKLGSTAIGLKTKEGVVLAVEKRITSPLLEPSSVEKIMEIDEHIGCAMSGLIADARTLVEHARVETQNHRFSYGEPMTVESTTQALCDLALRFGEGDEESMLCYIYLGKRSRPFGVSLLIAGHDENGPSF

SEQ ID NO: 169301 - protein, 46 aa, Glycine max
  Coding DNA Sequence Number=SeqID_52523
MVGDHSGSESEVSGTKSDCDTIFLFINIKQNRYSVEVLHITKDICL

SEQ ID NO: 169302 - protein, 541 aa, Glycine max
  Coding DNA Sequence Number=SeqID_52524
  Gene Ontology: Mol. function=electron carrier activity; Cellular component=integral to membrane; Biological process=protein amino acid phosphorylation
  Homolog annotation: Hit_ID=Q5N6W3; Match level="QueryCoverage=98%, HitCoverage=94%, E-value=1e-170, Identity=57%"; Hit description=ABC1- like
  Pfam annotation: Domain name=ABC1; Domain location=124-276; Score =118.8; E_value=1.5e-32; Accession=PF03109.7; Description=ABC1 family
MLPPIAFDINGIKDKLSNQFRPWQRSFQFWVRAIDIYTGYKVFQVRVNFVKDAQKQEAMWERQHELAADKIFSMCYDLGGFFLKIAQIIGKPDLAPAAWVKRLVTLCDRAPPTPFDVVKLVLENELGQGINDVFDRFDVEPLGSASIAQLKGETYLKNKGYMVYLLLFVKLRWISHRAGMVVHRARLKGDTGDVVVKVQHPGIQDLMMTDIHNLQAFALYMQKTDIKFDLYSVTKEMEKQIGYEFDFTREANAMQRIRKFLYENNKKSPVLVPRVIHDMVTRRVLVMEYIDGIPIMNLGDEIAKRGINPHGKVATAAKQKILQSLTLAYGQMILKSGFFHADPHPGNILICKGSEASHQLYLFSNISLTVISSLDYGQVKDLPDQLRLAYANLVLAIANGDPLRAAESYRFDGFLNCPHYTKTKETGFGSSKVRKELGIETFTKCENELQELFKLAQTMFDTKLPPGVVMLQPFSEESSIKKIAVQSFPEELFSVLRTVHLLRGLSVGLGINYSCAEQWRPFAEEALSRAGRLKGGTVTLA

SEQ ID NO: 169303 - protein, 263 aa, Glycine max
  Coding DNA Sequence Number=SeqID_52525
  Gene Ontology: Mol. function=nucleoside diphosphate kinase activity; Cellular component=chloroplast; Biological process=nucleotide metabolic process
  Homolog annotation: Hit_ID=P47923; Match level="QueryCoverage=88%, HitCoverage=88%, E-value=2e-59, Identity=56%"; Hit description =Nucleoside diphosphate kinase 2, chloroplast precursor (EC 2.7.4.6) (Nucleoside ...
  Homolog annotation: Hit description=diphosphate kinase II) (NDK II) (NDP kinase II) (NDPK II) [Contains: Nucleoside diphosphate kinase 2 high-molecular-weight; Nucleoside diphosphate kinase 2 low-molecular -weight]
  Pfam annotation: Domain name=NDK; Domain location=80-241; Score =258.0; E_value=2e-74; Accession=PF00334.9; Description=Nucleoside diphosphate kinase
  Subcellular localization annotation: CTP_CleavageSite=59; ConfidenceScore=5.52e-01
MEAVCGSGSSVWVTSSLTRSPKITLPLFRASYQHLTAFPSQSLLFSYHPSRYANARTLRARTSSKPIFLPHLIASLEQVDQTYIMVKPDGVQRGLVGEIISRFEKKGFKLTGLKLFQCSKELAEWFFLLLGLWGSGRKGGKKRDRRLPAYCDCLWFQEHYKDLKQKSFFPKLIDYITSGPVVCMAWEGVGVVASARKLIGATDPLQAEPGTIRGDLAVQTGRNVVHGSDSPENGKREIAIVSAMHCFGDKFEFPRKIYGIDPS

SEQ ID NO: 169304 - protein, 390 aa, Glycine max
  Coding DNA Sequence Number=SeqID_52526
  Gene Ontology: Mol. function=ATPase activity; Cellular component =protein complex; Biological process=ATP-dependent proteolysis
  Homolog annotation: Hit_ID=Q93Y35; Match level="QueryCoverage=90%, HitCoverage=98%, E-value=1e-163, Identity=77%"; Hit description =Probable 26S proteasome non-ATPase regulatory subunit 6
  Pfam annotation: Domain name=PCI; Domain location=255-359; Score =102.6; E_value=1.2e-27; Accession=PF01399.17; Description=PCI domain
MTRPVRKKSVFGGRKVKEANARARARAKAAEKMEGEEGSQQPQLVLADKLFLLRQPDVQDIDKVRYKEDVFTHVKENDMVPLYETLVADSVLDLDRALLDSMRAKIDDELTKLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFKKAANIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTVDFIDVELSRFIAAGKLHCKIDKVAGVLETNRPDAKNALYQATIKQGDFLLNRIQKLSRVIDL

SEQ ID NO: 169305 - protein, 62 aa, Glycine max
  Coding DNA Sequence Number=SeqID_52527
MEKVSSLRILDGEPSKVSRDEVDALILPNISDAATRFGSGQAEIGLVLTAEGLKITDCTMKK

SEQ ID NO: 169306 - protein, 172 aa, Glycine max
  Coding DNA Sequence Number=SeqID_52528
MKLKLGARRDTSEVTNDSSVNSPCAEEANLKPDLNPATSTSCSETTMMDTESDNSSPRVSDHVSSGNSEQRKQSNVSILYFFKVQDTGHAGVSSSEEATASTGNGSSESISSTSVESDYRGEVEVIEPRNGKNHSNWASVVYYSLSHGDWTGVQSHTSPSLNHRAAIHGNNS

SEQ ID NO: 169307 - protein, 146 aa, Glycine max
  Coding DNA Sequence Number=SeqID_52529
  Gene Ontology: Mol. function=transcription factor activity; Cellular component=nucleus; Biological process=regulation of transcription, DNA-dependent
  Homolog annotation: Hit_ID=Q8RZ73; Match level="QueryCoverage=76%, HitCoverage=25%, E-value=6e-44, Identity=69%"; Hit description =Gibberellin response modulator-like protein
MVEQDSSHNGPFFLGRFMESLHYYSSIFDSLDVMLPKYDTKRAKMEQFYFAEEIKNIVSCEGPLRMERHERVDQWRRRMSRAGFQAAPIKMRRGVWFLDGSRGLLLQFLAGNAELNHHQSPLSQQFKSWCLGSMSINNSFMRAVVC

SEQ ID NO: 169308 - protein, 672 aa, Glycine max
  Coding DNA Sequence Number=SeqID_52530
  Gene Ontology: Mol. function=nucleic acid binding; Cellular component= intracellular; Biological process=chromatin modification
  Homolog annotation: Hit_ID=Q8RXE0; Match level="QueryCoverage=74%, HitCoverage=83%, E-value=4e-94, Identity=45%"; Hit description =Putative C2H2-type zinc finger protein
MTKLPFIVSDVTFGKDQDQDQPATACNNRREEKKDLTQPNPSWPNTAHRVSEYFFAFSMSVTLNEDSNCMWVFQNSDTVLGFKEKKNTLSGEAEEDMAASSSSASLFGFREEDQNQMKQQHSLTPSSSTTPAAPPPQKKKRNQPGTPCNFCLAFFHGLYVRCATKGSKESKTYSYTEEDTTCLGSLSRRLQKSQRERFICVLSPHAFTMTLQGLLETSQGLRNTTLANTVRRSGSVTSAPRSMLFNLIGKPILRLVAPENIDVTVAPSSPALFSSGLARCMCSVLCSCRRDSFITHRAFCDALAQESARQPPSLSGGGIGSHLYGSTTNMALNLSQVGSQISTMQDPNAQPTELLRLGAASGRTGQFDHILGSPFRPSNQQQQQQPFFMSSEPNQTYHHPDQNKPFQQGLMQLSDHLNNNSHHNNSPFSLPFLSNNTSNASFSEHFNNANGGGGNNNNNNNNEGTNYFATSSAPSLFSNSVNASALSHMSATALLQKAAQMGATTSNGGTASLLKSFGSASSSSGGGGSKLVNAANYVSGMFGGNNHVNEQSNSNLQDLMNSFAVGGNSSIFEDGFEAYEHSNNNSNRDPKVHAMSGSSSSIGGSDRLTRDFLGVGQIVRGMSGSGGVAQREQQQQHGFNLSSLEAERYNNNSNNAAPSSGQAFGGGGGNFQ

SEQ ID NO: 169309 - protein, 67 aa, Glycine max
  Coding DNA Sequence Number=SeqID_52531
GMRCFDKGRRRAERATEKSSSPGGRGFSGCRSGGVEGERMEERKTGNITTASISLLFVGAITQKVSA

SEQ ID NO: 169310 - protein, 49 aa, Glycine max
  Coding DNA Sequence Number=SeqID_52532
MVFHYLVVTKYTDKGATSHNPEASKDTLGSTRKEKGGMCELEGKGIQTT

SEQ ID NO: 169311 - protein, 56 aa, Glycine max
  Coding DNA Sequence Number=SeqID_52533
GVGIWRGGEGLGKGHFDLPNQMINLSEGVPWVPHLVLEKLHVPRLPNDPSSRDEVR

SEQ ID NO: 169312 - protein, 219 aa, Glycine max
  Coding DNA Sequence Number=SeqID_52534
  Homolog annotation: Hit_ID=Q2HTU7; Match level="QueryCoverage=94%, HitCoverage=74%, E-value=1e-60, Identity=65%"; Hit description =Uncharacterized Cys-rich domain
  Pfam annotation: Domain name=PLAC8; Domain location=75-186; Score =51.4; E_value=2.9e-12; Accession=PF04749.7; Description=PLAC8 family
MGDLEKKQERAMEEEVKERLVEGVAVLDFDMLCSTVALRAAHGKWGKLGAEEEEEEEEEEEKEEGGEFGGVLRMWEGEVLDCFDDHRIAIESTCCPCYRFGKNMKRAGFGSCYIQAAIYFLLAVGAFLNFIAFAVTRRHCYLYLTVAFVVSVGAYLGFFRTRLRKKFNIMVTIFCNIFLVYEYNVVRVVIVPWTIAFTISPVLVVHYVRSFLKSPSLLN

SEQ ID NO: 169313 - protein, 379 aa, Glycine max
  Coding DNA Sequence Number=SeqID_52535
  Gene Ontology: Mol. function=isomerase activity; Cellular component =integral to membrane; Biological process=protein folding
  Homolog annotation: Hit_ID=Q1S1L9; Match level="QueryCoverage=87%, HitCoverage=31%, E-value=1e-63, Identity=79%"; Hit description =Peptidylprolyl isomerase, FKBP-type; Tetratricopeptide-like helical
  Pfam annotation: Domain name=FKBP_C; Domain location=181-301; Score =46.1; E_value=1.2e-10; Accession=PF00254.18; Description=FKBP-type peptidyl-prolyl cis-trans i
  Pfam annotation: Domain name=TPR_2; Domain location=321-354; Score =19.1; E_value=0.016; Accession=PF07719.7; Description=Tetratricopepti de repeat
  Pfam module annotation: Pfam domain module=FKBP_C::TPR_2; Domain location=181-301::321-354
MAIGTMVREEKAVIYVTSQYLTESPLMPVIEGYDEVHFEVELVHFIQHFTSTISESVHVSCRQSAWRNRECMSPVSLAKQGVHFTSELGETGTALTETHVGTCRLHSEACCRDVAFSEGFQSATLKATSLQHASERSLHVPACVLLTPPTKHAHDGHVKAAAFFDIPNVVKAVHVSRDFPMDCPLHDSLLRVHYKGTVLNEEKRVFYDTRVDNDSQPLEFCSGEGLVPEGFEMSVRLMLPGEIALVTCPPDYAYDKFPRLLTKIHCHSVLFLCFIAILPPFMTRPLNVPEGAHIQWEIELLGFETPKDWTGLDFKSIMNEAENIRNTGNRLFKEGKYELAKAKYEKAGRVDAQNLNPCYSLPKFLRSRPIVVIEKNDIS

SEQ ID NO: 169314 - protein, 385 aa, Glycine max
  Coding DNA Sequence Number=SeqID_52536
  Homolog annotation: Hit_ID=Q2QPA8; Match level="QueryCoverage=32%, HitCoverage=17%, E-value=4e-08, Identity=29%"; Hit description=HAT family dimerisation domain containing protein
  Pfam annotation: Domain name=DUF659; Domain location=160-257; Score= -47.6; E_value=0.0016; Accession=PF04937.6; Description=Protein of unknown function (DUF 659)
MDDIFDFQNIMLDQNNGVHHLEYDVYHGRNVVAIHGGHGGCNRIMSGTWICTASSNPTKLEAGAVGQPPIGAKGKPKKKDTRKGPMDLYTQLQSTASKNWDKLLQVNIRELCDKKATERVYQSIAQFWYQARLSFNMIKLQSFQDMLCEVRHFGKHLRPPSYHDIKVILQKEVGTMLMKSIDASNFVKIVDKLFELLDSIEIGEEKVAQVVTNNGSNYVYVYILKVMAPLMKVFQLVDDANKYRDAFQIIDKRWNVQLYSPLHAINHFLNPEFFYDNSQIEFDGEVVRGLYEVINKLEGDLEMEKIIMRELLSYTMGAVGYHVDKPDQPYMFLVDEVVMPPSAKPPAIVLMTCRAGVSAFRSAHMILELSASSRTLSRLVFKAMY

SEQ ID NO: 169315 - protein, 133 aa, Glycine max
  Coding DNA Sequence Number=SeqID_52537
MGTTSSKLSAKSRCQGVEQINGIKRKLWNQLNVGPFNEVRGVIIFVIDRPFQEGRGASMMPLTKGYKPLSFLMSDWMTSMLGLVIGFGEVLATTEGFLPCSFCSLLLPFPMGGRKFQLSPTMGAKTYQSRGTE

SEQ ID NO: 169316 - protein, 424 aa, Glycine max
  Coding DNA Sequence Number=SeqID_52538
  Gene Ontology: Mol. function=protein-tyrosine kinase activity; Biological process=protein amino acid phosphorylation
  Homolog annotation: Hit_ID=Q2HTU9; Match level="QueryCoverage=97%, HitCoverage=98%, E-value=1e-148, Identity=65%"; Hit description =Octicosapeptide/Phox/Bem1p
  Pfam annotation: Domain name=Extensin_2; Domain location=69-423; Score=-137.0; E_value=0.06; Accession=PF04554.4; Description =Extensin-like region
  Pfam annotation: Domain name=PB1; Domain location=46-136; Score=92.0; E_value=1.8e-24; Accession=PF00564.15; Description=PB1 domain
  Pfam module annotation: Pfam domain module=Extensin_2::PB1; Domain location=69-423::46-136
MTSHSHYPPDLDADSVSSSPRSDHFHDAPPRVRFMCSFGGKILPRPHDNQLRYVGGDTRIVAVSRSITFSALILKLSKLSGMSNITAKYQLPNEELDALISVTTDEDVENMMDEYDRVTHNQNPRSARLRLFLFPEGEDSRANSISSLLNGSANRENWFLDALNGGVSGLERGRSEASSMVSEVPDYLFGLDNSEEITNHQHQRDPRPKPVLQDSVSVTDPGSPAPVVSSPYCSTSSAPHVPSLPNLPHVKTKPLNLNPVPDTHFKENQPEPETEPQPNLYLNPNNPVIHYPPEAAYSVNPVPVFYVSGPVRPGTVPVPMQTPYPYVQQPYHAVMPPQVPIGYHHLVPGSGQLYGAGVRHVTPLQPYSPSAAVVHDGLKQHGYHPVPNTGSVPVHPVTPMTGSVEPQRGGAEFVAGRGPSSLNN

SEQ ID NO: 169317 - protein, 46 aa, Glycine max
  Coding DNA Sequence Number=SeqID_52539
MEIRSQVKARRTMKYMGTLMEQIQRTHMKLHLRHNERESLTDNYRD

SEQ ID NO: 169318 - protein, 946 aa, Glycine max
  Coding DNA Sequence Number=SeqID_52540
  Gene Ontology: Mol. function=metal ion binding
  Homolog annotation: Hit_ID=Q2HTV0; Match level="QueryCoverage=98%, HitCoverage=99%, E-value=0.0, Identity=57%"; Hit description=Zinc finger, RING-type; Transcription factor jumonji, jmjC; Zinc finger, C2H2-type
  Pfam annotation: Domain name=JmjC; Domain location=788-892; Score= -4.6; E_value=0.0017; Accession=PF02373.13; Description=JmjC domain
  Pfam annotation: Domain name=WRC; Domain location=14-59; Score=74.7; E_value=2.9e-19; Accession=PF08879.1; Description=WRC
  Pfam module annotation: Pfam domain module=JmjC::WRC; Domain location= 788-892::14-59
MSKTPKEKDAEEPLPDHLRCGRTDGRQWRCRRRVKENLKLCEIHYLQGRHRQYKEKVPESLKLQRKRKSNNDEEEEPEPDNNNNNNVLDDNVESRARRTSRIVKKKRMLSGDSDDGSPARKKALKQGDMQLELLRMVLKREAEKKKSKNKRNNNNKKKNNKKKENKKKKEEKEELCYTKEELRRELPNGVMEISPASPTRDYNNVGSHCDVKVGVDSKTVAPRYFRSKNVDRVPAGKLQIVPYGSKGKRKKCHWCQRSESGNLIQCLSCQREFFCMDCVKERHVQFVVELALVRIAQQVNVKTVKEYLTGKSKVDRILHFHYLICMLLPVLKQISKDQNIELEAEAKVKGKNISDIQIKQVGFGYNEKNYCQGKASGEINSSVFKRPGKMKPCGANESHNLDEKATSSGNLTDTSMLPEWKNGNGIDTLSCPPTELGGCGKSHLELRSVFPSSWIKEMEVKAEEIVCSYDFPETSDKSSSCSLCFDTDHSTNRYKQLQEAALREDSNDNYLFCPTVMDISGDNFEHFQKHCGKGHPIVVQDALRSTSNLSWDPLTMFCTYLEQSITRYEKNKDLLESCLDWWEVEINIRQYFTGSVKRRPQRNTWDEMLKLKGWLSSQIFKEQFPAHFAEVIDALPVKEYMHPLSGLLNLAANLPHGSAKHDIGPYVYISYGSADKETDSVTKLCYDSYDVEQKLNGIPLLHGPETERKGSRSMVEGMNFFRRVNRTSCISTEAKKVSSQSMDSNGECDFISDSDSGSALLLLGTVQTAELSEHDNPRNPFKSSKRHKNKFTEHLGAQWDVFRRQDVPKLIEYLERHYDEFSYTHDYHKKMVHPILDQSIFLDSTHKMRLKEEFKIEPWTFQQHVGQAVVIPAGCPYQIRNSKSSVHAVLEFVSPENVTEGIQLFDEVRLLPEDHKAKADMLEVKKMALHSMNTAIKEVRQLTSKT

SEQ ID NO: 169319 - protein, 73 aa, Glycine max
  Coding DNA Sequence Number=SeqID_52541
MGYNFGSGSFWRRAVKEVTMQGCLRLVVAAEGGCDGSDGDDEEDENHACTNRFCESQCFGRDSRESQYQGEEE

SEQ ID NO: 169320 - protein, 627 aa, Glycine max
  Coding DNA Sequence Number=SeqID_52542
  Gene Ontology: Mol. function=kinase activity; Cellular component =mitochondrion; Biological process=protein amino acid phosphorylation
  Homolog annotation: Hit_ID=Q2HTV1; Match level="QueryCoverage=99%, HitCoverage=99%, E-value=0.0, Identity=80%"; Hit description=Protein kinase-like
  Pfam annotation: Domain name=ABC1; Domain location=278-404; Score =129.8; E_value=7.4e-36; Accession=PF03109.7; Description=ABC1 family
MIFVCRYLMLGNVGKVAQSILRTHGRRYLEASRNEAFNSVGPNIKHCKMYMQYKFPSEGRSSFLWHWTRENFHKGCSFRNFSVISASNVAAYNCRIAWKFLYKKYSSNGYNGFTSINMIAQAVSLALTRSYLLVPGFLAFASGKLALAQPNGADTEFYPSQNALYMHAQDGYGYMFAFVFIVVESLVLLARAIYLAILFSPSILMAPLADYFGPEFRKMWLSVVHCTLEKAGPAFIKWGQWAATRPDLFPQDLCTKLAELQTKAPQHSFSYTKKTIERAFGRKISEIFENFEEVPVASGSIAQVHRASLKYRYPGQQAKPLVVAVKVRHPGVGESIRRDFAIINLVAKSSKFIHALNWLRLDESVQQFAVFMMSQVDLAREAAHLSRFIYNFRRSRDVSFPKPVYPLVHPAVLVETYENGESVSHYVDELQGHERIKSALAHIGTNALLKMLLVDNFIHADMHPGNILVRNKPHKRLFKSKPHVIFLDVGMTAELSGSDRVNLLEFFKAVAHRDGRTAAECTLKLSKQQNCPNPKAFVEEMEEAFTFWGTPEGDLVHPAECMEQLLEKVRRHKVNVDGNVCTVLVTTLVLERKLDPGYDVMNTLQTLLLRADWAKSLSYTIDGLMAP

SEQ ID NO: 169321 - protein, 374 aa, Glycine max
  Coding DNA Sequence Number=SeqID_52543
  Homolog annotation: Hit_ID=Q1T5K4; Match level="QueryCoverage=32%, HitCoverage=13%, E-value=3e-17, Identity=35%"; Hit description=RNA -directed DNA polymerase
MEQKHHEKGSTLLGNDLIGLLGDEGVLQGQRRQIHTKGGTSSQEVVQELCVHEGNDSVTTPRPSPSCWGLGGGVKWSFIKNIILKDNIQFGGCCICGVKTFSLCIICFKEMDLKRRLWKDLKSKESSTCDMWCIMGDFNCVRRPCERTWILIVVLNLIRTLDCWMDDKNFEKFMAESWEQQRVQGRGAFILKQKLKVMKACLRGWNHNHFGDIHQNIAIIERDMNDLEKKKERGLQEEFWRNVLYRESLLKQKSRAKWLREGYLNSKYFHIMANWRRKNMIRGMMGRLGFHEKWIKWSQGGLRQSDPPAPFLFLIVAEGLSGLMREATSKRFFSVLIVGNKKVEVNLLQYANDNFCGRNESPKCGYGEEYLEMF

SEQ ID NO: 169322 - protein, 33 aa, Glycine max
  Coding DNA Sequence Number=SeqID_52544
MGGRKFQLSPTMGAKTYQSRGTEVLAKALRCSN

SEQ ID NO: 169323 - protein, 87 aa, Glycine max
  Coding DNA Sequence Number=SeqID_52545
MRLSKEEAQGMASHNNYEDSQIEGHNNELVSVKEKNAKDTVACMNQPSFYRISPTLDVGLVGDNLNNHCKEKHNQDTTRNKVLYQQL

SEQ ID NO: 169324 - protein, 50 aa, Glycine max
  Coding DNA Sequence Number=SeqID_52546
MDTSEPYTGAMKGTMHKSQANLGVPSYKVMAKDNNWYLKASHWGNEGHRA

SEQ ID NO: 169325 - protein, 69 aa, Glycine max
  Coding DNA Sequence Number=SeqID_52547
MWVFRQCRGFCGFQRGQCGFFGSVGVSREWFSADFRREEKEKSDFRQEDDKEKREGKVFERAQLVKSQF

SEQ ID NO: 169326 - protein, 259 aa, Glycine max
  Coding DNA Sequence Number=SeqID_52548
  Homolog annotation: Hit_ID=O87109; Match level="QueryCoverage=97%, HitCoverage=25%, E-value=4e-41, Identity=36%"; Hit description =Surface layer protein
MATLVAQQKAAAFFLAISGKNIDTAALDYYSQKIETSALSLEQVAQKFITGTSSLNGLTASQIVTKVYTAVNGSAPSSSVLADLLAGNPTTASVVAKVINDVLSYSGFDSTLLTAQSNFEAQVEKTLFPVATAASSAGAADVQGVFHVVGLTQTQDGITYWGTVLAQGSKTLAAVAQTFVNNSPLKTLSDSDFINAIFQNSYERAPTSAESSSYLALLSGGSTRGDVVAQVIAALKGTVAAGDTTAQQHFQAATHVWQP

SEQ ID NO: 169327 - protein, 82 aa, Glycine max
  Coding DNA Sequence Number=SeqID_52549
  Subcellular localization annotation: CTP_CleavageSite=51; ConfidenceScore=5.09e-01
MELTRGLGDASSTSALPLCLCGAGGASNNGVLRKAPVKLACWVQQRRAKCSAAAVLQEAPLEAAGCRQVGGAITRSALLLYM

SEQ ID NO: 169328 - protein, 183 aa, Glycine max
  Coding DNA Sequence Number=SeqID_52550
  Gene Ontology: Mol. function=methyltransferase activity; Cellular component=nucleus; Biological process=regulation of transcription
  Homolog annotation: Hit_ID=Q2HTV3; Match level="QueryCoverage=99%, HitCoverage=52%, E-value=9e-81, Identity=78%"; Hit description=N-6 Adenine-specific DNA methylase; Homeodomain-related
  Pfam annotation: Domain name=Myb_DNA-binding; Domain location=14-61; Score=47.5; E_value=4.5e-11; Accession=PF00249.21; Description=Myb -like DNA-binding domain
  Pfam annotation: Domain name=Myb_DNA-binding; Domain location=67-112; Score=46.8; E_value=7.3e-11; Accession=PF00249.21; Description=Myb -like DNA-binding domain
  Pfam module annotation: Pfam domain module=Myb_DNA-binding::Myb_DNA -binding; Domain location=14-61::67-112
MGRSPCCNKNGLKKGPWTPEEDQKLIDYIQKHGYGNWRVLPKNAGLQRCGKSCRLRWTNYLRPDIKRGQFTFEEEETIIQLHSILGNKWSAIASRLPGRTDNEIKNYWNTHIRKRLLRMGIDPVTHRPRLDLLDLSSILSSTLYGSTQMNIQRLLGTNTVVNPELLKLASSPFPSLQQRQHQN

SEQ ID NO: 169329 - protein, 223 aa, Glycine max
  Coding DNA Sequence Number=SeqID_52551
  Gene Ontology: Mol. function=structural molecule activity; Biological process=response to gibberellin stimulus
  Homolog annotation: Hit_ID=Q2HTV7; Match level="QueryCoverage=79%, HitCoverage=66%, E-value=9e-91, Identity=96%"; Hit description=Major sperm protein
  Pfam annotation: Domain name=Motile_Sperm; Domain location=35-147; Score=80.6; E_value=5e-21; Accession=PF00635.16; Description=MSP (Major sperm protein) domain
MEIHDKQHRKFSLLLLPFPVSTGEILIRTVSQRYMLVLYVYMHVSEFIYEPGKQVRSAIRIKNTSKSSVAFKFQTTAPKSCFMRPPGAILAPGESIIATVFKFVEQPENNEKPEKSGLKFKIMSLKVKGSIDYVPELFDEQKDQVAVEQILRVVFLDPERPCPALEKLNRQLADADAALEARKKPAEDAGPKIIGEGLVIDEWKERRERYLAKQQGEVVVDSV

SEQ ID NO: 169330 - protein, 45 aa, Glycine max
  Coding DNA Sequence Number=SeqID_52552
MCLGIPTYFLVSLNHLGSLPWKRCARHTLNRVVVVKVEEVVVAWR

SEQ ID NO: 169331 - protein, 102 aa, Glycine max
  Coding DNA Sequence Number=SeqID_52553
MEAMKEKMTTMMEAMMTMRKMIEVNATTIAAPSAVAEMDLIPPSSHNQIIHPTSNMVGQGGKELGSMGGPHFVQIQNKHAFSPYGLPPNYTPPNMVHAPDEN

SEQ ID NO: 169332 - protein, 108 aa, Glycine max
  Coding DNA Sequence Number=SeqID_52554
LCATVCHVCTSAPPCTTFSRQPRVTMWNGKKGLNDDIFGVVNDDLATGGEEVVGGVSMAGREESELVVGGNDGGARGKGVDFLLAVVEVASLDEGVVECLGGAGKRER

SEQ ID NO: 169333 - protein, 567 aa, Glycine max
  Coding DNA Sequence Number=SeqID_52555
  Gene Ontology: Mol. function=binding
  Homolog annotation: Hit_ID=Q1S8C2; Match level="QueryCoverage=99%, HitCoverage=100%, E-value=0.0, Identity=77%"; Hit description =Armadillo
  Pfam annotation: Domain name=Arm; Domain location=177-218; Score =10.8; E_value=0.55; Accession=PF00514.13; Description=Armadillobeta -catenin-like repeat
  Pfam annotation: Domain name=Arm; Domain location=219-259; Score =11.3; E_value=0.47; Accession=PF00514.13; Description=Armadillobeta -catenin-like repeat
  Pfam annotation: Domain name=Arm; Domain location=260-302; Score =10.4; E_value=0.62; Accession=PF00514.13; Description=Armadillobeta -catenin-like repeat
  Pfam annotation: Domain name=Arm; Domain location=303-343; Score =16.3; E_value=0.11; Accession=PF00514.13; Description=Armadillobeta -catenin-like repeat
  Pfam annotation: Domain name=Arm; Domain location=345-388; Score =14.4; E_value=0.19; Accession=PF00514.13; Description=Armadillobeta -catenin-like repeat
  Pfam annotation: Domain name=Arm; Domain location=390-430; Score=3.1; E_value=5.1; Accession=PF00514.13; Description=Armadillobeta-catenin -like repeat
  Pfam annotation: Domain name=Arm; Domain location=432-472; Score =25.9; E_value=0.00015; Accession=PF00514.13; Description =Armadillobeta-catenin-like repeat
  Pfam module annotation: Pfam domain module=Arm::Arm::Arm::Arm::Arm::Ar m::Arm; Domain location=177-218::219-259::260-302::303-343::345 -388::390-430::432-472
MGDEEVFAGASGLRRAVELIFSVLSLSHSIRVFAGKWQLIRAKLEELHGGLIAAENFDSGDSPSLSRLAEAVAVTSTECRDLCRRCVDVSYSGKLLMQSDLDVAFAKLDAHAKKLSEIYKTGILTNGFALVVSKPNLGASKEDMRFYVRDLTTRMKVGDLGMKRQALKNLLEVVVEDEKYVKVIVDVGDVVHLLVGFLGSNEVEIQEESAKVVSVVAGFDSYKGVLVCAGVIAPLVKVLDCGSVLGKIAAARCLVKLTENSDNAWCVSAHGGVSVLLKICGGGDCGGDLVGPACGVLRNLVGVEEIKRFMVDEGAVVTFIRLVRSKEEAIQVNSIGFILSIASGDELVRQMVIKEGGIRALLRVLDPKWSYSCKTREVTMRAVEDLCFCSPSSVGVLMNCGFVDQLIYYVRNGEVSIQELALKVAFRLCGTSEEAKKAMGDAGFMPEFVKFLNAKSFEVREMAAEALSGMVIVPRNRKRFVQDDHNIALLLQLLDPEEGNSGNKKFLISILMSLTSCTSGRKKIVSSGYAKNIEKLADAEVSSDAKRLVKKLSTNRFRSMLSGIWHS

SEQ ID NO: 169334 - protein, 51 aa, Glycine max
  Coding DNA Sequence Number=SeqID_52556
MWCLVGEKRQYTVYCSTWNCSGDYVTACHTAFRESGANCNGKKFNTFYPLN

SEQ ID NO: 169335 - protein, 115 aa, Glycine max
  Coding DNA Sequence Number=SeqID_52557
MVIARAQAQSKKVKLPHVMTIPTKKALNPYLEDELSQNLWGVLGKSRGHMPQFRGQRPEFGIYVRCKMPFICQSHTTVTLSGEEAKFKTVEKFENVLAFKRKVDIKNNVFMFINS

SEQ ID NO: 169336 - protein, 515 aa, Glycine max
  Coding DNA Sequence Number=SeqID_52558
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=96%, HitCoverage=49%, E-value=1e-129, Identity=49%"; Hit description=U box
  Pfam annotation: Domain name=U-box; Domain location=265-334; Score =65.0; E_value=2.4e-16; Accession=PF04564.6; Description=U-box domain
MANELVARASHAPTSELLSRTIFAVFDTIKAANEVVIHKENLKRFSVHLKNVSLILKSLSKQDIHNSASLENAMNGLYREVGVAKQLFVECNNRSKVYLLINSRKIVTHLNCCTKDIGRAVSLIPLASLDINSDLNQQISELCKKMLDAEYQTAAADEEILKKIETAIQEGNVDRSYANQLLTCIADAIGVPLEHGALKREFEELKNEMENAKSRVDVAEALHMKQIIAVLGKADFITSAQEKETRYFEKRNSLGERPLMPLQSFYCPISLAIMADPVETSSGKTFERREIEKWFAEGNTLCPLTRLPLDTKILRPNKTLKQSIQEWKDRNTMITISAIKSELETNDEEGVVQSLEKLQKLCLEREVHREWLKMENYITVLIGLLSSKNREIRKHVLLILCMLAMDNADNKEDIAKVDNALGLIVRSLSRQAEERKLALVLLLELSKCKMVCSLIGSIQGSILLLVSMINSDDVEAAKHAHELLVKLSVLDQNVIEMAKANYLKPLLLKLSTGIP

SEQ ID NO: 169337 - protein, 61 aa, Glycine max
  Coding DNA Sequence Number=SeqID_52559
MGSYGGSSSRGLCSYKLAGAECEELEMHRSQACDQVHLKVQGEQQRGMLVGVGQQQMRVLC

SEQ ID NO: 169338 - protein, 70 aa, Glycine max
  Coding DNA Sequence Number=SeqID_52560
  Gene Ontology: Mol. function=isomerase activity; Cellular component =nucleus
  Homolog annotation: Hit_ID=Q9T096; Match level="QueryCoverage=88%, HitCoverage=42%, E-value=2e-24, Identity=80%"; Hit description =Protein yippee-like At4g27740
  Pfam annotation: Domain name=Yippee; Domain location=1-61; Score =62.8; E_value=1.1e-15; Accession=PF03226.5; Description=Yippee putative zinc-binding protein
MNIVTGPKEDRHLLTGLHTVADVYCGDCREVLGWKYERAYEASQKYKEGKFILEKSKIAKENWKFLPSTI

SEQ ID NO: 169339 - protein, 442 aa, Glycine max
  Coding DNA Sequence Number=SeqID_52561
  Gene Ontology: Mol. function=protein binding; Cellular component =nucleus; Biological process=multicellular organismal development
  Homolog annotation: Hit_ID=Q1S8C5; Match level="QueryCoverage=94%, HitCoverage=71%, E-value=0.0, Identity=83%"; Hit description=Cyclin -like F-box
  Pfam annotation: Domain name=LRR_1; Domain location=161-184; Score =4.7; E_value=38; Accession=PF00560.23; Description=Leucine Rich Repeat
  Pfam annotation: Domain name=LRR_1; Domain location=28-57; Score =11.9; E_value=1.7; Accession=PF00560.23; Description=Leucine Rich Repeat
  Pfam annotation: Domain name=LRR_1; Domain location=353-373; Score =4.5; E_value=40; Accession=PF00560.23; Description=Leucine Rich Repeat
  Pfam annotation: Domain name=LRR_1; Domain location=378-404; Score =2.0; E_value=1.2e+02; Accession=PF00560.23; Description=Leucine Rich Repeat
  Pfam module annotation: Pfam domain module=LRR_1::LRR_1::LRR_1::LRR _1; Domain location=161-184::28-57::353-373::378-404
MTEIINSVKIVDYIFNLSFGFQNLNSWNLTELDIQENGIEDKSGNWLSCFPDSFTSLEVLNFANLHNDVNFDALEKLVSRCKSLKTLKVNKSVTLEQLQRLIVHVPQLGELGTGSFSQELTSQQCSDLESALKNCKNLHTLSGLWVATAQYLPVLYSACTNLTFLNFSYAPLDSDGLTKLLVHCPKLQRLWVVDTVEDKGLEAVGSHCPLLEELRVFPADPFDEGIVHGVTESGFIAVSQGCPRLHYVLYFCRQMTNAAVATVVQNCPDFTHFRLCIMHPGQLDYLTQESMDEAFGAVVKTCTKLQRLAVSGYLTDLTFEYIGKYAKNLETLSVAFAGSSDWGMRCVLDGCPKLRKLEVRDCPFGNGALLSGLGKYESMRSLWMSDCNLTMNGVRLLAQEMPRLNVEVIKEESYETHQAKKVYVYRSVAGPRRDAPPFVLTL

SEQ ID NO: 169340 - protein, 218 aa, Glycine max
  Coding DNA Sequence Number=SeqID_52562
  Gene Ontology: Mol. function=nucleic acid binding
  Homolog annotation: Hit_ID=Q8H642; Match level="QueryCoverage=99%, HitCoverage=98%, E-value=6e-43, Identity=38%"; Hit description =Putative RNA-binding protein
MSDAYWRYAAESRQAPSSIAGKRSRSDYDVSGVHDLPSYFPHDDDRGGLRVIRDTESLDASYERYLRSAQVSSYGSGQSTRTIGGRIPNRAIDDSHVANIGGVDRGTNAKDKMPGLSSGRADHSLPPDATSTLFVEDIFRPFVGYKEVRLVSKESRQPGGDPLVLCFVDFMSPAHAATAMEALQGYKFDELDRNSVNLRFQFARYPGARSGGVHRGKR

SEQ ID NO: 169341 - protein, 351 aa, Glycine max
  Coding DNA Sequence Number=SeqID_52563
  Gene Ontology: Mol. function=binding; Cellular component=ubiquitin ligase complex; Biological process=protein ubiquitination
  Homolog annotation: Hit_ID=Q93XC9; Match level="QueryCoverage=99%, HitCoverage=69%, E-value=2e-86, Identity=50%"; Hit description =Armadillo repeat-containing protein
  Pfam annotation: Domain name=Arm; Domain location=219-259; Score =23.6; E_value=0.00071; Accession=PF00514.13; Description =Armadillobeta-catenin-like repeat
  Pfam annotation: Domain name=Arm; Domain location=263-303; Score=4.5; E_value=3.3; Accession=PF00514.13; Description=Armadillobeta-catenin -like repeat
  Pfam annotation: Domain name=Arm; Domain location=96-142; Score=14.4; E_value=0.19; Accession=PF00514.13; Description=Armadillobeta-catenin- like repeat
  Pfam annotation: Domain name=HEAT; Domain location=151-187; Score =18.9; E_value=0.019; Accession=PF02985.12; Description=HEAT repeat
  Pfam annotation: Domain name=HEAT; Domain location=224-261; Score =12.2; E_value=1.4; Accession=PF02985.12; Description=HEAT repeat
  Pfam annotation: Domain name=HEAT; Domain location=314-345; Score =2.1; E_value=24; Accession=PF02985.12; Description=HEAT repeat
  Pfam module annotation: Pfam domain module=Arm::Arm::Arm::HEAT::HEAT:: HEAT; Domain location=219-259::263-303::96-142::151-187::224-261::314- 345
SFQALCQSFYGLRIRKRLRQISAAKVLVHLLELNTQPVQVNSLKLFYCLTEDGDDGNISSHITERFIKVLLTIIEASDDAEAMVTAMGIISKLPQESHMTQWLLDSGALKTILTCLTDQHKHVSHKKQVIENSVQALCRFTVSTNLEWQKRVALEGIIPVLVQLLHSGTPFTKQNAAISIKQFSESSYRLSEPIKKPSIFKCCLVAKETGCPAHLGTCSVESSFCILQANALEPLVRMLADQDDGTREASLNALLTLVDSEAPQSGSKVLANSNAIAPMIQLSSVPIPRLQERILIALERIFQLDDVRNKYKVVATMHLVEITQGKDSRMRSLAAKCLAQLGELNKQSSYF

SEQ ID NO: 169342 - protein, 206 aa, Glycine max
  Coding DNA Sequence Number=SeqID_52564
  Gene Ontology: Mol. function=RNA binding; Cellular component =intracellular; Biological process=regulation of progression through cell cycle
  Homolog annotation: Hit_ID=Q4QXS6; Match level="QueryCoverage=73%, HitCoverage=84%, E-value=3e-65, Identity=79%"; Hit description=MLL
  Pfam annotation: Domain name=PUA; Domain location=140-206; Score =25.4; E_value=0.00018; Accession=PF01472.10; Description=PUA domain
  Subcellular localization annotation: CTP_CleavageSite=35; ConfidenceScore=5.21e-01
MEANTSARSAVAFASPLSLSLQFPCHKHRFTSKLNAAAEDVQKIYMSTFISRFSGEDVSAQNQVKASVQRKIRQSIAEEYPGLEPVLDDILPKKSPLIVAKCQNHLNLVLVNNVPLFFSVRDGPYMPTLRLLHQYPNIMKKLQVDRGAIRFVLAGANIMCPGLTSPGGVLDEDVGAECPVAIMAEGKQHALAIGFTKMSAKDMNVE

SEQ ID NO: 169343 - protein, 140 aa, Glycine max
  Coding DNA Sequence Number=SeqID_52565
MKLLLSNILPSDRSADLPLRKDCACKTPSGPEEVQQGPRVSSSDYGPLSFLRSARRPQQGIVPARHSVDPKKANRVLELPALITGLCRFYGVLVAPSKVIRPPTNRAFIKKYCAPRCLAQDVKEALLGGNLVPFESMLVI

SEQ ID NO: 169344 - protein, 107 aa, Glycine max
  Coding DNA Sequence Number=SeqID_52566
MTVPKSEKIEGQAETNKKQGSSRCGVSTENIDSLWWLMVAVGGGESAWDVRNGFGRKKGEEMVFFLSYTKAKPENAQVRNGLGHGNVLHTPDSFSRIPTVRSGTSVM

SEQ ID NO: 169345 - protein, 141 aa, Glycine max
  Coding DNA Sequence Number=SeqID_52567
  Gene Ontology: Mol. function=calcium ion binding; Cellular component =flagellin-based flagellum; Biological process=ciliary or flagellar motility
  Homolog annotation: Hit_ID=Q2HVQ3; Match level="QueryCoverage=63%, HitCoverage=81%, E-value=2e-40, Identity=86%"; Hit description =Calcium-binding EF-hand
  Pfam annotation: Domain name=efhand; Domain location=64-92; Score =20.2; E_value=0.0075; Accession=PF00036.22; Description=EF hand
MEQDYLLDFEDYFPSMIARMGAEGFIGELCNGFRLLMDVNKGLITFESLKLNCYLLGLDVMDDELACMLMEGDLDGDGALSQMEFCILMFRLSSCLCTPHGGGGGDGGSGGSGGDPMLMNADPADSHPSPPLRFNFSYSIA

SEQ ID NO: 169346 - protein, 132 aa, Glycine max
  Coding DNA Sequence Number=SeqID_52568
MESVIASHAIKMQTFKCFMIYEARTLQSLAVSDIRLASVSVSDTDITPVIHSIFGTLQVSTCPCLYRVRCPCFIVHNRYQEASTVSQLESTNRGTRHMHACNSRGLAQCGLLYSVRRGTGSLCVLHNVAAAI

SEQ ID NO: 169347 - protein, 276 aa, Glycine max
  Coding DNA Sequence Number=SeqID_52569
  Gene Ontology: Mol. function=zinc ion binding; Cellular component =nucleus; Biological process=regulation of transcription
  Homolog annotation: Hit_ID=Q0GLD0; Match level="QueryCoverage=99%, HitCoverage=100%, E-value=1e-152, Identity=85%"; Hit description =Dof21b
  Pfam annotation: Domain name=zf-Dof; Domain location=37-99; Score =138.6; E_value=1.7e-38; Accession=PF02701.6; Description=Dof domain, zinc finger
MDTAQWAQGIGVVKQPTMEGGSKPPPPPMLERRARPQKDQALNCPRCNSTNTKFCYYNNYSLSQPRYFCKTCRRYWTEGGSLRNVPVGGGSRKNKRSTPSAPPPSSASAQAKKLPDLTTPNFPQSASQDPKIHQGQDLNLAYPPAEDYNTVSMSKLIELSAMELLKTGIAAASSRGLNSFMPMYNSTHHGFPLQDFKPPHHGLNFSLEGFDNGTYGGLHQGIQEDPTTGGARILFPTVEDLKQQVPSTNEFDHQQNRSQEGSAHGYWNGMLGGGSW

SEQ ID NO: 169348 - protein, 78 aa, Glycine max
  Coding DNA Sequence Number=SeqID_52570
MAIVNGATIVTHDDGAIAHRFGVVEEVVTRLMGRGWVACVGCAYGVVDVTDEGGGREEEGQKGNIKQFRGAPSKNGVC

SEQ ID NO: 169349 - protein, 285 aa, Glycine max
  Coding DNA Sequence Number=SeqID_52571
  Gene Ontology: Mol. function=oxidoreductase activity; Cellular component=membrane; Biological process=electron transport
  Homolog annotation: Hit_ID=Q2HTZ1; Match level="QueryCoverage=99%, HitCoverage=52%, E-value=2e-99, Identity=61%"; Hit description=FAD linked oxidase, N-terminal; TonB box, N-terminal
  Pfam annotation: Domain name=FAD_binding_4; Domain location=9-142; Score=53.1; E_value=9.2e-13; Accession=PF01565.13; Description=FAD binding domain
FYAPTAPKPLAIVTALDESHVQGTVVCAKSNGIQIRIRSGGHDCEGLSYVSDVPFVVLDMFHFGSVDVDIENGTEWVETGATIGEVYYHTAERSGVHAFPGGVCPTVGAGGHFLVVAMEISCVDNIIDARLVDVNGNILDRKSMGEDQFWAIRGGGGGSFGVIHSWKIKFVFVTPKVTVFKVMRNLELEDGAKGLVYKWQLIATKLHEDLFIRVMHDVVDGTQNANKKTIQVTFIGLFLGQGDQMLSLVNESFPELGLEQSDCIEMPWINSTLYWFNYPIGTPIA

SEQ ID NO: 169350 - protein, 370 aa, Glycine max
  Coding DNA Sequence Number=SeqID_52572
  Gene Ontology: Mol. function=oxidoreductase activity; Cellular component=membrane; Biological process=electron transport
  Homolog annotation: Hit_ID=Q2HTY4; Match level="QueryCoverage=92%, HitCoverage=74%, E-value=4e-92, Identity=46%"; Hit description=FAD linked oxidase, N-terminal
  Pfam annotation: Domain name=FAD_binding_4; Domain location=59-193; Score=71.2; E_value=3.2e-18; Accession=PF01565.13; Description=FAD binding domain
MECFSFFLTSLMLMLSKSNHSSLASEIIYTPQKNATIIQLHLELARSQQEVQNANLTKASGHHNCSSETHVQATVKCAKSNDIQVRIRSGGHDFEGLSYVSEVNYVVLDMFSLHEVDLDIESGMAWVEAGATLGELNYQIANKSNVHAFPAGVCSSLGTGGHFSGGGYGNLMRKYGLSVDDIIDAKLVNANGGGGGASFGVIVAWKIKLVPCASTRTVFGVKKSIKEDATDVAYKWQLVAPNLDKDLLTRVQPNVVNGTVIVSFIGQFLGPIKRLVPLVSEAFPELGLKQTLLPTPQEPPSIYFKSKSDFVETPIPKEALKSIWDLMIKYNNIWMQWSPYGGRMAEISPQATTFPHRAGNLFLIQYSVLD

SEQ ID NO: 169351 - protein, 70 aa, Glycine max
  Coding DNA Sequence Number=SeqID_52573
  Gene Ontology: Biological process=electron transport
  Homolog annotation: Hit_ID=Q2HTY4; Match level="QueryCoverage=70%, HitCoverage=9%, E-value=2e-15, Identity=76%"; Hit description=FAD linked oxidase, N-terminal
MSDYVKRPIRETALKSIMIKSNRYLNISRSFYEFMTPYVSHSPREAFLNYRDLDIGANHPSNATNMNIAQ

SEQ ID NO: 169352 - protein, 209 aa, Glycine max
  Coding DNA Sequence Number=SeqID_52574
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=4e-29, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVPAFRELHVPTFRVLHVLAFKGLHVLAFRGLHVLAFRGLHVLTKRGLHVLAFRGLHVLAFRMLHTFAFKGQHALNIRRLPALAMLSEYNTSSPSEDYTSKPLEGYTPSALEDYTSSPSKDYMSLPSEDYMSSPSEGYMSLPLEDYMSSPSEGYTSSPSEDYTSSPSEDYTSLPSEGYTSWSLEGYTSSPSEDNTSKSSEGYTPSVIP

SEQ ID NO: 169353 - protein, 367 aa, Glycine max
  Coding DNA Sequence Number=SeqID_52575
  Gene Ontology: Mol. function=protein serine/threonine kinase activity; Cellular component=cytosol; Biological process=electron transport
  Homolog annotation: Hit_ID=Q2HTZ7; Match level="QueryCoverage=63%, HitCoverage=97%, E-value=1e-115, Identity=83%"; Hit description=WD40- like
  Pfam annotation: Domain name=WD40; Domain location=140-177; Score =11.0; E_value=1.9; Accession=PF00400.22; Description=WD domain, G -beta repeat
  Pfam annotation: Domain name=WD40; Domain location=184-222; Score =15.1; E_value=0.26; Accession=PF00400.22; Description=WD domain, G -beta repeat
  Pfam annotation: Domain name=WD40; Domain location=226-283; Score =6.7; E_value=6.1; Accession=PF00400.22; Description=WD domain, G -beta repeat
  Pfam annotation: Domain name=WD40; Domain location=97-136; Score =13.3; E_value=0.89; Accession=PF00400.22; Description=WD domain, G -beta repeat
  Pfam module annotation: Pfam domain module=WD40::WD40::WD40::WD40; Domain location=140-177::184-222::226-283::97-136
MHEGESIHDFCWYPYMSSSDLVTNVFATTTRDHPIHLWDATSGQLRCTYRAYDAMDEITAAFSIAFNPAGTKIFAGYNKCIRLFDLHRPGRDFELYSTVKDKKEGQTGIISAMAFSPFPSGMLALGSYNQTTAIYREDNMELLYFLHGQEGGITHVQFSRDGNYLYTGGRKDPYILCWDVRKSVDCVYKSSENTNQRILFDIDPSGKYLGTGGQDGLVHIYNLQTGQWVSSFEAALDTVNGFSFHPFLPHAVSSSGHRRFVIPDDGNEEFCLTGRENCLSMWTFCCDSMMETDLKNDGSFNNQSESLLEISVKSGKRNSIQQLTLYFCTLRQYFMLKKVTYIIDHFIRSVESGGKNIMVTCTNSTDA

SEQ ID NO: 169354 - protein, 83 aa, Glycine max
  Coding DNA Sequence Number=SeqID_52576
MESSNEISKREGKTKTSRWKGTRGGVIEDGKKVVNDVVLGRPCRLFSGCEFRVRNRVGVSWTVTAVDHSLLGKHVCDGLLDQR

SEQ ID NO: 169355 - protein, 207 aa, Glycine max
  Coding DNA Sequence Number=SeqID_52577
  Gene Ontology: Mol. function=hydrolase activity; Cellular component =cellular_component; Biological process=metabolic process
  Homolog annotation: Hit_ID=Q2HU02; Match level="QueryCoverage=83%, HitCoverage=100%, E-value=1e-73, Identity=78%"; Hit description =Haloacid dehalogenase/epoxide hydrolase; Haloacid dehalogenase-like hydrolase
  Pfam annotation: Domain name=Hydrolase; Domain location=8-191; Score =67.2; E_value=5.4e-17; Accession=PF00702.16; Description=haloacid dehalogenase-like hydrolase
MSVAKKLIRCVILDLDGTLLNTDGIVGNVLKVMLGKYGKEWDGREAQKIIGTTPFEAAAAVVQDYQLPCSAIEFLSEISPLFSDQWCNIKALPGANRLVKHLKSHGVPMALASNSPRESIEAKISYHDGWKNSFSVIIGGDEVRTGKPSPEIFLEAARRLNMEPSSCLVIEDSLNHILAEDDCHVDRLSSQYYMLFTCGDGGKFLRK

SEQ ID NO: 169356 - protein, 103 aa, Glycine max
  Coding DNA Sequence Number=SeqID_52578
MKTVMYHTPEAHTSQECISAWTTLNVKFFPFVILDKVQVIGTQRRQMPLSKNQQTFTKITPSTNRSILTSPSTDTRCMLADSGEKVEMKKTNQESCMKEIESK

SEQ ID NO: 169357 - protein, 87 aa, Glycine max
  Coding DNA Sequence Number=SeqID_52579
  Gene Ontology: Biological process=cell wall catabolic process
  Pfam annotation: Domain name=LysM; Domain location=40-83; Score=18.4; E_value=0.0064; Accession=PF01476.10; Description=LysM domain
MAKSTITSFALIFSSLLIMVLIAESGSTPTVADPICNTVHGVEEAETCTSIVQSFNLDERHFLDINPNINCNLIFVGQWVCVDGQVI

SEQ ID NO: 169358 - protein, 202 aa, Glycine max
  Coding DNA Sequence Number=SeqID_52580
  Homolog annotation: Hit_ID=Q1RYI2; Match level="QueryCoverage=37%, HitCoverage=11%, E-value=6e-08, Identity=38%"; Hit description =Ribonuclease H
MRVWSCWKVSVSVMVDGGRLEPSKGVSHLRPNRVLTMGEKRGRRCLEITCRFESSTAKGETSMLLCQGRHGGLTCVLKCHVASHVYFVDPRQYNNSLIDMYNLNFDDPIIHANHVAACGAISKDRKGTFVQAFPRRLGHCSIVEVALWAIFYGMRMLEEQGIHNLSIKSDSKDVVRIIQNYLGNGSHFQELASEIWSLKNAF

SEQ ID NO: 169359 - protein, 463 aa, Glycine max
  Coding DNA Sequence Number=SeqID_52581
  Gene Ontology: Mol. function=ubiquitin-protein ligase activity; Cellular component=integral to membrane; Biological process =phosphoenolpyruvate-dependent sugar phosphotransferase system
  Homolog annotation: Hit_ID=Q3Y4F2; Match level="QueryCoverage=100%, HitCoverage=57%, E-value=1e-152, Identity=58%"; Hit description =Anaphase promoting complex subunit 4
  Pfam annotation: Domain name=WD40; Domain location=52-89; Score=19.8; E_value=0.01; Accession=PF00400.22; Description=WD domain, G-beta repeat
METDESSRVIPFQLQFDKPLASQIKIAEWNPEKDLLAMVTDDSKILLHRFNWQRLWTITPGRCITSLCWRPDGKAIAVGLDDGTLSLHDVEDDFGHTSKYEDRTSRFFPPAPRVPRMPGLVSGDNGFMDDSEDSFQELSNSSHQRFNILCSADKDGNICFSIFGIFPIGKVNIHNLTFPTFCDGSEMSNGVSNALIHKVALSKDLCRLIVTCSGDLVKVGDDLGEIQMVGNNEHGLHCLALNTAIFWNRKNELHQVAQQASNIEDLTEVVRTSLSVMCRQWSDAMNTFQEKFRSLSTLIINHGLDSSPQEEFLSLLGGARTSPPVHQFLVNTLGEVGVKRISKVLSGAGKELQRIVLDHLQVIFAFLPCVNKVGIEGKPAPSTMIWDFRGCHPVASLKELKFNPAVEVIGFRIGELRGLSRWRARYHGIGLDESLINNATEKAGMLLVQVERFMRVLSSVVQQ

SEQ ID NO: 169360 - protein, 128 aa, Glycine max
  Coding DNA Sequence Number=SeqID_52582
MGQLQQQAFHKAYGKIWDLAMAEVSTVAIASLTQYYDQPVEMLHLWGLPAITHDSPNLGTGIRLRKASRKWGGWNTEKMFGVLFPNVDGLVDLAAINAFLAYHNHKESPVVTMLADLYDTFDRRCEKS

SEQ ID NO: 169361 - protein, 66 aa, Glycine max
  Coding DNA Sequence Number=SeqID_52583
MTKSIKMLNKGSDTLDEVLQLGKNVGNQRGLGLSFMHPPPLSLEPHELIAKLCSLILYHQSLFAAP

SEQ ID NO: 169362 - protein, 318 aa, Glycine max
  Coding DNA Sequence Number=SeqID_52584
  Gene Ontology: Mol. function=D-erythro-sphingosine kinase activity; Cellular component=integral to membrane; Biological process=protein kinase C activation
  Homolog annotation: Hit_ID=Q3Y4F2; Match level="QueryCoverage=96%, HitCoverage=38%, E-value=5e-58, Identity=43%"; Hit description =Anaphase promoting complex subunit 4
MSEPSDQLLPYNSELVIVFLKFLYEQDPVKQLLEVSETEYEVEIDLETMQRVRELVQFGGFADTEYLRRTLVKEFQLMELRSALHHDLQILAHCPAALSSIFEADRMGHFFKEAFEMPFTTISRKILCEDILPLFPLPSLPKSSSSMWIPTSVSYYEDPSRASVPPYSCQNQFIDYISFQVPDECFSDIVNCICIVRGFMHDSDCLKKGYSSLEAVLLCVPVDYQCVDLSLYKDSQIVLLLNKATNTSESAGDGCMMILQDSVAYLNIGDEKSRTIRHSVIAPLAVSASRGVACVFAATKRALVYILEEDEDEVSDVE

SEQ ID NO: 169363 - protein, 220 aa, Glycine max
  Coding DNA Sequence Number=SeqID_52585
MEAETVQEQRKGAQLKKRALKNKALGITFNEKDLNDYVTGFHKRKKKRRKEAQKQQNEALRRKRNDERKRRKLEREHVLNGGVPPDEIDEGQEEVEEQVESIAEMKTYENDDLKVTVVTSEINPEDESYPSERKEAAVIPQSVVSDKRQGVPISNKKSFKKVAKQRSRPRPSSKRDKKKGKKRGKNAVIWLYLEVRTHACILQDLDVFRLVGYLPGSYCP

SEQ ID NO: 169364 - protein, 117 aa, Glycine max
  Coding DNA Sequence Number=SeqID_52586
  Gene Ontology: Mol. function=diacylglycerol kinase activity; Cellular component=membrane fraction; Biological process=protein kinase C activation
  Homolog annotation: Hit_ID=UPI0000D9ECCB; Match level="QueryCoverage =86%, HitCoverage=21%, E-value=2e-16, Identity=37%"; Hit description =PREDICTED: similar to sphingosine kinase type 2 isoform isoform 4
  Pfam annotation: Domain name=DAGK_cat; Domain location=4-116; Score =39.3; E_value=1.3e-08; Accession=PF00781.14; Description =Diacylglycerol kinase catalytic domain
MRPGRIENENRSDSLETKHQLHAKQVVQSLDFSKYDGIVCVSGDGILVEWVVNGLLQSQDWDTAIKMPLGVVPAGTGNGMAKSLLDSVGHPCTVPNAVLAIIRGLVADIDIESEKYI

SEQ ID NO: 169365 - protein, 341 aa, Glycine max
  Coding DNA Sequence Number=SeqID_52587
  Gene Ontology: Mol. function=calmodulin binding
  Homolog annotation: Hit_ID=Q6ETN1; Match level="QueryCoverage=98%, HitCoverage=57%, E-value=1e-139, Identity=70%"; Hit description =Putative calmodulin-binding protein
  Pfam annotation: Domain name=Calmodulin_bind; Domain location=68-341; Score=561.0; E_value=1.2e-165; Accession=PF07887.2; Description =Calmodulin binding protein-like
MHGRAREKRGLDSASAEEGQPDRKRPALASVIVEALKVDSLQKLCSSLEPILRRVVSEEVERALAKLGPAKLNTGRLSLPLFTGGKVEGEQGTAIHIVLIDANSGHIVTSGPESCVRLDVIVLEGDFNNEDDDNWDEEEFDSHIVKEREGKRPLLTGDLQVTLKEGVGTLGELTFTDNSSWIRSRKFRLGLKVASGCCEEMRIREAKSEPFTVKDHRGELYKKHYPPALNDEVWRLEKIGKDGSFHKRLNKAGIYMVEDFLRLVVRDPQRLRNILGSGMSNKMWDILVEHAKTCVLSGKLYVYYPEDARNVGVVFNNIYELSGLIANDQYYSADSLSENQK

SEQ ID NO: 169366 - protein, 140 aa, Glycine max
  Coding DNA Sequence Number=SeqID_52588
MTTFSQGQLLRSFKIKKTLNELRANVSILHLKMKFPTLIREIVIVKADQKQAQQCYAKSLKVEPYPSIREPDRSHPTIGGGTCWISPTVTFWSTFSLYKYVKGKSGLPKSAPYRQVFKIKRDKSKYRTLGTSLRQGQIQK

SEQ ID NO: 169367 - protein, 74 aa, Glycine max
  Coding DNA Sequence Number=SeqID_52589
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=90%, HitCoverage=6%, E-value=4e-17, Identity=61%"; Hit description =Kinesin motor domain, putative
MSGITEYAHKDREFVIKFSAMEIYNEAVRDLLNAGATSLRILDGPEKWTVVEKLTEDTLTERRQLQQLPLLFGS

SEQ ID NO: 169368 - protein, 257 aa, Glycine max
  Coding DNA Sequence Number=SeqID_52590
  Gene Ontology: Mol. function=protein binding; Cellular component =endosome; Biological process=protein transport
  Homolog annotation: Hit_ID=Q9S9T7; Match level="QueryCoverage=80%, HitCoverage=99%, E-value=6e-92, Identity=80%"; Hit description =Vacuolar protein sorting-associated protein 28 homolog 1
  Pfam annotation: Domain name=VPS28; Domain location=68-255; Score =398.4; E_value=1e-116; Accession=PF03997.3; Description=VPS28 protein
MVSIVRSPLWCCDISSVKKNPSLCACPVLFSNPPPSPLCDLILNPIAMTTMEVKLWNDKREREMYDNFGELYAIIKATERLEKAYVRDIISPQEYELECQKLIAHFKTLASTLKDTVPSIERFADTYKMECPAAINRLVVSGVPATVEHRATVAASASTSAAIVAECVQNFITSMDSLKLNMVAVDQVHPLLSDLYASLNKLTILPPDFEGKTKMKEWIARLSKMGAADELTEQQARQLHFDLESSYNSFMAALPNA

SEQ ID NO: 169369 - protein, 306 aa, Glycine max
  Coding DNA Sequence Number=SeqID_52591
  Gene Ontology: Mol. function=DNA binding; Cellular component=oxygen evolving complex; Biological process=DNA integration
  Homolog annotation: Hit_ID=Q1ST43; Match level="QueryCoverage=49%, HitCoverage=11%, E-value=5e-52, Identity=65%"; Hit description =Integrase, catalytic region; Peptidase aspartic, catalytic
VLTDLPQHKTVIGCKWVYRIKHKSDGSIERYKVRLVAKGYTQVEGQDYLDTFSLIAKLTTMRFLLALTAIDKWRLKQLDVKNAFLHGDLNEEVYMVIPHDMQVAKPGQVCKLQRSLYGVKHASRQWYARLSSFLISHGYKQCTSDYSLFIKHGCKTISVLLVDVDDIVLKYVLDILNDAGMLGSKSISTPCDYTTKLHQHSGLEFGPRRKIHRARTTVSVVSVPSPTIQQQEKTAPRQGQNRPNGARASGMINGGRSFPRRFSGRPIPKRGQVKVGIVVGLANSVASIFSRSRATRGCATPTHLAH

SEQ ID NO: 169370 - protein, 91 aa, Glycine max
  Coding DNA Sequence Number=SeqID_52592
MTPRKKETPCRWQQLKEGQDSQQMANDSKPTTTREYIDEHREKKGKDGYASGGDHKKGFNQRQLFVQQEHRWPFDSQEGPSEVGNCGGLVS

SEQ ID NO: 169371 - protein, 264 aa, Glycine max
  Coding DNA Sequence Number=SeqID_52593
  Gene Ontology: Mol. function=endonuclease activity; Biological process=DNA catabolic process
  Homolog annotation: Hit_ID=Q9ZR87; Match level="QueryCoverage=56%, HitCoverage=63%, E-value=3e-45, Identity=52%"; Hit description =Bifunctional nuclease
  Pfam annotation: Domain name=S1-P1_nuclease; Domain location=1-186; Score=80.1; E_value=6.9e-21; Accession=PF02265.7; Description=S1P1 Nuclease
MLPDSAQGDLAAVCSWADEVGHTYRYRWCSALHYADTPDFKCNYEYFRDCHDSYRHKHRCVSGAIYNYTMQLKSADASTSSEFNYNLAEALMFLSHFVGDIHQVWDDLIIQSALKTFYDSDLSIMIQAIQRNITLSMQICLQKCYTRKHFGRSHHSVPIGSGVNVIGNGAPFETSCKSVSGNTFVKEIIGPSSSRIERERCEYEVYLPWIRSEGIPETQFVESQLTPAHILESDSAITGAWEDRDLRAEIVAFDTEPPKLSKYY

SEQ ID NO: 169372 - protein, 51 aa, Glycine max
  Coding DNA Sequence Number=SeqID_52594
MVFLIILLPDEEEEAKLALHGYSPGHKFYKSQGSNINNISAEKEEGDSSTQ

SEQ ID NO: 169373 - protein, 164 aa, Glycine max
  Coding DNA Sequence Number=SeqID_52595
  Gene Ontology: Cellular component=integral to membrane; Biological process=protein transport
  Homolog annotation: Hit_ID=Q8H5X5; Match level="QueryCoverage=96%, HitCoverage=49%, E-value=4e-41, Identity=55%"; Hit description =Putative secretory carrier membrane protein
MAGRYDSNPFDEEEVNPFSDPSVRGKASSQSNFSGGAFYTTNPGSVPAATNSRLPPLKPEPVDYNYGFGATVDIPLDSSMDLKKKEKELQAKETELRKREQVANTPREVRRKEEAASRAGNVLEEKKWPPFFPIIPHDIANEIPIPLQKLQYVAFTTLVGKPTP

SEQ ID NO: 169374 - protein, 420 aa, Glycine max
  Coding DNA Sequence Number=SeqID_52596
  Homolog annotation: Hit_ID=Q5JLN0; Match level="QueryCoverage=74%, HitCoverage=57%, E-value=6e-75, Identity=46%"; Hit description =Lysine ketoglutarate reductase trans-splicing related 1-like
  Pfam annotation: Domain name=DUF707; Domain location=44-419; Score =346.8; E_value=3.6e-101; Accession=PF05212.3; Description=Protein of unknown function (DUF707)
MISDTFCYSKQFVMKIETLKYQSYQEEIDKQWNFREDEKASSETSGNLKGLPRGIIQATSDFELRPLWSPSSLRSKVSVYSNRNLLAVPVGIKQKHNVDAMVQKFLPDNFTIILFHYDANMDGWWDLNWTSKAIHITAQNQTKWWFAKRFLHPDIVSIYDYIFLWDEDLGVEHFSPSRPILARSDGPGWAKKYIPIGDLDWAGQSPLSILLACQANPTHLTALMHNKLYIILIRLIRYIEIVKEEGLEISQPALDPNSTEIHHRITVRARTKKVHRRVYELRGSTRCSEASKGPPCTGFVEGMAPVFSRSAWYCTWHLIQNDLVHGWGVDIKIGYCAQGDRTQNVGVVDSEYVVHKAIQTLGGSDDPTKVSNRQRTTPKHGVAAFDQRVEVDCKSHCLHCNMIRYEDSQHGNLKSSKSGG

SEQ ID NO: 169375 - protein, 234 aa, Glycine max
  Coding DNA Sequence Number=SeqID_52597
MAFWQLENDKANAMRRFQRKRTLETIFHLFKLCAAILLFSHCSSFFPNITLQTFPYLYHFLLPLFRNSFYAFLLLNAIILLLFTLSNNVGASKDALNQSRLIVTAPQEQPRTVDSSHKKITTTICGSSSPVFEETVRAVTETTTTTTCCCTTVTTTEGETVSVSEKKCYRRVQSESYERRMAVAPPSLQRQLRCVEQLSEDEFNRAVEEFIAMNKRMQKEEHIRSQKTGYWASN

SEQ ID NO: 169376 - protein, 146 aa, Glycine max
  Coding DNA Sequence Number=SeqID_52598
MSKWTLSIDKDSVDDTVYKKYDIRKEQWAQFYQSRRDPSWEDVQKKAHAIQKQNIVPHMLSRGGYEYLENKMMEEKKKKKLEEVAQSGSSDTVIDPSSPIRRHMKWKTASTKKIGQIMSKATKEIADKIDSLEEHASHGSFVAHGR

SEQ ID NO: 169377 - protein, 86 aa, Glycine max
  Coding DNA Sequence Number=SeqID_52599
MGTWKLEGNNYLNFWKIGNRFGMFQTWSPFHIVATCHRGKKLHPGKSNAIFSQEHCFGTGICLRDEHRRIRAKNILGIWQPRSLRA

SEQ ID NO: 169378 - protein, 283 aa, Glycine max
  Coding DNA Sequence Number=SeqID_52600
  Subcellular localization annotation: CTP_CleavageSite=35; ConfidenceScore=5.33e-01
MRHRGDAEPPPQPQSSPSNSLPHRKKNRKRRATTSVSSETSYPNGPDQLNTHIHHATVVCQDKPKPEESKSAVAGEGFRFGELRQRSVNGRDSFGESAVTAVGDGYVTEVSSVATATSERVESLELKRVLANDSIPKRSPVSYVLEKLYHGNSVWSTTTIGDEKGRERVYDTIFRLPWRCELVFAYRCWFLCLLQFISVIINYHAHEDSDDHLEASENKSCELIKLCPSSAIFLAFSFRNRFSVLHSDLIMLMAGSSRGHLQLSCQILAVFLLWLVESLFCSK

SEQ ID NO: 169379 - protein, 325 aa, Glycine max
  Coding DNA Sequence Number=SeqID_52601
  Gene Ontology: Mol. function=transporter activity; Cellular component= intracellular; Biological process=transport
  Homolog annotation: Hit_ID=Q94FN1; Match level="QueryCoverage=98%, HitCoverage=56%, E-value=1e-83, Identity=51%"; Hit description =Phosphatidylinositol transfer-like protein III
MFIINAGPGFKILWNTVKTFLDPKTTSKIHVLGNKFQSKLLEIIDESCTCVDQGGCMRSDKGPWQDPNILKMVLSGEVGCSKQIVTVSNDEGRVIECDKISFPMIRGSDTSTGESGSEVEDIASPKACGNCISPMLTPVLEEARMVGKTSHAGNLVEHVPTVDKAIDVGPKEKQATPRMLFCSTAGFILALYTFARSIAFRVTKGIRYSDSDSARNILNMTVDSISMEESRPDSCAPGRFTKTNIPSSTLKRIGELEEKVDMLQSKPSVMPHEKEELLDAAVYRVDALEAELIATKKALYESLIRQEELMAYIDSQERDKFKASQ

SEQ ID NO: 169380 - protein, 241 aa, Glycine max
  Coding DNA Sequence Number=SeqID_52602
  Gene Ontology: Mol. function=oxidoreductase activity; Cellular component=membrane; Biological process=electron transport
  Homolog annotation: Hit_ID=Q9M066; Match level="QueryCoverage=90%, HitCoverage=41%, E-value=4e-23, Identity=29%"; Hit description =Cytochrome P450 90C1
MASLMSTICWALWCKNKSSIGIPPGNRGLPFVGETLQFMAAINSSKGVYEFVHARRLRYGKCFKAKLFGETHVFISSRESAKVIVNKENEGGKFSKSYIKSIAELLGRDSLLCAAQQHHKLIRARLFSLFSTDSLSSFVQLFDSLVLQATRTWTCGSVVVIQDETLKLACKAMCKMLISIESGQELVTMHNEVARLCEAMLALPVRLPWTRFYKGLQARKRIMNILEKNISERRSGIATHH

SEQ ID NO: 169381 - protein, 443 aa, Glycine max
  Coding DNA Sequence Number=SeqID_52603
  Gene Ontology: Mol. function=DNA binding
  Pfam annotation: Domain name=Bromodomain; Domain location=173-259; Score=39.2; E_value=1.4e-08; Accession=PF00439.15; Description =Bromodomain
SLESKLETLQAGRDEKRDDCHVDNGSAEPELHVPSQKLDRVDTSAKEMSKDGLSAGSFTHETKTNWTHECQVPATSCEYVRTKPEVSASTEQEKVLNVDKSTHTVYEGQGGCLKKPRGKRKRKDCGRSINEVSARESDFSADVCKESSISNCGEIVKSSGMNEENANLKKAGIKDLMEVLDSFLTVQGASAFSYKHDSQKRGKYEQLIRQHMDFETIKSRICNGTIKSVVELLRDLLLLSNNALAFYSKNTREYKTALQLRDLVIKTLTEKLECASTSPVCDPSAKVRSTCFSTSPMRDSSVKVRSICSTSLVHDPSVQVRSMRPGNRKIVAKVAGGSCSAERVSVGVKKAKKVDSLPAERVSAAVKKANKVESPPSVESVKKAFGGRAKKVGRESAAHSHILSLYTTFLSLKFFENCSKKKKVTCKSWVEAPISMMQIEELP

SEQ ID NO: 169382 - protein, 147 aa, Glycine max
  Coding DNA Sequence Number=SeqID_52604
MEAMKGQMATMMEGMMSMKTNDGGQCDYSCCCKYRHRSGPNSLIEPQSSKSSSLGYGRSGRRSIGKYSLPPNYTPPIVEHSANENINDSTPILIESQQPQSGHAHVSQPMGEAHEAPQDHNLVDFEPHLGYAAEGKTFCGIPVSCLI

SEQ ID NO: 169383 - protein, 56 aa, Glycine max
  Coding DNA Sequence Number=SeqID_52605
MVTWSTWQELLLGGAVSRHGIRDWTVIAAELKTRTVSPCIFTPESIVISSPSVMCC

SEQ ID NO: 169384 - protein, 85 aa, Glycine max
  Coding DNA Sequence Number=SeqID_52606
MATLYYAMSFPNFRRSGIGGHMPFLFDLAREMAFLFELSNSSAALEFDSHRFQSAEHQQRFETIKGWSFHRERHVQLREDEYPDI

SEQ ID NO: 169385 - protein, 455 aa, Glycine max
  Coding DNA Sequence Number=SeqID_52607
  Homolog annotation: Hit_ID=UPI00006909BF; Match level="QueryCoverage =40%, HitCoverage=86%, E-value=1e-41, Identity=50%"; Hit description =probable Phospholipase/Carboxylesterase family protein
  Pfam annotation: Domain name=Abhydrolase_2; Domain location=71-235; Score=-31.6; E_value=1.5e-05; Accession=PF02230.7; Description =PhospholipaseCarboxylesterase
QRDDVRHLVVGADPRLRRPGRVRCLHGRAGLGGIALAGRVDGAGGDRHGAGGPGEHPAAGAGTCCAAAPGSRRTTAAETGVSPQWSVIWLHGLGADGHDFAPIVPELVRPHWPALRFVFPHAPVRPITINNGVPMRGWYDIVGMDFRSRADMAGVQESVVQLDALIAREIERGHRTGEDLPGRLLAGGRDHPDRRAVAHRATGWPDRTVHLPAGSRERQARAGVHGPWQQRPGDSAGGGRTQRAGPAGDGPGGGMAQLPDGPPGTPGRCLSHVTGQRPALDAGTVPPAAAGGDARPGRTGGGGAGPGPGWQPPLDRGRTAVGQWFRAVAGAGRNGQPVPAAERVVEVATGPGGGLGHRTGDADRGGLRGHRTCPVRGAWRQLRPRHQLLALHAGQRRDDGADHGVGPALLLCQRTRTGRRAAGADPPAFPVQQHEPDRQPAASRPGGGRAGGAGP

SEQ ID NO: 169386 - protein, 174 aa, Glycine max
  Coding DNA Sequence Number=SeqID_52608
MAPKKLSMKRSRRDTAAEGTSAAPKFDSHRFRSAEHRQHFEAIKEWSFHRERRVQLREDEYTNFQEEIAHRHWASLVTPMAKYDPEEGQECEFIQRRNRADGFDEEAIAQLLCTPGQDFARTATGRRVRIMRTSMTTLTQTWMTLLLSNVLPSDHNSDLPLPKCQLVCHPPGTL

SEQ ID NO: 169387 - protein, 110 aa, Glycine max
  Coding DNA Sequence Number=SeqID_52609
  Homolog annotation: Hit_ID=Q6YZ52; Match level="QueryCoverage=32%, HitCoverage=6%, E-value=1e-09, Identity=83%"; Hit description =Kinesin motor protein 1-like
MMLLVIHCCFRDGRRLKDIWMWMLTFKDVVFGIVVEGTFVEGIKEEVVLSPTHALSLIAAGEGCTDVLMVIAKLTDGKETHIPYRDSKLTRLLQSSLSGHGRISVSAISL

SEQ ID NO: 169388 - protein, 104 aa, Glycine max
  Coding DNA Sequence Number=SeqID_52610
  Subcellular localization annotation: CTP_CleavageSite=24; ConfidenceScore=5.32e-01
MSLPGAVHASSTQRGGAPRMSLTRAVHVSSIFESGAPRMSLPSAVRQFSILHFFSDPHECHCLALFMHPPPKEFGAMLHDCLSVDPLVQSSILLFFRSPKNVIA

SEQ ID NO: 169389 - protein, 171 aa, Glycine max
  Coding DNA Sequence Number=SeqID_52611
METETSKELEEELIMYMKEVVEQHEKGFQKVVSQVGFFTKDLDLVLFDPFKDVMDDVLLDKEDIAVEEEVVEEQDADATNQGLGDVGRKALVVMCEVKRSKLTEWVPWVLKECVPRVDLRGSQRVNLGFNEPWTKHMFAMGFNKHVELHQGLPRMGLGSNEPVRLTKSGSW

SEQ ID NO: 169390 - protein, 652 aa, Glycine max
  Coding DNA Sequence Number=SeqID_52612
  Gene Ontology: Mol. function=catalytic activity
  Homolog annotation: Hit_ID=Q5VQE5; Match level="QueryCoverage=91%, HitCoverage=91%, E-value=0.0, Identity=56%"; Hit description =Alpha/beta hydrolase-like
  Pfam annotation: Domain name=Abhydrolase_1; Domain location=399-638; Score=55.7; E_value=1.5e-13; Accession=PF00561.10; Description =alphabeta hydrolase fold
MGKGGHCFFEKLRRCVRTVFFVVALVASLSVTSLPVVVAVVDVLVPCVLIPNFTCVMCYSIKDHFHRYAFKSSFTDIPLISVIRSLIILCVYSVCDGPALSHGPYLGTVTLCSFLSIVLLSVKACVFTVNSHIEAEASVSLRKHRLHLKKPWGMPVLFLSSVVFALGHTVVAYRTSCRARRKLLFHRVDPEAVLLCKNVFSGYPKVPRSPTPSAGRTPKSDCEMRRRPFGTARDEELLVRLLANSDSLFITCQGLTLHHKLSLPGSPPHTLSSMSCVDPNSSCSTSSMAAGLAKSNKHLPSTSPNIQPQLYRSYSNQFHGSSLHVPLLDGPMNSIISENIPVFHLDGVCEDETSKLNFQSLQQDLESIDQLGIVLVHGFGGGVFSWRHVMGSLARQSNCTVAAFDRPGWGLSSRPRREDWEEKELPNPYKLESQVDLLLSFCSEIGFSSVVLIGHDDGGLLALMAAQRIQTSMNYFNVNLKGIVLLNVSLSREVVPSFARILLHTSLGKKHLVRPLLRTEITQVVNRRAWYDSTKMTPEVLTLYKAPLSVEGWDEALHEIGKLSSETILSAKNAESLLQAVGDIPVLVIAGAEDSLVTLKSCQAMASKLVNSRLVAISGCGHLPHEECPKALLAAISPFINRLLSASDSQRQ

SEQ ID NO: 169391 - protein, 567 aa, Glycine max
  Coding DNA Sequence Number=SeqID_52613
  Gene Ontology: Mol. function=mRNA (guanine-N7-)-methyltransferase activity; Cellular component=nucleus; Biological process=mRNA processing
  Homolog annotation: Hit_ID=Q9LHQ7; Match level="QueryCoverage=58%, HitCoverage=98%, E-value=1e-137, Identity=65%"; Hit description=mRNA cap guanine-N7 methyltransferase 1 (EC 2.1.1.56) (mRNA (guanine- N(7)- )-methyltransferase 1)
  Pfam annotation: Domain name=DNA_photolyase; Domain location=363-546; Score=211.9; E_value=1.5e-60; Accession=PF00875.8; Description=DNA photolyase
  Pfam annotation: Domain name=Methyltransf_11; Domain location=107 -188; Score=35.4; E_value=2e-07; Accession=PF08241.2; Description =Methyltransferase domain
  Pfam annotation: Domain name=Methyltransf_12; Domain location=107 -186; Score=41.8; E_value=2.3e-09; Accession=PF08242.2; Description =Methyltransferase domain
  Pfam annotation: Domain name=Pox_MCEL; Domain location=48-309; Score =374.7; E_value=1.4e-109; Accession=PF03291.7; Description=mRNA capping enzyme
  Pfam module annotation: Pfam domain module=DNA_photolyase::Methyltrans f_11::Methyltransf_12::Pox_MCEL; Domain location=363-546::107 -188::107-186::48-309
MKRGYQESHSTSLGPPQSRARHDPQADEWGYIGKVLRLFELVIGSAHFLEDESTKIFARKVADHYSARSNQTLEEREASPIIHLKKLNNWIKSVLIQLYARRGDAVLDLACGKGGDLIKWDKAKIGYYVGIDIAEGSVRLDKVLADDAPFDLCSCQFALHYSWSTEVRARQALANVSALLRPGGIFIGTMPDANVIIKKLREAEGLTFGNSVYWVRFDEEFSDKDAVDCPEWIVPFHIFKSLAEEYDFELVFAKNSHEFVHEYMKKPEFVELMRRLGALGDGNQDQSTLSADEWEAAYLYMSFVLRKRGQPDKTQSSSRKDRGSMHISEEDIMKGANPMILFKPSSAMRLSPCANTTSMSSGSGSLLWFRKGLRIHDNPALEVASRGASHLYPVFVIDPHFMEPDPNSSAPGSSRAGLNRIKFLLECLVDLDLNLKNLGSRLLILKGDPAEVVIRCLKELHVKKLCFEYDTEPYYQALDVKVKNFALAAGIEVFSPVSHTLFNPTDIIEKNGGKPPLSYQSFVKLAGEPPSSLSTVYSSLPPVGNLGSCDISEVPTIRDLGYGDAEQ

SEQ ID NO: 169392 - protein, 457 aa, Glycine max
  Coding DNA Sequence Number=SeqID_52614
  Gene Ontology: Mol. function=RNA-directed DNA polymerase activity; Cellular component=chromatin; Biological process=chromatin assembly or disassembly
  Pfam annotation: Domain name=rve; Domain location=225-381; Score =92.8; E_value=1.1e-24; Accession=PF00665.16; Description=Integrase core domain
  Pfam annotation: Domain name=zf-H2C2; Domain location=170-207; Score =13.2; E_value=0.0064; Accession=PF09337.1; Description=His(2)-Cys(2) zinc finger
  Pfam module annotation: Pfam domain module=rve::zf-H2C2; Domain location=225-381::170-207
  Subcellular localization annotation: CTP_CleavageSite=25; ConfidenceScore=5.09e-01
MGAILSQNGHPLAFFSKPFTPKLLRASTYVRELFAITTTVKKWRQYLLGRHFTIITDHRSLKELLTQVIQTPKQHKYLAPLMGYDYSIQYRASIHNQAADALSRQQEPSSVFMILSVPSLTFLDELRRQVDNNSDYCRRQQEIIENPTQHPGFFMTHNLVLTVGRIWLPRGGHAKITETLARISENLNWPGLREDVKQFVTNCQECQVTKYETQKTAGLLCPLPVPHRPWEDLSLDFILGLSSYHGNTTILVVVDRFSKGIHLGMLSTAHTAHMVASLFIEMVVKLHEIPRSLVSDRDPLFISRFWQELFRAKDTHLRMSSAYHPQSDGQTEALNRVVEQYLSAFTHRRPHRWGKLLPWIELSHNTSWNAGTGTTPYEVTFGRKPFNFPEYITGTSNIEAVENLLVDRDATFQTIRKNLLKAHKVMNRQADSKRREVQYQMGDWVLLRLRPYRQTSM

SEQ ID NO: 169393 - protein, 434 aa, Glycine max
  Coding DNA Sequence Number=SeqID_52615
  Gene Ontology: Mol. function=nutrient reservoir activity; Cellular component=cellulose and pectin-containing cell wall
  Homolog annotation: Hit_ID=Q43557; Match level="QueryCoverage=78%, HitCoverage=89%, E-value=1e-139, Identity=70%"; Hit description =Unidentified precursor
  Pfam annotation: Domain name=DUF642; Domain location=105-432; Score =759.0; E_value=2.9e-225; Accession=PF04862.3; Description=Protein of unknown function, DUF642
MQKFKLLLVLFFATCHSSLSITDGRVRRRIQVGINNLISNPEPNFCCWRKFEPDSYSNQNQGGSGTDLMDSGPLSCLTSVLLHLSKCLSLLPNGDFEVGPKPSELKGSIVTTPNGIPHWTISGMVEYIKSGQKQGDMVLVVPHGTYAVRLGNEASIKQKIQVVKGMFYSLTFSASRTCAQEEKLNVSVVPSNEKSDWGVFPIQTMYGSNGCDSYACGFRADYPRVEIVIHNPGVDEDPACGPLIDSVALKLLHSPKRTRDNLLKNGNFEEGPYVFPKESWGVLIPPHIEDAYSPLPGWMVESLKAVKYIDSDHFAVPEGKRAIELVAGKESAIAQVVITIIGKVYDLTFVVGDANNSCEGSMVVEAFAGKDTIQVQYQSKGKGGFIRGKLRFKAMSTRTRIRFLSTFYTTKSDNTGSLCGPIIDDIRLLSVRYS

SEQ ID NO: 169394 - protein, 113 aa, Glycine max
  Coding DNA Sequence Number=SeqID_52616
  Subcellular localization annotation: CTP_CleavageSite=54; ConfidenceScore=5.59e-01
MNNLKSKSHLTKQKRMNNNLQNKSFIRNGAFTRNRVPSNHAFTGPGRRANCDLEAKAKRDLQLRNNIVIRDWGLKKMTTSRLDQIEGLVWFSREFNMLEVKVIPLRKDTINVS

SEQ ID NO: 169395 - protein, 171 aa, Glycine max
  Coding DNA Sequence Number=SeqID_52617
  Gene Ontology: Mol. function=cytochrome-c oxidase activity; Cellular component=mitochondrial envelope; Biological process=electron transport
  Homolog annotation: Hit_ID=Q0KKQ5; Match level="QueryCoverage=58%, HitCoverage=65%, E-value=1e-52, Identity=91%"; Hit description =Cytochrome c oxidase subunit Vb
  Pfam annotation: Domain name=COX5B; Domain location=50-147; Score =65.5; E_value=1.8e-16; Accession=PF01215.9; Description=Cytochrome c oxidase subunit Vb
  Subcellular localization annotation: CTP_CleavageSite=26; ConfidenceScore=5.62e-01
MLRRLLSSHLKTLAATASSSTPRSASAAARFAALSRSSRYFSTQSEDATAIKKKVEDVMPIATGHEREELQAELEGRNILEIDHPEGPFGTKEAPAVVKSYYDKRIVGCPGGEGEDEHDVVWFWLEKDKPHECPVCAQYFVCFCGERINESLFSMSCSDTFDSCGVECQDI

SEQ ID NO: 169396 - protein, 273 aa, Glycine max
  Coding DNA Sequence Number=SeqID_52618
  Gene Ontology: Mol. function=DNA photolyase activity; Cellular component=nucleus; Biological process=DNA repair
  Homolog annotation: Hit_ID=O48652; Match level="QueryCoverage=98%, HitCoverage=56%, E-value=1e-130, Identity=70%"; Hit description=6-4 photolyase
  Pfam annotation: Domain name=FAD_binding_7; Domain location=1-232; Score=339.1; E_value=7.4e-99; Accession=PF03441.4; Description=FAD binding domain of DNA photolyase
MKDKKWVANFEKPKGNPSAFLKPATTVLSPYLKLLWREFFYTAAFGTPNFDRMKGNRICKQIPWKDDDKLLEAWREARTGFPWIDAIMVQLRKWGWMHHLARHSVACFLTRGDLFVHWEKGRDVFERLLIDSDWAINNGNWMWLSCSSFFYQYNRIYSPTTFGKKYDPNGDYIRHFLPVLKDMPREYIYEPWTAPKSIQTKANCIIGKDYPMPVVSHDSASKECRRKMGEAYALNKELNGLVSEDDLKNLRRKLDESEGQEAGAKRYKQQLIG

SEQ ID NO: 169397 - protein, 77 aa, Glycine max
  Coding DNA Sequence Number=SeqID_52619
MAMMITIDCNPSIKSGINSGKMERHCLEYTLAFQNPVAYDAHLLELPILLDNASEVETELNDNLLIFGNNLGVSVMA

SEQ ID NO: 169398 - protein, 199 aa, Glycine max
  Coding DNA Sequence Number=SeqID_52620
  Gene Ontology: Mol. function=protein disulfide oxidoreductase activity; Cellular component=mitochondrion; Biological process=cell redox homeostasis
  Homolog annotation: Hit_ID=Q1PCR8; Match level="QueryCoverage=77%, HitCoverage=99%, E-value=1e-48, Identity=66%"; Hit description =Glutaredoxin
  Pfam annotation: Domain name=Glutaredoxin; Domain location=71-173; Score=55.5; E_value=1.7e-13; Accession=PF00462.14; Description =Glutaredoxin
MATSLSNMFLKGIAARSLSRPLNGLFYCTRYSTTVSNDSDTHDDFKPANKLENSGISLSNVIEQDVKDNPVMVYMKGVPDFPQCGFSSLAVRVLKHYDVPISARNILDDPDLKNAVKAFRNRSHLGPMLDPLVSEHLSHRLAKSLETSQPANVYACLCNWPTFPQIFIKGEFIGGSDIVLNMHQTGELKEKLKDITSKQ

SEQ ID NO: 169399 - protein, 63 aa, Glycine max
  Coding DNA Sequence Number=SeqID_52621
MVKDKLKKHVLTAFTPNGDYVAILSANEVAKIDWDHRHVVVLDHVVIPPSLHVFIRPISLNGT

SEQ ID NO: 169400 - protein, 255 aa, Glycine max
  Coding DNA Sequence Number=SeqID_52622
  Gene Ontology: Mol. function=hydrolase activity; Cellular component =mitochondrion; Biological process=fatty acid metabolic process
  Homolog annotation: Hit_ID=UPI000034F493; Match level="QueryCoverage =91%, HitCoverage=91%, E-value=1e-104, Identity=77%"; Hit description= carboxylic ester hydrolase
  Pfam annotation: Domain name=Abhydrolase_2; Domain location=20-249; Score=135.9; E_value=1.1e-37; Accession=PF02230.7; Description =PhospholipaseCarboxylesterase
  Pfam annotation: Domain name=Peptidase_S9; Domain location=59-252; Score=-77.7; E_value=0.035; Accession=PF00326.11; Description=Prolyl oligopeptidase family
  Pfam module annotation: Pfam domain module=Abhydrolase_2::Peptidase _S9; Domain location=20-249::59-252
MIVSLVHLEGSRTARRSLEFGKTHVVRPKGKHQATIVWLHGLGDNGLSSYQLLESLPLPNIKWICPTAPTRPVTILGGFSCTAWFDMGELSEDGPDDWEGLDASASHIANLLSTEPADVKVGIGGFSMGAAVAQYSATCFAMGRYGNGIPYPVNLRAVVGLSGWLPGSRSLRNKIEVSHEARRRAASLPVLLSHGISDDVVLYKYGEKSAQSLSSAGFRYITFKSYDGLGHYTVPREMDEVSNWLSSRLGLGGST

SEQ ID NO: 169401 - protein, 163 aa, Glycine max
  Coding DNA Sequence Number=SeqID_52623
  Gene Ontology: Mol. function=zinc ion binding; Cellular component =intracellular
  Homolog annotation: Hit_ID=Q3S345; Match level="QueryCoverage=70%, HitCoverage=74%, E-value=3e-36, Identity=63%"; Hit description=Zinc finger protein-like protein
  Pfam annotation: Domain name=zf-RanBP; Domain location=3-32; Score =21.3; E_value=0.0023; Accession=PF00641.9; Description=Zn-finger in Ran binding protein and others
  Pfam annotation: Domain name=zf-RanBP; Domain location=57-88; Score =25.7; E_value=0.00016; Accession=PF00641.9; Description=Zn-finger in Ran binding protein and others
  Pfam module annotation: Pfam domain module=zf-RanBP::zf-RanBP; Domain location=3-32::57-88
MSRPGDWNCRSCQHLNFQRRDSCQRCGDSKYGDRVVDFGGFGGRGGSSFGLTGSDVRPGDWYCAAANCGAHNFASRSSCFKCGAFKDDLAGGGYNSSDILRSRAFGGSGRPGWKSDQDAMSTTLLAEWNVLNAVLPGTRTRKNEFILARKATLINGDAARFLY

SEQ ID NO: 169402 - protein, 251 aa, Glycine max
  Coding DNA Sequence Number=SeqID_52624
  Homolog annotation: Hit_ID=Q47522; Match level="QueryCoverage=14%, HitCoverage=44%, E-value=8e-14, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLDSKHDSTQRLTSSSASCRQVSIASKDTQRQIMVILRLLSSRGGEPDDMWRQIVVIPHTFLSFGDDRVRWHAETNYSHSAPLVIHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 169403 - protein, 165 aa, Glycine max
  Coding DNA Sequence Number=SeqID_52625
MKTDMEAMKEKITIMMEAMMSMRKMIEVNTATVVFASTATTMDSIHPKHFLPPYGFPPNYTPPTVVYAPGPLAIIEKEKFDHIEERLRAIEGGGNYAFADMAELCLVPDVVIPPKLKVPDFSKYKGTTCPENHLKIYCRKMGAYAKDEKLLMHFFQETLVGAAIT

SEQ ID NO: 169404 - protein, 216 aa, Glycine max
  Coding DNA Sequence Number=SeqID_52626
MSIEQMRVVCEGAKALGMKLVGDNFIGYKFCDGRDNLRDAANELLQSFFPGELLQDDEHEYTQRVYFLGEHRDEDYSHARWCGNDYASKNKNSKYCSRKCLWAANSNRVPYNKGAGKGWTDRRGYRWINVIINGKSVAKREHRHVMEKHLGRTLSPDELVHHKNGIKTDNRIENLELQVWSEHTAHHHENSSRPDLTKKKMQVVANYRYQLERERE

SEQ ID NO: 169405 - protein, 145 aa, Glycine max
  Coding DNA Sequence Number=SeqID_52627
MTPTRHPLDLEKSNRALGFPALITGLCQSYGVPITPSKVIRPPITRSFIEKYCMPRQTQGDAHQDAGAPPPPQQADSDGPLGVECLNQQGQGSAPFVCPTLEQFGAEVAWPGDWPDAQAGEEPAGSPGEADESRMDEDMTDLLGF

SEQ ID NO: 169406 - protein, 45 aa, Glycine max
  Coding DNA Sequence Number=SeqID_52628
MGAKDKSIMHKSFSHRLMANEYLHNQTDKLANIFSHTSNYMLILF

SEQ ID NO: 169407 - protein, 207 aa, Glycine max
  Coding DNA Sequence Number=SeqID_52629
  Gene Ontology: Mol. function=DNA binding; Cellular component =mitochondrion; Biological process=DNA integration
  Homolog annotation: Hit_ID=Q1RSZ9; Match level="QueryCoverage=99%, HitCoverage=16%, E-value=2e-90, Identity=75%"; Hit description =Polynucleotidyl transferase, Ribonuclease H fold
MAYILLYVDDIILTASFDAIRKSIISLLSSEFAMKDQGSLSYFLGIAVTHHACSLFLSQRKYAIEIIERADMSSCKPSPTSVDTKPKLNANSSTPYADPSHYRSLARAFQYLTFMRPDIAYAMQQVCLFMHDPREEYIYALKRIVHYIQDADWGTCLDARCSTSSYCVFLGDNLISWSAKRQATLSRSSVEAKYRGIANVTSESCWL

SEQ ID NO: 169408 - protein, 169 aa, Glycine max
  Coding DNA Sequence Number=SeqID_52630
MTKVPFICSVPCRFGICQTPLEVTSSQFIASEFFPLLIVKTLLYPGALAEAICKQKTIPSYRNLLNLHQFNSRAVSAASDLQRLEVLGGSYLSVGGAITSLIKPGRMSLFRILILMWGLIRESIKGKSGLAHAKVIHIYSALYIALISAFFSIRKDVRKIIRTSLESTL

SEQ ID NO: 169409 - protein, 79 aa, Glycine max
  Coding DNA Sequence Number=SeqID_52631
  Homolog annotation: Hit_ID=Q1RSZ9; Match level="QueryCoverage=97%, HitCoverage=5%, E-value=9e-22, Identity=64%"; Hit description =Polynucleotidyl transferase, Ribonuclease H fold
MTDSNKFYPTLVVSNIKNYISITLEMENVQYATWGELFKIHALSHNVLHHIVPPKKGKEKVPKIDEEKELWLTFDATIL

SEQ ID NO: 169410 - protein, 116 aa, Glycine max
  Coding DNA Sequence Number=SeqID_52632
MDGLQRSEVSFRRQGSSGLVWDDKLLSGELNKVNNNEDQKGGGSGGDLNLKVRTTPPNTTIQRSRSNGGYRTGKVSPAIEPPSPKLSACGFCSAFGKTREKGRAKHRSRNFDLCTK

SEQ ID NO: 169411 - protein, 182 aa, Glycine max
  Coding DNA Sequence Number=SeqID_52633
  Gene Ontology: Mol. function=peptide deformylase activity; Cellular component=mitochondrion; Biological process=translation
  Homolog annotation: Hit_ID=Q9FUZ0; Match level="QueryCoverage=76%, HitCoverage=45%, E-value=4e-42, Identity=73%"; Hit description =Peptide deformylase, mitochondrial precursor
  Pfam annotation: Domain name=Pep_deformylase; Domain location=63-168; Score=-15.8; E_value=6.7e-07; Accession=PF01327.11; Description =Polypeptide deformylase
  Subcellular localization annotation: CTP_CleavageSite=45; ConfidenceScore=5.31e-01
MEALHLHRVLLMPVSQKTSIFLRASGTPLSTLARPPLRWSSQTCSARAGWFLGLGADSKKTNLPDTVKAGDPVLHEPAQDVDPNEIKSERVQKIIDDMIQVMRKAPGVGLAAPQIGIPLRIIVLEDTKEYISYVSKEEAKTQDRRPFDLLVCYFNTSFISSLEAGDPESQAREEGQEDCSVF

SEQ ID NO: 169412 - protein, 101 aa, Glycine max
  Coding DNA Sequence Number=SeqID_52634
  Gene Ontology: Mol. function=nucleic acid binding
  Homolog annotation: Hit_ID=Q1SEE1; Match level="QueryCoverage=50%, HitCoverage=3%, E-value=2e-18, Identity=82%"; Hit description =Integrase, catalytic region; Zinc finger, CCHC-type; Peptidase aspartic, catalytic
MAKVSYASEIGSFMYLMVCMRPDIGHAVGVVSRFMSNPGKAYWEALEWILRASPPVALLGFPYVRDKEKGLKPPFHGPTCDASFSVTRYSFVNPNVEGVRN

SEQ ID NO: 169413 - protein, 79 aa, Glycine max
  Coding DNA Sequence Number=SeqID_52635
  Homolog annotation: Hit_ID=Q1SEE1; Match level="QueryCoverage=90%, HitCoverage=6%, E-value=5e-14, Identity=72%"; Hit description =Integrase, catalytic region; Zinc finger, CCHC-type; Peptidase aspartic, catalytic
MAAEDVKLLEDANRRLFNKPKGMKDEDWALLDRQALRVICLTLSCNVAFNIAKETTISSLMAAFSACMKSCQPQTKFIL

SEQ ID NO: 169414 - protein, 153 aa, Glycine max
  Coding DNA Sequence Number=SeqID_52636
  Gene Ontology: Mol. function=receptor activity; Cellular component =integral to membrane; Biological process=protein amino acid phosphorylation
  Homolog annotation: Hit_ID=Q9SLS3; Match level="QueryCoverage=99%, HitCoverage=78%, E-value=3e-31, Identity=41%"; Hit description =Elicitor-inducible LRR receptor-like protein EILP
MVKGMDPESLFLKRRMASKLTKLPMEAGIGPVSSFKDIYNPLSFDKFPMVKGMDPESLFSSRSKESKWTKLPMEAGIGPDHGVQIDQVAYGSWDWSRMDPESLFSKRRMASKLTKLPMEAGIGPVSSFKDIYNPLSFDKFPMVKGMDPESLFS

SEQ ID NO: 169415 - protein, 505 aa, Glycine max
  Coding DNA Sequence Number=SeqID_52637
  Gene Ontology: Mol. function=protein binding; Cellular component =integral to membrane; Biological process=protein amino acid phosphorylation
  Homolog annotation: Hit_ID=Q9ZTJ9; Match level="QueryCoverage=91%, HitCoverage=84%, E-value=2e-78, Identity=33%"; Hit description=Hcr2 -0B
  Pfam annotation: Domain name=LRRNT_2; Domain location=33-72; Score =43.8; E_value=6e-10; Accession=PF08263.3; Description=Leucine rich repeat N-terminal domain
  Pfam annotation: Domain name=LRR_1; Domain location=101-123; Score =13.9; E_value=0.6; Accession=PF00560.23; Description=Leucine Rich Repeat
  Pfam annotation: Domain name=LRR_1; Domain location=125-147; Score =14.0; E_value=0.54; Accession=PF00560.23; Description=Leucine Rich Repeat
  Pfam annotation: Domain name=LRR_1; Domain location=149-171; Score =15.0; E_value=0.28; Accession=PF00560.23; Description=Leucine Rich Repeat
  Pfam annotation: Domain name=LRR_1; Domain location=173-195; Score =13.3; E_value=0.86; Accession=PF00560.23; Description=Leucine Rich Repeat
  Pfam annotation: Domain name=LRR_1; Domain location=197-219; Score =12.9; E_value=1.1; Accession=PF00560.23; Description=Leucine Rich Repeat
  Pfam annotation: Domain name=LRR_1; Domain location=221-243; Score =4.4; E_value=44; Accession=PF00560.23; Description=Leucine Rich Repeat
  Pfam annotation: Domain name=LRR_1; Domain location=244-266; Score =15.5; E_value=0.19; Accession=PF00560.23; Description=Leucine Rich Repeat
  Pfam annotation: Domain name=LRR_1; Domain location=268-290; Score =6.9; E_value=15; Accession=PF00560.23; Description=Leucine Rich Repeat
  Pfam annotation: Domain name=LRR_1; Domain location=292-314; Score =14.8; E_value=0.32; Accession=PF00560.23; Description=Leucine Rich Repeat
  Pfam annotation: Domain name=LRR_1; Domain location=316-338; Score =6.3; E_value=19; Accession=PF00560.23; Description=Leucine Rich Repeat
  Pfam annotation: Domain name=LRR_1; Domain location=340-362; Score =7.6; E_value=11; Accession=PF00560.23; Description=Leucine Rich Repeat
  Pfam annotation: Domain name=LRR_1; Domain location=364-386; Score =9.9; E_value=3.9; Accession=PF00560.23; Description=Leucine Rich Repeat
  Pfam annotation: Domain name=LRR_1; Domain location=388-410; Score =20.2; E_value=0.0072; Accession=PF00560.23; Description=Leucine Rich Repeat
  Pfam annotation: Domain name=LRR_1; Domain location=412-434; Score =16.0; E_value=0.13; Accession=PF00560.23; Description=Leucine Rich Repeat
  Pfam annotation: Domain name=LRR_1; Domain location=436-458; Score =9.6; E_value=4.6; Accession=PF00560.23; Description=Leucine Rich Repeat
  Pfam annotation: Domain name=LRR_1; Domain location=460-482; Score =18.6; E_value=0.023; Accession=PF00560.23; Description=Leucine Rich Repeat
  Pfam annotation: Domain name=LRR_1; Domain location=484-504; Score =7.1; E_value=14; Accession=PF00560.23; Description=Leucine Rich Repeat
  Pfam annotation: Domain name=LRR_1; Domain location=76-99; Score=0.0; E_value=2.8e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1; Domain location=33-72::101 -123::125-147::...
  Pfam module annotation: Domain location=149-171::173-195::197 -219::221-243::244-266::268-290::292-314::316-338::340-362::364 -386::388-410::412-434::436-458::460-482::484-504::76-99
MVFIFPTLLSMKLQPLLLLLVMYFCAFAASSEIASEANALLKWKSSLDNQSRASLSSWSGNNPCIWLGIACDEFNSVSNINLTNVGLRGTLQNLNFSLLPNILTLNMSHNSLNGTIPPQIGSLSNLNTLDLSTNNLFGSIPNTIGNLSKLLFLNLSDNDLSGTIPSEIVHLVGLHTLRIGDNNFTGSLPQEIGRLMNLRILDIPRSNISGTIPISIEKLSILSHLDVESNNLSGNIQLRIWHMNLKHLSFAGNNFNGSIPKEIVNLRSIETLWLWKSGLSGSIPKEIWMLRNLTWLDMSQSSFSGSIPRDIGKLRNLKILRMWKSGLSGSMPEEIWTLRNLEQLDIRMCNLIGSFPISIGALVNLTLIMLHENKLFGHIPHEIGKLVNLQVLDLGNNNLSGFIPPEIGFLKQLDRLDLSDNFLSGEIPSKIGALVNLTRIRLHKNKLLGHIPREIGKLVNLQNLYLGNNNLSGFIPPEIGFLKQLARLDLSDNFLSASLEQSHLP

SEQ ID NO: 169416 - protein, 62 aa, Glycine max
  Coding DNA Sequence Number=SeqID_52638
  Gene Ontology: Mol. function=ATP-dependent helicase activity
  Homolog annotation: Hit_ID=Q56XG6; Match level="QueryCoverage=53%, HitCoverage=7%, E-value=5e-12, Identity=97%"; Hit description=DEAD -box ATP-dependent RNA helicase 15
MVYNLLRKIQAKTAYAKSCLLKDAQILNLQWLEEALVSTGSLEIPNYGCQHNPCTTKNVHAK

SEQ ID NO: 169417 - protein, 444 aa, Glycine max
  Coding DNA Sequence Number=SeqID_52639
  Gene Ontology: Mol. function=nucleotide binding
  Homolog annotation: Hit_ID=Q6ZD37; Match level="QueryCoverage=89%, HitCoverage=86%, E-value=1e-126, Identity=58%"; Hit description=AP2 domain-containing protein AP29-like
  Pfam annotation: Domain name=DUF246; Domain location=117-415; Score =322.5; E_value=7.2e-94; Accession=PF03138.5; Description=Plant protein family
MVVFSVKLFFSILVVSLSLLFLLALLLPSSLFSQIHIYGEASLGEVDIWSVRRLVEWRPCNWWLQGHQTEMSVWGFEPTTSPPFILLQPMDLISPIGIAIGVILYHYKLMDISEWIAMGGSIRCEEIGFADVYDVDYFIKHMNGFVKVVKELPPDIASKEPVRIDCSKRKGQFDYFESVLPSLLKHKYISITPAMSQRRDRYPLYAKAALCQACYKALRLTRSLEMKASQLLDAIPKPFLSLHLRFEPDMVAYSQCEYPDLSPASIKAIEAAQVDRKPWTGELARVWRLRGKCPLTPNETALILQSLSIPLTTNIYLAAGDGLMEIEGLIDTYANIVTKSSLLSREDFTSMHGNTKAALDYYVSINSDSYIATYFGNMDKMVSAMRAFNGLYKTLFFSRRGFAQLTSQGLNGKELKQALWKLHRDDFAKGRGSALSECFCEFKL

SEQ ID NO: 169418 - protein, 396 aa, Glycine max
  Coding DNA Sequence Number=SeqID_52640
  Gene Ontology: Mol. function=ATP-dependent helicase activity; Cellular component=nucleus; Biological process=mRNA processing
  Homolog annotation: Hit_ID=Q56XG6; Match level="QueryCoverage=88%, HitCoverage=79%, E-value=1e-177, Identity=88%"; Hit description=DEAD- box ATP-dependent RNA helicase 15
  Pfam annotation: Domain name=DEAD; Domain location=1-167; Score =131.7; E_value=2e-36; Accession=PF00270.19; Description=DEADDEAH box helicase
  Pfam annotation: Domain name=Helicase_C; Domain location=235-311; Score=120.0; E_value=6.9e-33; Accession=PF00271.21; Description =Helicase conserved C-terminal domain
  Pfam module annotation: Pfam domain module=DEAD::Helicase_C; Domain location=1-167::235-311
MDVICQAKSGMGKTAVFVLSTLQQVDPVPGQVAALVLCHTRELAYQICHEFERFSTYLPDIKAAVFYGGVNIKVHKELLKNECPHIVVGTPGRILALARDKDLGLKNVRHFILDECDKMLESLGLFLPPLWKFAYMRRDVQEIFKLTPHDKQVMMFSATLSKEIRPVCKKFMQDPMEIYVDDEAKLTLHGLVQHYIKLQETEKNRKLNDLLDALDFNQVVIFVKSVSRAAELNKLLVECNFPSICIHSAMSQEERLKRYKGFKEGKQRILVATDLVGRGIDIERVNIVINYDMPDSADTYLHRVGRAGRFGTKGLAITFVSSTADSEVLNQVQSRFEVDIKELPEQIDTSTYNRLHVEEVRFLVHFLAEVILPLQCMYRCLRWEFGLVTVKNELGQ

SEQ ID NO: 169419 - protein, 126 aa, Glycine max
  Coding DNA Sequence Number=SeqID_52641
  Gene Ontology: Mol. function=nucleic acid binding
  Homolog annotation: Hit_ID=Q2QQM2; Match level="QueryCoverage=66%, HitCoverage=50%, E-value=1e-28, Identity=77%"; Hit description =Expressed protein
  Pfam annotation: Domain name=Alba; Domain location=18-87; Score=80.6; E_value=4.9e-21; Accession=PF01918.11; Description=Alba
MEAITEGVNNINISDSYKKNRIQVSNTKKPLFFYVNLAKRYMQQHNEVELSALGMAIATVVTVAEILKNNELAIEKKITTSTVDIKDDSRGRPVQKAKTEKFDELMAAAAAAAEDGENGDVEEHTA

SEQ ID NO: 169420 - protein, 50 aa, Glycine max
  Coding DNA Sequence Number=SeqID_52642
MGELKDTEAYEEELIDYEEEEEKAPDSAKPVTESGKNFFGAIHCLSYFHC

SEQ ID NO: 169421 - protein, 165 aa, Glycine max
  Coding DNA Sequence Number=SeqID_52643
  Gene Ontology: Biological process=transport
  Homolog annotation: Hit_ID=Q2HUA7; Match level="QueryCoverage=99%, HitCoverage=100%, E-value=3e-73, Identity=84%"; Hit description =Longin-like
MILAVLFANAEGNILIERFHGVPAEERLHWRSFLVKLGADNLKGVKNEELLVACHKSVYIVYTVLGDVSIYVVGKDEYDELASDRLPAFHFSLMEVLTEKVSEVIFVITSAVKDVCGKPPSERLFLDKYGRICLCLDEIVWQGYLENTEKDRIKRLIRLKPPTEF

SEQ ID NO: 169422 - protein, 172 aa, Glycine max; identical to SEQ ID NO: 124030
  Coding DNA Sequence Number=SeqID_52644
  Gene Ontology: Mol. function=calcium ion binding; Cellular component =periplasmic space
  Homolog annotation: Hit_ID=P0AFH8; Match level="QueryCoverage=98%, HitCoverage=84%, E-value=1e-64, Identity=77%"; Hit description =Osmotically-inducible protein Y precursor
  Pfam annotation: Domain name=BON; Domain location=109-172; Score =66.7; E_value=7.5e-17; Accession=PF04972.7; Description=Transport -associated domain
  Pfam annotation: Domain name=BON; Domain location=30-93; Score=63.1; E_value=9.1e-16; Accession=PF04972.7; Description=Transport -associated domain
  Pfam module annotation: Pfam domain module=BON::BON; Domain location =109-172::30-93

SEQ ID NO: 169423 - protein, 174 aa, Glycine max
  Coding DNA Sequence Number=SeqID_52645
MGRKDKELRGSSNGVIGGYHKWLKSRTQGMTWLQKLKGLSAEKAKMPEKSEKVQALKTELKKIKVAKEKLKVAVTRVRKECDELKDINMIAAEVLERETKRARKEEWSRNKFQGDLLGSSNELKLRKSEREKSRMESMMLEDKLKSFQRSKRCLTEQLIIHQYKEKVNLAASHR

SEQ ID NO: 169424 - protein, 47 aa, Glycine max
  Coding DNA Sequence Number=SeqID_52646
MGGRTPREVKVNAYLIEVSLNSQVIEYDYVKEWSTSLRGDPCLSETL

SEQ ID NO: 169425 - protein, 55 aa, Glycine max
  Coding DNA Sequence Number=SeqID_52647
MATQADEGRAEEKVEGYKQQLATEPALEPVSDLIELEEVVEDKDDQQERETQIKE

SEQ ID NO: 169426 - protein, 182 aa, Glycine max
  Coding DNA Sequence Number=SeqID_52648
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=99%, HitCoverage=20%, E-value=3e-59, Identity=63%"; Hit description=S -receptor kinase-like protein 2
MNPKISDFGMARTFELDQHEANTTRIMGTYGYMSPEYAVHGSFSVKSDVYSFGVIVLEIINRRKIKEFCDPHHDLNLLGHAWRLWIQQRPMELMDDLVDNSASPSEILRHIHIGLLCVQQRQEDRPNMSSIVLMLNGEKLLPEPSQPGFYTRIDHAPMRESSARNLEAFSLSEMSNSVLEAR

SEQ ID NO: 169427 - protein, 141 aa, Glycine max
  Coding DNA Sequence Number=SeqID_52649
  Homolog annotation: Hit_ID=Q5XM22; Match level="QueryCoverage=81%, HitCoverage=79%, E-value=3e-30, Identity=48%"; Hit description =Resistance-like protein HAAS-2
MYQSRYRARQWVAAARTHLLHLVGCTLFANKSATHVHVVHLQEFRDLGQAGAFSWGAAALVHLYDQLNEASQAPTRQMAGYISLLQCWIYEHFPSVHRSVVDDGYAEASPRACRWLTSKAQMTGIKGAPYRARIDALTVTN

SEQ ID NO: 169428 - protein, 226 aa, Glycine max
  Coding DNA Sequence Number=SeqID_52650
  Gene Ontology: Mol. function=nucleoside-triphosphatase activity; Cellular component=membrane; Biological process=transport
  Homolog annotation: Hit_ID=Q2P4Z8; Match level="QueryCoverage=100%, HitCoverage=16%, E-value=2e-83, Identity=71%"; Hit description=ATP -dependent RNA helicase
  Pfam annotation: Domain name=DEAD; Domain location=81-226; Score= -29.8; E_value=0.0018; Accession=PF00270.19; Description=DEADDEAH box helicase
MNSIDKNPSPRLRQQRAAIDGAMSRDRGRLLGMLSRCQAKPQDAALAATFEQALQASVQRRMTRAQQQPSITLDPQLPIAREADAIIGLIRDHQVVVIAGETGSGKTTQLPKLCLAAGRGQAGMIGCTQPRRIAARAVASRVAQELQSELGQLVGYQVRFNDKVSEDSRIKFMTDGILLAEIASDRWLSNYDTIIVDEAHERSLNIDFLLGYLKQLLRKRPDLKLI

SEQ ID NO: 169429 - protein, 186 aa, Glycine max
  Coding DNA Sequence Number=SeqID_52651
MTTYYGVGGLGENMVSVDKVIEGDAEVPFPTSEIQYVKQALQTFIAWPTNLVKKVSHEESHTSPMKLPEIDERGTNDFEDDPLRQLIKSLYYMFLDEWSSTLGHASVYGFLEPQSIHDAKDRRAECEHYLQAWLKESQREGPLATGSTVSCDQCCCMVLFVTAMKTTNTTANGTNNQPTPKWSEVK

SEQ ID NO: 169430 - protein, 629 aa, Glycine max
  Coding DNA Sequence Number=SeqID_52652
  Gene Ontology: Mol. function=nucleoside-triphosphatase activity; Cellular component=membrane; Biological process=peptide transport
  Homolog annotation: Hit_ID=Q8U7K4; Match level="QueryCoverage=52%, HitCoverage=97%, E-value=1e-112, Identity=52%"; Hit description=ABC transporter, nucleotide binding/ATPase protein
  Pfam annotation: Domain name=ABC_tran; Domain location=71-261; Score =202.8; E_value=8.2e-58; Accession=PF00005.17; Description=ABC transporter
  Pfam annotation: Domain name=Acetyltransf_1; Domain location=434-515; Score=31.9; E_value=2.3e-06; Accession=PF00583.14; Description =Acetyltransferase (GNAT) family
  Pfam annotation: Domain name=oligo_HPY; Domain location=264-327; Score=42.4; E_value=1.5e-09; Accession=PF08352.2; Description =Oligopeptidedipeptide transporter, C-
  Pfam module annotation: Pfam domain module=ABC_tran::Acetyltransf _1::oligo_HPY; Domain location=71-261::434-515::264-327
LGAMPGIDGPRKFALNGEAPVAQARQTPQGQTPLLSVKNLSTRFSIHEGLFSRKTGAVHAVENISFDLLPGETLSLVGESGCGKSTTGRSLTRLVQPNSGQIAFDGSDVLTLSRQELRKLRCAMQMIFQDPFASLNPRMSVLEALTEPFLQHRLGSKAAAQSKAAELMTRVGLPATMLKRYPHEFSGGQRQRICIARALMLDPKMIIADESVSALDVTVKAQIINLLLDLQHSLNLSYLFISHDMAVVERISHRVAVMLLGEIVEIGPRASIFENPQHPYTQKLLASVPLPDPARRHLKRHVDVSELKSPVRANGFVPETRHYQEVSAGHWVMRPDTTAKEINVTRHNHYGQPIGFALPDWQPASYPPAENLSGRFCQLAPLQLSHSQALFTAFSLAPDDRDWTWLGVSRPQSLIEMESWIEHKISDRQLVCYAVMDRHQRAVGVVCFASIDMQNGAIEIGHITWSPLMQRNVMGTEALFLLLRQAFALGYRRVAWRCDSLNLASRRAAERIGFTFEGRFRQAMTRKQRNRDTDWLSMIDGEWPVVQQALTAWLAPDNMDDNGAAVSLPVMPVFSRVPALDNFIQQHRWHHAADNHALGIKDTLQHVNTLAQRRKYGIDPAIKQCRINL

SEQ ID NO: 169431 - protein, 165 aa, Glycine max
  Coding DNA Sequence Number=SeqID_52653
  Gene Ontology: Cellular component=integral to membrane; Biological process=cell wall organization and biogenesis
  Homolog annotation: Hit_ID=P41809; Match level="QueryCoverage=81%, HitCoverage=19%, E-value=3e-13, Identity=39%"; Hit description =Hansenula MRAKII killer toxin-resistant protein 1 precursor
  Subcellular localization annotation: CTP_CleavageSite=26; ConfidenceScore=5.06e-01
TYQGNPCGVYPDLSSFTGSGVYPDLSSFTGSGVYPDLSSFTGSGVYPDLSSFTGSGVIQKLYSLYQAIRPTYQGNPCGVYPDLSSFTGSGVYPDLSSFTGSGVYPDLSSFTGSGVYPDLSSFTGSGVIQKLYSLYQAIRPVRFTSSGIRALALDTGSILFYYFSL

SEQ ID NO: 169432 - protein, 91 aa, Glycine max
  Coding DNA Sequence Number=SeqID_52654
MAHSVLAPCPYFRNLHWRELKGLFSDNSQGGLISLDGLWSGVANCRNLPFGGRVTRDSRVRVPKREYAQSRHQHLFEENVRKTGKDVVYEL

SEQ ID NO: 169433 - protein, 69 aa, Glycine max
  Coding DNA Sequence Number=SeqID_52655
MKELLLGSLSEKSCDLLGRIDGDPVLRETRIWATWEYVSSDGGGQQGMVGLCALCGCGKLVVHHRPTAT

SEQ ID NO: 169434 - protein, 92 aa, Glycine max
  Coding DNA Sequence Number=SeqID_52656
MENERLGEWGREHEDEEELEGIKGRHWKEEEMRVKSSFYRVNGALPTCKIPLLPTHQIFLNPLVPHIQTEQPHDDQPSSSNYLDEVRAGFMA

SEQ ID NO: 169435 - protein, 249 aa, Glycine max
  Coding DNA Sequence Number=SeqID_52657
  Gene Ontology: Mol. function=4 iron, 4 sulfur cluster binding; Cellular component=molybdopterin synthase complex; Biological process=pyrroloquinoline quinone biosynthetic process
  Homolog annotation: Hit_ID=Q01060; Match level="QueryCoverage=63%, HitCoverage=41%, E-value=7e-82, Identity=96%"; Hit description =Coenzyme PQQ synthesis protein E
MAMQHEVEHHRIAERLDRLSHGQLLLKRLGGARQRGVQRFIAGLKTDLDMIQPGVGEGLQLLLGQADAGGDQVGVKAERARGGDQLGQVFTHQRLAAGKTELHTAHRPRLAKHLDPLRGGQLFFLRGEIERVGAIRTLQRAAVGQLRQQPERRVHRRRASFSHGRSPIFVRGSRDGRRGCVQGSASLHQPLVVPYPRGGHAVVRRAVQGIGHAHGVQHAPQNVQLELQDLQHALLFFYGVAIVQRQRQA

SEQ ID NO: 169436 - protein, 763 aa, Glycine max
  Coding DNA Sequence Number=SeqID_52658
  Gene Ontology: Mol. function=protein phosphatase type 2C activity
  Homolog annotation: Hit_ID=Q1S8C9; Match level="QueryCoverage=99%, HitCoverage=78%, E-value=1e-50, Identity=42%"; Hit description =Protein phosphatase 2C, putative
MGNGTSRVVGCLVPFNGKSGVDLEFLEPLDEGLGHSFCYVRPSIFESPAITPSNSERFTVDSSTLDSETLSGSFRHESIEERPGKNVAETTFKTISGASVSANVSTARTGNQNALLASDVLEPAASFEGTSSFAAIPLQPVPRGSGPLNGFMSGPLERFASGPLDKGGGFMSGPIEKGVMSGPLDATDKSNFSAPLARGRRRPHLQRLMRSVSGPMRNTFSRTFSRHSMGGSWVQRLFLHPVSQLAWNSKEAKFRPEVSRNCAEVGSSELEYKHIQNLQWAHGKAGEDRVHVVLSEEQGWLFIGIYDGFSGPDAPDFLMSHLYKFIDKELEGLLWDYEDNPVDPLKPEVLENGNDVVALECGREEMSDAHSISNEESSCCLENSCPIMVKDQSSNSEIVEVNAEVKVNIEQKNCGSPSIVHTVPASVPIGQLSGQGRRSVRLYELLQMESWNEQVSEQGKDSVVPAEIAQERQMRFCSPDGKEDRSRHPDEGPTTSGENGGAGFNSTYQEPIAPFSVSGQRQNSRKSFIGTKIRKMYRKQKSLRKKLFPWSYDWHREETCVDQKLVESSGPIRICKSGVNHNAVLRAMARALERTEEEYLKMVENNMDKNPELALMGSCVLVMLMKDQDVYVMNLGDSRVILAQERPNDRHPNPCLIKDDMRHKNRSRELLVGMELDRISEESPVHNINKHVNKINKNREISMCRLKMRAVQLSTDHSTSIEEEVFRIRAEHPDDNQAIFNDRVKGQLKVTRAFGAGFLKRVS

SEQ ID NO: 169437 - protein, 254 aa, Glycine max
  Coding DNA Sequence Number=SeqID_52659
  Gene Ontology: Cellular component=extracellular region; Biological process=cellulose and pectin-containing cell wall organization and biogenesis
  Homolog annotation: Hit_ID=Q9ZSI1; Match level="QueryCoverage=98%, HitCoverage=98%, E-value=1e-112, Identity=73%"; Hit description =Putative expansin-A17 precursor
  Pfam annotation: Domain name=DPBB_1; Domain location=62-150; Score =174.3; E_value=3e-49; Accession=PF03330.8; Description=Rare lipoprotein A (RlpA)-like double
  Pfam annotation: Domain name=Pollen_allerg_1; Domain location=161 -239; Score=142.3; E_value=1.3e-39; Accession=PF01357.11; Description= Pollen allergen
  Pfam module annotation: Pfam domain module=DPBB_1::Pollen_allerg_1; Domain location=62-150::161-239
MGKFILSGLILFVVFFTTELGVSSAVWQRAHATFYGGSDASGTMGGACGYGNLYTDGYGIKTAALSTVLFNDGKSCGGCYRIVCDARQVPQWCLRGTSIVVTATNFCPPNLALPNDNGGWCNPPRPHFDMSQPAFQTIAKYKAGIVPILYRKVGCKRSGGIRFTINGRDYFELVLISNIGGAGEISRVWVKGSRMNDWESMTRNWGANWQSLRYLNGQSLSFRIQLRNGKTRTANNVAPSNWRFGQSFTSNVQF

SEQ ID NO: 169438 - protein, 148 aa, Glycine max
  Coding DNA Sequence Number=SeqID_52660
  Gene Ontology: Mol. function=nutrient reservoir activity; Cellular component=apoplast; Biological process=auxin mediated signaling pathway
  Homolog annotation: Hit_ID=Q0MYQ7; Match level="QueryCoverage=97%, HitCoverage=80%, E-value=4e-49, Identity=68%"; Hit description =Germin-like protein 2
  Pfam annotation: Domain name=Cupin_1; Domain location=9-141; Score =98.2; E_value=2.5e-26; Accession=PF00190.13; Description=Cupin
  Pfam annotation: Domain name=Cupin_2; Domain location=27-103; Score =38.3; E_value=2.7e-08; Accession=PF07883.2; Description=Cupin domain
  Pfam module annotation: Pfam domain module=Cupin_1::Cupin_2; Domain location=9-141::27-103
MMYEWICMQGGGKCDRSRFLLCWASESRSYQQRNGTSNPPHTHPRATEILFVLEGELDVGFITTANKLISKTVKEGEVFVFPKALVHFQKNNGDKPAAVISAFDSQLPGTFSIVAVLFNSTPSVPDDVLTHAFQIDTQDVDKIKNSLS

SEQ ID NO: 169439 - protein, 135 aa, Glycine max
  Coding DNA Sequence Number=SeqID_52661
MGSNQAPSFKKMFYPVKIKSLEVASLQELAQRMDQLQRQAFRKTWKNLEFGYDRNRNRVVEIPRKHLEDKAKALVDQGEWTSFADVLALLVFGIVLFPNVDRLVDLAVIDAFLSYHHSKESLVIVVLADAYDTFD

SEQ ID NO: 169440 - protein, 93 aa, Glycine max
  Coding DNA Sequence Number=SeqID_52662
MRCKERIRSLDEAAMAEVPEESEEVQALKQNLKEHEWSRKSSRRQPSGGFMGQQQRTQASKGRKGRVEGGKYDIRGQVEGLSKVEGELDRIVE

SEQ ID NO: 169441 - protein, 45 aa, Glycine max
  Coding DNA Sequence Number=SeqID_52663
MAEDPGVLEVVKQLDKACTEAGFFYVHFDMQKRDWNKRIINRVAN

SEQ ID NO: 169442 - protein, 114 aa, Glycine max
  Coding DNA Sequence Number=SeqID_52664
  Gene Ontology: Mol. function=oxidoreductase activity
  Homolog annotation: Hit_ID=Q8LCJ7; Match level="QueryCoverage=99%, HitCoverage=36%, E-value=1e-34, Identity=57%"; Hit description =Flavonol synthase-like protein
PQNPPTFKVLMEEYVSLCRGMPFPPPLFFFPSYLARKIMRGIALALGGSPNEFEGQRAGDPFWVMRLIGYPGLLTLLNQDDDVNALQVRNLSGEWITAPPVPGTFVCNIGDMLK

SEQ ID NO: 169443 - protein, 261 aa, Glycine max
  Coding DNA Sequence Number=SeqID_52665
  Gene Ontology: Mol. function=oxidoreductase activity; Cellular component=mitochondrion; Biological process=metabolic process
  Homolog annotation: Hit_ID=Q6PD85; Match level="QueryCoverage=77%, HitCoverage=39%, E-value=2e-45, Identity=46%"; Hit description =Dihydrouridine synthase 1-like
  Pfam annotation: Domain name=Dus; Domain location=1-238; Score=32.4; E_value=3.1e-11; Accession=PF01207.8; Description=Dihydrouridine synthase (Dus)
MINQAQIANGNYLQMTGRCPQRIAKRGYYGAFLMDNLPLVKSLVEKLAVNLQVPVSCKIRLFPNLEDTLKYARMLEEAGCMLLAVHGRTRDEKDGKKFRADWNAIRAVKNAVRIPVLANGNIRHMDDVRDCLEETGVEGVLSAETLLENPALFDGFRTAEWVSESEGTNLDGKLDQADLLIEYLKLCEKYPVPWRMIRSHVHKLLGDWFSLQPHIREELNKQSKLTFEFLYDMVDRLRSTGTRIPLYKNTEVEHTAGSYPD

SEQ ID NO: 169444 - protein, 59 aa, Glycine max
  Coding DNA Sequence Number=SeqID_52666
MACGVRRVWGCKGGILILYMMLPAIAVCDRGIGGELRSEAFIESYGRRHVPPLRLEQCL

SEQ ID NO: 169445 - protein, 80 aa, Glycine max
  Coding DNA Sequence Number=SeqID_52667
MVGYTPSSFADLVFTDERIKVEDEKEGETHAVPFLYDQVPHQLNTIITQPISAILITHHPFIHKGHPQINNKTHLPHNQC

SEQ ID NO: 169446 - protein, 77 aa, Glycine max
  Coding DNA Sequence Number=SeqID_52668
MKVGDDALERGKEKKGRVGIGLFGWSRMALVGKPMAKSKWVGVELISSSTQKGPYLVRVNLSFANFAFALTSTLLRG

SEQ ID NO: 169447 - protein, 67 aa, Glycine max
  Coding DNA Sequence Number=SeqID_52669
MACNLWLTASRYLAPFVAQYVKFRDMPKIKRKLCYAIREIPPTWAFQIVPPEGGCFWRKQPGSPGRA

SEQ ID NO: 169448 - protein, 301 aa, Glycine max
  Coding DNA Sequence Number=SeqID_52670
  Gene Ontology: Mol. function=helicase activity; Biological process =viral genome replication
  Homolog annotation: Hit_ID=Q9ZQR0; Match level="QueryCoverage=99%, HitCoverage=26%, E-value=2e-67, Identity=43%"; Hit description =Putative helicase
MWYNERISKDKNTTSPKFSLCCGDDKVELPLLQSPPKYLERLMFDGNASDSKNYQCNIRTYNMMFAFTSAGIKLDKSINESRGPPTIRIQGQPCHRIGSLLPMPGKQPKFAYQHVVIQPEIVSTLSQMLDEHNVHAKSFRMARDRLTDSQLDNVKLRLIAAREKDGRTYNLPNVSEVAALIVGDFDPDSRRDIIVETQNGELQRIHELHSSYLGLQYPLLFPYGEDGYRPDILHRSISSSRKMKRNRLTMREWFAYRLQSRSNEAQTLLHSRKLFQQFIVEAYTMVESERLTYIRNNKKKT

SEQ ID NO: 169449 - protein, 64 aa, Glycine max
  Coding DNA Sequence Number=SeqID_52671
MVRSRDKLTVEINQGTKGRMQVGDRVTTLTDRCPFPALDKQRTSLHGSPVSFEFTVFITIICFK

SEQ ID NO: 169450 - protein, 167 aa, Glycine max
  Coding DNA Sequence Number=SeqID_52672
  Gene Ontology: Mol. function=N-acetyltransferase activity; Biological process=metabolic process
  Homolog annotation: Hit_ID=UPI00005F80B1; Match level="QueryCoverage =97%, HitCoverage=98%, E-value=1e-44, Identity=54%"; Hit description =COG0454: Histone acetyltransferase HPA2 and related acetyltransferase s
  Pfam annotation: Domain name=Acetyltransf_1; Domain location=55-138; Score=72.9; E_value=1e-18; Accession=PF00583.14; Description =Acetyltransferase (GNAT) family
MSQVTVRHATPEDAAVLTRIYSQPETQAGTLHLPYQSPSLWQERLANPRPHVTMLVACIDGLVVGQLTLEVMAVARRRHCATIGMGVDPAFHRRGVGKALMAAMVDLCDNWLQVTRIELTVFADNYQAMGLYQQFGFEIEGTARGFAVRDGQMIDTHYMARLKGNAR

SEQ ID NO: 169451 - protein, 266 aa, Glycine max
  Coding DNA Sequence Number=SeqID_52673
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=1e-45, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=5; ConfidenceScore=5.13e-01
MSQSLASHKSGPLGTSTLVIRGLLTLAFRGLHVLTFRGLHVFTFRGLHVLTIRGLHVLAIKGLHVLAIRGLHALAFRGLHVLTFRGLHVLTFRGLHVLAIRGLHVLAIRGLHILAIRGLHALAFVGLHALTFRGLHVLTFRGLHVLAFRGQHVLAFRGQHVLAFAFVGLHALTFRGLHVLAFRGIHVLTFRGLHILAIKGLHVLAIRGSHALAFVGLHALTFQGLHALAIRGLHVLAIRGLHVLAIRGLHALAFVGLHALTFRGLH

SEQ ID NO: 169452 - protein, 80 aa, Glycine max
  Coding DNA Sequence Number=SeqID_52674
  Subcellular localization annotation: CTP_CleavageSite=42; ConfidenceScore=5.24e-01
MQNYQHAKRSNSAKARINRKRIMQQKRHPHAQSSSQPTINCTSEYDKSVNSESTQGSGSNFLTAYEDCQSPTNQPVINTE

SEQ ID NO: 169453 - protein, 117 aa, Glycine max
  Coding DNA Sequence Number=SeqID_52675
MASYDSELVLDSFFSRSGVFNHLFSFFILLPLIFMKQNTPLMKKIQGLQALHGATSAESMKLKRRTLSPIKVKRRRLSPMKLKGRTLSPMKLKGRTLTPMKLKMEDVESYEIKKGGC

SEQ ID NO: 169454 - protein, 98 aa, Glycine max
  Coding DNA Sequence Number=SeqID_52676
MVADAIDQVKVGIEEVKDANTPIPVPTEEVKLVEQTFNMFLAWPTHLIKRLSEQVLWDATIFGVFNGNFPLYMKHEDLSEIAHGGQCLNISVIQLWIL

SEQ ID NO: 169455 - protein, 77 aa, Glycine max
  Coding DNA Sequence Number=SeqID_52677
MTCDHSLVLVRCLAPIIRQFVKFQDVPKNRKILMHNPDIILLSNNIVAVGTTSDNATPKEENSRLGFTVIKRVGDPA

SEQ ID NO: 169456 - protein, 257 aa, Glycine max
  Coding DNA Sequence Number=SeqID_52678
  Homolog annotation: Hit_ID=Q1T034; Match level="QueryCoverage=82%, HitCoverage=41%, E-value=2e-07, Identity=22%"; Hit description=Zinc finger, CCHC-type
  Pfam annotation: Domain name=zf-CCHC; Domain location=159-176; Score =13.0; E_value=0.0071; Accession=PF00098.13; Description=Zinc knuckle
MVLMSTWEDLDDTSSHEDDEEANICLMADTTSEGFESDKEDEIETSAGEKATLLKNFQELENELNDLQKDLKELNELHHKIEERYNLWRECAQAQKHYEDLKISKHNLWVECEEHKKSVKFLNDELSKNKECKGQPQDVVKLHEEIKTLNVYVHDEDTIVCYFYGKTGHMTSICNNFPKKHSPNPFMNNTKGPKKIWVPKKTVIPIANVLDSKKQRLSCVDVSDRGLSKECKDLEAFHGLKGPMTRSKAKLLLEEMA

SEQ ID NO: 169457 - protein, 33 aa, Glycine max
  Coding DNA Sequence Number=SeqID_52679
MDGFYTKITVCEVREEAGFLDGDVLIFPDMIKY

SEQ ID NO: 169458 - protein, 276 aa, Glycine max
  Coding DNA Sequence Number=SeqID_52680
MGEDSQLALITKGLVVAKQQKFSKTNLKAIKVSLEQSLKKAPLVDLDTINKRKQKRLAKSIIDEDQGLNRFDISRKIQKIMVEQPKKNLKRMKKKWSFLHGSRGKKHVTNASSPMHPSAMSSVPQRLKDQSETNENDEVFKLRVSIISSAIPRRIKMRMTKANPKIRDKEWAISFTGNKEDSTSSPSDRESIEDTPISPLCKHAPSAQPHRPPSPSHLDRLRRVAPREPLIEAQRDRRATWNNLRLNLKLKEKLEEVLAFTCLTPLSGICICCYLD

SEQ ID NO: 169459 - protein, 284 aa, Glycine max
  Coding DNA Sequence Number=SeqID_52681
  Homolog annotation: Hit_ID=Q41419; Match level="QueryCoverage=85%, HitCoverage=72%, E-value=4e-60, Identity=48%"; Hit description =Clostridium pasteurianum ferredoxin homolog
  Pfam annotation: Domain name=Suc_Fer-like; Domain location=1-172; Score=113.9; E_value=4.5e-31; Accession=PF06999.3; Description =Sucraseferredoxin-like
MEAFRFTPIFFSDAIPLCIGGSSKLALTGPFLLFFNLKGGLEESNVDSFFEDVLVNGKPWTAGVPEVFSGSHVYVCAHGSRDVRCGVCGPVLIKKLNEEIELRCLKDQISVTACSHIGGHKYAGNVIIYCPGADGKIMGHWYGYVTPNDVSDLLDQHIAKGEVIKRLLRGQMGPSVAEDKGADDQKVANGEDTSKGKTNHVESDNLSNKENMGGCCQGVNGVSCCRSASVEQNNEIEETPEAQKKGSKICSNWPQLQQRDILTAVGVLGAVAVVAVVYKLYRRA

SEQ ID NO: 169460 - protein, 427 aa, Glycine max
  Coding DNA Sequence Number=SeqID_52682
  Gene Ontology: Mol. function=metalloendopeptidase activity; Biological process=proteolysis
  Homolog annotation: Hit_ID=UPI000066948F; Match level="QueryCoverage =99%, HitCoverage=75%, E-value=8e-25, Identity=34%"; Hit description =putative peptidase
  Pfam annotation: Domain name=Peptidase_M23; Domain location=328-421; Score=76.5; E_value=8.6e-20; Accession=PF01551.12; Description =Peptidase family M23
  Pfam annotation: Domain name=TolA; Domain location=2-368; Score= -102.3; E_value=0.00052; Accession=PF06519.2; Description=TolA protein
  Pfam module annotation: Pfam domain module=Peptidase_M23::TolA; Domain location=328-421::2-368
INRQNKELAVLRKNYAEVLVNAYKNKGVQNKVTFILSAKNLGEAIRRVQYLKEYSDYQDKKAAEITDAANQIKKTIAQRQKSVADKQQLLIDQQKDLATINVERAQKEQLVEDFKKNESKLTAELKQKQVQSKALEGQIRSIIAEEIRIAKAEEEARRKAEAEKIRLAKIAAEREKARIEAENRARAEALERERKLAEAEAKRAEELAAKKAEEERKRTEEAARAEANARDEARKIAAAKASSEANARAKEAASKLAAAKAAEAALEKRKDDEKKAAETKAMTNFGVSTAAGNNFAENRGKLGFPVDKGQITHRFGRQPHPVFKNITEENNGIKISVPSGTRAKSVFPGSVSSVLANSDGTKTVMLKHGNYFTIYSNLGSVNVSKGQQVSAGTIVGTVGQDFDGSYTLDFQVWNGTTPVDPLGWVSY

SEQ ID NO: 169461 - protein, 170 aa, Glycine max
  Coding DNA Sequence Number=SeqID_52683
  Gene Ontology: Mol. function=transferase activity; Biological process= biosynthetic process
  Homolog annotation: Hit_ID=Q1XQC2; Match level="QueryCoverage=100%, HitCoverage=44%, E-value=1e-52, Identity=57%"; Hit description =Glycosyl transferase, group 1
MKIGILCYPTYGGSGIVATELGMSLANKGYEVHFISSALPARLDITNPNIFFHRVNVQTYPLFQYQPYDIALSSMIYRVVNLYKLDLLHAHYAIPYAYAAFTAKQMLQEDNNDIPLVTTLHGTDITLVGQHPSYKHAVEFSINKSDAITSVSESLKKDTLQFFNIKKPIQ

SEQ ID NO: 169462 - protein, 67 aa, Glycine max
  Coding DNA Sequence Number=SeqID_52684
IVCADNHLGISARHLTSRVRMTESGVVEKSKAFAPTYPPFVMRNSDLRVDNRKVSSHATGLLGHDSK

SEQ ID NO: 169463 - protein, 206 aa, Glycine max
  Coding DNA Sequence Number=SeqID_52685
  Homolog annotation: Hit_ID=Q7CHF3; Match level="QueryCoverage=25%, HitCoverage=14%, E-value=6e-11, Identity=63%"; Hit description=Inner membrane permease of iron/siderophore ABC transporter
  Subcellular localization annotation: CTP_CleavageSite=60; ConfidenceScore=5.81e-01
MASGQAGWRLCASQARPAVSSSNRSSRTIPTSRWFSQAYPTNSAAGPTAFSQGVRGEGVSVSRSWRLNGSSSACSGLCNSQFSSAGRLGVTAGDGLLITASSIRSLLRRPESLVGSGITFRIMNLLAAAGAVAARFPVYGGRFRAAVMMVVTGATQRRRDGALSAYSSPSPVDDGRVGTGDPGVAAAGFHHGAVRAVAVVFMANAA

SEQ ID NO: 169464 - protein, 155 aa, Glycine max
  Coding DNA Sequence Number=SeqID_52686
MAKNMLITPHHAGVGLPLGVSHGIAAAHADALSSHSLAECRGAGGAVGGVRLAEPATGRYRSAAPVAAADRRARLAGAEAPTRLAGRHAGDGVAVDAASDRADAALPAGGAAVARAKPVRPGGSHAAVAGAGPWHDRALPPPAGTARHAGLGEAA

SEQ ID NO: 169465 - protein, 43 aa, Glycine max
  Coding DNA Sequence Number=SeqID_52687
MVEKSLEQNVTGVCWWRITLSNLLLKLLSQHLSKVGWPRGESR

SEQ ID NO: 169466 - protein, 73 aa, Glycine max
  Coding DNA Sequence Number=SeqID_52688
MVQELERPPLPLDEPTKCPRSINNEHSMTQVSMLQRELNNEQEGKIKKKEQGNTCTQSESHTELHYIIARYTV

SEQ ID NO: 169467 - protein, 151 aa, Glycine max
  Coding DNA Sequence Number=SeqID_52689
MKLSRDVMESGFSPFPFDWTNVPRRMRTKRKSKFNGKEVLSEPKEAHSKPKEELSRPKRKLNSGVFDIYLKFCHKIERGALCTLTAYGLAFTGEMLVASSSLRAKRQASSSSFPRTRLPEDPLGVLSELPEEAVPETFRNPEEFRKKGSSG

SEQ ID NO: 169468 - protein, 181 aa, Glycine max
  Coding DNA Sequence Number=SeqID_52690
  Gene Ontology: Mol. function=transposase activity; Biological process= transposition, DNA-mediated
  Homolog annotation: Hit_ID=Q1SGJ8; Match level="QueryCoverage=80%, HitCoverage=57%, E-value=4e-16, Identity=34%"; Hit description =Transposase, IS4
MEVDFLTKGIHINVSDDEKDDIKVLRHKRKEIFSSGERRRKEGKTSNKDMLDKIEVGNLCDGKKVSIEEAVAMFLIIICHNLRHRVVVERFQHSLHTDCIGAIDGTHGRQTIQGYFWMVYLPKIISQSLMEINSIWSTLDFLTCQAILHLSEGTNIICEIFVKDVDVHVEKKNYSITDTLH

SEQ ID NO: 169469 - protein, 245 aa, Glycine max
  Coding DNA Sequence Number=SeqID_52691
  Homolog annotation: Hit_ID=Q5XM22; Match level="QueryCoverage=41%, HitCoverage=75%, E-value=2e-27, Identity=55%"; Hit description =Resistance-like protein HAAS-2
MRCQAQRWIVAARAYLLHLVSCTLFANKSATYVHVVHLDAFHDLGQSGGYAWGVATLVHMYDQLDEASRTTTRQIASAGSMSTSLVHQFVTDDTYQETSPRASWWLTSKAHMNGITGAPYRARCDALTITYVSWLPYTEHRGVRAFELISSFQGQLRWGPMVVTARPERVWFFRISHPFMIPIQVGDQPRDALAADPEEYIQPSSPQVPVTFDPPRHAVDCLTIARGGASADGSVRARQRRRREY

SEQ ID NO: 169470 - protein, 63 aa, Glycine max
  Coding DNA Sequence Number=SeqID_52692
MVGLRFFLSNLICDKIFIINHYHDRYHDLHRRHSHVGDNDDGRDNDHDNDGADVDSNNDDDRS

SEQ ID NO: 169471 - protein, 257 aa, Glycine max
  Coding DNA Sequence Number=SeqID_52693
MTHLLISDSSRLGSAISSESNSNMHCDLVVDCKLSPKMAEDQKAPVTPTTLGIQMNGQLCPSAKVISGRPFFQKSSGRPFSGKLPEDTSSGRRWTSGRTLENVPKEVSSGTFPEKGSSEILPLLPGEEGSSSGMRMLNFWKKFFWKLLFSIPEEVVPEVFSRTTSFGSRHSNFRKKFFQNMDEDQWRYDYAMSQEVHMDYDYDNEEECGVNEPHVDCSNACNTSQVFGTRDDVLQWAGTVVHENEFVAVIMRSDTYT

SEQ ID NO: 169472 - protein, 144 aa, Glycine max
  Coding DNA Sequence Number=SeqID_52694
  Gene Ontology: Mol. function=cysteine-type endopeptidase activity; Biological process=proteolysis
  Homolog annotation: Hit_ID=O24322; Match level="QueryCoverage=94%, HitCoverage=40%, E-value=1e-23, Identity=46%"; Hit description =Cysteine proteinase precursor
  Pfam annotation: Domain name=Inhibitor_I29; Domain location=54-90; Score=12.4; E_value=0.00087; Accession=PF08246.2; Description =Cathepsin propeptide inhibitor domain (
MARYSFLLALLLLLFVIVASATDDILIRQVVPDAFSEAAEKEDENHLLNAEHHFASFKAKFEKKYATKEVHNRRFDVFKSNLRKVRRMPSSTSPPSMMSTNCPISLRQFLSLKPLRFSVNAHKAPKDFDWRDKGAIIFAFKDNL

SEQ ID NO: 169473 - protein, 249 aa, Glycine max
  Coding DNA Sequence Number=SeqID_52695
  Homolog annotation: Hit_ID=Q337D7; Match level="QueryCoverage=36%, HitCoverage=23%, E-value=3e-14, Identity=42%"; Hit description =Chaperone protein dnaJ 13, putative, expressed
MGLDMDALDNVGKEEGTVTESDDNGDLDVEVDVVGQWGSFLPFSCAFPIHNCGIVGNAKGRNNDYGSAVCIVRGDDAAVVGNWLVVLGAMMVFEGGYLGIGIGGCGVVEKVVVGSRGGDENVREKDDVKDEKEEEEEEEEEKEKEKEKEKEKEKEYEILSDPNKWQIYDIYDMEGLTFGLELGPKLNGAEEIKAELQRLKRMRMGESGSAFSTLQYNSSQYVFAMLLNGEEGDGAASVAFRHQLLKVRQ

SEQ ID NO: 169474 - protein, 142 aa, Glycine max
  Coding DNA Sequence Number=SeqID_52696
MVKDYELVLVRFIVVVIATVEVLESPNNVTRMKHRQRSNSSFYKGGHVDHFVLSPYVGHIAPQLWEGMNKPPLKSVSITKADAMPIDPYVLRYGFGLAPFARGWKPYSHIPLSLDETMIVIGLLLKVNSKMAYLATDNETNV

SEQ ID NO: 169475 - protein, 96 aa, Glycine max
  Coding DNA Sequence Number=SeqID_52697
MEIKKDRVQKKLFLCEKEYIQPIISLSTTKDKAIIFCDNLRAICFAKDQVHHEMTKHIDYHFICTEKRIIIQKVDTKENPGDMFTKSIPQILNPTT

SEQ ID NO: 169476 - protein, 129 aa, Glycine max
  Coding DNA Sequence Number=SeqID_52698
MKKEKENLLKVFDLFENNPIHVATCSNNPQLLKELMELIPIEDRWQAMCKRNHEGNTILHVVNVIICFGIDKSNIEWVLMGESESLQEPKQDSPFKAMAGDVQMAYVVFELEEELLQQQSSLKEKKGHC

SEQ ID NO: 169477 - protein, 38 aa, Glycine max
  Coding DNA Sequence Number=SeqID_52699
MAMMAIKILFTISTNQLIDSKVTTLLWNHGIQIIQLQV

SEQ ID NO: 169478 - protein, 54 aa, Glycine max
  Coding DNA Sequence Number=SeqID_52700
MTFSAGFAYLEGKGVNNVVSHQQECQGKMIESAHWALKRLSIIALETYVVFGKL

SEQ ID NO: 169479 - protein, 52 aa, Glycine max
  Coding DNA Sequence Number=SeqID_52701
MDSVPFRDGNIHTILDSRYLHSPLDVNHSLHTHSSLIRRLSQERELEVRNVS

SEQ ID NO: 169480 - protein, 64 aa, Glycine max
  Coding DNA Sequence Number=SeqID_52702
MASGTPSIFEAGLLLEEATQLARASWAAIPPPFFPINKQKGAILRIPPPLAMHFSCFGWKKLFP

SEQ ID NO: 169481 - protein, 286 aa, Glycine max
  Coding DNA Sequence Number=SeqID_52703
  Gene Ontology: Mol. function=carbohydrate binding; Biological process= iron ion transport
  Homolog annotation: Hit_ID=UPI00005FA2C2; Match level="QueryCoverage =94%, HitCoverage=63%, E-value=6e-89, Identity=55%"; Hit description =COG2382: Enterochelin esterase and related enzymes
  Pfam annotation: Domain name=Esterase; Domain location=49-283; Score =204.3; E_value=2.8e-58; Accession=PF00756.11; Description=Putative esterase
MRHDPLNPVAPHCSSRGFPLSAIHLPAAPDQSAWRALDAGQALPAASERLQHFFWHSERLANRRNIWLYATGAGEDRPLVVLLDGQFWLHGIPIFSALDAETLNGRLPSALYLFIDVIDMARRAEELACNAAFWRAVQEELLPQVAARAPYSDDPQRTVVAGQSYGGLAALYAGLHWPQRFGCVLTQSGSFWWPHIEAMINPAVEYDADVGWLTEQVRRGLCAATPLRVFQEAGEGERDIHQVNRQMHRALVEAGHRVDYRVFAGGHDAVCWRGGLLDGLRALLAP

SEQ ID NO: 169482 - protein, 498 aa, Glycine max
  Coding DNA Sequence Number=SeqID_52704
  Gene Ontology: Mol. function=acetolactate synthase activity; Cellular component=chloroplast; Biological process=branched chain family amino acid biosynthetic process
  Homolog annotation: Hit_ID=UPI0000E68FA5; Match level="QueryCoverage =98%, HitCoverage=88%, E-value=0.0, Identity=68%"; Hit description =acetolactate synthase, catabolic
  Pfam annotation: Domain name=TPP_enzyme_C; Domain location=332-478; Score=178.4; E_value=1.8e-50; Accession=PF02775.11; Description =Thiamine pyrophosphate enzyme, C-term
  Pfam annotation: Domain name=TPP_enzyme_M; Domain location=135-270; Score=107.2; E_value=5e-29; Accession=PF00205.12; Description =Thiamine pyrophosphate enzyme, centra
  Pfam annotation: Domain name=TPP_enzyme_N; Domain location=1-118; Score=85.3; E_value=1.9e-22; Accession=PF02776.8; Description =Thiamine pyrophosphate enzyme, N-term
  Pfam module annotation: Pfam domain module=TPP_enzyme_C::TPP_enzyme _M::TPP_enzyme_N; Domain location=332-478::135-270::1-118
  Subcellular localization annotation: CTP_CleavageSite=49; ConfidenceScore=5.06e-01
MAAAVGRLTGKAGVALVTSGPGSSNLITGLATATSEGDAVVAFGGAVKRADSLKQTHQSMDTVSMFRPVTKYCAEVHAGSAISEVIANAFRRAEFGRPGASFVSLPMDIVNEPVSAPVLAGCRLPRMGAAAADDIQAAVKLIRQAKCPVLLLGLQASRPENSEAVRHLLYRTHMPVVGTYQAAGVIDVNHFARFAGRVGLFNNQPADQLLQKSDLVVSVGYDPIEYDPCMWNSHGRLKLVHIDVLPADIDTCYRPDVELVGNISATLNMMTETFTEAVCVPPEVELILTDLGRQRTELAERAARRGGMPIHPLRIVKELQDIVSDDVTLCVDMGSFHIWIARYLYSFRARQLLISNGQQTMGVALPWAIGAALVRPGDKVVSISGDGGFMQSSMELETAVRLKNNIVHVIWVDNAYNMVEMQEVNKYQRKSGVEFGSIDFKAYAESCGAVGFAVQSVDDLRPMLRKAMAIQGPVVVAIPVDYADNYKLMAQMNFSQMI

SEQ ID NO: 169483 - protein, 275 aa, Glycine max
  Coding DNA Sequence Number=SeqID_52705
  Gene Ontology: Mol. function=ATP-dependent helicase activity; Cellular component=nucleus; Biological process=mRNA catabolic process, nonsense-mediated decay
  Homolog annotation: Hit_ID=Q9C718; Match level="QueryCoverage=81%, HitCoverage=56%, E-value=2e-90, Identity=62%"; Hit description=DEAD -box ATP-dependent RNA helicase 20
  Pfam annotation: Domain name=DEAD; Domain location=34-257; Score =138.8; E_value=1.5e-38; Accession=PF00270.19; Description=DEADDEAH box helicase
MALDLQCPCSFLPIDVIWIFNIFIGFVNKAKFELEPQHMASAEAGAPTGFGGSVQHSSSNRRDYDDGGSPKRNLSLDGLPHFEKNFYIESPAVRAMTDAEVNEYRQQREITVEGRDIPKPVKSFHDAGFPDPGDGPIVLVLAPTRELAVQIQQEATKFGASSRIKSTCIYGGVPKGPQVRDLRKGVEIVIATPGRLIDMLESNHTNLQRVTYLVLDEADRMLDMGFDPQLRKIASQIRPDRQTLYWSATWPKEVEQLARKFLYNPYKVIIEALLI

SEQ ID NO: 169484 - protein, 66 aa, Glycine max
  Coding DNA Sequence Number=SeqID_52706
MVTRWWTEAVPLGCVACDCVSMSRVLFCFPGKKPVRRTSVLATMVVTTIYENDNLKEKKDRENIKK

SEQ ID NO: 169485 - protein, 94 aa, Glycine max
  Coding DNA Sequence Number=SeqID_52707
  Homolog annotation: Hit_ID=Q1T176; Match level="QueryCoverage=51%, HitCoverage=24%, E-value=2e-14, Identity=75%"; Hit description=GINS complex, Psf1 component
MYGSKASQLVKEFASGEKGQLTTYNNDLIREVVAECTQHHLDFQSLIRKSHIACLNSWDVAYASVGQHHLGPIDFKLKSNMLLESIAHLGSCLF

SEQ ID NO: 169486 - protein, 196 aa, Glycine max
  Coding DNA Sequence Number=SeqID_52708
  Gene Ontology: Mol. function=nucleic acid binding; Cellular component= chromatin; Biological process=DNA integration
  Homolog annotation: Hit_ID=Q1S1G2; Match level="QueryCoverage=84%, HitCoverage=11%, E-value=6e-41, Identity=48%"; Hit description =Integrase, catalytic region; Zinc finger, CCHC-type; Peptidase aspartic, catalytic
MDLNLKLTLTDGDLIPDPSLYRRLIGQGLFFPAQNFLHLSAYADANWGNYLDTCKSTTGFCVFLGDALILWKPVKQGTVPKSSTESEYRALSSVASEVVQLKRLLGHFEVDIGSIMLFCDNKPAIHLTSNPSYHERLKYIDIDCHFIRELVQSNIFKLIHVKTQHQIVDIFTKPLPTSSFTNFIRKLGIIENLKVI

SEQ ID NO: 169487 - protein, 119 aa, Glycine max
  Coding DNA Sequence Number=SeqID_52709
  Subcellular localization annotation: CTP_CleavageSite=71; ConfidenceScore=5.71e-01
MTYNTTTSGGALVGWARSSLGRLPLLSASLQGLLSSSFRPGQAFSLSRFGLGRCAPATSWQKSRLMGKPPPAAMVSVLEFNLYEIMLRITLNFVIDILSQSGFDWDSTIYMINVENVNA

SEQ ID NO: 169488 - protein, 62 aa, Glycine max
  Coding DNA Sequence Number=SeqID_52710
  Homolog annotation: Hit_ID=Q10PB0; Match level="QueryCoverage=66%, HitCoverage=32%, E-value=5e-12, Identity=76%"; Hit description =Expressed protein
MKCGIRVEILLDIQSSEECNTVCYSMSSLLVYQPHLQVSEGNPESGGRGEENQVPLDSFSHD

SEQ ID NO: 169489 - protein, 106 aa, Glycine max
  Coding DNA Sequence Number=SeqID_52711
MSDEVDMDMDDTVKNEDCSKIFTTMKVFDTRDELLKWVRKVVFELGVANIDIKKDAKAVTRTRKCDCSFRLKGRPLKTSEGWVHRVLCGSHNHDIAKTLIGHPYVG

SEQ ID NO: 169490 - protein, 70 aa, Glycine max
  Coding DNA Sequence Number=SeqID_52712
  Subcellular localization annotation: CTP_CleavageSite=50; ConfidenceScore=5.25e-01
MYLTWRVGRGKQWNLYRSWKNNSVGTFGVVGAFSTGKQPSVTPSASPIICCSSFQIEGKRRNLAQIQTPL

SEQ ID NO: 169491 - protein, 137 aa, Glycine max
  Coding DNA Sequence Number=SeqID_52713
MSWDMKRRLRGLVDGQISNELTTKGVRWTPYETHRTHHPFKNISLFYGYIRLGPDLHLQLPERVDDKWLNVHNHLIQLTMGAVKLRIVDHRLVTQGTDAYCGTKKELALTRGVTDDGPMKTSRALGGTRGGRGRGRH

SEQ ID NO: 169492 - protein, 281 aa, Glycine max
  Coding DNA Sequence Number=SeqID_52714
  Gene Ontology: Mol. function=binding; Cellular component =mitochondrion; Biological process=embryonic development ending in seed dormancy
  Homolog annotation: Hit_ID=Q8S5M5; Match level="QueryCoverage=99%, HitCoverage=52%, E-value=2e-19, Identity=24%"; Hit description =Putative PPR-repeat protein
  Pfam annotation: Domain name=PPR; Domain location=121-155; Score=7.5; E_value=0.97; Accession=PF01535.11; Description=PPR repeat
  Pfam annotation: Domain name=PPR; Domain location=214-248; Score =14.4; E_value=0.15; Accession=PF01535.11; Description=PPR repeat
  Pfam annotation: Domain name=PPR; Domain location=50-84; Score=24.3; E_value=0.00042; Accession=PF01535.11; Description=PPR repeat
  Pfam module annotation: Pfam domain module=PPR::PPR::PPR; Domain location=121-155::214-248::50-84
MDYQSCYPNKDSYAILMKGLCQDRRLHEATHFLYSIFWRISQKGNGEDIVIYRTLLDALCDAEKFEETEEVLGKILRKGLKAPKRCYNRLDLGQNSDGKDIESAKRMIHEALIKGSVPSLASCNTMAIDLYSEGKIDEADKVIVEMQESRGFKPTHTVFEAKVAALFKVNKVDEAIKVIEENMVKVNCLPIAKVLVLKSLNKVSSKVGCTGDIDTYDILLKMLCGERRYLEASQLLEKMSIKSYWPCTKSYNSLIEGLYSLGLQYEAIMWLEDMINQGKLP

SEQ ID NO: 169493 - protein, 157 aa, Glycine max
  Coding DNA Sequence Number=SeqID_52715
  Homolog annotation: Hit_ID=Q1T1Y0; Match level="QueryCoverage=62%, HitCoverage=26%, E-value=8e-14, Identity=40%"; Hit description =Ankyrin
  Pfam annotation: Domain name=DUF1723; Domain location=88-137; Score =51.3; E_value=3.2e-12; Accession=PF08330.1; Description=Protein of unknown function (DUF1723)
MARTKRVSFDGDDDNDRRNRTTMSERRRCLEAQQVDPLKIEHVDQERGELKLVSHGRKLQLEITLHEQIHNAIKESGLFPLTTCSYQTIYNGLLSTFAGRWHTETNTFHLSVGEMMVTLDDVTYLLDILITGAFYNCEHMDKEAAISVLVEILGVGY

SEQ ID NO: 169494 - protein, 55 aa, Glycine max
  Coding DNA Sequence Number=SeqID_52716
MDSMIEQTIEHDIQLEHGLLHLPVYKKYSTEKFGFSVQSTWKVCKPTFSENPNTL

SEQ ID NO: 169495 - protein, 460 aa, Glycine max
  Coding DNA Sequence Number=SeqID_52717
  Gene Ontology: Biological process=conjugation
  Homolog annotation: Hit_ID=Q93GN9; Match level="QueryCoverage=75%, HitCoverage=75%, E-value=4e-67, Identity=41%"; Hit description =Conjugative transfer: assembly
  Pfam annotation: Domain name=TraB_pillus; Domain location=11-401; Score=288.7; E_value=1.1e-83; Accession=PF06447.2; Description=TraB pilus assembly protein
MSNINTATRRRQWIITGVAAGVMLALGGGIWAYSQHLAALKNPPPAKAADLTGTGLVNSRFTGAVSESVLAQQQNKTATLEKDLSTLSATVSAQNDALSRKLEQIGTALDKLQSQAEKPPAQIPAAGQGTPSASSPVSGGPSGPAQWSISNPGSGPAAGQGSQFYPAQGQGFYPGAGTVRPGGLSRDTFTYASLTDKKTKLPWIPSGSFSEAVMIEGADANASVTGQQNTSPVVITLLGDVSMPNGKTWNMDQCRVTGEMYGDISSERGEVRTKNISCILKNGKHIDMPFDGHVSFQGKVGIRGKPVMRNGVIVANAWGAGMLSGFGEGIKSAATPTVGLGASASVGAGDIFKQGFGGGASKAADTLSQYWIKRAEQYHPVIDIGAGNAVTVVFQQGFRLETIEDAEAEKAQKEAPQPVVQQTAANQPVSSGGSNSAPVLNPDEVLRQASQLRLGDTILQ

SEQ ID NO: 169496 - protein, 356 aa, Glycine max
  Coding DNA Sequence Number=SeqID_52718
  Gene Ontology: Mol. function=DNA binding; Cellular component=beta -galactosidase complex; Biological process=DNA integration
  Homolog annotation: Hit_ID=Q1SH28; Match level="QueryCoverage=98%, HitCoverage=39%, E-value=2e-86, Identity=44%"; Hit description =Integrase, catalytic region
MTTYIINRTPSSNLQNQSPYKLLYGKVPVYDLIKVFGCLCYAATAPAQRHKFTPRATKFVFLKYPFGYKGYKLYDLDNYKFLISRDFYHQEIRFLEWRQAMNEEIQALEMNNTWVVQPLPPGKRTISCRWIYKVKYRANGSLDRYKVLLIAKGYTQQAWIDFLDTFSPVAKLTTVRVLLSIAAHRNWNMLQLDINNTFLNSDLIEEVYMDMPLGYLVKNDNMVCKLTKSLYGLHQASRQWFHKFSTTILDQGFQQCPTYHSLFTRGSGATLVTLLVYVDEIIVAGPDQKLIAEIQLMLAKHFKIKVIDDLKYFLGLEIAKSPRGIHLCQHKYTLQLLTDTDFAASKPQSVPMDPNS

SEQ ID NO: 169497 - protein, 177 aa, Glycine max
  Coding DNA Sequence Number=SeqID_52719
  Gene Ontology: Mol. function=nucleic acid binding; Biological process= DNA integration
MDDPYDPYIIIMLIVLENWNSWKRAMLMTLGGRNKLRFVDGTIPPLDPKDPLHHVWLRNNNIVASWLMNSISKEVAASVTYSSNATTIWKDLEDRFQQNNGPRILQLKHDLSNCLQGSLSILQYYTKMKSIWKELSEYKHVHHCHYGGVQSLLDHFHFEYVLKFLLGLNESYSQIHG

SEQ ID NO: 169498 - protein, 202 aa, Glycine max
  Coding DNA Sequence Number=SeqID_52720
MASRKCRAVPIPGEASNWYSSRFTSEIAWHRYQDNIQFRNILPERNVELGPGMFDEFLQELQRRRWDQVLTRLPEKRIDVALVKEFCSNLYDPEYHSPRFCRVRGQVVHFDADTINNFLGTPVILEDGEEYLAYTRYLSTHPDPYTIAATLCTPGGRFGTLDLRPGEPHGYGRGQLYISADQSDCPVQHLEARVPSVDYSAV

SEQ ID NO: 169499 - protein, 90 aa, Glycine max
  Coding DNA Sequence Number=SeqID_52721
MHGQMLRSIHIGQQLIMENMHRLSLHLQMDPPLITLEAYRQQVAWPGDQPSTNRGAEHFGAAKDPAVNEDLIADLANADWGPWADLGGGS

SEQ ID NO: 169500 - protein, 85 aa, Glycine max
  Coding DNA Sequence Number=SeqID_52722
MPNNVNLMCFNISFSVFLSEACALSENHALNEALSPLSEMGETEKHLHAQNVISSLRKEFVSSRTKHAEPAQRIFTNSRLARKWR

SEQ ID NO: 169501 - protein, 169 aa, Glycine max
  Coding DNA Sequence Number=SeqID_52723
KTVPWNTELGGKLLRVCARPAEKNVRSVLLPWLDNWWHLQEGIQRSDVELDQLPPHTDLLGGFVFGIIQVCIKFLDQGHIYVPIHLGFDGLQTNVGERFDSLEHQVDTRFEEINSRIAKVEEDVTFIRDCFDLPPPPPSVCHHQKEGDRRSKLHDDEPSNFDDAKSPSD

SEQ ID NO: 169502 - protein, 95 aa, Glycine max
  Coding DNA Sequence Number=SeqID_52724
MKSFVNLIGGILKKEEPWPLERAAIVNWVSANKSSRDKKIKGKRVFRKSENGTSFIYTELRTLNSETRTTSRQRKEFYNLFFLMTPYLLIYWVKN

SEQ ID NO: 169503 - protein, 69 aa, Glycine max
  Coding DNA Sequence Number=SeqID_52725
MQCLWSLLKEVVLSLRCNVWHELGPGLLHVSDLAKTLRMVGVVRGFRDAYGKVLLRENNATHMASVDRK

SEQ ID NO: 169504 - protein, 82 aa, Glycine max
  Coding DNA Sequence Number=SeqID_52726
  Gene Ontology: Mol. function=phosphatidate cytidylyltransferase activity; Cellular component=integral to membrane; Biological process=phospholipid biosynthetic process
  Homolog annotation: Hit_ID=Q2N2K1; Match level="QueryCoverage=50%, HitCoverage=13%, E-value=6e-10, Identity=95%"; Hit description =Probable phytol kinase 1, chloroplast precursor
MATCISYLPSLFHLAFCCETIAKWLLSTSLGGSEQKAGPYIVCLAFFGFLANFQDSNSPKASYFAAFVPLVNCLRLLVNGAY

SEQ ID NO: 169505 - protein, 86 aa, Glycine max
  Coding DNA Sequence Number=SeqID_52727
  Gene Ontology: Mol. function=transferase activity, transferring hexosyl groups; Biological process=metabolic process
  Homolog annotation: Hit_ID=Q1RXI0; Match level="QueryCoverage=52%, HitCoverage=9%, E-value=2e-10, Identity=56%"; Hit description=UDP -glucuronosyl/UDP-glucosyltransferase
MNIVTDDASNQMINVSELMLQQTRVQSIVAKLSLILYLPYENYLTNGHLDSTINWIPGLKNITLRDLVGIYRTTDPNDILLDFAVE

SEQ ID NO: 169506 - protein, 77 aa, Glycine max
  Coding DNA Sequence Number=SeqID_52728
  Gene Ontology: Mol. function=transferase activity, transferring glycosyl groups; Biological process=metabolic process
  Homolog annotation: Hit_ID=Q589Y1; Match level="QueryCoverage=64%, HitCoverage=10%, E-value=1e-13, Identity=66%"; Hit description =Glycosyltransferase NTGT5b
MRHQQLVELAWGLANSKKKFMWVIRPDLVEGEASILPPEIVEETKDKGLLVGISLVNGLLAWRWIVIMLQGLKWKSL

SEQ ID NO: 169507 - protein, 97 aa, Glycine max
  Coding DNA Sequence Number=SeqID_52729
MDMSRGYAHDRRIVVPCPALDKREALLGGSLVSFKFLVIITVVSLRISSPERAPPARNGLKREGECSFHPRNFSPSLKNAALTGLLGMAFGLGCVLK

SEQ ID NO: 169508 - protein, 95 aa, Glycine max
  Coding DNA Sequence Number=SeqID_52730
MRWKMLWMKLKKEKKTLFESASSPLQVPYDPYNYSQSFDQGTAKDEPENFSGSFSVRFADPSTSRVLVKKRVVQDKALETCDFTISDCNVECAYI

SEQ ID NO: 169509 - protein, 48 aa, Glycine max
  Coding DNA Sequence Number=SeqID_52731
MPWKICMDSLTCSVRNFFAKTKVGASYRMSFIEGKIGNGSEETLHEEV

SEQ ID NO: 169510 - protein, 94 aa, Glycine max
  Coding DNA Sequence Number=SeqID_52732
  Gene Ontology: Mol. function=protein serine/threonine kinase activity; Cellular component=membrane; Biological process=protein amino acid phosphorylation
  Homolog annotation: Hit_ID=Q9FLJ8; Match level="QueryCoverage=83%, HitCoverage=9%, E-value=2e-16, Identity=60%"; Hit description =Receptor protein kinase-like protein
MAQGLCCYLSLKEMKQATNNFDEPNVIGVGGFGKWLSKDQIRNQGHVSTPLKGSFGYLDPEYFRRHQLTKKSDVYSFGVVLSEALYLRKVALDT

SEQ ID NO: 169511 - protein, 35 aa, Glycine max
  Coding DNA Sequence Number=SeqID_52733
YHLTALGNSIYKISDHEWEIDWCGDQIEEHLRIKY

SEQ ID NO: 169512 - protein, 92 aa, Glycine max
  Coding DNA Sequence Number=SeqID_52734
MNIVGEEDEQQCNNMNRKIQKIQNHKSTTPPCHLCGAETTMVPPPLHLAVVGNTEARKRAQRGREEDEETWRQRKTLEEDATEEDGYGNFEK

SEQ ID NO: 169513 - protein, 498 aa, Glycine max
  Coding DNA Sequence Number=SeqID_52735
  Gene Ontology: Mol. function=nucleoside-triphosphatase activity; Cellular component=membrane; Biological process=response to abscisic acid stimulus
  Homolog annotation: Hit_ID=Q75NU0; Match level="QueryCoverage=93%, HitCoverage=94%, E-value=1e-161, Identity=59%"; Hit description =Putative ATPase
  Pfam annotation: Domain name=AAA; Domain location=235-439; Score =54.5; E_value=3.6e-13; Accession=PF00004.19; Description=ATPase family associated with various cellular activities (AAA)
MGSTLASFMFLWTIMRQYCPYGVQRFFEKYTHRIMSYFYPYIRISFHEYMGDRLKRSEAYAAVEAYLSANTSKSAKRLKAEMGKDSSNLVLTMDEYERVTDDYEGVKVWWVSSKVMSPTRSPMSYYPEQEKRFYKLTFHSKHRDTITGSYLEHVMREGKEIRLRNRQRKLYTNSPGYKWPSYKQTMWSHIVFEHPATFDTMAMDPEKKQEIIEDLDTFSKSKDFYARIGKAWKRGYLLYGPPGTGKSTMIAAMANLLAYDVYDLELTAVKDNTELRKLLIETTSKSIIVIEDIDCSLDLTGQRKKKGDKSPSDDEADKDVVGRKEAKEEGGSGSKVTLSGLLNFIDGIWSACGGERLIVFTTNYVEKLDPALIRRGRMDKHIQLSYCTFDGFKVLANNYLKLEAHPLFDTIERLIGEVKITPADVAENLMPKSPLDDPHKCLSNLIVALEEAAKVEEMKQSSPIKEELLQQNGSIKENGELHGDKAMNQCQMWLVNDT

SEQ ID NO: 169514 - protein, 228 aa, Glycine max
  Coding DNA Sequence Number=SeqID_52736
  Gene Ontology: Mol. function=RNA binding; Cellular component=nucleus; Biological process=ribosomal large subunit assembly and maintenance
  Homolog annotation: Hit_ID=Q8H478; Match level="QueryCoverage=81%, HitCoverage=99%, E-value=7e-65, Identity=63%"; Hit description =Putative 60S ribosome subunit biogenesis protein
  Pfam annotation: Domain name=PUA; Domain location=144-218; Score= -1.4; E_value=0.052; Accession=PF01472.10; Description=PUA domain
  Pfam annotation: Domain name=UPF0113; Domain location=40-224; Score= -17.6; E_value=0.00041; Accession=PF03657.4; Description =Uncharacterised protein family (UPF0113)
  Pfam module annotation: Pfam domain module=PUA::UPF0113; Domain location=144-218::40-224
MAVAIVIPCVLIIEHMRVISTRRWDLDLRTCGQKRHFIPFWMRPLDEKETSAVFEKLFKFVGNNLKNIVENPSHEGPDSNPGRYCFRLHKNKIFYASESLVKRATNVARPNLVSLGTCIGKYTHGGSFHLTVQALNLLAANAKHKVWLKPQSEMSFLYGNHVLKGALGKLSENIAAGDGVVVFSMADVPLGFGVAAKSTLDCRKLDPNGIVVLHQADVGEYLRMEDEL

SEQ ID NO: 169515 - protein, 512 aa, Glycine max
  Coding DNA Sequence Number=SeqID_52737
  Gene Ontology: Mol. function=sugar porter activity; Cellular component=integral to membrane; Biological process=carbohydrate transport
  Homolog annotation: Hit_ID=Q9LT15; Match level="QueryCoverage=97%, HitCoverage=97%, E-value=0.0, Identity=67%"; Hit description=Sugar transport protein 10
  Pfam annotation: Domain name=MFS_1; Domain location=23-448; Score =91.9; E_value=2e-24; Accession=PF07690.6; Description=Major Facilitator Superfamily
  Pfam annotation: Domain name=Sugar_tr; Domain location=26-487; Score =574.4; E_value=1.1e-169; Accession=PF00083.14; Description=Sugar (and other) transporter
  Pfam module annotation: Pfam domain module=MFS_1::Sugar_tr; Domain location=23-448::26-487
MAGGSFVDSNGVRHYEGKVTGFVLITCFVAAMGGLLFGYDLGITGGVTSMDPFLIKFFPVVYRQMKGEAESKSQYCKFDNQLLTLFTSSLYLAALIACFFASTTTRMFGRKPSMFIGGLFFLIGALLNGLAINIEMLIIGRILLGFGVGFCNQSVPVYLSEMAPAKIRGALNIGFQMMITIGILIANLINYGTSKHENGWRMSLGIGAVPAILLCIGSLCLDETPNSLIERDQHEKAKEMLKKIRGTENVEEEYQDLVDASEAAKMVDHPWKNIVQPKYRPQLIFCIFIPTFQQLTGINVIMFYAPVLLKILGFGNDASLMSAVITGVVNVVATLVSIFTVDKFGRRVLFLEGGAQMLICQVIIGIMIGLKFGLNGEGSFSKGEADVLLFFICAYVAAFAWSWGPLGWLVPSETCSLEIRPAGQAINVAMNMLFTFIIAQVFLTMLCHLKFGLFFLFAGCVVIMTLFIALLLPETKNVPIEEMNRIWKAHWFWTKIVPDVAATVAPGKKVVP

SEQ ID NO: 169516 - protein, 103 aa, Glycine max
  Coding DNA Sequence Number=SeqID_52738
MGLGAGLLGGALGGLLIGDMISDAGYDAGFGDVESINPNCGVNPRRRKKRKDETFGPEGDERNVREAVQVLLRQRVPRQARHQRRLLLHNLNKMGNRFVFFAI

SEQ ID NO: 169517 - protein, 88 aa, Glycine max
  Coding DNA Sequence Number=SeqID_52739
MKILYRWMMMLSAVQVNDLNCIDEQSLSRRLIGLNCIDEQSLSHRFIGRLDPCYFELIFKNNEENKTSLFYINSPRAGLSIASNTKLN

SEQ ID NO: 169518 - protein, 530 aa, Glycine max
  Coding DNA Sequence Number=SeqID_52740
  Gene Ontology: Mol. function=galactosyltransferase activity; Cellular component=membrane; Biological process=protein amino acid glycosylation
  Homolog annotation: Hit_ID=Q10BV0; Match level="QueryCoverage=83%, HitCoverage=70%, E-value=1e-157, Identity=59%"; Hit description =Galactosyltransferase family protein, putative, expressed
  Pfam annotation: Domain name=Gal-bind_lectin; Domain location=159 -355; Score=146.4; E_value=7.6e-41; Accession=PF00337.12; Description= Galactoside-binding lectin
  Pfam annotation: Domain name=Galactosyl_T; Domain location=401-530; Score=-57.9; E_value=0.01; Accession=PF01762.12; Description =Galactosyltransferase
  Pfam module annotation: Pfam domain module=Gal-bind_lectin::Galactosyl _T; Domain location=159-355::401-530
MHQPQHNANNKNKNDVVRVTTNLKRILKPKAEMKRGRTGKFDNLVALSRQRSIQILIAIALLYVLFLTLEIPFVFRTAQQPTHTRRQLVRRQNGVVSALVLNDAAFDSELYQSACRAGKTVWEELRSGSPPGPIPSPENRSGPCPESVSVSGPEFLGRGSVMVIPCGLTLGSHVTVVGKPLRAQRKTCQFVMELQGLKTVEGEEPPRVMHFNPRLKGDWSGKPVIELNTCYRMHWGTALRCDGWKSRAGEDTVDGLVKCEKWIRGDDDDRDAVETKAAWWLKRLIGRPKRVTVDWPFPFSENKLFILTLSAGLGGYHINVDGRHVTSFPYHTGFTLEDATGLTLSGDIDVHSVFAASLPSVHPNVSSQQHLEFSTRWRAPNLPRYGVELFVGILSAGNHFAERMAVRKSWMQHSFIKSSKVVARFFVALHPRKEINVELKKEAEYFGDIVIVPYIDNYDLVVLKTVAICEYGVRTVSAEYIMKGDDDTFVKVDAVMNQARNVPRSMSFYIGNINYRHKPLRRGKWAVTYK

SEQ ID NO: 169519 - protein, 273 aa, Glycine max
  Coding DNA Sequence Number=SeqID_52741
  Gene Ontology: Mol. function=transcription regulator activity; Cellular component=nucleus; Biological process=regulation of transcription
  Homolog annotation: Hit_ID=Q5U8L7; Match level="QueryCoverage=81%, HitCoverage=78%, E-value=2e-48, Identity=50%"; Hit description=BHLH transcription factor
  Pfam annotation: Domain name=HLH; Domain location=106-156; Score =32.5; E_value=1.4e-06; Accession=PF00010.16; Description=Helix-loop -helix DNA-binding domain
  Subcellular localization annotation: CTP_CleavageSite=40; ConfidenceScore=5.07e-01
MEPLLFNDSTFSSANPSLSEIWPSHFPSDHTPRKRRLSPSSDSASNKHIKLSAPESQDQNGALKVGEVDATSVAGNKLPQQTPKPSSSEQAPKQDYIHVRARRGQATDNHSLAERARREKISERMKILQDLVPGCNKVIGKAFVLDEIINYVQSLQRQVEFLSMKLEAVSSRLSMKPTLECFPSKEVSVLTTPRKCPVLVLTYTDVSYMVTWIRKEECSSEPCCQVYLPDSRECSVCTQAGIIFGSQPAKGYAQGSQMGWLHMQIAGGFEKAT

SEQ ID NO: 169520 - protein, 240 aa, Glycine max
  Coding DNA Sequence Number=SeqID_52742
  Homolog annotation: Hit_ID=Q10EQ8; Match level="QueryCoverage=48%, HitCoverage=64%, E-value=6e-08, Identity=30%"; Hit description =Expressed protein
KHKEESMCHPGIPFVNREGLMVHRRWLVSSPLARQIHDGGSSGESGSVQRCVCSPSQHPGSFRCRLHHVNVKRNHTLSDIFEQVERIVDNLKSVDGERGVNVGGAARPDAAAAGGYEAELAAAVENGPRVGSDPDAVESDPSETNLRVGGVEEEGGASDEEEEEECRGVDDAAAATTLEMGTVGGEQNDDVLGGWREGASKRRTRPSRSSSKIVWYFQETNNDWVRGARGGGRIYEMKLS

SEQ ID NO: 169521 - protein, 287 aa, Glycine max
  Coding DNA Sequence Number=SeqID_52743
  Gene Ontology: Mol. function=serine esterase activity
  Homolog annotation: Hit_ID=Q010S2; Match level="QueryCoverage=88%, HitCoverage=57%, E-value=4e-25, Identity=32%"; Hit description=[R] KOG1516 Carboxylesterase and related proteins
  Pfam annotation: Domain name=Abhydrolase_3; Domain location=19-234; Score=-59.8; E_value=0.00082; Accession=PF07859.3; Description =alphabeta hydrolase fold
MKTGSENSNEENQPEEISGFYVPHHKPLKAHGTISDMIVDASQGISFVCNNIAEYGGDPNRIYLMGQSAGAHIAACAIVEQAIKEAGEGESTSWSLSQIKTYFGLSGGKLISGKNSNHRVVVKNVISSPQVYFFVKSIDGDLHALRPVLTQTTNTSIMEGEESLQRFSPEVMIQDPNIGNANSLLPPVVLFHGTGDYSIPSDASKTFAEALKRVGVTAESILYEGKTHTDVFLQDPMRGGKDDMFEDLVAYIHSGDADARARDATAPPRRRLVPEFMLKLAHSVSPF

SEQ ID NO: 169522 - protein, 71 aa, Glycine max
  Coding DNA Sequence Number=SeqID_52744
MAHVLKKKGVAPPRRVVRLPNTASARLDDARPPSGQRWRYEGGTMTQTKKERRNEGVYKMCEKPKTKCNNE

SEQ ID NO: 169523 - protein, 165 aa, Glycine max
  Coding DNA Sequence Number=SeqID_52745
MSSLFREKAFLLSSLFREKAFCLLLFFSARLLQLHLLREACLPFAFEMNLRVEDAGKNGGSLVTVSLPEDSLWVLPELPEEDLPEDFRKKGLPEVTHSGRSASEINFRKKILPETSGRRFFRKLPDDVLPEVVCGAILPLHCLLGAPTIMLGARNNSQIQNALTG

SEQ ID NO: 169524 - protein, 312 aa, Glycine max
  Coding DNA Sequence Number=SeqID_52746
  Gene Ontology: Mol. function=protein serine/threonine kinase activity; Cellular component=spindle; Biological process=protein amino acid phosphorylation
  Homolog annotation: Hit_ID=Q39030; Match level="QueryCoverage=81%, HitCoverage=51%, E-value=1e-96, Identity=66%"; Hit description =Serine/threonine-protein kinase AtPK19
  Pfam annotation: Domain name=Pkinase; Domain location=14-226; Score =158.5; E_value=1.7e-44; Accession=PF00069.15; Description=Protein kinase domain
  Pfam annotation: Domain name=Pkinase_C; Domain location=246-277; Score=13.5; E_value=0.013; Accession=PF00433.14; Description=Protein kinase C terminal domain
  Pfam annotation: Domain name=Pkinase_Tyr; Domain location=16-210; Score=-86.6; E_value=3.7e-07; Accession=PF07714.7; Description =Protein tyrosine kinase
  Pfam module annotation: Pfam domain module=Pkinase::Pkinase _C::Pkinase_Tyr; Domain location=14-226::246-277::16-210
  Subcellular localization annotation: CTP_CleavageSite=37; ConfidenceScore=5.03e-01
MISARGPILPTTPSSISIARQIQSNYSIQQLNSLSAKCNTKSKLYLVLDFINGGHLFFQLYRQGIFSDDQTRLYTAEIVSAVSPLHKNGIVHRDLKPENILMDADGHVMLIDFGLSKEIDELGRSNCFCGTVEYMAPEILLAKGHNKDADWWSVGILLYEMLTGKAPKHNNRKKLQEKIIKEKVKLPPFLTSEAHSLLNGLLQKDPSTRLGNGPNGDDQIKSHKWFRSINWKKLEARELEPNFKPDVSAKDCTANFDQCWTAMPVDDSPAPTPTAAWFSSCLKGKRFELLCLPFRSTLTYLTSQGPKEGDRL

SEQ ID NO: 169525 - protein, 386 aa, Glycine max
  Coding DNA Sequence Number=SeqID_52747
  Gene Ontology: Mol. function=RNA-directed DNA polymerase activity; Cellular component=exocyst; Biological process=RNA-dependent DNA replication
  Homolog annotation: Hit_ID=Q1SLB1; Match level="QueryCoverage=96%, HitCoverage=65%, E-value=3e-64, Identity=35%"; Hit description=RNA -directed DNA polymerase
MLERTGFSSKWVKWIEGCLKSASISVLVNGSPSAEFLPKRGLRQRDPLAPFLFNVVAEGLNGLIRRAKEENLYKGFQVGINNVNISILQYTDNTIFFGEAIMENVTAIKTILRTFELASSLKINFAKSCFGVFGQSQQWKQQAAKYLNCRLLALPLVYLGIPIGANPRRGQMWDSIIHKWKRKVPKSMVDKLVILQRRFLWGGAPDQNKIAWVRWETVCLPKEKGGLGIKDINNFNLALLRKWRWKLMQHKGELWARVVESKYGGWRGLFEADRAGPESVWWRDLKRALIHTQQGQLIQNGLKWKQHQVIQQMGSHKDNGWKWNFTWRRPLFDNEIDWAISFLNEVQYKVIQQQGSDRWEWIGDPTGQYSVGNYVMEFFLIINKTT

SEQ ID NO: 169526 - protein, 83 aa, Glycine max
  Coding DNA Sequence Number=SeqID_52748
MPIYRKKKAFGTKTARPDELRLSPEVISSPRRVGYFILKSFGGSGEPEDSLGEVGSRKLNEKTLLPLLFVQLARMKISVNDSP

SEQ ID NO: 169527 - protein, 283 aa, Glycine max
  Coding DNA Sequence Number=SeqID_52749
MKGTSKFIMGATLVMVVSLAIVLGLILVLLAELYCSLLLRRRQLRRKTNTIPISTTQTTTTISNHASSPSHTPQHSPSPPPFCNDFYSQGVLQAPRSFLFPCKDEPNATPRGIGLVSAVSSSPSLASFLARAPPHSLLQQQNTLQVSASGINEIPCADYNNKSCGGGVEHLVYISNPIYENEEGKASGANDTPFETPHTSPSRLARSGSSGEDDDHAGAQGSPPPPPSVTPPLTPMKKLPAAEGSSVSLRDATSLGTSGSDSHSINGPSSSSSLDTPCTSPSW

SEQ ID NO: 169528 - protein, 123 aa, Glycine max
  Coding DNA Sequence Number=SeqID_52750
MYWDVEEELTTMIESRPLEGPGNHLYSSLYQSSLIQREQYGVDKNGSKNEDPCVLRPHGAVFKIVKIRRFQPSMIQNLDEIFLDLTEEEVRTRLKLPSSGSLSAVTDLVQLIDEGPLMQEDKR

SEQ ID NO: 169529 - protein, 690 aa, Glycine max
  Coding DNA Sequence Number=SeqID_52751
  Homolog annotation: Hit_ID=Q3LHL2; Match level="QueryCoverage=16%, HitCoverage=22%, E-value=5e-09, Identity=32%"; Hit description =Hypothetical protein PPS5
  Pfam annotation: Domain name=DUF292; Domain location=26-96; Score= -17.5; E_value=0.00062; Accession=PF03398.5; Description=Eukaryotic protein of unknown function, DUF292
MRTPLFRAVSVTNVDLFIDPLLEISILKRLNILKFMGPFHIFPHVFCSGCPEEVREAISSLMFAAARFSDLPELRDLRQIFQDRYGSSLECYVNQEFATNLNSKSSTLEKKVHLMQDIASEFAIKWDSKAFELRMSKCSVFAQDRNNFKSNHTSDHDIPLQGKDATPKGVKFERSHDHPNDRHKFQNGKEAVVSKGDENHLCSKSNPPIPENGFKPLSSYDEVNLKRDSHGNPLPGREELSKVSDRGYWKEGSMLKPIGSSSKDTREEQFEGGSNLHDSWGNARRVKESQDTATARKSPGPAGSRSKNNVNESYVVNHGGLPDVDYLERKNPKDETFRVKPFYNNANPPAYTREEQFEGGFNQHDSWGNARRVKESQDTATSRKSPGHAGSHSKNNVNKPFAVNHGGLPDVDNSERRTQKDETPRAKPFYNNAMIPPPYVKPHSKLKNNKHENNSVYSNIDSDGIRTYPLVHEKPDAAPTMDRIQPGLDDSERDLQATRHARLSKHGHEKALSVQEDATEAVVLKQKSTRRKHSKSRSTQDDASNEDAEVVRKPRSRRRDEQKRGLQILFDDERHKNDEEERVIDRLLIHYSKKPSINVPEKTRRKYRSCLVHQMDNSTRDGPDETPEMVTRPPRSVSLPREQTEAVEVKKVYARAASFQPERLNEARHVHPKLPDCDDLAARIAALRGT

SEQ ID NO: 169530 - protein, 114 aa, Glycine max
  Coding DNA Sequence Number=SeqID_52752
MEEMSRFINEVQQPRQKHNKREGGTKIESHKLDKHQPIQKGPRYERYTPLTTNRTSILEETFNADVHIKLPLPFPPRLGSDNHPIGVKPEGHQEDQHRNHDTKRSRGKAEDRKR

SEQ ID NO: 169531 - protein, 220 aa, Glycine max
  Coding DNA Sequence Number=SeqID_52753
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=75%, HitCoverage=23%, E-value=9e-51, Identity=63%"; Hit description=BY-2 kinesin-like protein 10
MPRSSSAVHHHRQSSDNFMFDAHGRWLHSSAYAQELGTRSSSLRRNDDDRVLTSGLLDLHSFDTELLPEMYGVHNEYLTNHTIQGQSFDGYESILSGNKLVPRSRGLPESHLLKSVSADKERANNVAKIKVVVRKRPLNKKEIAKKEEDIIYIDSNFLTVHERKLKVDLTEYIEKHEFVFDAVLNEDVSNDEVYAETVEPIVPLIFQRTKATCFAYGQTG

SEQ ID NO: 169532 - protein, 151 aa, Glycine max
  Coding DNA Sequence Number=SeqID_52754
  Gene Ontology: Mol. function=RNA-directed DNA polymerase activity; Biological process=RNA-dependent DNA replication
MVFNLFSFKKYWDIIKKDLWRLVRGAFVNGFYEASIVEVLIALILKIYHPKQFKGFKPISLCNVTHKIITKVLVHRLRPFLEEIISPLQGIFCLRDDILLSAKAKEPQFEMINSTLDLFCMEPELKVNPLKSKLMFSRISELLRIYVSTSC

SEQ ID NO: 169533 - protein, 604 aa, Glycine max
  Coding DNA Sequence Number=SeqID_52755
  Gene Ontology: Mol. function=binding; Cellular component=plastid chromosome; Biological process=positive regulation of transcription, DNA-dependent
  Homolog annotation: Hit_ID=O64624; Match level="QueryCoverage=89%, HitCoverage=83%, E-value=2e-71, Identity=25%"; Hit description =Putative salt-inducible protein
  Pfam annotation: Domain name=PPR; Domain location=135-169; Score =33.1; E_value=9.9e-07; Accession=PF01535.11; Description=PPR repeat
  Pfam annotation: Domain name=PPR; Domain location=170-204; Score =37.5; E_value=4.8e-08; Accession=PF01535.11; Description=PPR repeat
  Pfam annotation: Domain name=PPR; Domain location=205-240; Score =13.0; E_value=0.21; Accession=PF01535.11; Description=PPR repeat
  Pfam annotation: Domain name=PPR; Domain location=241-275; Score =44.4; E_value=3.9e-10; Accession=PF01535.11; Description=PPR repeat
  Pfam annotation: Domain name=PPR; Domain location=276-310; Score =24.4; E_value=0.00041; Accession=PF01535.11; Description=PPR repeat
  Pfam annotation: Domain name=PPR; Domain location=311-345; Score =37.5; E_value=4.8e-08; Accession=PF01535.11; Description=PPR repeat
  Pfam annotation: Domain name=PPR; Domain location=346-380; Score =36.4; E_value=1e-07; Accession=PF01535.11; Description=PPR repeat
  Pfam annotation: Domain name=PPR; Domain location=381-415; Score =33.4; E_value=7.7e-07; Accession=PF01535.11; Description=PPR repeat
  Pfam annotation: Domain name=PPR; Domain location=416-450; Score =25.9; E_value=0.00014; Accession=PF01535.11; Description=PPR repeat
  Pfam annotation: Domain name=PPR; Domain location=451-485; Score =21.2; E_value=0.0036; Accession=PF01535.11; Description=PPR repeat
  Pfam annotation: Domain name=PPR; Domain location=486-520; Score =42.9; E_value=1.1e-09; Accession=PF01535.11; Description=PPR repeat
  Pfam annotation: Domain name=PPR; Domain location=521-555; Score =31.5; E_value=2.9e-06; Accession=PF01535.11; Description=PPR repeat
  Pfam annotation: Domain name=PPR; Domain location=556-590; Score =24.1; E_value=0.00049; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=135-169::170 -204::205-240::241-275::276-310::311-345::346-380::381-415::416 -450::451-485::486-520::521-555::556-590
  Subcellular localization annotation: CTP_CleavageSite=44; ConfidenceScore=5.69e-01
MPLKMTLTLSPFSPTLLTPATTLRQLLFTNFTPSPKRRLLLQARAAKPNVLIPINPSVTVEKGKYSYDVETLINRLTALPPRGSIARCLDPFKNKLSLNDFALVFKEFAQRGDWQRSLRLFKYMQRQIWCKPNEHIHTIMITLLGREGLLDKCREVFDEMPSNGVVRTVYSYTAIINAYGRNGQFHASLELLNGMKQERVSPSILTYNTVINACARGGLDWEGLLGLFAEMRHEGIQPDVITYNTLLGACAHRGLGDEAEMVFRTMNESGIVPDINTYSYLVQTFGKLNRLEKVSELLREMECGGNLPDITSYNVLLEAYAELGSIKEAMGVFRQMQAAGCVANAATYSVLLNLYGKHGRYDDVRDLFLEMKVSNTDPDAGTYNILIQVFGEGGYFKEVVTLFHDMAEENVEPNMQTYEGLIFACGKGGLYEDAKKILLHMNEKGVVPSSKAYTGVIEAFGQAALYEEALVMFNTMNEVGSNPTVETYNSLIHAFARGGLYKEAEAILSRMNESGLKRDVHSFNGVIEAFRQGGQYEEAVKSYVEMEKANCEPNELTLEAVLSIYCSAGLVDEGEEQFQEIKASGILPSVMCYCMMLALYAKND

SEQ ID NO: 169534 - protein, 137 aa, Glycine max
  Coding DNA Sequence Number=SeqID_52756
MQKYVKWKFQCYSRESTTTLTIKKVSAFGGPYFTQKHLLKISLAGQHKEAKWATQSKNELEQQHHRRATAAGIEHGRGGGGMSAQREGGGSTNGHKQEREARVEVGLLSLELSCDLQQQWAVMATPTKYDMMSTTLQ

SEQ ID NO: 169535 - protein, 572 aa, Glycine max
  Coding DNA Sequence Number=SeqID_52757
MEDSEKLTALKKAYADIILNTAKEAAARIMVSERKVTRFQQELVSTKEEALRMLLRLKQMFDSKRDQLALLQLPNSPTYMYIWFENEAKLFVTVSEAELMSLNQQKKIEELEAQLQEAEEIVRDLRAELRETQAELENVTKHQMQPLVEQNTEAEVAAQESFLQKNRLDPYDGSIYSAPGLQFESVSISENRNPIVNGSNDSSKFCGSHDHTNNCYIHNPDFASIVIRRKEPKLYRNGCTQRIHAFERSLFDGNMSVSGNLDNVQNENLVSVHEEGKTMTVSTNAKADIISEKEKPDELKVVKAVADLVKVPVQRKKRKFGKRKAIIKSILHSNQVKETNKESHLSCAKDSTLVLDNDDPSRVSSSMACENEAQKDLMSPFADVPTDTTATNEKSGPHSNAENGEVFVKAGSAWNITKDDKESLDKSDLTRQESLSAESVEVPACKDVEASNGSLDKMDSKVSDLDEKVSNRSTGDKFKFTFCRKRKKEAISCDDVDCSQDNTSSKKKCGEKQDDHVEPQKSCTMTESSRDSRRLAQVARQVVLNKLLLFFKHGHSIVEVMLLVADKGDYLD

SEQ ID NO: 169536 - protein, 156 aa, Glycine max
  Coding DNA Sequence Number=SeqID_52758
MTREILSRFILSFPIIFFKPYGRWILFSHLQFLISDCNYYPSSTYKWLTSQVTIGTYIPFAHFKWPWKLRILEKIKIFLWLIPQKTRFPMLLALTVLSLASQPCTVFVVALTLYWSVVAVRVPFLTKVSHLCVKKWLKEQLLSDRGFLFVAFVVWI

SEQ ID NO: 169537 - protein, 657 aa, Glycine max
  Coding DNA Sequence Number=SeqID_52759
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=99%, HitCoverage=59%, E-value=1e-127, Identity=55%"; Hit description=BY-2 kinesin-like protein 10
  Pfam annotation: Domain name=Kinesin; Domain location=1-226; Score =193.7; E_value=4.5e-55; Accession=PF00225.13; Description=Kinesin motor domain
MEPLPLKASHDILRLMHHTYRNQGFQLFVSFFEIYGGKLFDLLNERKKLCMREDGKQQVCIVGLQEYRVSKVETIKEFIERGNSTRSTGTTGANEESSRSHAILQLCIKRSADGTESKPTRLVGKLSFIDLAGSERGADTTDNDKQTRIEGAEINKSLLALKECIRALDNDQGHIPFRGSKLTEVLRDSFVGDSRTVMISCISPSSGSCEHTLNTLRYADRVKSLSKGNTSRRDPLSSSNLRDSTVLPGSSVLSHDDTLEDETTYVSSDKNRFGWPKQLEREPSPPNNVDRVPSGRMGGNLIPSVYSDPQNGQRGSQKARTANEYDYLGPTYEQDRTRKTSKRVDNNQLSAVGDKRKIESRVKLVDELHFEANHSDPDDNLNALLKEEEDLVTAHRRQVEETIDIVRELHFRVKSLSKGNTSRRDPLSSSNLRDSTVLPGSSVLSHDDTLEDETTYVSSDKNRFGWPKQLEREPSPPNNVDRVPSGRMGGNLIPSVYSDPQNGQRGSQKARTANEYDYLGPTYEQDRTRKTSKRVDNNQLSAVGDKRKIESRVKLVDELHFEANHSDPDDNLNALLKEEEDLVTAHRRQVEETIDIVREEMNLLVGADQPGNQLDDYISKLNTILSLKAAGIFQLQTQLAQFQRRLNEYNVVVTSGN

SEQ ID NO: 169538 - protein, 319 aa, Glycine max
  Coding DNA Sequence Number=SeqID_52760
  Gene Ontology: Mol. function=sequence-specific DNA binding; Cellular component=nucleus; Biological process=regulation of transcription, DNA-dependent
  Homolog annotation: Hit_ID=Q9LV52; Match level="QueryCoverage=73%, HitCoverage=65%, E-value=3e-59, Identity=52%"; Hit description =Similarity to heat shock transcription factor
  Pfam annotation: Domain name=HSF_DNA-bind; Domain location=14-195; Score=177.3; E_value=3.9e-50; Accession=PF00447.8; Description=HSF -type DNA-binding
MEHNIIVNNNNVIAPFVIKTYNMVNDPTTDKLIMWGPANNSFIVLDPLDFSHSLLPAFFKHNNFSSFVRQLNTYGFRKVDPDRWEFANEWFLRGQKHLLRNIARRKHGGAGRSNFNLHSHHHPLKVEELDDEAMVMEIARLKEEQKALEEELQGMNKRLETTEKRPQQMMAFLSKVVEDPQVLSRILREREKKHLGEKKRRLIPPPTTTAATTSSSSSSGIKTEFEEDEGNYNIMSSSPETGLEIDNNNICSPLAAGYWGEQGCHGYNRGAVTAPLTVVAPAVPTMGGGYLGRGVFFGEMAAEGNAVPPYPFSLLEGGF

SEQ ID NO: 169539 - protein, 208 aa, Glycine max
  Coding DNA Sequence Number=SeqID_52761
  Gene Ontology: Mol. function=RNA-directed DNA polymerase activity; Biological process=RNA-dependent DNA replication
MESGFALVLLCMGIEFRLKVSHDLCLHGIARLIVEVKLQIFDGPGHLPSCKFRLSQNLLDGVVHFDHHLMTQEVELESPGRALFSVIEYTTSEIDRELASCTRTKLTTSSATERYRCRGTPGLGWLKTSAEELASAYPKGTFFRVHAHVIFVEFPKDLFQVYHVLGYALRLDGHVFNICLDVSSDLIFKDLTHQSLTSGLNNLRGGVN

SEQ ID NO: 169540 - protein, 139 aa, Glycine max
  Coding DNA Sequence Number=SeqID_52762
  Subcellular localization annotation: CTP_CleavageSite=34; ConfidenceScore=5.03e-01
MASSSLSVKVGNFIFRCSVETMISPVKVGNFIFRCGMETMALSSLSVFLQIKEKKDYITRALGCEAPNTGGLASHDNERLYTLGADVDRRMDIDRGFSLFEILGLKIYSLESYESPRLSRDWYPDVYLSFASYSFYRPK

SEQ ID NO: 169541 - protein, 177 aa, Glycine max
  Coding DNA Sequence Number=SeqID_52763
  Gene Ontology: Biological process=lipid metabolic process
  Homolog annotation: Hit_ID=O80959; Match level="QueryCoverage=87%, HitCoverage=24%, E-value=2e-17, Identity=48%"; Hit description =Similar to latex allergen from Hevea brasiliensis
MGDAYKMKAPTFTPFHFSSIDEKISCVAVDGGLVMNNPAVAVVTHVLHNKCDFPSVNGMEDLLVLSIGNRAQAKRMNNAGECSTSTVVDIALDGVFETTDQMLGNAFCWNRTDYVRIQDEEILHAVHRWEIVLLVEDVRDGSCCQIVHHQAIVDGGEVEGSEEARGRRRCEVRSSQQ

SEQ ID NO: 169542 - protein, 146 aa, Glycine max
  Coding DNA Sequence Number=SeqID_52764
  Homolog annotation: Hit_ID=Q8S3F0; Match level="QueryCoverage=33%, HitCoverage=15%, E-value=4e-07, Identity=57%"; Hit description =Putative bHLH transcription factor
  Pfam annotation: Domain name=HLH; Domain location=102-146; Score=1.5; E_value=0.1; Accession=PF00010.16; Description=Helix-loop-helix DNA -binding domain
MEQSWENWPLDMGMEEDRDLRDEEEFLRNILSEPSESEMVTVGSAKRPPRTYILSFDNSTIIPATPEPTSRKRTRQPQNLNLEPIKPNPNTQPGKRGRSCSQTLDHIMAERKRRQELTQKFIALSATIPGLKKILLSSFASVLEME

SEQ ID NO: 169543 - protein, 61 aa, Glycine max
  Coding DNA Sequence Number=SeqID_52765
MESHEDSTNGGFNHLSISLMFRNPIRIIKKKIKESQKIVRNAAIAVGRHVSPLRGILRGSN

SEQ ID NO: 169544 - protein, 128 aa, Glycine max
  Coding DNA Sequence Number=SeqID_52766
  Gene Ontology: Cellular component=nuclear chromosome; Biological process=chromosome organization and biogenesis (sensu Eukaryota)
  Homolog annotation: Hit_ID=Q1SKA6; Match level="QueryCoverage=84%, HitCoverage=13%, E-value=3e-24, Identity=52%"; Hit description =Rad21/Rec8 like protein, C-terminal; Rad21/Rec8 like protein, N- terminal
  Pfam annotation: Domain name=Rad21_Rec8_N; Domain location=1-57; Score=-13.1; E_value=0.011; Accession=PF04825.4; Description=N terminus of Rad21  Rec8 like protein
MDGVSYRVLGYLLLGTIRIFSRKVEYVLEDCNEVLLKISKFVIHKEGLIPVETLRMPITIPERFELDAFELDGLEDAGRGHTAPPEEITLGDKEIVCSTEGLGLFPHEKLFTNICQINFCLINALSLH

SEQ ID NO: 169545 - protein, 47 aa, Glycine max
  Coding DNA Sequence Number=SeqID_52767
MVEPFVWLGSGNGRNRRFYQCAIEESEGEGEDRNDVSFSGYLSENSC

SEQ ID NO: 169546 - protein, 611 aa, Glycine max
  Coding DNA Sequence Number=SeqID_52768
  Gene Ontology: Mol. function=binding; Cellular component=microtubule
  Homolog annotation: Hit_ID=Q654G4; Match level="QueryCoverage=96%, HitCoverage=93%, E-value=9e-82, Identity=37%"; Hit description =Putative potyviral helper component protease-interacting protein 2
  Pfam annotation: Domain name=HEAT; Domain location=121-157; Score =2.1; E_value=24; Accession=PF02985.12; Description=HEAT repeat
  Pfam annotation: Domain name=HEAT; Domain location=204-239; Score =24.8; E_value=0.00031; Accession=PF02985.12; Description=HEAT repeat
  Pfam annotation: Domain name=HEAT; Domain location=37-77; Score=4.1; E_value=13; Accession=PF02985.12; Description=HEAT repeat
  Pfam annotation: Domain name=HEAT; Domain location=82-118; Score =26.3; E_value=0.00011; Accession=PF02985.12; Description=HEAT repeat
  Pfam module annotation: Pfam domain module=HEAT::HEAT::HEAT::HEAT; Domain location=121-157::204-239::37-77::82-118
MSSSPQNIKQRVFTCLTKLSDRDTQSLAAAELESIARNLDATTLPAFLSCMYSTDASDKPPVRKQCVHLLGFLAQTHGNMLAPYLSKILGSVVRRLRDVDSSVRSACVNSIAALSGHVSKQPLNSFLKPLAEALFTEQDQNAQASAALCLASAIDGAPDPDPARLAKLLPRFEKLLKRDGFKAKPALLTLVGSVVAAGGASGHAQLKSLVPCLVEALSNDDWATRKAAAETLVVVADVERDFLSEFKGECVRVFENRRFDKVKLVRDVMNQMLEAWKLVPDVSDEVSPPPKSQSSSKENASDGRYPQVSQNSCSPRSMMANLRRKSTPFSRFSPADSSSASNAKNTSASSSNKRMSSSVSRKLNHKNWDAQIAVADQGDLQERDGIVSERSKMDKSGVSKPETKRALLNKSSEDKIQKYGGSKAGSRVVPYQEDESQDSVPVSIVSKDLQRNDKESEDLSLIRDQLHQIENQQSSLLDLLQKFMGSSQNGMRSLETRVHGLELALDEISYDLAISSGRMTKPDPHGNTCCMLPGAEFLSSKFWRKTHGRDSITRFSRSGGTPSLAAMNYQANRDAETKLANHRFRPDGGFITNPLAEIHTNSRNFATSEIA

SEQ ID NO: 169547 - protein, 267 aa, Glycine max
  Coding DNA Sequence Number=SeqID_52769
  Gene Ontology: Mol. function=RNA-directed DNA polymerase activity; Biological process=RNA-dependent DNA replication
  Homolog annotation: Hit_ID=Q2HRG4; Match level="QueryCoverage=42%, HitCoverage=7%, E-value=3e-19, Identity=43%"; Hit description =Ribonuclease H
MDSGVEVHDVCCTSVLENKCVNNNKERINDMVTFHELMRLLRELVPNFDYFYASLHIYIHYICQFPSLPWTMANSMQWRWLWRLHLPQRCKIFLWLALNDKLPTAVPHVADFAFSPCPFCRGHETLLHVLRDCPRAASVWLPLVAPQYQRGFFSCSLCNWMVTYLQQPWSSVNSDDEDCVLFAATVWLLWKDRKSWVSDGCGFSSSERVLHRVGALADDYGGVVELEHSAPSASVRYVSWCFYWNQPPSQLQLRSVADGSNVVSPKL

SEQ ID NO: 169548 - protein, 66 aa, Glycine max
  Coding DNA Sequence Number=SeqID_52770
MRFWSYYRVSVSVMVARGGLEPLKGVTHLRPNHMLTMVEKRSRGSWHKSRWTWLRWALGLRTSDEG

SEQ ID NO: 169549 - protein, 329 aa, Glycine max
  Coding DNA Sequence Number=SeqID_52771
MEEMFRIRNDVRQARKKHNKRQEGTKSYSHKSNKRHKPDKRQPLLKRPRYEHYTPLTPNRTTILEEAFNVDVLMKLPSPLPPRPRSDNHATIMRPGGHQEDHHKNHNSGRRDDAILPRRGSITRAMSRRLPEDWARDAGEGPRSSSPTFKLLSMTFYGGELVLDSSPRSGVSNNLSSLMKKKIQGLQALHGATLRRDTTNKDTSNNLCRNRKMSSPSKSESISPTSTTSTPFGTSISTMSTYCVNLPSPQSLAPITFTDRDFKGINPINEDDPKVVSIIIANFMVYKVLINQGSSTDILYWKTFHRLEVSPDTTQSHFGPLLGFARERV

SEQ ID NO: 169550 - protein, 122 aa, Glycine max
  Coding DNA Sequence Number=SeqID_52772
MEDLLKRWIEHLGRTRSGISHPPPVETHEESLVEEHDSREKDEDKSEERTQQQWEKCSQVEIQQESILQVNTPPHKLIVKEERHGEHDKSLSVILSLITSTSLAMIWKVSPEYMSFMEFLAK

SEQ ID NO: 169551 - protein, 126 aa, Glycine max
  Coding DNA Sequence Number=SeqID_52773
MVVSKLRNDVKGFVLYRNREPSWTVPLRSMGCSRCGVSTDDNGGSWWLMVVIGDGEEDWHVGNGFGKEEEKKWRFFQSYTDYKAQNAQVINALGKQKFRAHYSRLLKYPNGQIVDKCSMKLQTKFR

SEQ ID NO: 169552 - protein, 93 aa, Glycine max
  Coding DNA Sequence Number=SeqID_52774
  Gene Ontology: Mol. function=RNA-directed DNA polymerase activity; Biological process=RNA-dependent DNA replication
  Homolog annotation: Hit_ID=Q1SKV6; Match level="QueryCoverage=93%, HitCoverage=28%, E-value=1e-15, Identity=32%"; Hit description=RNA -directed DNA polymerase
MPHFGENAIEEAIWDCDRQKSLRPNDIHFNFLKRFWETMKKDIVRFIFEFHAHGMLPRGTNASFITLVPKVIEEAKRQRKKCLVFKVDYEKGL

SEQ ID NO: 169553 - protein, 98 aa, Glycine max
  Coding DNA Sequence Number=SeqID_52775
KIGDIAHYYSISDHNLAFFEDNGESNDDEDDDGGSHGRDTGEHVAVRASYIRQFDWLQQKILCSFLQAPANMNELLRNMPRGNTRYQIEAHIIARCRI

SEQ ID NO: 169554 - protein, 85 aa, Glycine max
  Coding DNA Sequence Number=SeqID_52776
MSIKRETKCINEGNGFENFSLGKGVVIEVNRSGGDQSDSNILEMYGDYNEELSMTTFDSSEIIGFNHRFKESKGSGEVSSENDFK

SEQ ID NO: 169555 - protein, 80 aa, Glycine max
  Coding DNA Sequence Number=SeqID_52777
MSNGYQLHSWFTYSMHVLFLSTAGFSLIYDKCDENPKTVQIQGPMTKQSMDTLQQMVAGILSKAQVEKDKSPNGEGRRPK

SEQ ID NO: 169556 - protein, 366 aa, Glycine max
  Coding DNA Sequence Number=SeqID_52778
  Pfam annotation: Domain name=Transposase_23; Domain location=43-103; Score=-9.8; E_value=0.013; Accession=PF03017.5; Description =TNP1ENSPM transposase
MASQYSPSRDAVSMKGNYVEATAKAFTEEPFAVDVAIMGLYIVGDKCTWLVALGKMYDNHNTIHNVPYADDVVRVSVVTVYDADAPVPFPTSEIHYMRVVVNTFIGWPTHLVKPVSDEDSHNRLPKLVGDVERCNIVAGEDPLGELIKSLFDVYQKPVELPWDGPKFRIPNVHTSFFITSAYVTEIISGYKCLNISILQLWMIAMKTVTTTLEGMSDQPVPLWIEAKSHVQTGGYECGYYVIHWMWCIVSGGLKNEWNKWFSNGTMLDVEAITTLCKKSHCQPENFACPVDSANEKDKYEVGEHPVVPWILFYYSLETMNYKVYFSKAKAYYFGSAPSKSEQLSSIGWILGSTTFIDYLLLLKSTN

SEQ ID NO: 169557 - protein, 136 aa, Glycine max
  Coding DNA Sequence Number=SeqID_52779
MGHTFEPSWSTPLKPMSVPGTGIAALSKSEERIGADPGGAEPLELRDSAPDHARVCDKEKGRYKATMRERKVKDSAHHLGATGGACIDDQARLTSALSKGGKMRGVATNVYLWKTSGKPKETGQNENSKFGSCIYA

SEQ ID NO: 169558 - protein, 63 aa, Glycine max
  Coding DNA Sequence Number=SeqID_52780
MVWVQKFGNNLQNTDKPLIEKKLMDEKRKTCLQQAEFTEDSTMTVDPPSLIARHVKSKMAHIK

SEQ ID NO: 169559 - protein, 62 aa, Glycine max
  Coding DNA Sequence Number=SeqID_52781
MVGPARATQRGILLCLRQCATVGDVDEMVGDCGRDGSRSRAMLFLVDGKSRSSRRKKGPYLL

SEQ ID NO: 169560 - protein, 571 aa, Glycine max
  Coding DNA Sequence Number=SeqID_52782
  Gene Ontology: Mol. function=sugar porter activity; Cellular component=integral to membrane; Biological process=carbohydrate transport
  Homolog annotation: Hit_ID=Q68BK0; Match level="QueryCoverage=91%, HitCoverage=92%, E-value=1e-140, Identity=50%"; Hit description =Sorbitol transporter
  Pfam annotation: Domain name=MFS_1; Domain location=84-525; Score =116.9; E_value=5.8e-32; Accession=PF07690.6; Description=Major Facilitator Superfamily
  Pfam annotation: Domain name=Sugar_tr; Domain location=80-566; Score =382.5; E_value=6.3e-112; Accession=PF00083.14; Description=Sugar (and other) transporter
  Pfam module annotation: Pfam domain module=MFS_1::Sugar_tr; Domain location=84-525::80-566
HCCCSALEMEENSSLEHHYYYPLPASSAAAEADHPNNHNDGDKEETCAEEGRSQYKPNTSQNYVSYQSNRSRLNGYALCGAILASTNSILLGYDIGVMSGASLFIRQDLKITSVQVEILVGSLNVCSLIGSLASGKTSDWIGRRYTIMVAAATFLIGAILMGLAPSFPFLMAGRVVAGIGVGYSLMISPVYVAELSPALTRGFLTSLPEVFISVGILLGYVSNYAFAGLPNGINWRLMLGLAALPAIAVALGVLGMPESPRWLVVKGRFEEAKQVLIRTSENKGEAELRLAEIQEAAASAFFTNIDKATTSSRASPTTTQAFSCFIFGSALTSSDGSSGMWHGQGVWKELLVTPTHTVLRILVAAIGVNFFMQASGNDAVIYYSPEVFKEAGIEGEKQLFGVTIIMGIAKTCFVLISALFLDKFGRRPMLLLGSCGMAISLFVLGLGCTLLKLSGDNKDEWVIALCVVAVCATVSFFSIGLGPITWVYSSEIFPLRLRAQGSSLAISMNRLMSGIVSMTFLSVSEAITFGGMFFVLGGVMVCATLFFYFFLPETKGKSLEEIEALFEDQAH

SEQ ID NO: 169561 - protein, 243 aa, Glycine max
  Coding DNA Sequence Number=SeqID_52783
  Homolog annotation: Hit_ID=Q9LW80; Match level="QueryCoverage=29%, HitCoverage=44%, E-value=4e-09, Identity=44%"; Hit description =Arabidopsis thaliana genomic DNA, chromosome 3, P1 clone: MSL1
  Subcellular localization annotation: CTP_CleavageSite=45; ConfidenceScore=5.76e-01
MLLSSISSTKKFFQKTVKNFKSFFSPGNYQRLPKASPHSKFSYSVAAASSSAMDMTSNTSYQDMEKLYTDFSDQCESENEKAIRRRMKKKAASSALLPSKQESEVYSGSYISLSNARHAQKKNKVEKKEEGGGGGGNNKRSITIQKGRQKESSSSFMSMCMKEHRYCMVEQKLRELEMLDMNNVEYVLDIEEVLHYYSRLTCPAYLEIVDKFFLEMYSELFGSSSMWHASPRSVNSRLKIRYQ

SEQ ID NO: 169562 - protein, 437 aa, Glycine max
  Coding DNA Sequence Number=SeqID_52784
  Gene Ontology: Mol. function=transcription factor activity; Cellular component=transcription factor complex; Biological process =regulation of progression through cell cycle
  Homolog annotation: Hit_ID=Q1SSY4; Match level="QueryCoverage=95%, HitCoverage=99%, E-value=1e-116, Identity=60%"; Hit description =Transcription factor E2F/dimerisation partner
  Pfam annotation: Domain name=E2F_TDP; Domain location=148-233; Score =60.0; E_value=7.6e-15; Accession=PF02319.11; Description =Transcription factor E2Fdimerisation partner (TDP)
  Pfam annotation: Domain name=E2F_TDP; Domain location=16-81; Score =107.1; E_value=5.2e-29; Accession=PF02319.11; Description =Transcription factor E2Fdimerisation partner (TDP)
  Pfam module annotation: Pfam domain module=E2F_TDP::E2F_TDP; Domain location=148-233::16-81
MASSDPIPSRHCTYNRKQKSLGLLCTNFLSLYDRGSVHLIGLDDAAIRLGVERRRIYDIVNVLESIGLLSRKAKNQYIWRGFVAIPHTLQELKEEGLKDNSNFLRGSGNDNDKVSDDEDDEETLSNPATGSQSDKLNPNSSTLTKSLKNGNGTNCCILVELISLDEAAKLLLGDAHNTSVMRSNTMINVPCSLSVDKAKVRRLYDIANVLSSMNLIEKTHTTDTRKPAFRWLGSEGKTWNETLHKSNLNESRKRAFGSDITNISFERNNVELFTNGDSNPNPKKPRMEYGSGLGQADENNLKQGTKQASKNYQFGPFAPACVPKVGASENNNLKQVHGWDSLATANSPQYQNEGVPPSCDFQSILMHISLRASDSQLRDRSASSNRYPTLERTVLALHGSMEIVVLRNCWEEVITNFVNVCQSNMFRKMEDEGEGGR

SEQ ID NO: 169563 - protein, 101 aa, Glycine max
  Coding DNA Sequence Number=SeqID_52785
MDVRSERSCDVRVATWESRRCAKTQSHDVRVGMVRGGGDGGFLGLGFSFVLRSYFALGRWKGGKVKHANGVVTMMGLGCQKIPLKCHRKSPPAMMNSGWWR

SEQ ID NO: 169564 - protein, 64 aa, Glycine max
  Coding DNA Sequence Number=SeqID_52786
MANEMRPEEVRDGKGVLAEPSQKFESCVWISNGGVGGMGENRSGQTLKDPNLTYDESLRPDPGL

SEQ ID NO: 169565 - protein, 268 aa, Glycine max
  Coding DNA Sequence Number=SeqID_52787
  Homolog annotation: Hit_ID=Q00YZ5; Match level="QueryCoverage=73%, HitCoverage=56%, E-value=5e-07, Identity=26%"; Hit description =Homology to unknown gene
MARILTLDFQLDCLNYESSNWYHADLDYETFKLLQLEKGESFFSFAKDMTLKSTKAVLQPASIPEDLDPLRSKLLWASRVLPMPLVGLLIIGGVCTDVGTQASEYPEIEALSRLDFGAALKVFLAKRLTSEFTLVTADVEEKSVIIGERNRVAIEALRAAMDKGHNKIAILYGGGHMPDLGRRLREDFDLVPSNVQWITAWSITKKDLNTDSFPFLKTIAKASGWPLNRYQTLALLIFSSVLALDLWFWELFFGTAVNWVSELGSELL

SEQ ID NO: 169566 - protein, 124 aa, Glycine max
  Coding DNA Sequence Number=SeqID_52788
MKSKRPQLIKKKRKKRKKLESDLKERAQKGPREPLPVADKSSLQLGTGTTIDPALEPHEIGYGIALQELFRRPIFMRRGNGRRRGSEGSTGKVCSGEHKKRGSVGGMEEEWSDSGGRGRSGRRI

SEQ ID NO: 169567 - protein, 195 aa, Glycine max
  Coding DNA Sequence Number=SeqID_52789
  Gene Ontology: Mol. function=RNA-directed DNA polymerase activity; Cellular component=chromatin; Biological process=chromatin assembly or disassembly
MAGQSPLLVTKTPFPLIGFGVNYFSYRVLQLTNPHLTIHKHPQTDGQNEVANKCLETYLHCMCFRKPTRWSKWLSLAKWWYNTNFHSSIQTTPYEVVYDQAPPIQLPFMPGEVANPTVDRTLSKREQLQPYRQFTMRHSSFHKLLPKYYAPFQVLERIGSMHANWEFYYDLLKKFPSFRRSGQGCTRRGGYCYNI

SEQ ID NO: 169568 - protein, 107 aa, Glycine max
  Coding DNA Sequence Number=SeqID_52790
MKCAYLLSLSTTTNIACLPWECGKPFIKSIPIASHTLLGIGICSGDVCDSEGVECKDRRKSKKVKNVFRELEEGCNIRIVRLAQMMDVMSVEKHIDSTFEGGKGEKL

SEQ ID NO: 169569 - protein, 546 aa, Glycine max
  Coding DNA Sequence Number=SeqID_52791
  Gene Ontology: Mol. function=nucleoside-triphosphatase activity; Cellular component=membrane
  Homolog annotation: Hit_ID=Q8L5U8; Match level="QueryCoverage=79%, HitCoverage=90%, E-value=0.0, Identity=75%"; Hit description=Rubisco expression protein, putative
  Pfam annotation: Domain name=AAA; Domain location=312-497; Score =49.4; E_value=1.2e-11; Accession=PF00004.19; Description=ATPase family associated with various cellular activities (AAA)
  Pfam annotation: Domain name=AAA_5; Domain location=312-455; Score= -20.3; E_value=0.063; Accession=PF07728.4; Description=ATPase family associated with various
  Pfam annotation: Domain name=Ank; Domain location=114-147; Score =20.1; E_value=0.0081; Accession=PF00023.20; Description=Ankyrin repeat
  Pfam annotation: Domain name=Ank; Domain location=151-183; Score =34.5; E_value=3.8e-07; Accession=PF00023.20; Description=Ankyrin repeat
  Pfam annotation: Domain name=Ank; Domain location=184-220; Score =30.5; E_value=5.8e-06; Accession=PF00023.20; Description=Ankyrin repeat
  Pfam module annotation: Pfam domain module=AAA::AAA_5::Ank::Ank::Ank; Domain location=312-497::312-455::114-147::151-183::184-220
MNNINNNRSQDQRSRPAKAATIHGCALSGDLVGLQRLLRDNPSLLNERNPVVWNYVHRFQIYLVLTHDGDFSSQIWPMYKGIGGCYRLFISLVASFWDSSFKVLKRVGCMQALMAQTPLHVSAGHNRTEIVKFLLDWQGADKVEMEAKNMYGETPLHMAAKNGCNKAAQLLLARGAIVEARANNGMTPLHLAVWYSLRAEEFLTVKTLLEYNADCSAKDDEGMTPLNHLSQGPGTEKLRELLLWHLEEQRKQRAIEACSETKAKMDELEKQLSNIVGLNDLKVQLRKWAKGMLLDEKRRSLGLHVGRRRPPHMAFLGNPGTGKTMVARILGKLLHTVGILPTDKVTEVQRTDLVGEFVGHTGPKTRRKIKEAEGGILFVDEAYRLIPMQKSDDKDYGLEALEEIMSVMDSGKIVVIFAGYSKPMKRVITSNEGFCRRVTKFFQFNDFNSEELAQILHIKMNNLAEDSLLYGFKLHTDCSIKSLAALIERETTEKQRQETNGGLVDTMLVNARENLDLRLSFDCMDTEELLTITLVDLEAGLQLLTQ

SEQ ID NO: 169570 - protein, 192 aa, Glycine max
  Coding DNA Sequence Number=SeqID_52792
  Gene Ontology: Mol. function=ligase activity, forming carbon-nitrogen bonds; Biological process=tRNA processing
  Homolog annotation: Hit_ID=Q9LV47; Match level="QueryCoverage=86%, HitCoverage=32%, E-value=2e-54, Identity=57%"; Hit description =Arabidopsis thaliana genomic DNA, chromosome 3, P1 clone: MOB24
  Pfam annotation: Domain name=ATP_bind_3; Domain location=6-174; Score= 119.2; E_value=1.1e-32; Accession=PF01171.11; Description=PP-loop family
MMPLFVSALGVSGGPDSMALCVLTAGWKTAGADAVTPENGGFIDGLLAIIVDHGLRAESKEEANIVSHRVSKMGIRCEIACCDWPSGRPKQGQLQEAAREMRYQIFQEVCAQHRIGVLLIAHHADDQSYREVQANQGILVVRPLLEFSKEDMYKICQGGSENWVEDPTNQSPLYCSAHAIEKISMSGVKRRK

SEQ ID NO: 169571 - protein, 122 aa, Glycine max
  Coding DNA Sequence Number=SeqID_52793
MNEESNAPNIIIGLSVNHRSNKWMKTNTTTDAWGGATDTKVYLYGSGNCRMGLLVEVCQKNKNSAHNEEVNAVVIMAHYFANSSRTAFNGSSTESDIGLSVVAKFGSLSNINGDLDITVEGP

SEQ ID NO: 169572 - protein, 129 aa, Glycine max
  Coding DNA Sequence Number=SeqID_52794
MTNIMMKINKESDEMCNTVHVIDQSFAIRWKVELEPTWHLLHSSGNMHSVTYNQDLASPTLLDRWMELRVFYGLTRNHQVTLTHYGQSVFLLTIFESSFEPKNFPKWHSLYHQVPNSVTFKVLLIVAFC

SEQ ID NO: 169573 - protein, 216 aa, Glycine max
  Coding DNA Sequence Number=SeqID_52795
MQRMLNTRRTATAPTAIPTTTPVEMLDEEDDGGDGVVGLDPDGGEGELRDGGLGVLPPLGGDGGDVDGGDGGEVDGVVGVDGGGEAEGVDGGGEEGVAGGGEEGVAGGGEEGVAGGGDDGVAGGGDDGVEGGGAEGVAGGGAEGVAGVDGGGAVPLFAGGEDGAGAVDISENDYRNKNARSKNKENLKKAKNKPTSEDKRVHGTHTNAPRTPSSYN

SEQ ID NO: 169574 - protein, 78 aa, Glycine max
  Coding DNA Sequence Number=SeqID_52796
MELPLACPRNLQSLAILAFCRLPRHRGGVETPSLSWAPISDWQNILLRSLRILVQYDFYKWRCYSTISKNRKTHGGDD

SEQ ID NO: 169575 - protein, 36 aa, Glycine max
  Coding DNA Sequence Number=SeqID_52797
MDDERLGPLLLRKTKFCCIRDRLKNTFCKIREMGEE

SEQ ID NO: 169576 - protein, 63 aa, Glycine max
  Coding DNA Sequence Number=SeqID_52798
MYKKLLKNLTSEELLVVTLLMGTNARRSFLISTKVLPNLWLRFILLRQSRLYIAEMRDLLVSM

SEQ ID NO: 169577 - protein, 120 aa, Glycine max
  Coding DNA Sequence Number=SeqID_52799
  Homolog annotation: Hit_ID=Q5YLM3; Match level="QueryCoverage=76%, HitCoverage=10%, E-value=2e-25, Identity=61%"; Hit description =Roothairless 1
MQIFFFLRNENYAAFQNSLYDLANIVPTLAKFYHQASEAYEQACTRHISMIIYYQFERLFQFTRRIEDLMFTVEPEEFYHMPNMGLPLHRSPINRETKSPVTLFKSASHQSWRKGFICRF

SEQ ID NO: 169578 - protein, 109 aa, Glycine max
  Coding DNA Sequence Number=SeqID_52800
  Gene Ontology: Mol. function=enzyme inhibitor activity
  Homolog annotation: Hit_ID=Q1SG57; Match level="QueryCoverage=96%, HitCoverage=37%, E-value=1e-12, Identity=37%"; Hit description =Pectinesterase inhibitor
NANLMLLKPILAHRNIRHNNTKHNDNNDEIVRRNDLHGPEEVLQSVIVLFLTILKHYGDLQRGLHVLGDDEDGEVGLVGAGFDGDLKDIHEVEVVVEEQRDGGDAHDMM

SEQ ID NO: 169579 - protein, 698 aa, Glycine max
  Coding DNA Sequence Number=SeqID_52801
  Gene Ontology: Mol. function=DNA binding; Cellular component =chromatin; Biological process=DNA integration
  Homolog annotation: Hit_ID=Q1S9T4; Match level="QueryCoverage=61%, HitCoverage=31%, E-value=0.0, Identity=88%"; Hit description =Integrase, catalytic region
  Pfam annotation: Domain name=GidB; Domain location=529-698; Score =116.2; E_value=9.5e-32; Accession=PF02527.6; Description=Glucose inhibited division protein
  Pfam annotation: Domain name=Methyltransf_11; Domain location=589 -686; Score=-1.4; E_value=0.075; Accession=PF08241.2; Description =Methyltransferase domain
  Pfam module annotation: Pfam domain module=GidB::Methyltransf_11::RVT_ 2; Domain location=529-698::589-686::1-186
KPATIRTVLSIALSKSWGLHQLDVKNAFLHGNLNETVYMYQPAGFRDPQYPDYVCLLKKSLYGLKQAPRAWYQRFTDFVATLGFSHSICDNSLFTYHNGNDTAYILLYVDDIILTASSDTLRQSIMSKLSSEFAMKDLGPLSYFLGISVTRHSSGMFLSQHKYAEEIIERASMSSCKPVSTPVDTKAKLSGTSGNPYHDPSEYRSLAGALQYLTFTRPDISYAVQQVCLFMHDPRTQHMNALKRIIRYIKGTITHGLHLSPSSVDKLTTYTDADWGGCPDTRRSTSGYCVYLGDNLVSWSAKRQPTLSRSSAEAEYRGVANVVSESCWLRNLLLELQCPIAKATLVYCDNVSAVYLSGNPIQHQRTKHIEMDIHFVREKVARGQIRVLHVPSRYQIADIFTKGLPLQLFSDFRDSLNIRPPPVSTTGVEIVDVPMPPIAGESVCGTSGRRKRAMGVREAKRFFSVDFLQTPYATEIQISSTTLSAQIRSHSLSLRNPNLPPERPDSSLRRNSSSMEQGIQFLPLTRHKRTFSLNTHTSQLQLQRMNLTAVREVNEVMERHVEDSLAILPPLSDCYRSHCSASCDKLSLVDVGTGAGLPGVVLAIARPEWDVTLMESMNKRCVFLEHVVGVIGSSNIKIVRGRAESLGQNPCFREQFDIAVARAVAEMRILAEYCLPLVRVGGLFIAAKGHDPEVCNSY

SEQ ID NO: 169580 - protein, 432 aa, Glycine max
  Coding DNA Sequence Number=SeqID_52802
  Gene Ontology: Mol. function=ATP binding; Cellular component=nucleus; Biological process=electron transport
  Homolog annotation: Hit_ID=Q1S771; Match level="QueryCoverage=90%, HitCoverage=100%, E-value=1e-155, Identity=68%"; Hit description =WD40-like
  Pfam annotation: Domain name=WD40; Domain location=125-161; Score =17.9; E_value=0.037; Accession=PF00400.22; Description=WD domain, G -beta repeat
  Pfam annotation: Domain name=WD40; Domain location=200-238; Score =37.0; E_value=6.4e-08; Accession=PF00400.22; Description=WD domain, G-beta repeat
  Pfam annotation: Domain name=WD40; Domain location=243-280; Score =34.5; E_value=3.6e-07; Accession=PF00400.22; Description=WD domain, G-beta repeat
  Pfam annotation: Domain name=WD40; Domain location=288-326; Score =23.6; E_value=0.00069; Accession=PF00400.22; Description=WD domain, G-beta repeat
  Pfam annotation: Domain name=WD40; Domain location=333-369; Score =39.5; E_value=1.2e-08; Accession=PF00400.22; Description=WD domain, G-beta repeat
  Pfam annotation: Domain name=WD40; Domain location=375-424; Score =31.1; E_value=3.9e-06; Accession=PF00400.22; Description=WD domain, G-beta repeat
  Pfam annotation: Domain name=WD40; Domain location=76-115; Score =19.0; E_value=0.017; Accession=PF00400.22; Description=WD domain, G -beta repeat
  Pfam module annotation: Pfam domain module=WD40::WD40::WD40::WD40::WD4 0::WD40::WD40; Domain location=125-161::200-238::243-280::288 -326::333-369::375-424::76-115
  Subcellular localization annotation: CTP_CleavageSite=38; ConfidenceScore=5.16e-01
MLEGISLRTQYRQINFVQHLYKVNYPPTLLATPSSDLSMEHSASFNNNSLSSQRSLASVPSLNSHSHLFIPSTTSHSCLTTLKPHTSSSVYISCLTLAGNLLYTGSSDREIRSWNHTHFIQKPTTTNNNVVIAGKGAVKSIVVHSDKLFTAHQDNKIRVWRVTNLEHDQNQKYTRVATLPTLGDRLTKLLLPKNQVRIRRHKKCTWVHHVDTVSSLALSKDGTFLYSVSWDRTIKVWRTKDFACLESVRDAHDDAINAVAVSYDGYVYTGSADKRIRVWKKLEGEKKHSLVDTLEKHNSGINALALSADGSVLYSGACDRSILVSEKGKNGKLLVVGALRGHTRSILCLAVVSDLVCSGSEDKTVRIWRGVQKEYSCLAVLEGHRSPIKSLTAAVDRSEQDPNSEEPSFLVYSASLDCDVKVWQVFVPLLST

SEQ ID NO: 169581 - protein, 132 aa, Glycine max
  Coding DNA Sequence Number=SeqID_52803
MGTIGYDIMVGSHVKGLGGHERRRPMEAPVRRVDQMGDIPIIKGSDPNQLRMVQAWKIEAHENHNITKLTTEGRRGGSQRVWRNEVGTQALKLKQRSTKLESLQTEEMVLFEALDPFQSCQLTNQEEERLFG

SEQ ID NO: 169582 - protein, 315 aa, Glycine max
  Coding DNA Sequence Number=SeqID_52804
  Gene Ontology: Biological process=regulation of transcription
  Homolog annotation: Hit_ID=Q1SWC6; Match level="QueryCoverage=100%, HitCoverage=59%, E-value=1e-108, Identity=62%"; Hit description =Tesmin/TSO1-like, CXC
MDCKNFEGSEERQALFHGDQNNNMAYIQQAANAAITGAIGSSGYSSPPVSKKRKGQELFFWPTTKDPSISKLGQQVNHVRGPAPSSSLSPVSGARVGTATLGPSKFMYRHYTTTAPQGAMLSSGSSIRTSCKDTYSQEQLPSQKEGRVEKTVADDCSSANQTDKISPDNSSSDGADVPKGRPMSPGTLALMCDEQDTMFMTAASPIAPMAHACNTSSQFPYGQEMTEVYAEQERIVLTKFRDFLNRVITMGEINGKNELESQKDPIINGIGNTSSEIVLQHGTTSNGVTKPAVSPLATTSTSMIPGNIAENGETK

SEQ ID NO: 169583 - protein, 318 aa, Glycine max
  Coding DNA Sequence Number=SeqID_52805
  Pfam annotation: Domain name=zf-CCHC; Domain location=213-230; Score =24.5; E_value=8.9e-05; Accession=PF00098.13; Description=Zinc knuckle
MAATNKVLMSLCIAPIPIIEVRMGVNPSMSSLIALYRNFLLSTFHLHVNLDYMSLEELVGTLKASLSGEQVLRSSSKVLKVDDSSDDKSEEDSNEDEGLMSTWEDLDDTSSDEDEEEANICMMVDTIFEGSKLDQEDEELENKGKYLQMDLKELNELHNHQKEEKYDLWRDRSKAHKDYEDLNMSKHNLCGSSFDKFGNGYDGKIHVHDEDTVVCYVCGKTGHMESRCKDCPKKAILDSRKAMPVMVPGQWLLVTHDKRKVYVPMPNSLSLWNSLKHNVLTISQLCDNGYGVFFNKEECVVLHDDGSLLFPAKRKGNL

SEQ ID NO: 169584 - protein, 406 aa, Glycine max
  Coding DNA Sequence Number=SeqID_52806
  Gene Ontology: Mol. function=ligase activity, forming carbon-nitrogen bonds; Biological process=tRNA processing
  Homolog annotation: Hit_ID=Q9LV47; Match level="QueryCoverage=91%, HitCoverage=53%, E-value=8e-70, Identity=43%"; Hit description =Arabidopsis thaliana genomic DNA, chromosome 3, P1 clone: MOB24
MVLKIWWCSHDLYGKHALSYLNDFFFSIFPATFKFELQALISACRITRTYVDQIGYSLIGDAVVIKDHGYAVIDLQILCPLKVEDICLMKFLSLVLQFVSQRQRQIRGNALKLLMDYIRTFPCKNSVTAAGCYLCPDPGSRGFRVLVCCCSDDCALPSKIEYFESHSQGQGCCVANELGEIIEAEKSYANHLVLDASDVHFLDVNPELVLTEAKKLNIIGESTYNTVLALQKQETAHFRSKTEVISDSASKHGVTPFSKSLQPGQFCYLMDRFILTWKLKTNTDNDELSGLVGYEMDMGEETRSLCCTSCVTGNNKVPEVRHMIESDWLYLAELSKYPLSKNFPQYEVESVNGTERIMDRTSLCLHYASVSAKQALRLLKSIPVAARRSLPVLINQQGQLLSIPVS

SEQ ID NO: 169585 - protein, 525 aa, Glycine max
  Coding DNA Sequence Number=SeqID_52807
  Gene Ontology: Mol. function=kinase activity
  Homolog annotation: Hit_ID=Q5DK69; Match level="QueryCoverage=79%, HitCoverage=81%, E-value=1e-158, Identity=68%"; Hit description =Pollen-specific kinase partner protein
  Pfam annotation: Domain name=DUF315; Domain location=14-450; Score =747.7; E_value=7.6e-222; Accession=PF03759.4; Description=Domain of unknown function (DUF315)
MVRAFHHQISMEKSKSFHFRKMFEIPGKHIHGLFDKDHDEAGESDSKIYSKSFESRSSLDHHTFEIQFNSDHSPTASLGIEAPKMPPKPPTEADLMKERFAKLLLGEDMSGAGNGVSSALALSNAITNLAASVFGEQSKLGPMPSERKARWRKEIEWLLSVTDYIVEFAPSQQIAKDGTSMEIMTTRQRTDLLMNIPALRKLDAMLIIAMEQDTLDNFRDQNEFWYVSKNDENSEVNSNSQRKSDKWWLPTVKVPPTGLSEPAGKWIQFQKDNVNQVLKAAMAINAQILSEMEIPENYIESLPKNGRESLGESVYKSITVEYFDPGQFLSTMDMSTEHKVLDLKNRIEASIVIWRRKMTNKDSKSAWSSAVSIEKRELFEERAETILLMLKHQFPGLPQSSLDISKIQYNKDVGQAILESYSRVIESLAYTVMSRIDDVLYADSVTKNPSLAVSSRRYSLDSVPVAEQTSPNSGDEISNLKFSETPPSMTLSDVMGWSSTNEGSDLKTNSAGDLEEYEKEKYEKV

SEQ ID NO: 169586 - protein, 691 aa, Glycine max
  Coding DNA Sequence Number=SeqID_52808
  Gene Ontology: Mol. function=oxidoreductase activity; Cellular component=cytoskeleton; Biological process=fatty acid metabolic process
  Homolog annotation: Hit_ID=Q1SWD4; Match level="QueryCoverage=100%, HitCoverage=98%, E-value=0.0, Identity=75%"; Hit description=IQ calmodulin-binding region; Fatty oxidation complex, alpha subunit FadJ
  Pfam annotation: Domain name=3HCDH; Domain location=604-688; Score= -15.1; E_value=0.022; Accession=PF00725.12; Description=3-hydroxyacyl- CoA dehydrogenase, C-terminal domain
  Pfam annotation: Domain name=3HCDH_N; Domain location=308-489; Score =274.8; E_value=1.7e-79; Accession=PF02737.8; Description=3 -hydroxyacyl-CoA dehydrogenase, NAD binding domain
  Pfam annotation: Domain name=ECH; Domain location=16-185; Score =192.4; E_value=1.1e-54; Accession=PF00378.10; Description=Enoyl-CoA hydrataseisomerase family
  Pfam module annotation: Pfam domain module=3HCDH::3HCDH_N::ECH; Domain location=604-688::308-489::16-185
MALPKVDFEVGADGVAVITMCNPPVNALAIPIIMGLKNRFDEAARRNDVKAIVLTGKGGRFSGGFDISVMQKVHRTGDSSHLPDVSVELVVNSIEDSKKPVVAAVAGLALGGGLELAMGCHARVAAPRAQLGLPELTLGIIPGFGGTQRLPRLIGLSKAVEMMLTSKPITSEEGRKLGLIDAIVSSEELLNASRLWALEIGERCKPWVRSLHRTDKIGSLSEAREVLRTARQQVKKTVPHLPQQLACVDVIEHGIVHGGYSGVLKEAEVFKQLVVSDTAKGLINVFFSQRAISKVPGVTDIGLKPRNVKKAAVIGGGLMGSGIATALILGNIHVILKEINPEFLLKGIKTIEANVNGLVRRGKLTKQKADAALSLLRGVLDYSEFKDVDLVIEAVIENISLKQTIFSDLEKICPPHCILASNTSTIDLDVVGKTTSSQNRIAGAHFFSPAHIMPLLEIIRTDKTSAQVILDLITVGKIIKKTPVVVVNLSVTCRLQDLAGYGVAVATSKVFADAFSDRIFKSPLLDLLIKSGRNGNILCEYNQLFLTLAISALPGKNNGKGYYIYEKAGKPKPDPSILPIIEESRRLCNIMPNGKPISVTDQEIVEMILFPVVNEACRVLEDGVVIRASDLDIASVLGMSFPNYRGGIVFWADLVGANHIYTSLKKWAQLYGNFYKPSRYLEERALKGIPL

SEQ ID NO: 169587 - protein, 568 aa, Glycine max
  Coding DNA Sequence Number=SeqID_52809
  Gene Ontology: Mol. function=sugar porter activity; Cellular component=integral to membrane; Biological process=carbohydrate transport
  Homolog annotation: Hit_ID=Q1T4P5; Match level="QueryCoverage=85%, HitCoverage=100%, E-value=0.0, Identity=80%"; Hit description=Sugar transporter
  Pfam annotation: Domain name=MFS_1; Domain location=132-523; Score =81.2; E_value=3.3e-21; Accession=PF07690.6; Description=Major Facilitator Superfamily
  Pfam annotation: Domain name=Sugar_tr; Domain location=131-564; Score= 316.4; E_value=5.2e-92; Accession=PF00083.14; Description=Sugar (and other) transporter
  Pfam module annotation: Pfam domain module=MFS_1::Sugar_tr; Domain location=132-523::131-564
  Subcellular localization annotation: CTP_CleavageSite=49; ConfidenceScore=5.86e-01
MVGNDARCTRALATVSSASAVSGSRSFLPSFFFPPTNKNKATFPFLSVSFANQQQPPAHDSAIAFVTRLDKLMVLWFVKYWLMWVGHSSMYKRTPSRDNSNMEDMEENSDLLDIGLDKGTSNPSLMLSLPHVLVATISSFLFGYHLGVVNEPLESISVDLGFRGNTLAEGLVVSICLGGALIGCLLSGWIADGVGRRRAFQLCALPMIIGASMSAATNNLFGMLVGRLFVGTGLGLGPPVASLYVTEVSPAFVRGTFGAFIQIATCLGLMGALFIGIPVKEISGWWRVCFWVSTIPAAILAAAMVFCAESPHWLYKQGRTAEAEAEFERLLGVSEAKFAMSELSKVDRGDDTDTVKLSELLHGRHSKVVFIGSTLFALQQLSGINAVFYFSSTVFKSAGVPSDIANVCIGIANLAGSIVSMGLMDKLGRKVLLFWSFFGMAIAMILQATGATSLVSNVGAQYFSVGGMLLFVLTFALGAGPVPGLLLPEIFPSRIRAKAMAVCMSVHWVINFFVGLLFLRLLEKLGPQLLYSMFAIFCIMAVTFVKRNVVETKGKSLHEIEIALLPQD

SEQ ID NO: 169588 - protein, 314 aa, Glycine max
  Coding DNA Sequence Number=SeqID_52810
  Gene Ontology: Mol. function=protein-tyrosine kinase activity; Cellular component=MHC class I protein complex; Biological process =antigen processing and presentation
  Homolog annotation: Hit_ID=Q1T4P8; Match level="QueryCoverage=93%, HitCoverage=93%, E-value=2e-76, Identity=54%"; Hit description =Harpin-induced 1
  Pfam annotation: Domain name=Hin1; Domain location=144-292; Score =63.6; E_value=6.3e-16; Accession=PF07320.4; Description=Harpin -induced protein 1 (Hin1)
  Subcellular localization annotation: CTP_CleavageSite=74; ConfidenceScore=5.13e-01
MAHAKTDSDVTSMDTSSSPKRAVYYVQSPSRDSHDGDKSSTATHATPACNSPVDSPSHHSYVHHSRASSSSRVSAGSYNNIASYWGRNNKGTRKNKLGSWTHDQCKVIQEEEGYYGEREGFSRRKTQIFVGILAFAFIFTLFCFIIAGVARPHKVRISVKSFTVHNFLFGEGLDLTGVPTKMLTVNCSVRMTVHNPATFFGIHVSSKAVNLMYSEMTVATGELNKHYLPRKSTRIVSLNLQGSKVSLYGAGASLIGLVDNGKIPMTLVFDVRSRGNIVGKLVMSKHRRRVSCSVAIDSHNIKPIKLKENACTYN

SEQ ID NO: 169589 - protein, 210 aa, Glycine max
  Coding DNA Sequence Number=SeqID_52811
  Gene Ontology: Mol. function=nucleic acid binding
  Homolog annotation: Hit_ID=Q69WP6; Match level="QueryCoverage=77%, HitCoverage=15%, E-value=4e-28, Identity=44%"; Hit description =SWI/SNF-related matrix-associated actin-dependent regulator of chromatin a-like
MPLLQHLHFQIFKVCKFFRFILQHGGCVLLTDEVGLGKTLQAIHCLKLNHFHTLSVHHDAWQCFASLQANNYLCKKLNLVRISAFLSNIYCWVVNFVNYLLIIALSSLCLQWASMIQQWLNIPSSDILIVLSQNGGSNRGGFNIVSSSAKSSIHLDGVFNIISYDLVPKLQNMLMTCNFKIYTDSIEAKIPCVLDYVGTVIEVFLSSSLQ

SEQ ID NO: 169590 - protein, 363 aa, Glycine max
  Coding DNA Sequence Number=SeqID_52812
  Gene Ontology: Mol. function=zinc ion binding; Cellular component =intracellular
  Homolog annotation: Hit_ID=Q1T4P7; Match level="QueryCoverage=89%, HitCoverage=88%, E-value=2e-48, Identity=38%"; Hit description=Zinc finger, RanBP2-type
  Pfam annotation: Domain name=Extensin_2; Domain location=18-338; Score=-141.1; E_value=0.087; Accession=PF04554.4; Description =Extensin-like region
  Pfam annotation: Domain name=zf-RanBP; Domain location=148-179; Score= 24.5; E_value=0.00038; Accession=PF00641.9; Description=Zn-finger in Ran binding protein and others
  Pfam module annotation: Pfam domain module=Extensin_2::zf-RanBP; Domain location=18-338::148-179
MASSRDKEPAPPHHHPPLLSSLVVRPSHTEAVAAGGGRVADFEPGELHRDPPPPYSRSDRYPDEPGSSSPVHRRDADHRFGSDYNNMPRSRGYGGGRDPGRYRDPSPSYGRGRVGGRPMGRAFDGPGFVSGLARGEGNNRNNPNVRPREGDWICPDPLCNNLNFARRDHCNSCNRSRNAPARSPRRAYPAPPPLHAPPRRFPGPPIDRSPERTLNGYRSPPRGLARNGPREYGSAALPPLRHEGKFPDPHLRRERMDFIEDAYRGRNKFDRPPPPDWDNRDRGRDGFSDEGKGFERRPLSPPPPLLPSLPHHRGGRWARDVRQRSRSPIRGGPPPKEYRRDTFMHRATDDRRGMGRDRIGGMY

SEQ ID NO: 169591 - protein, 173 aa, Glycine max
  Coding DNA Sequence Number=SeqID_52813
  Gene Ontology: Cellular component=integral to membrane
  Homolog annotation: Hit_ID=Q8S1P4; Match level="QueryCoverage=93%, HitCoverage=62%, E-value=2e-66, Identity=72%"; Hit description =Membrane protein COV-like
  Pfam annotation: Domain name=DUF502; Domain location=6-157; Score =260.4; E_value=3.7e-75; Accession=PF04367.3; Description=Protein of unknown function (DUF502)
MLKLFANTWSGLGFITSITFIFLVGVFMSSWLGASVLGLGEWFIKRMPLVRHIYNASKQISAAISPDQNTQAFKEVAIIRHPRIGEYAFGFITSSVTLQNYSGDEELCCVYVPTNHLYIGDIFLVNTKDVIRPNLSIREGIEIVVSGGMSMPQILSTIDSRIRLGEISRINRS

SEQ ID NO: 169592 - protein, 70 aa, Glycine max
  Coding DNA Sequence Number=SeqID_52814
MDSMWKGLPRTSLSDMEELKVNTKKTKNPTPHSGRCTVNQRHLTTHEKPCSCRVSNNDGGQRTSDDEDHD

SEQ ID NO: 169593 - protein, 842 aa, Glycine max
  Coding DNA Sequence Number=SeqID_52815
  Homolog annotation: Hit_ID=Q9LJ43; Match level="QueryCoverage=63%, HitCoverage=71%, E-value=1e-30, Identity=26%"; Hit description =Arabidopsis thaliana genomic DNA, chromosome 3, P1 clone:MSD24
MYRPFMTCDDPKGVVECGAIRKYRTSSQKMKEKTKNRRPAETSLANKQDKEEKVSKGSTERSFDPSSLQLMEVSRGAQRLNNMIHSWSRGLRYDERSEDIAKDLLKGALDLQESLLMLRKVQEASQHMASLKRRQNEKSERGRFDAKVIDGTAHCDHFGEQSYPMRFQRRWPSADGSSSSCNEELKKVIKESLVRQNLFTTTEGLDSASTFRSTNSSQSSVAWNDRLSDSSFSPTTSRRERGSNLVAKLMGLEEASSRSFPAVIQKQLESPMILNQKRPVFDIDMPKVRKNVETVNLEHKMTLKEILETTHFNGVLKSPVREPKVQVHHSIDPHYKHFGDLPPIVLMKPRCTPYRECAKSYEHVVPPEELSLRNLKAKFLPSKVFQHREGSTTNMGKKMEEYVSKRLAKEERANLLREGVELKEKEIKPVENEKAPGGKLKPQSHVSQKSQVNETVDKKAKVKTITSRKLSEKEVSKPKQQQQQQSLIPLGEVPKPKVVKKSQDKGEISSTSTKLRKPQSGSRIDKNEIPSRKSTASNSNTISKPKSKKNSNTNSKEQKKNQMKKQRPAVAEPEAAKPVDEQLRAEEANSLDVSCKDDCPEIRIITTTTYDLSVEHEEVDAYANKIREICELSQSSSSDDILMLKSEHENDAIPAEEAHSITNISFSETDREPDKDSSELKYLLLTSQSFIEHAEELLNLDVDCPKILPRSETKEIANLKLYLDCANELTERKSLQGTQAVHPFLLTCAGHSRYHISLGRLVDEVYSAIEHLTSYSEKLASDNIYAMMERDIKSNNGLINGIWNWGWRHGFSADEAEQVVNEVENLVLGELIEEISASSPCI

SEQ ID NO: 169594 - protein, 101 aa, Glycine max
  Coding DNA Sequence Number=SeqID_52816
MPKLGGIGVGGDDIVGRWAFILSNYQVKKAFLQVSQTNRLQRAHVLKNKMTTKIRIVNLIWVRMSEVGSYKEGGDGGVRGGVRSSSPNEPEVAIGRWRLEA

SEQ ID NO: 169595 - protein, 405 aa, Glycine max
  Coding DNA Sequence Number=SeqID_52817
  Gene Ontology: Mol. function=DNA binding; Cellular component=beta -galactosidase complex; Biological process=DNA integration
  Homolog annotation: Hit_ID=Q1SDN3; Match level="QueryCoverage=99%, HitCoverage=31%, E-value=1e-154, Identity=65%"; Hit description =Polynucleotidyl transferase, Ribonuclease H fold
MKHQCWRDAMKCEIKALQLNQTWDIVQTPSYVRPIGCKWVYKIKRLSNDNIKRYKTRLVIKGYFQIEGIDYFETFSPVVKMATVRVVLALASINRWHLHQLDVSNAFLHRDLREDVYMEIPPGLLGYTSSQSCKLKKLLYGLKQSNRQWYGKLSNLLLTYGYSHAHADRSLFIKAHNSEFIALIVYVDDIVLTGNSLAEIERIKHILHTNFHIKDLGKLKYFLGIEVAHSDKGISLCQHKYCLDLLKDSGMLGCKPSSTPMDSSLQLHNDSSGFLDDPLSYRRLVGRLVYLTSTHPDIAFATQQLSQFMSKPTKAHHAAAVRVLRYLKGCSGKCLFFPRTCSPHILGFSDADWATCIDSRRSITGYCFFIGNSLVSWKTKKQTTVSRSSSEVEYRALASATCELQ

SEQ ID NO: 169596 - protein, 1464 aa, Glycine max
  Coding DNA Sequence Number=SeqID_52818
  Gene Ontology: Mol. function=RNA-directed DNA polymerase activity; Cellular component=chromatin; Biological process=chromatin assembly or disassembly
  Pfam annotation: Domain name=Chromo; Domain location=1363-1420; Score= 28.8; E_value=1.9e-05; Accession=PF00385.14; Description='chromo' (CHRromatin Organisation MOdifier
  Pfam annotation: Domain name=RVP_2; Domain location=332-460; Score= -38.2; E_value=0.00094; Accession=PF08284.2; Description=Retroviral aspartyl protease
  Pfam annotation: Domain name=rve; Domain location=1070-1226; Score =116.5; E_value=7.7e-32; Accession=PF00665.16; Description=Integrase core domain
  Pfam annotation: Domain name=zf-H2C2; Domain location=1011-1052; Score=19.4; E_value=0.00095; Accession=PF09337.1; Description=His(2)- Cys(2) zinc finger
  Pfam module annotation: Pfam domain module=Chromo::RVP_2::RVT _1::Retrotrans_gag::rve::zf-H2C2; Domain location=1363-1420::332 -460::585-1000::96-186::1070-1226::1011-1052
MADHNTRKTTTDRLEEAISRLSLHHSELASKVDAILDRLDRQSSASPVSSPKPPPASRTHVKIDVPRFDGSDPMGWIFKITQLFEYQGTPEEERVTLASFYLDGPALSWYQWMFRNSFITSWSSFLQALESRFAPTYYDDPKGALFKLTQTGSVNDYLTEFERLANRIFGLPPPFLLSCFVSGLAPDIRREVLALQPISLPQATALAKLQEDKLRDRPRPPCHPSTNPYTLPSHPSPFPSPSPPPRPKAPFTQRTPSEIAYRRERGLCYNCDDKWSATHRCKGRVLLLIADPDNPDNPDNPSDSPPLSPVASSFRPEPNLSPAPDFSPPTPHISLNALSGLPTPETFRLFGYINHTRVTVLIDSGSTHNFLQPRLATFLRLPTVPTDPLRVLVGNGAVLTCTHLCPDTTISLQSHLFTLTFHLLPISGADVVLGIQWLKLLGPITTDYTSLVMKFTHLGHPVELHADADTGPHPISATQIKRIIQTKATSAFFHLCVLPAIDTNHHPPMPTSIPAIDALVTKFHSLFHTPNTLPPSRSIDHHITLRPNTEPINVRPYRYPYFQKAEIEKQVAELLSAGLIQVNRSPFSSPVLLVKKKDGSWRMCVDYRALNAVTIRDRFPMPTIDELMDDLGHASWYSKLDLQQGFHQIRMAPADIPKTAFRTHQGHYEYRVMPFGLCNAPSTFQAAMNTLLQPVLRRFTAGQFYLKYTKCSFAQRRLEYLGHIISERGVEPDPSKIRAMVEWPTPKNPKDLRAFLGLTGFYRKFVRGYATLASPLTALLCKNAFDWTPESQIAFETLKTAMTQAPVLALPNFEYPFVIETDASGTAMGAVLLQQNHPLAYFSKPFGPRLLHSSTYVRELHAIVSAVRKWRQYLLGHRFTILTDHKSLKDLLSQIIQTPEQQHYLSKLLGYDYDIQYKTGASNAVADALSRVTIPPESQYLFLSIPNFTFMDQLRQSLHDNTEFQTTMTNVQAQPSDHRDFTISNGLLFFQGRIWLNHDNPFIPSLITEFHSTPLGGHLGIAKTTHRVNANFYWTTLRHDVKQFVRNCVTCQQSKNSTSRPAGLLHPIPIPSGVWEDLSLDFITHLPCSHGFTVILVVVDRFSKGVHFGALPTNFTAYKVAVLFLDMVCKHHGLPRSLISDRDPVFVSSFWRELFRLSGTRLRMSTAYHPQTDGQTEVMNRVLEQYLRSFVSAHPSDWFKFLAMAEWSYNTSVHSGTGFTPYEIIYGKAPPSIPHYITGSSNNEAVDSLLTSRQELHDTMKHQADGHRRDVHYDVGQWVYVRLRPLRQRSLSGPAHPKLSKRFFGPFQILEKIGPVAYRLQLPSTAKIHPVFHCSLLRPHHGPLPPAATDPIPLTMIDNHPVLRPLSILSSKSDDSTHPPTRLVLVQWEGQAPEDSTWESWDELKEQYHLEDKVDLEEGGVVSNIHTDTGTTHTDRGAASNTHSSTNRPIRNIQPPHYLNDYIT

SEQ ID NO: 169597 - protein, 341 aa, Glycine max
  Coding DNA Sequence Number=SeqID_52819
  Homolog annotation: Hit_ID=Q1SN43; Match level="QueryCoverage=64%, HitCoverage=50%, E-value=6e-41, Identity=36%"; Hit description =Nucleic acid-binding, OB-fold, subgroup
MNVIQIEDDGLSIECTLFGPFVDELNAFLESGEVENVVIKLHLQNCICGTRVVFNAKCEEVKELATRMSEDFLYNTPRKTISALKDCFEDTCFVVFGTMKHVVDDEEWWYTACTCNKCRIKVGVIDKTDSATFVIFDWDATILFSKSCANMFETYQKRGLVGTFPRDITNLVDRFFLFKVEVKSVCNSQFEKTFRVKKIYTNLSIIKLLKEEAIDLSKDSKELTPTKHNFCCKSAVGELTPNESEFAIRNQENDILFNNSGDLTPVGIVFGTQIHSLTKNMEGADKQLESGCLENVKTKENSRVKGKIDCVIMDVELMQSQSLEMHLPLNFLKKRIKVEKI

SEQ ID NO: 169598 - protein, 99 aa, Glycine max
  Coding DNA Sequence Number=SeqID_52820
  Subcellular localization annotation: CTP_CleavageSite=66; ConfidenceScore=5.32e-01
MCVHFFNFDHLRIKLQSSDFFKGTKFRALLFLSLHSSSSTFKLLSMPSYGVAYPFIFLLLHSSAIISQEAKESIDEEDPRPTSSNGATSERANTIDVRH

SEQ ID NO: 169599 - protein, 131 aa, Glycine max
  Coding DNA Sequence Number=SeqID_52821
MKNLHGFAHGNVSEALRKHIGMNFLHGNNFFHPKQLKFIARGVRDIWNNPFSPIYRKKGEEVATQLAQASWVAFSRSNPASKIFWKIVQQFFLSTSGMSRNFTDCLTMSVKYLEAVKQKLHATKQMIPGRN

SEQ ID NO: 169600 - protein, 221 aa, Glycine max
  Coding DNA Sequence Number=SeqID_52822
  Homolog annotation: Hit_ID=Q1SN45; Match level="QueryCoverage=30%, HitCoverage=3%, E-value=2e-13, Identity=55%"; Hit description=AAA ATPase
MVGSQRLTWMRFNQKITRYDVLNGLQEVVSIGETNPSSIVKHVILPSSFTGGMRYMFHNFQDAMEICMYTVEFTKQRTSTCTYIIMVGCSCSMKNRTSCSFYGFKGLTCPLLRGLTHAWVHKGAVVDHEHSAGDHGNTQKLVMHPLKHIDDILRWAPKATFSTIDFANEVFFLMNPYMLHHYTISNFRVHSCNASSSYFSEEGLENIVRSFRHLLFGFTIK

SEQ ID NO: 169601 - protein, 86 aa, Glycine max
  Coding DNA Sequence Number=SeqID_52823
  Homolog annotation: Hit_ID=P61430; Match level="QueryCoverage=67%, HitCoverage=6%, E-value=3e-08, Identity=50%"; Hit description =Synaptonemal complex protein 2
IKALRCELEDECQKLEEELHLQKSKEDRQRALLQLQLKVMSDKPKEDQEVNSKQTLSHSLCQGINTLNSKQIRHCIPRRLLHNNCL

SEQ ID NO: 169602 - protein, 58 aa, Glycine max
  Coding DNA Sequence Number=SeqID_52824
MENWRKALGIKVAGLQKKWRMENWRTALGTLGNEFMGLRKKGRMENWRTALGSRFAGL

SEQ ID NO: 169603 - protein, 58 aa, Glycine max
  Coding DNA Sequence Number=SeqID_52825
MALGVMAARPSELLLHPEVRWLAQASWGSKNKDTNFVRAILLLDQATGENQGSETEKA

SEQ ID NO: 169604 - protein, 126 aa, Glycine max
  Coding DNA Sequence Number=SeqID_52826
  Homolog annotation: Hit_ID=Q9ZPW2; Match level="QueryCoverage=35%, HitCoverage=23%, E-value=4e-14, Identity=84%"; Hit description =Anaphase-promoting complex subunit 10
MVTKAFYIGQLTSVIAKTDVNESAVKPLAGTHRTSYRRKVEENPALLLELCGSKKPYTALGTVVGAQSSKLSTLPVNKLIVLDKSYTPSKVSIRAGDGFHNLKIKTVELVKPTGWVYLSLSRADPR

SEQ ID NO: 169605 - protein, 446 aa, Glycine max
  Coding DNA Sequence Number=SeqID_52827
  Gene Ontology: Mol. function=RNA-directed DNA polymerase activity; Cellular component=chromatin; Biological process=chromatin assembly or disassembly
MENEIERGKWKNLVASIAGEGQEIDELAIGHSTGKEKEKEKEKEKNESRRRLVGTERESSYADHLDPLSLRTARSLGTIRFESRRRIFKRPHSEFVIDTEYLVMSFGVTNAHVIFMDYMNCIFHQYLDKFVVVSIDNILIYSRSSEKHAEHLRIFLRHVVTSKGIIVDPTKVEAVMHWMQPTMPIEKIFQELKKRLMSTPILILLDPEKKFKVCCDASRQGLNCVLMQEKKAIAYTSRQLRPHEVNYPNHDLELAAVVFAVKIWRYYLYGTRFEVFNNHKILKYLFDQKELKMRQRRWMEFLKDYDFELSYHPGKANVVANALSRKSLHVSVMMVKELQLIDKFRDLNLVVEFLQDIMRLKEEGKELEFQHNVEHKRAIGELHPLDIPEWKKDNISMDFVYGLPKTKQNCDDIWVIVDRLKKSSHFIPFNMKHMKKIMELTNQEEG

SEQ ID NO: 169606 - protein, 77 aa, Glycine max
  Coding DNA Sequence Number=SeqID_52828
CEIEQEAPYQDDELVGLQEMLELDPDVINESLADVDGGGEEIDVDLLKQLGLIEPDKDECMLSENDIESDFDDSNTS

SEQ ID NO: 169607 - protein, 290 aa, Glycine max
  Coding DNA Sequence Number=SeqID_52829
MGNIISISLLSNAWIDEDVKLGSHVSLAFSGRLQEEKGNNHVWTMSYKVGITDCEMQLWRRMENGDIKALLLLLHSESTCYKLDPNNHVSVLDFRLDVTTVDGKDDLLFVDSKATYRNNKLCFQLTKSIYGDGSVTQTSVFLYGMGHKAGLVVLQRHYNGSAQDENPCAVTLTHYHATSPGINDYSKSKADFGLSVIARIVPSKGNVVIDVEGPKQHPSSALFYLFDQVRSTGVWNPSMCPHCAAQDPRPRSRDSVVPVARPHARLFANEGRFAGTGNGGKIRCRNFNVY

SEQ ID NO: 169608 - protein, 108 aa, Glycine max
  Coding DNA Sequence Number=SeqID_52830
MWVQQSKENQTQDEWKGMDVTLRETNVDWLRRCMVGRLCKEEVMINTQEAFFVYGHSSILGWRGSIGWVAREGDKGIYDIGESFLARLSFIPGMACGEAEGLTTKNYG

SEQ ID NO: 169609 - protein, 86 aa, Glycine max
  Coding DNA Sequence Number=SeqID_52831
MAFRHWDWRNRHPSGHGSSESFAGDVNEIGMRVLCETREDGELRERGSTVKSIREAITVGYCSSSTSMMPQPRNKEEMIVQCYSND

SEQ ID NO: 169610 - protein, 1099 aa, Glycine max
  Coding DNA Sequence Number=SeqID_52832
  Gene Ontology: Mol. function=translation elongation factor activity; Cellular component=intracellular; Biological process=translational elongation
  Homolog annotation: Hit_ID=Q2QP54; Match level="QueryCoverage=96%, HitCoverage=94%, E-value=0.0, Identity=54%"; Hit description =Elongation factor TS family protein, expressed
  Pfam annotation: Domain name=EF_TS; Domain location=705-846; Score =221.1; E_value=2.4e-63; Accession=PF00889.9; Description=Elongation factor TS
  Pfam annotation: Domain name=EF_TS; Domain location=948-1089; Score =224.8; E_value=1.9e-64; Accession=PF00889.9; Description=Elongation factor TS
  Pfam annotation: Domain name=S1; Domain location=104-177; Score=95.2; E_value=1.9e-25; Accession=PF00575.13; Description=S1 RNA binding domain
  Pfam annotation: Domain name=S1; Domain location=218-291; Score=27.6; E_value=4.4e-05; Accession=PF00575.13; Description=S1 RNA binding domain
  Pfam annotation: Domain name=UBA; Domain location=652-692; Score =53.0; E_value=9.8e-13; Accession=PF00627.21; Description=UBATS-N domain
  Pfam annotation: Domain name=UBA; Domain location=895-935; Score =59.9; E_value=8.4e-15; Accession=PF00627.21; Description=UBATS-N domain
  Pfam module annotation: Pfam domain module=EF_TS::EF_TS::S1::S1::UBA:: UBA; Domain location=705-846::948-1089::104-177::218-291::652 -692::895-935
  Subcellular localization annotation: CTP_CleavageSite=54; ConfidenceScore=5.43e-01
TVKPGSSSWRFLLPSFVASGAFPQNKRILSFHKKSRTSISATETDVAVEEPGPVADEDSGELPSNEVGVSEDSFTKSDANPDPAKARRSRPARKSEMPPVKNEDLLPGATFTGKVKSVQPFGAFVDIGAFTDGLVHISMLSDSYVKDVASVVSVGQEVKVKLIEVNTETQRISLSMRENVDTGKQRKDAPTKTEKAGPGKRNNSKPSPKKDNVTKSTKFAIGQQLVGSVKNLARSGAFISLPEGEEGFLPVSEEPDDGFDNVMGNTTLEVGQEVNVRVLRITRGQVTLTMKKEEDTAGLDSTFNQGVVHVATNPFVVAFRKNKDIASFLDDREKTQTEVLKPSTASTLEEIKGTVNQGETVLDVPDVQGEPESSKLTDDVPSAEDDISENVGTSATNGSSTAIVDDESNLVSNVSSPKTGIDSAIEKEEEVAFGSLIPEEDLSTVNPIIEEATQTDVTTIDLKTDAPVEIANENVIETGVDQIVAEDEKQSQTPNAMEEFAAAVLTDSDVVEPSPDKNDAITESDITSSAPAPQESAGDDVGAITENIDSDTSLSGQSDELSPEGSLTTDATEETDQVPSPESSATEVVKTSIDDPEEEAKKQTPATENENSFTSQVEDKEVAIASDKNSSLSNSDGQTGATSGESLSKATISPALVKQLREETGAGMMDCKNALSETGGDIIKAQEYLRKKGLSSADKKASRVTAEGRIGSYIHDSRIGVLVEVNCETDFVSRGEIFKELVDDIAMQVAACPQVEFLVTEDVPEEIVNKEKEIEMQKEDLLSKPEQIRSKIVEGRIRKRLEELALLEQSYIKDDKVAVKDFVKQTIATIGENIKVKRFVRFNLGEGLEKKSQDFAAEVAAQTAAKPAPILVKEEPAVADAEAKETEPKQITVAVSASLVKQLREETGAGMMDCKKALAETGGDLEKAQEYLRKKGLSSADKKSSRLAAEGRIGSYIHDSRIGVLIEVNCETDFVGRGEKFKELVDDLAMQVVACPQVQFVSIEDIPETIVNKEKELEMQREDLLSKPENIREKIVEGRISKRLGELALLEQPFIKDDSVLVKDLVKQTVAALGENIKVRRFVRFTLGETSEKETTVPA

SEQ ID NO: 169611 - protein, 114 aa, Glycine max
  Coding DNA Sequence Number=SeqID_52833
  Gene Ontology: Mol. function=methyltransferase activity; Cellular component=cytoplasm; Biological process=metabolic process
  Homolog annotation: Hit_ID=Q7X9J8; Match level="QueryCoverage=69%, HitCoverage=51%, E-value=5e-12, Identity=42%"; Hit description=Early nodule-specific-like protein ENOD8 gene
MVILVLSLGPIVDTVIMNSPFGSRKKGAHLDFLSVALKHVKRIALRDFNASSAEVICELQFTQNTSVGYLLRFDVPKMYKFHKKEAEILDLMQKRIVCIGIDDKIASKKKIFGT

SEQ ID NO: 169612 - protein, 260 aa, Glycine max
  Coding DNA Sequence Number=SeqID_52834
MMPEPSKVRSCGWILKKSPLIAMIEVTMLSTTTLFRCYVLLGSTTLMMLASASPMTLIVIPSFNVFSNFPLFTQKKKKVGEEVVVAAKKDVVASIQAEASTEVVGDTIVHGVIIDLTNTGVMDETPEAPNATVANEVEHHVLETATKQSTTSHEVTSKDKGDHDVVIVYSTNSAPLLSTMYNPPLSPEIKLSMHNAIITQFSNLGVVLLQNIQQAQMSMLGVVTAPTPVPQPPLALASLDPLPPPLAPIPPPLPSSPPSS

SEQ ID NO: 169613 - protein, 89 aa, Glycine max
  Coding DNA Sequence Number=SeqID_52835
MAVRLEAFLAPHVTTKCVEVAVSLSLVHALSEIHPLSETSACLVSKRNLGENLPCQHTLNASPVCPARFLSLFALSAPGSLSQSLLTRA

SEQ ID NO: 169614 - protein, 57 aa, Glycine max
  Coding DNA Sequence Number=SeqID_52836
  Subcellular localization annotation: CTP_CleavageSite=28; ConfidenceScore=5.23e-01
EKGPDGLFRVQALGVNPPGLSAPLSRCRSHMVGVFSQNSVTLTSLPMILPSESDVTY

SEQ ID NO: 169615 - protein, 134 aa, Glycine max
  Coding DNA Sequence Number=SeqID_52837
MVPDRVYPRLPICNEGKKTCTCFLLKGFHSEKAEADAETTRARKMVSIPIAIIVEAPKMAESTPIIVAEKPKAKVDEAQIESISHEATSKDTMDIIVYITSFGPTPVIFAPPEVVTKAKVKKMMELAMNNFAEK

SEQ ID NO: 169616 - protein, 78 aa, Glycine max
  Coding DNA Sequence Number=SeqID_52838
MAWSLRYICSFDLPKDKLSSLERLRLTGCTSKSLGPLCVFQIDPWRCCFERFSCPLTSEDLMEACWWSFYGGWIFELQ

SEQ ID NO: 169617 - protein, 207 aa, Glycine max
  Coding DNA Sequence Number=SeqID_52839
  Pfam annotation: Domain name=zf-CCHC; Domain location=48-65; Score =6.7; E_value=0.077; Accession=PF00098.13; Description=Zinc knuckle
MICGRVLACTTTKEMWDLMQLAHEEKNFKGISFQPKKKFKNDSNYPNFTCFKCGKLGLIKSKCSFFLKKQQGGEKKEKCESKKKKAYIAWDENASSTLSDSSNEEKENLCLMADGEVDSMMHEEAKKLLLGMDDHSSHPSRILMYHNNVRQQSFQGINADPMMDPSLKSIKGHLNEEATDEKDYKKARKYLKKNSAKITRRIIHSFH

SEQ ID NO: 169618 - protein, 172 aa, Glycine max
  Coding DNA Sequence Number=SeqID_52840
MASANTPTTKTIPTMEITTIHTHNESSIHVEHFFDIQELEKVVLKLNETLPLCGERWKKNYDSHATRTLYRENADEVGNQKMNVYNLKFKPTLSDLHKFVLFHLMENLPFDHPHTIYINILRNLKGLGGIDDIYYVALINKLLWDQGVYHIFNNMDKDSKHTLIAKGPVIAK

SEQ ID NO: 169619 - protein, 70 aa, Glycine max
  Coding DNA Sequence Number=SeqID_52841
MVMEDDMILLNHQAPFPRVESSSWDVVNPSGVNWNELNHITNFVTALNLRHDANNVLRYGQVPETWPKNI

SEQ ID NO: 169620 - protein, 73 aa, Glycine max
  Coding DNA Sequence Number=SeqID_52842
MDRYFAGIIQDCAFLLRSNFLKVSSYVNRHANGGADTLAKLTFLNPDTVWFEVIPQIVNIVDDDVRPQCPPYF

SEQ ID NO: 169621 - protein, 290 aa, Glycine max
  Coding DNA Sequence Number=SeqID_52843
  Gene Ontology: Mol. function=mismatched DNA binding; Biological process=response to DNA damage stimulus
  Homolog annotation: Hit_ID=Q9PCR2; Match level="QueryCoverage=99%, HitCoverage=36%, E-value=1e-106, Identity=72%"; Hit description=DNA mismatch repair protein mutS
  Subcellular localization annotation: CTP_CleavageSite=58; ConfidenceScore=5.75e-01
MALASSCAHSSCSPSAACRACRRGESSGANTSRTAGSRPRPSRRVEKSRGRAERSATRGFHRMVALYQHLAQAQRTMQPAPQQAAAHRRHRAVEHAQQRIAGVAINTRIQFQMAAGGGVHRDRLAGSLHRDGGQVRQALLLGFLDITEQGAGGSGRARLVIDAEAAQVMQFEEVQQLAAATVGIEQPRRAATHAGALAQELRPVFFVGHQQLGRLQPCQLGFQGVVGFHFVDQEAAASQVGPRQAVALLAARQGHQQGVAAFIQQRLVGDRAGGDDAHYLALDQALGQRR

SEQ ID NO: 169622 - protein, 149 aa, Glycine max
  Coding DNA Sequence Number=SeqID_52844
  Subcellular localization annotation: CTP_CleavageSite=67; ConfidenceScore=5.63e-01
MTLNGPTVKSTKREMLGAPKALAVASFGSSGSCFLFSVSDTASQASSSSPRTSLRDAGKNGERGLTVAASGRSVKGSSGTSRRSCSGKIPKEVFFRKQPKVFRKNPSSESLPEHLFRKLSGRSSSSGRIPEEGFFRMTFEFSGRTTSSG

SEQ ID NO: 169623 - protein, 177 aa, Glycine max
  Coding DNA Sequence Number=SeqID_52845
  Gene Ontology: Mol. function=potassium ion transporter activity; Cellular component=integral to membrane; Biological process =potassium ion transport
  Homolog annotation: Hit_ID=Q11PK1; Match level="QueryCoverage=100%, HitCoverage=25%, E-value=2e-33, Identity=45%"; Hit description=Low affinity potassium transport system
MSEVTEGGHHFDLKKLSFVGVIVSLGIVFGDIGTSPLYVMKAIVNARKDGAAMPFDEYIEGALSCIIWTLTLQTTIKYVIIALRADNKGEGGILALYSLVKKLKKKWLYVVAIIGAATLVADSVITPSLTVMSAIEGLKIYNPETPVVLITLVILFVVFVVQQFGTASIGKFFGPVM

SEQ ID NO: 169624 - protein, 115 aa, Glycine max
  Coding DNA Sequence Number=SeqID_52846
  Gene Ontology: Mol. function=pyruvate dehydrogenase (acetyl -transferring) activity; Cellular component=mitochondrion; Biological process=glycolysis
  Homolog annotation: Hit_ID=UPI0000689B34; Match level="QueryCoverage =97%, HitCoverage=34%, E-value=2e-37, Identity=65%"; Hit description =dihydrolipoamide acetyltransferase
  Pfam annotation: Domain name=Transketolase_C; Domain location=1-103; Score=125.1; E_value=1.9e-34; Accession=PF02780.10; Description =Transketolase, C-terminal domain
MKVAIQAAEDLAKEGISVEVIDLRTIRPLDYDAILNSVKKTNRLVILEEAWPFASISSEIAYMVQQKAFDYLDAPIKRITTPDAPAPYSAALFAEWFPKLEKVKEEIKNALYIKS

SEQ ID NO: 169625 - protein, 157 aa, Glycine max
  Coding DNA Sequence Number=SeqID_52847
  Gene Ontology: Mol. function=transcription factor activity; Cellular component=cytoplasm; Biological process=regulation of transcription, DNA-dependent
  Homolog annotation: Hit_ID=UPI00006B0E50; Match level="QueryCoverage =94%, HitCoverage=92%, E-value=1e-39, Identity=50%"; Hit description =ferric uptake regulation protein
  Pfam annotation: Domain name=FUR; Domain location=23-152; Score=74.9; E_value=2.6e-19; Accession=PF01475.10; Description=Ferric uptake regulator family
MDTIQKEKNIALIKDVLRNYLLEKGFRNTPERYTILEEIYNMDHHFNVDDLYLLMMQKKYHVSKATIYNTIEIFLDAGLIRKHQFGEKTLTSSSYEKSYFDKQHDHLVIYKKDSDKEIEEIIEFCDPRIQGIKEAIEDAFGVKIDSHSLYFYGIKND

SEQ ID NO: 169626 - protein, 134 aa, Glycine max
  Coding DNA Sequence Number=SeqID_52848
  Pfam annotation: Domain name=zf-CCHC; Domain location=65-82; Score =22.8; E_value=0.00017; Accession=PF00098.13; Description=Zinc knuckle
MVVTNPSEFTIHRKVEIIIEKKKVPKASMQEEDNRRTPSKPKDDKRKTIKKQAPKASMQEKTSSIKCFKCLGRGHITSQCPTTKTMIMRGQEICSSQDKATTSPSSSESEKAKGAESSEEIYPQEEGQPLVVKE

SEQ ID NO: 169627 - protein, 264 aa, Glycine max
  Coding DNA Sequence Number=SeqID_52849
  Gene Ontology: Mol. function=protein binding; Cellular component =integral to membrane; Biological process=defense response to fungus
  Homolog annotation: Hit_ID=Q1SWI6; Match level="QueryCoverage=84%, HitCoverage=91%, E-value=5e-36, Identity=42%"; Hit description =Leucine-rich repeat, plant specific
  Pfam annotation: Domain name=LRRNT_2; Domain location=19-59; Score =49.3; E_value=1.3e-11; Accession=PF08263.3; Description=Leucine rich repeat N-terminal domain
  Pfam annotation: Domain name=LRR_1; Domain location=116-141; Score =9.8; E_value=4.2; Accession=PF00560.23; Description=Leucine Rich Repeat
  Pfam annotation: Domain name=LRR_1; Domain location=143-165; Score =13.4; E_value=0.82; Accession=PF00560.23; Description=Leucine Rich Repeat
  Pfam annotation: Domain name=LRR_1; Domain location=167-188; Score =2.0; E_value=1.2e+02; Accession=PF00560.23; Description=Leucine Rich Repeat
  Pfam annotation: Domain name=LRR_1; Domain location=190-215; Score =11.3; E_value=2.2; Accession=PF00560.23; Description=Leucine Rich Repeat
  Pfam annotation: Domain name=LRR_1; Domain location=217-239; Score =14.5; E_value=0.37; Accession=PF00560.23; Description=Leucine Rich Repeat
  Pfam module annotation: Pfam domain module=LRRNT_2::LRR_1::LRR_1::LRR_ 1::LRR_1::LRR_1; Domain location=19-59::116-141::143-165::167 -188::190-215::217-239
MDLVEWPAVCPGDKESVCIPSERETLLKFKNNLIDPSNRLWSWNHNHTNCCHWYGVLCHNVTSHLLQLHLHTSPSAFEYDYDYNYDYNYNNLFDEEAYRRWSFGGEISPCLADLKHLNYLDLSGNYFLGEGMSIPSFLGTMTSLTHLNLSYTGFRGKIPPQIGNLSNLVYLDLRYVANRTVPSQIGNLSKLRYLDLSRNRFLGEGMAIPSFLCAMTSLTHLDLSNTGFMRKIPSQIGNLSNLVYLDLGSYASEPLLAENVEWVS

SEQ ID NO: 169628 - protein, 135 aa, Glycine max
  Coding DNA Sequence Number=SeqID_52850
  Pfam annotation: Domain name=DUF821; Domain location=1-129; Score= -204.3; E_value=1.4e-08; Accession=PF05686.3; Description=Arabidopsis thaliana protein of unknown function (DUF821)
MVIIMPIIIVIEGAEINIKPWHILLGGLKEGTTRIPWLNREPYAYWKGNPAVAETRQDLIKCNLCLSQWFGEAEGSVKKFMMESLVKVPANTDPCTMPAPFDPPTLYATLERKESSIQQVESWEKSYWDNQTITS

SEQ ID NO: 169629 - protein, 146 aa, Glycine max
  Coding DNA Sequence Number=SeqID_52851
  Homolog annotation: Hit_ID=Q6Z387; Match level="QueryCoverage=30%, HitCoverage=21%, E-value=8e-10, Identity=55%"; Hit description=Lipid transfer protein-like
MKTNKKCVCLILKDRDDPDLGLKINMTIAVGLPSLCKTPDNLSQCSDQQGTTTDPLTSGIRFSRDSISALHFLTGNTQALNLPILVKLRTPLSGGSSLCEAEGSSQNGRNQGTDEMATAKKNSASYIGKRLLESLVAVAGLLIWLS

SEQ ID NO: 169630 - protein, 74 aa, Glycine max
  Coding DNA Sequence Number=SeqID_52852
MVQVEEVGGHCHEIGGVAYGIWIKLKKSETLVWLDFVECPKKLKKSETLIWVDFVECPKVQDEKMEELDMDLME

SEQ ID NO: 169631 - protein, 251 aa, Glycine max
  Coding DNA Sequence Number=SeqID_52853
  Gene Ontology: Mol. function=nucleoside-triphosphatase activity; Cellular component=exodeoxyribonuclease V complex; Biological process=viral genome replication
  Homolog annotation: Hit_ID=UPI00005F9276; Match level="QueryCoverage =100%, HitCoverage=40%, E-value=2e-73, Identity=60%"; Hit description= COG0507: ATP-dependent exoDNAse (exonuclease V), alpha subunit - helicase superfamily I member
MGRQATWLYRFDAAIRQREKHLEQPFLIEQRNADITIEQAERAVVTRHHHRTPLIPAAAPCRTTNQLQLHQLVLNTLIEPLHAKWPFAQGAQQLITAKRSNHLGRCGTLVNQLEKWPIAFGNLRQHRLIRFGIVERLAHDITEARLKGRLDRLRFAGVDRRSQLTDAGVRRETVAFAQQADGIAHRRGHRIIGAGNLAAGQRGELQRAHRTVARLGTAADIPEYRTGFNRGQLVAIAEKNHPRMSGQRGDQ

SEQ ID NO: 169632 - protein, 75 aa, Glycine max
  Coding DNA Sequence Number=SeqID_52854
  Gene Ontology: Mol. function=exodeoxyribonuclease V activity; Cellular component=exodeoxyribonuclease V complex
  Homolog annotation: Hit_ID=Q7N8T4; Match level="QueryCoverage=78%, HitCoverage=9%, E-value=3e-18, Identity=71%"; Hit description =Exodeoxyribonuclease V alpha chain
MTVHKSQGSEFDHTALVMPAQFLPVLTRELIYTAITRARSQLTLFSDEAVFRRAVQLRTQRRSGLLDRLGGEEGR

SEQ ID NO: 169633 - protein, 190 aa, Glycine max
  Coding DNA Sequence Number=SeqID_52855
  Gene Ontology: Mol. function=lipid binding; Cellular component =anchored to membrane; Biological process=lipid transport
  Homolog annotation: Hit_ID=Q6Z387; Match level="QueryCoverage=60%, HitCoverage=55%, E-value=1e-20, Identity=44%"; Hit description=Lipid transfer protein-like
  Pfam annotation: Domain name=Tryp_alpha_amyl; Domain location=34-112; Score=32.8; E_value=1.2e-06; Accession=PF00234.12; Description =Protease inhibitorseed storageLTP f
MDSNACLPHLLVLAITLVLVSHAMGDSAQDKQRCAEFLTGVTTCLPYLGGDTKAPTADCCSGLTQAMKTNKKCVCVILKDRDDPDLGLKINMTIAAGLPSLCKTPDNFSVFCFLTENTQTLNLPVLHFCTWILNHLKLKLLMKLIRNPMVVLSVLRPLLLLKEVPRMVESRGQMKRRQLRIVNLISGRDC

SEQ ID NO: 169634 - protein, 153 aa, Glycine max
  Coding DNA Sequence Number=SeqID_52856
MVFYNLGVCTSANCWLFQAWGSASHTIHHNVSPYAASNAVWAEWQQHVISLGDVVSSMGPWACTPDYLLWFYCISHPYAILLEEGEPPRPLVHLLPIPVQFLPEQPLIEYVPDGDYSCQFLHEGFKDGCSLERQRKRAAKDIGKGGKKRGKCG

SEQ ID NO: 169635 - protein, 139 aa, Glycine max
  Coding DNA Sequence Number=SeqID_52857
  Gene Ontology: Mol. function=protein serine/threonine kinase activity; Cellular component=cytoplasm; Biological process=protein amino acid phosphorylation
  Homolog annotation: Hit_ID=Q10SQ6; Match level="QueryCoverage=58%, HitCoverage=11%, E-value=7e-31, Identity=74%"; Hit description =Protein kinase, putative, expressed
MKGIVGTYPVVVGLKCSPGKLHALVKVDLQAYTFFMLKHVFPITISLTPYIYMRVLHEGGADDEPDRAPQRGEGLLLLHGEAEPMGGDGIHGAGLLPASHEGRLSRGIQRGLHWIYPQRDSQGVGVSPPTRPHSPRRQG

SEQ ID NO: 169636 - protein, 109 aa, Glycine max
  Coding DNA Sequence Number=SeqID_52858
  Gene Ontology: Mol. function=ATP-dependent peptidase activity; Cellular component=integral to membrane; Biological process=ATP -dependent proteolysis
  Homolog annotation: Hit_ID=Q8H0X2; Match level="QueryCoverage=80%, HitCoverage=18%, E-value=9e-17, Identity=50%"; Hit description =Expressed protein
MKLRRLYLIQQVSLAEFACEVEITECEPLPDGRFYIEIESRRRFRIIRSRDQDGYRVAEVEWIQDIMPPEGTSERETLQQQTYNAAEDARSWIARAKEAAKHVKTKIYW

SEQ ID NO: 169637 - protein, 59 aa, Glycine max
  Coding DNA Sequence Number=SeqID_52859
YRAAKVEWIQDIMPSEGTSERETLQQQTYNAAEDAHYKFTYQHRLFKKLMLIGTNNIGF

SEQ ID NO: 169638 - protein, 106 aa, Glycine max
  Coding DNA Sequence Number=SeqID_52860
  Subcellular localization annotation: CTP_CleavageSite=71; ConfidenceScore=5.10e-01
MRRYPSGYPSKTISINPDPRSQVVGGNTPSGYPYTYSSATLTCEKSVGLLKKEATGRQAPPRCWKMVFGASVNLRKPCISIFHLTLVKGKRNKDENQIRNTSVTFP

SEQ ID NO: 169639 - protein, 216 aa, Glycine max
  Coding DNA Sequence Number=SeqID_52861
  Subcellular localization annotation: CTP_CleavageSite=67; ConfidenceScore=5.37e-01
MSAAGASGSQARCPCAAVGLSRLKGGPDPTETGLGAASSPLTSGKSGSSPPARAGLTGESEGLAGTLSGHRVAACGGFSPLTVGLTVKPAGTGLCACIQCGKNMLEMDVDGLSGDVQLIEFLTDVSVAHRLARKRAGTKPGKRRRWQRPVYAALSKVHACDLHMQPRRGQAAGKHQDDKNQRKPARCHRIRGIDESPGVDRRPGIQEKGKERGSDY

SEQ ID NO: 169640 - protein, 415 aa, Glycine max
  Coding DNA Sequence Number=SeqID_52862
  Gene Ontology: Mol. function=protein binding; Cellular component =integral to membrane; Biological process=protein amino acid phosphorylation
  Homolog annotation: Hit_ID=Q949G7; Match level="QueryCoverage=97%, HitCoverage=85%, E-value=2e-65, Identity=31%"; Hit description =HcrVf3 protein
  Pfam annotation: Domain name=LRR_1; Domain location=146-167; Score =3.9; E_value=53; Accession=PF00560.23; Description=Leucine Rich Repeat
  Pfam annotation: Domain name=LRR_1; Domain location=172-194; Score =7.6; E_value=11; Accession=PF00560.23; Description=Leucine Rich Repeat
  Pfam annotation: Domain name=LRR_1; Domain location=196-221; Score =2.6; E_value=91; Accession=PF00560.23; Description=Leucine Rich Repeat
  Pfam annotation: Domain name=LRR_1; Domain location=20-42; Score =14.2; E_value=0.48; Accession=PF00560.23; Description=Leucine Rich Repeat
  Pfam annotation: Domain name=LRR_1; Domain location=223-245; Score =13.2; E_value=0.97; Accession=PF00560.23; Description=Leucine Rich Repeat
  Pfam annotation: Domain name=LRR_1; Domain location=247-269; Score =10.3; E_value=3.3; Accession=PF00560.23; Description=Leucine Rich Repeat
  Pfam annotation: Domain name=LRR_1; Domain location=271-293; Score =13.8; E_value=0.62; Accession=PF00560.23; Description=Leucine Rich Repeat
  Pfam annotation: Domain name=LRR_1; Domain location=295-317; Score =20.9; E_value=0.0047; Accession=PF00560.23; Description=Leucine Rich Repeat
  Pfam annotation: Domain name=LRR_1; Domain location=319-340; Score =4.5; E_value=41; Accession=PF00560.23; Description=Leucine Rich Repeat
  Pfam annotation: Domain name=LRR_1; Domain location=342-364; Score =0.7; E_value=2.1e+02; Accession=PF00560.23; Description=Leucine Rich Repeat
  Pfam annotation: Domain name=LRR_1; Domain location=390-413; Score =7.5; E_value=11; Accession=PF00560.23; Description=Leucine Rich Repeat
  Pfam annotation: Domain name=LRR_1; Domain location=67-92; Score =11.1; E_value=2.3; Accession=PF00560.23; Description=Leucine Rich Repeat
  Pfam annotation: Domain name=LRR_1; Domain location=94-116; Score =14.5; E_value=0.38; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=146-167::172-194::196-221::20-42::223-245::247 -269::271-293::295-317::...
  Pfam module annotation: Domain location=319-340::342-364::390-413::67- 92::94-116
GNEFLGKGMAIPSFLGTMTSLTHLNLSYTGFWGKIPPQIGNLSNLVYLALRDVDNGTVPSQIGNLSKLRYLDLSDNYFLGEGMAIPSFLCAMTSLTHLDLSYTRFMGKIPSQIGNLSNLVYLGLGGYSVVEPLLAENVEWVSSMWKLEYLHLSTVDLSKAFHWLHTLQSLPSLTHLYLSGCTLPHYNEPSLLNFSSLQTLILYNTSYSPAISFVPKWIFKLKKLVSLQLWGNEIQGPIPGGIRNLTLLQNLYLSGNSFSSSIPDCLYDLHRLKFLNLGDNHLHGTISDALGNLTSLVELDLSGNQLEGNIPTSLGNLCNLRDIDFSNLKLNQQEDDLANLTSLTEFGASGNNFTLKVGPNWRPNFRLSYLDVTSWQLSPNFPSWIQSQNKLEYVGLSNTGIFDSIPTQMWETLPQ

SEQ ID NO: 169641 - protein, 65 aa, Glycine max
  Coding DNA Sequence Number=SeqID_52863
MWWLWCRSSSLSDEGKVELGGDSGKSESSLEKGLVDRSDASDVDAKVDNMARCFRTNQRILVRKG

SEQ ID NO: 169642 - protein, 89 aa, Glycine max
  Coding DNA Sequence Number=SeqID_52864
MKKHLFEGKGEGVVEAEAKEEGSLGGEGGRRRGVTRGRRGNEGEGEEKRQIVDMRGGREKLRCGIKLGKIKSNLVFRLRYFGNNSWLIL

SEQ ID NO: 169643 - protein, 46 aa, Glycine max
  Coding DNA Sequence Number=SeqID_52865
MPSFRDLEQKWAPKVEALFEASMESEGERKATSSRFSASVWASFQK

SEQ ID NO: 169644 - protein, 68 aa, Glycine max
  Coding DNA Sequence Number=SeqID_52866
MQTPNFRVETCPLCPSLLQLLSQVELLELVAIIGLIMMGSAMMQRVGAVIWWLIFPREIVDEGNAIDY

SEQ ID NO: 169645 - protein, 57 aa, Glycine max
  Coding DNA Sequence Number=SeqID_52867
MVQPSISLSTQLALSEPGDTGAKQERSNKTKRTKREEPAKRAIQQKQHTLIEGGRIE

SEQ ID NO: 169646 - protein, 239 aa, Glycine max
  Coding DNA Sequence Number=SeqID_52868
  Gene Ontology: Cellular component=integral to membrane; Biological process=autophagy
  Homolog annotation: Hit_ID=Q1T6K6; Match level="QueryCoverage=99%, HitCoverage=100%, E-value=8e-96, Identity=65%"; Hit description =CD9/CD37/CD63 antigen
  Pfam annotation: Domain name=Tetraspannin; Domain location=3-228; Score=185.6; E_value=1.2e-52; Accession=PF00335.10; Description =Tetraspanin family
MAMSNNVIGCINFVAVILSIPIIGAGIWLLNGEADSCVQFLQWPVIILGVLILVVALAGFIGAFFRVSWLLIVYLVAMLVLVILLVSLVAFVYMVTLRGHGNIEPNRAYLEYRMDDFSGYLRRRVRSSFKWDRIRSCLSQTNMCAELNQGYRMAQDFFNARLTPMQSGCCKPPTQCAYTFVNPTYWISPINTAADMDCLQWSNDQTQLCYNCDSCKAGCCAFRNAKTEDLFRKYKQGYT

SEQ ID NO: 169647 - protein, 156 aa, Glycine max
  Coding DNA Sequence Number=SeqID_52869
  Gene Ontology: Mol. function=nucleic acid binding; Cellular component= ribonucleoprotein complex; Biological process=mRNA processing
  Homolog annotation: Hit_ID=Q1T6L0; Match level="QueryCoverage=85%, HitCoverage=48%, E-value=2e-30, Identity=55%"; Hit description=RNA -binding region RNP-1
  Pfam annotation: Domain name=RRM_1; Domain location=75-145; Score =59.4; E_value=1.2e-14; Accession=PF00076.12; Description=RNA recognition motif. (a.k.a. RRM, R
  Subcellular localization annotation: CTP_CleavageSite=49; ConfidenceScore=5.33e-01
MATLESALTLFAPQRFSAKAPISIKLHASTSHIFSSKSFFKTGRLCFQLCSTLQEVAPTEQTLEPIQPTDNVKKLYVVNLSWSLTAADITDLFAQCGTVTDVEIIKSKDGRSKGYAFVTMASGEEAQAAVDKFDSYCWSKLGVHCFHCLNFWLLLW

SEQ ID NO: 169648 - protein, 122 aa, Glycine max
  Coding DNA Sequence Number=SeqID_52870
  Subcellular localization annotation: CTP_CleavageSite=38; ConfidenceScore=5.39e-01
MHTQGFTIPQFHRIGLTHKKVPSGVANCRNVPFCGRAKARLTGALSKGGKMRGVATNVYLWETSKKLKETVDKSGALAPTYPPSKRKSDLRSSFLRVNHTISFYLKGDHLKVLDLKNDPLTW

SEQ ID NO: 169649 - protein, 46 aa, Glycine max
  Coding DNA Sequence Number=SeqID_52871
MSAFIYSCTSSTLPITLALAQVRIWGCDMNPHGTRADDLGSSRIKP

SEQ ID NO: 169650 - protein, 124 aa, Glycine max
  Coding DNA Sequence Number=SeqID_52872
MTDGIEETNHTGGIEESGDMTMDDRWGELDAGFDEQVITLQNMDTQDTLLPSISPIEPLLGRGHRIKQPFTHLQDYVTNTARRLNPSNCSPSPKADSGALYPITDYVNYNHFSLAHCAFLESIS

SEQ ID NO: 169651 - protein, 103 aa, Glycine max
  Coding DNA Sequence Number=SeqID_52873
MRTCGRSGTWRYVAGVRRPWGHQVGCYFPKPSLTNPRPNPGIEARGASGNRLPGDVIDYQASKGNWKTVEASGNRLPVYVIDYTKEWVTGNRLPDCDGGATNP

SEQ ID NO: 169652 - protein, 109 aa, Glycine max
  Coding DNA Sequence Number=SeqID_52874
  Gene Ontology: Mol. function=nucleic acid binding; Biological process= DNA integration
MDMIKSLSSKPEKFTGENFFCWQQQMKFWLTELDLYSVISKREIKTSTSSTDIVQTDATIKHDVSDKDILCHGRILSALADNIYKIFCHTKTSVELWEALELKYGSAEK

SEQ ID NO: 169653 - protein, 108 aa, Glycine max
  Coding DNA Sequence Number=SeqID_52875
  Gene Ontology: Mol. function=zinc ion binding; Cellular component =integral to membrane; Biological process=ubiquitin cycle
  Homolog annotation: Hit_ID=Q1SZZ2; Match level="QueryCoverage=49%, HitCoverage=17%, E-value=3e-23, Identity=87%"; Hit description=Zinc finger, RING-type; RINGv
  Subcellular localization annotation: CTP_CleavageSite=48; ConfidenceScore=5.03e-01
IFVFRLLLVTDQDRFDKRGKSCVNLATNRCTVGGKHGNKRLRASACCRSQTPTSKWRILMNTYSLGRSFMHGGVEERGGAYVHETAPAEEENAETHEAEHDHRHGEEY

SEQ ID NO: 169654 - protein, 184 aa, Glycine max
  Coding DNA Sequence Number=SeqID_52876
  Gene Ontology: Mol. function=catalytic activity; Biological process =cellular metabolic process
  Homolog annotation: Hit_ID=Q1T6L3; Match level="QueryCoverage=94%, HitCoverage=58%, E-value=6e-88, Identity=90%"; Hit description =Ribosome-binding factor A
MADVEVRAAHNVLEACAQTETMDKVVFTSSATAVVWREDRKTMELDLDERHWSDVNFCRKFKLWHGVSKTMAEKSAWALAMDRGVNMVSINAGLMMAHDLSIKHPYLRGAAEMYEDGVFVTVDLAFLVDAHICVYEDVSSYGRYLCFNHIINTHEDAVQLARKLTPGASSSLPQRLVRGRFWSF

SEQ ID NO: 169655 - protein, 103 aa, Glycine max
  Coding DNA Sequence Number=SeqID_52877
MAAEEPLDASPSPNLFSETLSAAELVADLAGYYAQSPTGGGSTLPEDSDEDTAADDTGVPSSFRQLNHDDSSSLWSSALGSNSRVSSVAPESWIAAQGKLALT

SEQ ID NO: 169656 - protein, 475 aa, Glycine max
  Coding DNA Sequence Number=SeqID_52878
  Gene Ontology: Mol. function=nucleic acid binding; Cellular component= nucleus; Biological process=rRNA processing
  Homolog annotation: Hit_ID=Q9LUK6; Match level="QueryCoverage=78%, HitCoverage=74%, E-value=1e-103, Identity=54%"; Hit description =Similarity to RNA-binding protein
  Pfam annotation: Domain name=RRM_1; Domain location=133-220; Score =24.9; E_value=0.00029; Accession=PF00076.12; Description=RNA recognition motif. (a.k.a. RRM, R
  Pfam annotation: Domain name=RRM_1; Domain location=244-318; Score =49.7; E_value=9.8e-12; Accession=PF00076.12; Description=RNA recognition motif. (a.k.a. RRM, R
  Pfam module annotation: Pfam domain module=RRM_1::RRM_1; Domain location=133-220::244-318
NRTQNPNDGDHPVNTDSGEEKKRKRNKEKTDKTPAPAIDTVVSVIEASDKSEKKRKRDSDEGKDLIVGAEASGKRKRKRGEVEKDWEEKKYGIVEEGLENKTVGIKRKTLDDPADMMVSKEGFDDEDKLLRTVFVGNLPLKVKKKTLLKEFKKFGEVESVRIRSVPIQDTKKPRKGAILAKKINDAADSVHAYIVFKTEQSAQASLSHNMSLVEGNHIRVDRACPPRKKHKGESTPLYDDKRTVFVGNLPFDVKDEELYQLFCGISNLESSIEAVRVVRDPHLNVGKGIAYVLFKTKEAAKFVVKKRNLKLRDRELRLSHAKVDATPSKRPNPSSAHAPSTPAKRPYPLAHAPSTPAKEFSVASRSPSSSNNMSKSNRKTNASYQGLRATKSDVHKKIQGGEKPKERMTKRPSVAARKAKAKLGKESDLPKQAGMKRKLDSRTPDSTLRNRKAMFSADLKAHLTANGEELRKISG

SEQ ID NO: 169657 - protein, 186 aa, Glycine max
  Coding DNA Sequence Number=SeqID_52879
  Gene Ontology: Mol. function=hydrolase activity; Cellular component =integral to membrane; Biological process=cell redox homeostasis
  Homolog annotation: Hit_ID=Q75IA4; Match level="QueryCoverage=86%, HitCoverage=58%, E-value=2e-64, Identity=72%"; Hit description =Expressed protein
  Pfam annotation: Domain name=SNARE_assoc; Domain location=28-149; Score=107.9; E_value=2.9e-29; Accession=PF09335.1; Description=SNARE associated Golgi protein
MSKRLQEDWARAAEEGPRVLMNLRTFMIPGTVFMSLLAGALFGVFKGVALVVFTATAGASSCYFLSKLIGRPILSSLWPEKLKFFQTQVAKRRKGLLNYMLFLRLTPTLPNTFINFASPIVDVPYHIFFLATVIGLIPAAYVTVKAGLALGELQSVGDLYDFNSIATLFLIGVVSVTPTLISKNES

SEQ ID NO: 169658 - protein, 47 aa, Glycine max
  Coding DNA Sequence Number=SeqID_52880
DGHVAIANKWERQLNLRIMTEGTEAYTIVEECLSIARSYISQSIVGH

SEQ ID NO: 169659 - protein, 192 aa, Glycine max
  Coding DNA Sequence Number=SeqID_52881
SAISTAWGNKPLGLQPDITQLAKIQLVQNLLQLINNNSFVNIGNNNPYLLSNPNLNPLFLNGINPLQTNKEPHVVLSGSEEYANPGLYSQAQSQCSQHDVSKSLADLDGGSIPQDYNKINSTTTSRENLAENPPLPALVAFPPKMGTFNQMDSGCNIAAQTSTESPSNTIFDDWEKLLDDETSGSYWKEILE

SEQ ID NO: 169660 - protein, 222 aa, Glycine max
  Coding DNA Sequence Number=SeqID_52882
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MGGPLGTSTHTFRGLHVLTIRGLHTLTFRGLHVLAFRGLHVLAFRGLHVLAIRGLHVPTFKGLHVLTIRGLHVLTFRGLHDLTFRGLHAFTFRGLHVLTIRGLHALTFRGLHVLATRGLHVLAFRGLRVLTFRGLHALAFRGLHALTFRALHVLTFRGLHVLVIRGLHVLTFRGLHAITFRGLHIFTFRGLHVLAFRGLHTLSFSGLHALAFRGLDALVFKG

SEQ ID NO: 169661 - protein, 78 aa, Glycine max
  Coding DNA Sequence Number=SeqID_52883
MVAKKLGNNTGHNELKGNPLAMETLGVPNDNGACGTLSTSRWREQGDNGGYDTAEGTRGENATEVQQQALLMHDEQAS

SEQ ID NO: 169662 - protein, 1365 aa, Glycine max
  Coding DNA Sequence Number=SeqID_52884
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=94%, E-value=0.0, Identity=48%"; Hit description =Integrase, catalytic region
  Pfam annotation: Domain name=RVP; Domain location=300-394; Score= -12.2; E_value=0.062; Accession=PF00077.10; Description=Retroviral aspartyl protease
  Pfam annotation: Domain name=rve; Domain location=503-663; Score =146.8; E_value=5.6e-41; Accession=PF00665.16; Description=Integrase core domain
  Pfam annotation: Domain name=zf-CCHC; Domain location=169-186; Score =4.1; E_value=0.21; Accession=PF00098.13; Description=Zinc knuckle
  Pfam annotation: Domain name=zf-CCHC; Domain location=204-221; Score =12.0; E_value=0.01; Accession=PF00098.13; Description=Zinc knuckle
  Pfam module annotation: Pfam domain module=RVP::RVT_2::Retrotrans _gag::rve::zf-CCHC::zf-CCHC; Domain location=300-394::865-1120::1 -115::503-663::169-186::204-221
MVVSWIVHSVANSIRQSILWMDKAEEIWRDLKSRYSQGDLLRISDLQQEASTMKQGLLTVTEYFTRLRVIWDEIENFRPDPICSCNIRCSCNAFTIIAQRKLEDRAMQFLRGLNEQYANIRSHVLLMDPIPAISKIFSYVAQQERQLLGNAGPGIHFEPKDISINAAKTICDFCGCIGHLESTCYKKHGMPSNHDTRNKNNGRKACTHCGKMGHTVDVCYRKHGYPPGYKPYGGRTTVNNVVAVESKANEDQAQHHEAHDFVRFSPEQYKALLALIQEPSARNTTISQPKQVASISSCINTPTNPGMSLSFRTPPISWILDSGATDHVTYSLHNLHSHKRINPITVKLPNGQCVHATHSGTVQLSSNIILQDVLYIPSFTFNIISISKLVSSVDCELIFSSTSCVLQEMNNHMRIGIVEAKHGLYHLIPAQLTTKTVNSTITHPRCNVIPIDLWHFRLGHPSAERIQCMKAYYPLLRNNKNFVCNTCHHAKQKKLPFSLSNSHASHIFYLLHMDIWGPCSKPSMHGHKYFLTIVDDCSRFTWVHLMKSKAETRQIIMNFITFIETQYDCKVKIIRSDNDIEFSMHHYYASKGIIHQTTCVETPEQNGIVERKHQHLLNVTRALLFQASLPPSFWCYALPHATHLINCIPTPYLHNISPYEKLHKHPCDISNLRVFGCLCYINTLKANRQKLDARAHPCIFIGFKMHTKGYLVYDLHSNDVSVSRNITFYEDHFPYYSETQHIHSEYSAPSPEPFSDKISDPQTESHPSQPVISVPPSNEPANDHPPSNLRRSTRTKNAPTYLQDYHRELASSTPNTSMVVRYPLSSVLSYSRLSPAHRNFVMNISSIAEPTSYAEASRHDCWIKAMEAELRAPQSNKTWRLTPLPSHKTAIGCRWVYKIKYRADGSIERYKARLVAKGYTQMEGLDYLDTFSPVAKLTTVRLLLAIAALNQWCLRQLDVNNAFLHGELDEEVYMQIPPGLSVDNPKLVCRLQKSLYGLKQASRQWFMKLSSFLTSHGFHQSNADHSLFLRFTGDITTILLVYVDDIILTGNSMAEIQTMITLLDSEFKIKDLGDLKFFLGLEIARSLQGIHLCQRKYTLDILSVSGMLGCKPNSTPIDYSTKLQADSGSPLSAESSSFYRRLIGKLIYLTNTRPDITYAVQQLSQYMAAPTNAHLQAAFRILRYLKSSPGSGIFFAATSTAQLRAFSDSDWAGCKDSRKSTTGYLVYFGSSLVSWQSKKQPTVSRSSSEAEYRALASTTCELQWLTFLLQDFHVPFVQPATLYCDNQSAIQIATNPVFHERTKHIEIDCHIVRQKLNSGLIKLLPVSSSLQLADIFTKALSPAVFRHLCNKLGMMNIHSQLEGGS

SEQ ID NO: 169663 - protein, 172 aa, Glycine max
  Coding DNA Sequence Number=SeqID_52885
  Gene Ontology: Mol. function=transferase activity; Cellular component= integral to membrane; Biological process=transport
  Homolog annotation: Hit_ID=Q6AY85; Match level="QueryCoverage=92%, HitCoverage=79%, E-value=6e-25, Identity=37%"; Hit description =Similar to RIKEN cDNA 5430428G01
  Pfam annotation: Domain name=Alg14; Domain location=13-171; Score =236.8; E_value=4.6e-68; Accession=PF08660.1; Description =Oligosaccharide biosynthesis protein
MRIPQIYSLSAVGGHTAEMLNLLVVLQKDRFNPRFYIAAATDNMSLQKAQLLENSLAAENATRVTDTAQFMKIYRSREVGQSYITSVWTTLVAMILCNGPGTCIPLCAIAFIFKVLGIRWSLIFYVESIARVRRLSLSGLLLYKLRMADQLFVQWPQLQRQYPRATYVGRLM

SEQ ID NO: 169664 - protein, 1084 aa, Glycine max
  Coding DNA Sequence Number=SeqID_52886
  Gene Ontology: Mol. function=ATPase activity, coupled to transmembrane movement of substances; Cellular component=integral to membrane; Biological process=transport
  Homolog annotation: Hit_ID=Q8LPK2; Match level="QueryCoverage=99%, HitCoverage=99%, E-value=0.0, Identity=63%"; Hit description =Multidrug resistance protein 2
  Pfam annotation: Domain name=ABC_membrane; Domain location=521-799; Score=142.5; E_value=1.1e-39; Accession=PF00664.13; Description=ABC transporter transmembrane region
  Pfam annotation: Domain name=ABC_tran; Domain location=233-417; Score= 214.0; E_value=3.3e-61; Accession=PF00005.17; Description=ABC transporter
  Pfam annotation: Domain name=ABC_tran; Domain location=869-1053; Score=237.6; E_value=2.6e-68; Accession=PF00005.17; Description=ABC transporter
  Pfam annotation: Domain name=SMC_N; Domain location=850-1057; Score= -128.9; E_value=0.036; Accession=PF02463.9; Description=RecFRecNSMC N terminal domain
  Pfam module annotation: Pfam domain module=ABC_membrane::ABC _tran::ABC_tran::SMC_N; Domain location=521-799::233-417::869 -1053::850-1057
MAVGNFMHYISRFVAGFVIGFVRVWQISLVTLSIVPLIALAGGLYAYVTIGLIAKVRKAYVRAGEIAEEVIGNVRTVQAFAGEERAVRSYKAALMKTYVNGRKAGLAKGLGLGSMHCVLFLSWSLLVWFTSIVVHKNIANGGESFTTMLNVVIAGLSLGQAAPDISAFIRAKAAAYPIFEMIERETVSKSSSKTGRKLGKLEGHIQFKNVCFSYPSRPDVAIFNNLCLDIPSGKIIALVGGSGSGKSTVISLIERFYEPISGQILLDRNDIRELDLKWLRQQIGLVNQEPALFATSIKENILYGKDDATLEELKRAVKLSDAQPFINNLPDRLETQVGERGIQLSGGQKQRIAISRAIVKNPSILLLDEATSALDAESEKSVQEALDRVMVGRTTVVVAHRLSTIRNADMIAVVQGGKIVETGNHEELMANPTSVYASLVQLQEAASLHRLPSIGPSMGCQPSITYSRELSRTTTSLGGSFRSDKESIGRVCAEETENAGKKRHVSAARLYSMVGPDWFYGVAGTLCAFIAGAQMPLFALGISHALVSYYMDWETTCHEVKKIAFLFCGAAVITVTVHAIEHLSFGIMGERLTLRVREMMFSAILKNEIGWFDDTNNTSSMLSSQLETDATLLRTIVVDRSTILLQNIGLVIASFIIAFILNWRITLVVIATYPLVISGHISEKLFMKGYGGNLSKAYLKANMLAGEAVSNIRTVAAFCSEEKVLDLYANELVDPSKRSLQRGQIAGIFYGISQFFIFSSYGLALWYGSVLMEKELASFKSIMKAFFVLIVTALAMGETLALAPDLLKGNQMVASVFEVMDRKSGISCDVGEELKTVDGTIELKRINFSYPSRPDVIIFKDFNLRVPAGKSVALVGQSGSGKSSVISLILRFYDPTSGRVLIDGKDITRLNLKSLRRHIGLVQQEPALFATSIYENILYGKEGASDSEVIEAAKLANAHNFISGLPEGYSTKVGERGVQLSGGQRQRVAIARAVLKNPEILLLDEATSALDVESERIVQQALDRLMQNRTTIMVAHRLSTIRNADQISVLQDGKIIDQGTHSSLIENKNGAYYKLVNLQQQHQL

SEQ ID NO: 169665 - protein, 140 aa, Glycine max
  Coding DNA Sequence Number=SeqID_52887
  Pfam annotation: Domain name=PPR; Domain location=100-134; Score =18.8; E_value=0.02; Accession=PF01535.11; Description=PPR repeat
MSLICFLGCVLLRHQVHFQRQCLFRFYSSTSSALMLEDNVFDESSKSHYTNFVINRPAPHVPATRRELFPLVSRVFKSLSWSVAREALLDSPQHVERSDVVFDVLIRVFASNSMLENALDAFVNAKHVGLEPDNRTCNSC

SEQ ID NO: 169666 - protein, 156 aa, Glycine max
  Coding DNA Sequence Number=SeqID_52888
  Gene Ontology: Mol. function=small conjugating protein ligase activity; Cellular component=integral to membrane; Biological process=protein modification process
  Homolog annotation: Hit_ID=Q01EG5; Match level="QueryCoverage=92%, HitCoverage=22%, E-value=2e-14, Identity=39%"; Hit description=[O] KOG1815 Predicted E3 ubiquitin ligase
MAISRTEGCNKMKCGNCEQYFCYRCNKAIDASDPYGHFRDGSCELFPREMVDSWEERINHRQAVGQLQAELFPQHGLACPSCRQYNPKDSFSVITNNFLYCHFEFFNRLEIIITCFAGHANAITATYAKRLSGVALSIMDQRAANSTLRDSISTIP

SEQ ID NO: 169667 - protein, 441 aa, Glycine max
  Coding DNA Sequence Number=SeqID_52889
  Gene Ontology: Mol. function=small conjugating protein ligase activity; Cellular component=integral to membrane; Biological process=protein modification process
  Homolog annotation: Hit_ID=Q1RL49; Match level="QueryCoverage=64%, HitCoverage=64%, E-value=8e-41, Identity=29%"; Hit description=Zinc finger protein
  Pfam annotation: Domain name=RWD; Domain location=109-248; Score =92.4; E_value=1.4e-24; Accession=PF05773.12; Description=RWD domain
  Pfam annotation: Domain name=zf-C3HC4; Domain location=306-355; Score= 13.5; E_value=0.0063; Accession=PF00097.15; Description=Zinc finger, C3HC4 type (RING finger)
  Pfam module annotation: Pfam domain module=RWD::zf-C3HC4; Domain location=109-248::306-355
EPRSTTAPPPPDLQYRVVSMPEPAPSSSNSHSVEDNVNVEATGTPQNRHNKDGAGASEINTVDGSDRVASSSKAEEGDGDDNDDYIQARVDKLLCKIEEPELSEEQIRINDQSQQDEILVVESIYGENVFSLERWKGLRCFQIHINVDVLGEIAITANLNSINQLETLSSNSDEFLYTFKVQYLPPIVLTCLLPKSYPSDQPPIFTLSVKWLEPVKILNLCYKLDSIWEEQQGQEVIYPWVEWLHSSSLSHLGFDEEIILGPYGMNYVQDERVISGAECIDVDIPFLRSYNDERHNENFLKELHDCNICFSEYAGSQFIRLPCEHFFCLKCLQTFAQIHVKEGTVSNLKCPEAKCAIMIPPGLLKQLLDDTDYERWESMMLEKTLASMSDVVYCPRERRHVGIACMSLDMKLQILQPKRSKRIEKTNRVRLIENEDDAKNV

SEQ ID NO: 169668 - protein, 61 aa, Glycine max
  Coding DNA Sequence Number=SeqID_52890
MTASRRSTQAMESSVSAIEEWQLISIFRYVKSQISWLSLNMLIYNPAVFVIVRMNLVIIYT

SEQ ID NO: 169669 - protein, 532 aa, Glycine max
  Coding DNA Sequence Number=SeqID_52891
  Gene Ontology: Mol. function=sequence-specific DNA binding; Cellular component=nucleus; Biological process=regulation of transcription, DNA-dependent
  Homolog annotation: Hit_ID=Q4L0F7; Match level="QueryCoverage=95%, HitCoverage=93%, E-value=1e-170, Identity=61%"; Hit description=Heat shock factor 1b
  Pfam annotation: Domain name=HSF_DNA-bind; Domain location=19-237; Score=292.8; E_value=6.6e-85; Accession=PF00447.8; Description=HSF -type DNA-binding
MEGGGSTPAAPIPNANAPPPFLSKTYDMVEDPSTDAIVSWSATNNSFIVWDPPEFARDLLPKYFKHNNFSSFVRQLNTYVFDFDDVVMCWQLVNFEFRYIVIILRCVSVTRKTDKDEIRIRGFRKVDPDRWEFANEGFLRGQKHLLRSITRRKPAHGQNHQQPQQPHGQSSSVGACVEVGKFGLEEEVERLKRDKNVLMQELVRLRQQQQTTDNQMQTMVQRLQGMEQRQQQMMSFLAKAVQSPGFFAQFVQQQNDSNRRITEVNKKRRLKQEGMAETEHAAAPDGQIIKYQPMMNEAAKEMLRQVMKWDTSRVESLNKNSDNYMIGDASSSSSGMDSSSSSGWTSGVTLKEVSPASVQSSHIQAATGTQGHVPSIVKPEILSVSQAVASEKVMNDGAHDPPSIPVSRADVMIPDLPSITEMVAGNILDIPEENYMATETDEGYMDPSLGAGGSFPIDFEGISPDADIDDLLANPIWDEILQTSVPEDIDTNVAEVSKGNEVQPTENGWNNTRHMDHLTEQMGLLSSNAKRP

SEQ ID NO: 169670 - protein, 111 aa, Glycine max
  Coding DNA Sequence Number=SeqID_52892
MQQQSVILTELSKQISQKGVSPEGETSVGDSTQNESRLAGKKVKLPVFEGEDPVAWITRAEIYFDVQNTPDEMRVKLSRLSMEGSTIHWFNLLRETEDDLSWEILKRALIA

SEQ ID NO: 169671 - protein, 97 aa, Glycine max
  Coding DNA Sequence Number=SeqID_52893
  Gene Ontology: Biological process=electron transport
MNSSSPAHSSLSTTAVVGGGGGGGGSSNATVSIDDFHLPCDPISSQERKDEAMIVLKSDLMAALDKEVKSLVEDNWKFEGPRSRIHLVSHRGVDPCI

SEQ ID NO: 169672 - protein, 192 aa, Glycine max
  Coding DNA Sequence Number=SeqID_52894
MVLWEITLGTAYFLGLKRTYRLALRIQHRTVSPKYPKLRQFLHRRTRAVFDVAIKVHRNIQDRDIEVGRNFGNFILRWLDRMKPSAQIRGPPPSNGVTSRESVGKRLSAGSSSNQKPSGTLRRDSDRHLSTSSRTMPFPTVARMMRSPYPAGTTVHGRHFRASTPQIVGSNCRVNWSEGVIRKDIMQWMMHN

SEQ ID NO: 169673 - protein, 170 aa, Glycine max
  Coding DNA Sequence Number=SeqID_52895
  Homolog annotation: Hit_ID=O82293; Match level="QueryCoverage=39%, HitCoverage=37%, E-value=6e-09, Identity=47%"; Hit description =Expressed protein
MHRQSLGSPSPKLPMLETLVTDEDDAPKPHRLSLSPPPPPPHKFVHLIPVLTLLCFFVLYLFSHTPSPSDLNHFTGFNRSPSHRLDLAEKIGGDIGQYMDVKRSDVLAIRNGAPGGCCNVGYSWSWGPLLHPRVAIKCQLEIAVFFMSGFLAAFGVGRLMKRRRGRNNGE

SEQ ID NO: 169674 - protein, 46 aa, Glycine max
  Coding DNA Sequence Number=SeqID_52896
  Homolog annotation: Hit_ID=O82290; Match level="QueryCoverage=59%, HitCoverage=7%, E-value=1e-10, Identity=96%"; Hit description =Expressed protein
MGRFKMRSASGKKSLYIRLGCRGDWPNIKPPGWDPSSEDNTTLGTQ

SEQ ID NO: 169675 - protein, 183 aa, Glycine max
  Coding DNA Sequence Number=SeqID_52897
  Gene Ontology: Mol. function=structural molecule activity; Cellular component=chloroplast; Biological process=response to abscisic acid stimulus
  Homolog annotation: Hit_ID=Q9ZP40; Match level="QueryCoverage=88%, HitCoverage=45%, E-value=1e-36, Identity=52%"; Hit description =Plastoglobulin-1, chloroplast precursor
  Pfam annotation: Domain name=PAP_fibrillin; Domain location=3-179; Score=191.8; E_value=1.6e-54; Accession=PF04755.3; Description=PAP _fibrillin
MTRQQLSLKMGRALGQCREGYTASSELLPLLAAGRLPLLKVDKITQTIDTSSSTIINSTTLSSPFASLSFSASSSFEVQSPTRIQVAFKEGSIQAPDIKSNVELPENVDIFGQKLNLQPLQQSLGPLQGLVENISRVISGQPPLKIPIPGEKTSSWLLTTYLDKDLRISRGDGGLFVLAREGK

SEQ ID NO: 169676 - protein, 69 aa, Glycine max
  Coding DNA Sequence Number=SeqID_52898
MDVVDRPANQKTPGMSHVPDTHHHRLHPIMPPSYSFTIIPATTPFHQSSHTKRSKKASTATHTHAFISN

SEQ ID NO: 169677 - protein, 167 aa, Glycine max
  Coding DNA Sequence Number=SeqID_52899
MRGAWACVNRNEVQMETSLKPRNYHWKQSVKEMAMPRQSSKCVACTFVITRQFGSLGSEKLQHLRVTPPLSVLFQAWFLPNPTIRRSFQLGFFALSENGVYRNPIYSSDAPGELNIYNKKKAKKRGEKNLSGKLLILLFCVFLDSGAALFPGKSMYSMNTKCSAGYA

SEQ ID NO: 169678 - protein, 226 aa, Glycine max
  Coding DNA Sequence Number=SeqID_52900
  Gene Ontology: Mol. function=ubiquitin thiolesterase activity; Cellular component=nucleolus; Biological process=ubiquitin-dependent protein catabolic process
  Homolog annotation: Hit_ID=Q9FPS7; Match level="QueryCoverage=92%, HitCoverage=28%, E-value=2e-57, Identity=53%"; Hit description =Ubiquitin-specific protease 20
  Pfam annotation: Domain name=UCH; Domain location=3-224; Score=66.4; E_value=9e-17; Accession=PF00443.19; Description=Ubiquitin carboxyl -terminal hydrolase
MKILIFGIGNFRRYQQEDAHEFMQCALDKLERCFLDLKKSNLNFEDDNLVEKVFGGRFISKLQCSTCGHTSNTFEPLIDMSLEIDNVDSLPSALESFTKVENIDENFRCDNCKEEVSMEKQLMLDQTPSVAALHLKRFKTNGILVEKIDKHIDFPLELDLQPYTIKVMEDLVAENDVPLKYDLYAIVVHTGLSSTSGHYFCFVRSAPDTWHKLDDSMVSLFPPGCA

SEQ ID NO: 169679 - protein, 102 aa, Glycine max
  Coding DNA Sequence Number=SeqID_52901
  Homolog annotation: Hit_ID=Q5W7C9; Match level="QueryCoverage=53%, HitCoverage=20%, E-value=3e-20, Identity=83%"; Hit description =Unknow protein
LFLDGGKGYNSAVECHLDVVEVISSSLIIPKPNRTPVEYEAPGYKLCLGMEENSESALSTNKEAISNATRNLMESSILAQDERWRHALHMQVGREVVFPVAD

SEQ ID NO: 169680 - protein, 151 aa, Glycine max
  Coding DNA Sequence Number=SeqID_52902
MEFFSNENFECFQAFENSNLIPFMSLKLPVYSELVKAFYSNLEIHEGTLMSEVYGIKMVIDQSLFYDLTKLPSEGVPFALIDDWKFDFSVHDAHRLVCTNQEDMTERLLAGSLAFESRILHYLIVRILLPRSSNLAQVFEEDLIVMWAFHK

SEQ ID NO: 169681 - protein, 227 aa, Glycine max
  Coding DNA Sequence Number=SeqID_52903
  Gene Ontology: Mol. function=protein binding; Cellular component =integral to membrane; Biological process=defense response to fungus
  Homolog annotation: Hit_ID=Q1T2W5; Match level="QueryCoverage=98%, HitCoverage=76%, E-value=6e-40, Identity=33%"; Hit description =Leucine-rich repeat
  Pfam annotation: Domain name=LRR_1; Domain location=118-146; Score =10.1; E_value=3.7; Accession=PF00560.23; Description=Leucine Rich Repeat
  Pfam annotation: Domain name=LRR_1; Domain location=16-38; Score =20.1; E_value=0.0081; Accession=PF00560.23; Description=Leucine Rich Repeat
  Pfam annotation: Domain name=LRR_1; Domain location=166-189; Score =15.4; E_value=0.2; Accession=PF00560.23; Description=Leucine Rich Repeat
  Pfam annotation: Domain name=LRR_1; Domain location=191-214; Score =6.3; E_value=19; Accession=PF00560.23; Description=Leucine Rich Repeat
  Pfam annotation: Domain name=LRR_1; Domain location=40-62; Score =12.6; E_value=1.2; Accession=PF00560.23; Description=Leucine Rich Repeat
  Pfam annotation: Domain name=LRR_1; Domain location=69-91; Score=7.9; E_value=9.4; Accession=PF00560.23; Description=Leucine Rich Repeat
  Pfam annotation: Domain name=LRR_1; Domain location=93-116; Score =13.4; E_value=0.81; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=118-146::16-38::166-189::191- 214::40-62::69-91::93-116
MLEGPIPDGFGKVMNSLEVLYLSGNKLQGEIPSFFGNMYALQSLDLSKNKLNGEISSLFQNSSWCNRDIFKRLDLSYNRLTGMLPKSIGLLSELEDLNLAGNSLEGDVTESHLSNFSKLQSLYLSENSLSLKLVPSWVPPFQLSSLGLRSCKSGPTFPSWLKTQSSLYELDISDNGINDSVPDWFWNNLQYMRYLNMSFNYLIGAIPDISLKLPMRPSIILNSNQFE

SEQ ID NO: 169682 - protein, 80 aa, Glycine max
  Coding DNA Sequence Number=SeqID_52904
MAFGNGKYSFHVFGCNREAWLHGKTKTDSVGNVPFSLEKEMDPKCLSYERISDGSSSSNLSGSSPKKPNLDLEFSLGQPL

SEQ ID NO: 169683 - protein, 107 aa, Glycine max
  Coding DNA Sequence Number=SeqID_52905
MTEHWEMNFSIGKCTVSLELDRAGLDNCIARDRVQGRSSVGVLIPIDLEINATSRKRNAERNRNFLQDIEAAGTQEEPLSSEASSSFPTQGQSRTVLAEANIMAEEP

SEQ ID NO: 169684 - protein, 241 aa, Glycine max
  Coding DNA Sequence Number=SeqID_52906
YSEPRFDYYCQEDHNFLEINDTEDATHGFGQLLSGSNQVIFDSNGSKDVDVQKLFSNRGHNDNTLGCGQFPSGSNQESVDLNSSKDVDAQKLFRNRTTLDDSAMLDMGNSYIENSSLDNNNRQEGGDFRENAGFHSLTPPNSPPDDASDKFHNSRGNLKRENLRSCKRSSNKLTGVSEERREAVKYLCKNRSRRGLLLKFVTSNKVLDKKRKKMDSSQCKKSTKKSNHTSVSPPVAAGSSQ

SEQ ID NO: 169685 - protein, 143 aa, Glycine max
  Coding DNA Sequence Number=SeqID_52907
MDRSPANDLPDLDFSSPGNTNKHVVVVMDGMTEFTTDTLQWALDNVVTAGCILTLLGVMPWLNIPLFLKTRNDFWTEELEDAPPVKEKNGCGNDAKYLKRQAVIDLCRKYGVVPQKKIVMGYPQRLLVVEQVATLCPTWVVFD

SEQ ID NO: 169686 - protein, 212 aa, Glycine max
  Coding DNA Sequence Number=SeqID_52908
  Pfam annotation: Domain name=GRP; Domain location=1-112; Score=-16.9; E_value=0.0039; Accession=PF07172.2; Description=Glycine rich protein family
MATNSKVILSNVLFVLLCLGICSAARTLFTLEDHVSGGYGGGGVEHGGAGYGEGAGGGEGAGAGYGAAGGGSGGAGAEGGGYGGGACKGGGEGYGGGGAKGGGYGGGRGSGGGGGGGAGGAGAGYGGGEGSGAGGGYGGGNGGGGGGGSGGGSHGGGYGGGEGAGQGAGGGYGGGGSGGGGGGGSGGGARGGGYGAGGLSGEGGGHGGGYYP

SEQ ID NO: 169687 - protein, 138 aa, Glycine max
  Coding DNA Sequence Number=SeqID_52909
  Pfam annotation: Domain name=Metallothio_PEC; Domain location=27-108; Score=-22.7; E_value=0.028; Accession=PF02068.6; Description=Plant PEC family metallothionein
MESQTSTQEQEFLNLREVPSAADITLGLDMAKGSAFCKMGEGWTCIITKTEGPDAGKVFVKCGENCTCTIEGEAVSPELNLSPDVVSSSGSGALCKCGEGWTCVIFRTEGPDAGSGKGFAECSGQCSCTIDDKSTKDI

SEQ ID NO: 169688 - protein, 174 aa, Glycine max
  Coding DNA Sequence Number=SeqID_52910
MEDWGIFSTESLRRILRILLRLKCSSWCGSSMASNGGSWRPLVVVGDVATQKRQDFQPVIVKKPTPFPYKSDKTVPWKYAAQGLDGKKDAFIVHVKDDLSFAKVTNISAPELLVRFKDLKGKVSQPTLRRGCKKAKIDGPRSIFRKGKCMESPPTFIRGKRQKNQKERSKVYIF

SEQ ID NO: 169689 - protein, 53 aa, Glycine max
  Coding DNA Sequence Number=SeqID_52911
MEEKVKLKINGGLRSTYLKLLCSDYHLMEACLRSFYGVEAEDKGEKVRGGPIH

SEQ ID NO: 169690 - protein, 639 aa, Glycine max
  Coding DNA Sequence Number=SeqID_52912
  Gene Ontology: Mol. function=oxidoreductase activity; Cellular component=cytoplasm; Biological process=lignin biosynthetic process
  Homolog annotation: Hit_ID=UPI0000527405; Match level="QueryCoverage =51%, HitCoverage=95%, E-value=1e-120, Identity=67%"; Hit description= Alcohol dehydrogenase GroES domain protein
MAMTPTVTPAADANVFGRARIHDNAFMPGSPPGFPHCCGAGREARSCPRSGPPAPDDVIVDHAGGLHQRVHGGRADEAESSPTQLLAQGRRLCGDGRDVGEGCRARPSPLGRERPHQRVELTVGHRPHEARVADGGLDLRAVADDAGVGQQTLDVLLTELGDALGLEPREDLAKARPLAEDGDPRQPGLETLQRHLLEQCTVAVQRGAPFLVVVAPVLDVVAHPRAAVAGVGARENRSHGTTVSITSDAADHAPATRSVHEGRRVDDEAVPHVGGEHTLVGGVDVGRRDDLDPGADAVLGAEVEHLLGLPDAADVRAGDRTPSGDQRTSVQGEGLGGSPDADDGAVDVEQPEVGAQVDHGAHGVEDHVERPPQLTERRSIARREVAVRPQAESVVLLRQRLREHRHLGTKRVRDLHTHVSEATEPDHGDAGAGADLPVPQRRVRGDARAQQRSRGVEREGVGDAQHEVLGDDDLLGVPALRDGAVPVDRAIRADGALRAELLVAAAAVLALPAGVHQAPDAHPVADRMPGDPDADGRDRTGDLVTGGERVLLRSPVAADGVDVGVADAGEGDVDQHVVRPQLAAFDHGLLERCGLGGRRVGGDGGHRAPSAGYPPTLPAVSASASSAPSPGSGPRRSLR

SEQ ID NO: 169691 - protein, 129 aa, Glycine max
  Coding DNA Sequence Number=SeqID_52913
MAKFGTSSFVGMLATIEDEDGVDVGTKDGPCVSIGDENGVDISTGNGPHASRCDGDGLTSVGGGDGAGATSEDLTRIDTIDKDGVDDVRLSLGSNSLTIYRFFFPLVPFSLESCDKGRGGSAPPDDIYI

SEQ ID NO: 169692 - protein, 79 aa, Glycine max
  Coding DNA Sequence Number=SeqID_52914
MSFKESTPLCTRIGSLYGWTEGLSQTRFNSFFAGIPGLSGVYGGSDQSREEVFSDLPLRKATRIYGFYVSIGYQLLGCV

SEQ ID NO: 169693 - protein, 134 aa, Glycine max
  Coding DNA Sequence Number=SeqID_52915
MRQADQTPPWASRLRPDRGNLLYRTIKGLNPGRSEAHAMREERDHQCKWIDLSIDFEGDNMKHENRASHFLSLIMLQATTIKYALGCMPLSPTHRPDLGLKYPSSAKTKKRTIGILVLGLALFYTNSITSAEQG

SEQ ID NO: 169694 - protein, 815 aa, Glycine max
  Coding DNA Sequence Number=SeqID_52916
  Gene Ontology: Mol. function=nucleic acid binding
  Homolog annotation: Hit_ID=Q9LSS9; Match level="QueryCoverage=99%, HitCoverage=94%, E-value=3e-49, Identity=31%"; Hit description =General negative transcription regulator-like
MAQKDETEGRCPACRSPYDKERIVAMAANCQRLVAEMNSQHKKKMQKLNLKPKSVDGRKHLSDVRVIQRNLVYIIGLPLNLADEEPCSNKDCLYLHDHGSHEDSFTKDELVLAFARSRVQQIIGATNNLHRRSGNVLPPPVDDPKHMSSATKLVSKSPLDKCENQIKGFASGIGAANSTVLPAMSSWVRCVSGNLPQDTISSCSGNLANRKVEASNDPQALVSGVACTERSISTRSGEAENSSDVCSNGAFVPSETNNHNIGGNSKTCESNDFNEVTLEKFPGIVLSNCETFLAAFMGNDQDTAAPSVNTGFLELSRQHDFNIDTAVGINSNGDVHGLCLGLSSISINDHLEDSYFTPDSDRLPFTLNSINSSLGQHLQQDNEYSTEQSSTPAFWEDIIVDDILNIDSEQQKFSKDINCLSSSGLHSTCLPQNVNQSSHQPFKQDQICSQNHFRKPSTESFNELLETGHVKHVESKDNGTGVDNMVASDMGENNIISDILSLELDAWEGSLVNLLGERDELYRPFKAATLRKVQDKNQSRFSFARQDDFMNEASNLQQPFAVTGHGPEGNFSSGGLIGNKDTVTGKYPHVFPSGNSVSSDKFVGSQSFVPSNFSMSKAHSSGPPGFSLSSRIPPGFSCGRVEQDSNTSVKHLQQQYVSSTGNIGSMGDEFNNLAVLNFGKGMLAERLNNASFDMRQTSLPQFIPGEDDPRLKLLMQQSTPTQNLRFPDHVGNRFLPQNDSYRISSRFLDQFPPNSPSIYEQLHSQQFSSNTLPSNNQWGGWNDAKNFSDLSISEVLNNERVGFSNFMPNYENIKF

SEQ ID NO: 169695 - protein, 224 aa, Glycine max
  Coding DNA Sequence Number=SeqID_52917
MLASGKIVRANPRAGKKARIEMTVPFFHITLFSLRCTKKALEGRQQKKSYSGRSRNPPHMGHLQRGVALAYSKEGRNKSETLVEFVLCGTESCLSWRNNCSVLLRISMPLVIPSPKGSLGKLPPRNALSPEPERCPTIKTISHKWESSISLVLTVLAFFNSKRRTYTIRGREASEPSVPLCSTKPLRPFLTADSIAADSFAYYSTQKENCGFSMVEQKRDRASN

SEQ ID NO: 169696 - protein, 287 aa, Glycine max
  Coding DNA Sequence Number=SeqID_52918
  Subcellular localization annotation: CTP_CleavageSite=69; ConfidenceScore=5.08e-01
MENKMSAGGFKLYTLPLPKKSRLSGIIVRHYVPRSSTARGAALPLTTLFHPLSTAHQANLEKKNSEFPSSALASDSSGNSMDGIHQRDLGHPTATRILGLLKGVKGVGQSKAGNAKHEGRTHTSFVAICRQEGKGLQGRVKSKQRFSFCPYGMQLLLLRRVRLLRTVPVGQAKQAFQLALLLAVVLKSMGNGQGFSFRSGGFHPPSLIRFPLAGAVEGEMRLWLFEAILMDRSFLSWFRLYDGSGDLESSILVISKLPAETLLTMRDREPKGHRRKDYGKACLPAGD

SEQ ID NO: 169697 - protein, 474 aa, Glycine max
  Coding DNA Sequence Number=SeqID_52919
  Homolog annotation: Hit_ID=P92567; Match level="QueryCoverage=10%, HitCoverage=25%, E-value=4e-07, Identity=50%"; Hit description =Hypothetical mitochondrial protein AtMg01410
MEEIGGIPLGGTHSKQEILENKRDLIRGNKGYRISSCPGFALKTAQTLAEGDIGRNFEEIEHSAQKEAKLGLLLVLRSSMNPVPALPFRLSHSLVVPIKGLNKKTLVLKAKYHMKEKSQHETRKTLGDKEKKMTLSSVDMAEAHALTLRKATPDVPPQLVGIKGEQISQCFGRLAYRDLADSSQASPAYLTFLRLANSSLNCPPVWTGNLLDISLLGRSLHCLTIWWCAEKIYPGKRFDKYAILGVTISLPKSLVSDVGGAEFAKKFRLLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPDVSIEDFIQAPVVTTRSFQRGVRTSLMLRLRLIENCCGETIAEAGLDPKPLTILGSRLGGSEKTKGDADYSIADSEEITDIVGTNLIFMTGPVIDLLLVMQHRVP

SEQ ID NO: 169698 - protein, 158 aa, Glycine max
  Coding DNA Sequence Number=SeqID_52920
MPPSWGADRIGVSLGSHRPTVILKLPCLVEKKRTKVRSLAVLFSAANWDRSPARGQYIPKGALVIFDGLNKELCVGIHLVVIRIVHLGRKSGWLFCAFYFKQAASSLMMAYGGDEFVHPDNAVPVSLTRSGYPRIIPSHHRRMILKKDEKADMLVKFY

SEQ ID NO: 169699 - protein, 88 aa, Glycine max
  Coding DNA Sequence Number=SeqID_52921
MALYLPLSAGAYFDKLQDQWLKLLLLQRFSCDLFSFRPCSCTHLKEGLLVITEGMTKELLLRAIDFPTEMERMRSYSLSIADAKTKRA

SEQ ID NO: 169700 - protein, 140 aa, Glycine max
  Coding DNA Sequence Number=SeqID_52922
  Subcellular localization annotation: CTP_CleavageSite=44; ConfidenceScore=5.13e-01
MKTSLNKINILFLNALTFNYGSSFPANRSVFFPELVGPKSNVILEKSKWKNKLYPLVPKEFLSPLLQKCSASLHQRQQAPPLNLVLIVTNADKFCGEMLSLHLPLPTLIFIIVDARKIASESPSTSSKGTSPFQNYRNLR

SEQ ID NO: 169701 - protein, 113 aa, Glycine max
  Coding DNA Sequence Number=SeqID_52923
MFNGLAEVSMVVSRLPVFYKQKGLSTLLGIFLTYVIGFEHMFEGKNNFLTFTTILVVVTMDYGYIYRLFSGCKIFPMPYRWPSKTSVFNPNLPYLTVEDVRIETYMERTKKTT

SEQ ID NO: 169702 - protein, 269 aa, Glycine max
  Coding DNA Sequence Number=SeqID_52924
  Gene Ontology: Mol. function=DNA binding; Cellular component=nucleus; Biological process=regulation of transcription, DNA-dependent
  Homolog annotation: Hit_ID=Q0PJJ0; Match level="QueryCoverage=79%, HitCoverage=80%, E-value=4e-90, Identity=78%"; Hit description=MYB transcription factor MYB118
MGKAYFDKSYRNCYLNRFLAMVSCFASVSRFDRDWKKIEDFVGSKTVIQIRSHAQKYFLKVQKNGTVAHVPPPRPKRKAAHPYPQKASKNGLFLFEMAIFSVPKVLVPLPASIGYASSRNTLAPGFASWDETSLLMNAGADKPMTSDIGSKGIAQITNSSLSGVGNSTGALPTSEIPKQGKQAPVLHGLPDFAEVYSFIGSVFDPETNDHVQKLKEMDPINFETVLLLMRNLTVNLSSPDFEPIGVQPICSMFYVLRKLNKSMLILLKI

SEQ ID NO: 169703 - protein, 116 aa, Glycine max
  Coding DNA Sequence Number=SeqID_52925
MEVKPGEEVEKEVVAKDVDEGGWGEVVINGKVDIRDGENRDGGVVRGICTRGVAEVRREVNWESFDTMERRVMRLLMCGERDTGQKVVSEFSQKKLPKRVYEATCEVQEATTLNWT

SEQ ID NO: 169704 - protein, 67 aa, Glycine max
  Coding DNA Sequence Number=SeqID_52926
MAMGRGGDWYCLPSPRSRLPNIYPYSSRYSTVAAHFPTKIIKKRILNYGGYGNGYGTGSDIPVPDPD

SEQ ID NO: 169705 - protein, 226 aa, Glycine max
  Coding DNA Sequence Number=SeqID_52927
MGSSGFDPIPFRSVLLIEFCKRFRSFFGESRGLSDGCAQPNVIYVDPSQTSLQRAFWRKGGKHWFMPTRLKGGFLAGEKEERRGEGAQSTLNYPFLRHQLDIRIAERTACGTDFTRDVSELDCKTESRGEGVLARPRPLSLSIDFLKDDLAVDDVPAREPLATLDTSYSRIVTLPSLSASSKAIEEFFNQYPLFCIWSFRKPAHRAERRAGFVVPSRDWNANPSRK

SEQ ID NO: 169706 - protein, 264 aa, Glycine max
  Coding DNA Sequence Number=SeqID_52928
  Gene Ontology: Mol. function=phosphotransferase activity, phosphate group as acceptor; Cellular component=chloroplast; Biological process=nucleobase, nucleoside, nucleotide and nucleic acid metabolic process
  Homolog annotation: Hit_ID=Q10S93; Match level="QueryCoverage=87%, HitCoverage=79%, E-value=1e-103, Identity=78%"; Hit description =Adenylate kinase, chloroplast, putative, expressed
  Pfam annotation: Domain name=ADK; Domain location=36-230; Score =160.9; E_value=3.2e-45; Accession=PF00406.12; Description=Adenylate kinase
MEDAHNEDVGLDKTVGFVGSNNFMEMELGIRKKWAFLGCPGVGKGTYASRLSNLLGVPHIATGDLVRDELASSDPLSSQLSEIVKQGQLVSDEIIIRLLSKRLVAGEAKGDLGFILDGFPRTIKQAEILEGVTDIDLVINLKLREDVLLEKCLGRRICNQCGGNFNVASINIKAENGSPEIIMAPLLPPENCMSKLITRSDDTESVVKERLRIYNEMTQPVEEFYRSRGKLLEFNLPGGIPESWPKLLHALNLDDYEDKRSAAA

SEQ ID NO: 169707 - protein, 436 aa, Glycine max
  Coding DNA Sequence Number=SeqID_52929
  Gene Ontology: Mol. function=DNA topoisomerase (ATP-hydrolyzing) activity; Cellular component=chromosome; Biological process=DNA topological change
  Homolog annotation: Hit_ID=Q9LZ03; Match level="QueryCoverage=99%, HitCoverage=100%, E-value=0.0, Identity=79%"; Hit description =Meiosis specific-like protein
  Pfam annotation: Domain name=TP6A_N; Domain location=128-212; Score =77.7; E_value=3.7e-20; Accession=PF04406.4; Description=Type IIB DNA topoisomerase
  Subcellular localization annotation: CTP_CleavageSite=61; ConfidenceScore=5.08e-01
MADNKKRRRKDPAGDELPFKNKLKPDSAIMETLKQFSASSSSSSASVSQTLTLQDLSLPFRCREVADLSLSSVQSNIESLILRIAHSILSGHGFSFDVPSRSAANQLYVPELDRIVLKDKSSLRPFANISTVRKSAITARILQLIHQLCLKGIHVTKRDLFYTDVKLFQDQCCCFYKNKQFTKFCVNQIQSDAVLDDVSCMLGCTRSSLNVVAAEKGVVVGRLIFSDNGDMIDCTKMGMGGKAIPPNIDRVGDMQSDALFILLVEKDAAYMRLAEDRFYNRFPCIIVTAKGQPDVSTRLFLRKMKIELKLPVLALVDSDPYGLKILSVYGCGSKNMSYDSANLTTPDIKWLGVRPSDLDKYKIPEQCRLPMTEQDIKTGKDLLEEDFVKKNPGWVEELTLMVKTKQKAEIQALSTFGFQYLSEVYLPLKLQQKDWL

SEQ ID NO: 169708 - protein, 485 aa, Glycine max
  Coding DNA Sequence Number=SeqID_52930
MEINRIGVAYTEKKGAMLQLDNKEGKLTESSNSLFSIDSTSPAIEKTTHSDLQWKSNIGSDLWASAASPSYAPIRDIPPGREDAPRSISPVKDDDDKAIPVDESEHSDGDAKAVALSKYEFGAYFSTLRHLDPSATSQVTFPERAMAGQSLEHLVEASSPRGAQPRGDDADVRDVVVDREFGLDNQDPLYTMNEIPMRESRAKEDLRLDGKGKPRTDTKACKEPAELKGQYIGPALPLQHKITTERKGLLVELLANRAGKIDSIFRYDGKTFDNRSFCGYESGGDRSSSGATQQATICATPNSSSETSASFPSYPSFPSVAVSRILFIVTYCVGKRLKQPKQYVQKPSLDPNIVMKNVPDGLISAEPVQEREEEVTTIKIQIVALINDIKSTPFQSQFFLLPKPYTQTEGMHEQEGSASKKRIQNRHSFSGEIGQIEASFLFAGGPREKSGLHSSFAVVTFRDGSIANKDKHGKQQTPATPRAQA

SEQ ID NO: 169709 - protein, 174 aa, Glycine max
  Coding DNA Sequence Number=SeqID_52931
MESKPIESATAVNLLADSISPESAQGSKPEAKFLFYDTLESDSSPGPVVELDPRPTPIEIFPCAVQVNFALEGIPGSSELQPEEVGSGINFLSQTSLIGETSTKALIRRILVCKAFDLKGASVGETVPVAKVKPVHSFMAIGLQSCFGSRLRSRKSLQAMALDRPDFLERKASE

SEQ ID NO: 169710 - protein, 83 aa, Glycine max
  Coding DNA Sequence Number=SeqID_52932
MWRRGMFLTCHVGGRYFHVGVHVDEIKRRASNVKERIFKDLGKDTWRDLAWEVSGLLWKRRCLKIMKDRESIVIELFSFNKSF

SEQ ID NO: 169711 - protein, 178 aa, Glycine max
  Coding DNA Sequence Number=SeqID_52933
MEAQSAWKAKPVMVTDEGLGCMGVKHGGGVGMESGGSSGDCTEEDGFRRMDRVWIQWKLGSRRNEVELQQVWPWQHQGDPRKWRKVLRLPLKDGREGTGRRKCLCVGVLALSLALQNPWKAESAWSTQFVEPWSRTSLASRTGYSQNQSQGIELDVHKEKVCAEMEGMSLTEVVADAG

SEQ ID NO: 169712 - protein, 130 aa, Glycine max
  Coding DNA Sequence Number=SeqID_52934
MNFKEKKEKKGYITWEDNVINYSSDSEKKIISLNIMMKDYENGEEQSRYIDSNFSKHMACIKVYSYFSPRKVNMQFMETTNKGHLINNPNNWKWKLLEVGSWKLEMKVIGSWKLEVENGGWKLEGEVTKN

SEQ ID NO: 169713 - protein, 87 aa, Glycine max
  Coding DNA Sequence Number=SeqID_52935
  Gene Ontology: Mol. function=nucleic acid binding; Biological process= DNA integration
  Homolog annotation: Hit_ID=Q1S3Z1; Match level="QueryCoverage=100%, HitCoverage=6%, E-value=2e-16, Identity=48%"; Hit description =Integrase, catalytic region; Zinc finger, CCHC-type
MESLYMTKSLANRLILKKGLQTFQMTLGKSIVDHIDNFSKFILDLENTEVTIDQEDQAIILLNFLPNSYEHFVETMILGRESLTLYE

SEQ ID NO: 169714 - protein, 320 aa, Glycine max
  Coding DNA Sequence Number=SeqID_52936
  Gene Ontology: Mol. function=protein serine/threonine kinase activity; Cellular component=membrane; Biological process=protein amino acid phosphorylation
  Homolog annotation: Hit_ID=Q5NAH9; Match level="QueryCoverage=50%, HitCoverage=23%, E-value=5e-23, Identity=35%"; Hit description =Protein kinase CDG1-like
HRPLFLVSIFDSERLRVQPLGGHQTLDCTSARLLTFGGDGPSVFKSQPPFSSPNIKDIHAPATAPSPATLPVPSPSPRISPLGSSLKKKKTPPPAYTLILPPPPPNKDCLSMTCLEPLTYTAPGSPCGCVSELAKEIATSVLLNHTQVRIVGADAANQQLEKITVLLDLVPKGVKFDDTSAILIYKKFWYREILIDASVFGAYEVLYVHSPGLPPSPPSTPSDASGIDDGPNPGHDNNGTIMKPLGVDVPKKKKEGNNGRLIVIFVLSSSAILLKPDTSRGGGMDPGGYVKVKCIACGHRNERFVLLTAMLLDLFPVLYG

SEQ ID NO: 169715 - protein, 159 aa, Glycine max
  Coding DNA Sequence Number=SeqID_52937
  Homolog annotation: Hit_ID=Q6CQF3; Match level="QueryCoverage=35%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MPERGEARGNSVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 169716 - protein, 100 aa, Glycine max
  Coding DNA Sequence Number=SeqID_52938
  Gene Ontology: Mol. function=structural constituent of ribosome; Cellular component=ribonucleoprotein complex; Biological process =translation
  Homolog annotation: Hit_ID=P56804; Match level="QueryCoverage=99%, HitCoverage=100%, E-value=3e-40, Identity=80%"; Hit description =Chloroplast 30S ribosomal protein S14
  Pfam annotation: Domain name=Ribosomal_S14; Domain location=45-99; Score=83.6; E_value=6e-22; Accession=PF00253.11; Description =Ribosomal protein S14pS29e
MARKSVIQREKKRQKLEQKYHLIRRSSKKEISKVPSLSDKWKIHGKLESLPRNSAPIRLHRRCFSTGRPRANYRDFGLSGHILREMVHACLLPGATRSSW

SEQ ID NO: 169717 - protein, 113 aa, Glycine max
  Coding DNA Sequence Number=SeqID_52939
MKSAFDKKVRLRKFHEGDLVLKKMSPAVKDNRGKWAPNYEGPFVVKRAFFRRSPGAYQHGWYLGTDASGDGVTTDRSLPLLCAKQAENAAQGSPVSFGFAVFYYHCLFLVINA

SEQ ID NO: 169718 - protein, 165 aa, Glycine max
  Coding DNA Sequence Number=SeqID_52940
  Homolog annotation: Hit_ID=Q1T199; Match level="QueryCoverage=28%, HitCoverage=3%, E-value=9e-12, Identity=70%"; Hit description =Homeobox
KDLTEVGANLAEDLQCGDIFHLLALVSSGELSISPFLPDNGVGEAEDLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169719 - protein, 113 aa, Glycine max
  Coding DNA Sequence Number=SeqID_52941
MRTTTGEELATQLAQASSARPGEPGCFLQKQPPSGGRIWKAQLSECYGNSRIAQQHFLLISGTLRNFTDCVTMLPFDFRHVSELHVLCNKGCQVPRSDQSKVACHQTIVLGQN

SEQ ID NO: 169720 - protein, 112 aa, Glycine max
  Coding DNA Sequence Number=SeqID_52942
MEHSFILQPGPTSHTSDITLDRARLIYGIIQKMDMNLGCIISSQISMIAQHDSSRLGFLALITTLCKARGVTSDSLSFESLSPTINLAYVKKNCWNLDDPSVTFRGPRKAKG

SEQ ID NO: 169721 - protein, 62 aa, Glycine max
  Coding DNA Sequence Number=SeqID_52943
MCTCAIFGSQDALSMHVCKFSQGSACDVGSKYTLEVHINNLGNGPKEACLKEVQEGLGDRRN

SEQ ID NO: 169722 - protein, 113 aa, Glycine max
  Coding DNA Sequence Number=SeqID_52944
  Gene Ontology: Mol. function=transferase activity; Biological process= DNA integration
MESEFIALDLAGQEAEWLRNLLADVPLWGKRSIPVSLHCDSEAAIGIAKNSVYNGKRRHIRIRHSSVRELLKNGVISLQFVRSENNLADPFTKGLTKKVVLESSRGMGLKPLC

SEQ ID NO: 169723 - protein, 165 aa, Glycine max
  Coding DNA Sequence Number=SeqID_52945
  Gene Ontology: Mol. function=RNA-directed DNA polymerase activity; Cellular component=mitochondrion; Biological process=RNA-dependent DNA replication
MYCIPRESNTRPDLLSKLANTQKTKHLKTIIQETLQTPTTDTKDVMGTLPPDQNEARRLKLKANYYVIIDGELFKRGFTTPLLKCRDNQQANYIMRELQEGICGLHIEGRSLATKVVRAGYYWPTLKVDTLEFTKRYKQCQEFADVPRTPSNNLHILNSPWPFAM

SEQ ID NO: 169724 - protein, 39 aa, Glycine max
  Coding DNA Sequence Number=SeqID_52946
MTNKAKGKGKEVAGKGSTGKRKGAFDDDKTGGGRKRNKR

SEQ ID NO: 169725 - protein, 299 aa, Glycine max
  Coding DNA Sequence Number=SeqID_52947
  Gene Ontology: Mol. function=RNA-directed DNA polymerase activity; Cellular component=mitochondrion; Biological process=RNA-dependent DNA replication
MGEEHRKVERVEVDKLLKANFIREVIFSTWLANVVMACPKDPYPLPSIDKLVNGASDFQVLSSMDVYSGYNQIQKHALDKEKIAFITKDVNFCYRVMQQIGRNVQVYVDDMLNDKLASLSRFLPKLAEKARPFYKLLKKTETGVPLLLYLSVFDDAASLALVQEEWKHQLPIYFISHLLHDAEKRYQMGEEPKLSGRMVAWSVELSEFDIHYEPRGPMKTQFMAEFAGNDQTTIDWWTLYVDGASNVKRSKAGIILEGPDNIVLEQALKFNFKASNNQAEYKALIAGLKLAREVGAKKL

SEQ ID NO: 169726 - protein, 124 aa, Glycine max
  Coding DNA Sequence Number=SeqID_52948
MEHKAYWALKFLNFDEVLLGEKRKLQLLELEEMRLNAYKSSKLYKQKMKAYHDKKLLKKDFKLGQQVLLFHVLGIVVPSSSCNLYALLSKLVVTLNGPSQLGPSFPARGSFLASPRTRHTRSLG

SEQ ID NO: 169727 - protein, 443 aa, Glycine max
  Coding DNA Sequence Number=SeqID_52949
MEQRHEEELRKLKANNDQLEAHLKCLQGGEHSAHTSPEGTQGESHPRHTFNTLDILSLSHAHHPARRTTRRHPFVHRIMEVNIPIGWKPLNQEQYDGIADPDEHLDTFLTQENLCINNDAIMCRVFLTSLKVKALTWYGGLLDSLQTALTNLRQANDESFQKFMDRFGRIVVQIHNLNLEVALHSMLLALRLAWTSYVNEPRATSRWKKCPGLTRSDKLDKSETKEREVIRPNRTSWTSASLSRKDPGSLQHGGTHQVTPPLPPKLGQIGPKTIDTTVVVEQETEDKKNTAEEMTQISGVINTIVGGFSYGGQSSQSCKRHLHAIRDINIYHVDSSSLRSLPPSISVTKMSGENAQRAWSHCLHTTFKDEVPHLNWGDSDYQDKPKAGTIVLCGKPKSGNISSHQGTYQAYSHSGRYHTSHEHRGRVPNPNPDSLPSKPKRCI

SEQ ID NO: 169728 - protein, 719 aa, Glycine max
  Coding DNA Sequence Number=SeqID_52950
  Gene Ontology: Mol. function=transferase activity, transferring glycosyl groups; Cellular component=integral to membrane; Biological process=metabolic process
  Homolog annotation: Hit_ID=Q40287; Match level="QueryCoverage=64%, HitCoverage=93%, E-value=1e-142, Identity=54%"; Hit description =Anthocyanidin 3-O-glucosyltransferase
  Pfam annotation: Domain name=UDPGT; Domain location=8-482; Score= -113.0; E_value=6.2e-05; Accession=PF00201.9; Description=UDP -glucoronosyl and UDP-glucosyl transferase
  Pfam annotation: Domain name=zf-GRF; Domain location=589-633; Score =16.2; E_value=0.00032; Accession=PF06839.3; Description=GRF zinc finger
  Pfam module annotation: Pfam domain module=UDPGT::zf-GRF; Domain location=8-482::589-633
  Subcellular localization annotation: CTP_CleavageSite=41; ConfidenceScore=5.01e-01
MELQKPTHVALLSSPGLGHLIPTIELGKRFVLNHNFKVTVLAVTSQTSRAETQILNSALTPSLCNVINIPSPDLTGLIHQNDRMLTRLCVMMRQALPTIKSILSEITPRPSALIVDIFGTEAIPIGRKLNIPNYVYVASQAWFLSLLVYSPILDEKIEGEYVDQKEALKIPGCNPVRPEDVVDQMLDRNDREYKEYLGVGKGIPQSDGILVNTWEELQRKDLEALREGGLLSEALNMNIPVYAVGPLVREPELETSSVTKSLLTWLDEQPSESVVYVSFGSGGTMSYEQMTELAWGLELSEWRFVWVVRAPMEGTADAAFFTTGSDGVDEVAKYLPEGFVSRTRKVGLLVPEWAQQVTILKHRSIGGFLSHCGWGSTLESVTNGIPLIAWPLYAEQRMNATLLAEELGLAVRTTVLPTKKVVRREEIARMVREVLQGDENVKSNGIRERVKEVQRSAVNALSEGGYILCGTSRGYIYLGLTENKRGYISCGSVLMEGTFTRLFKENKGGTHYQKSLIPWNPNRATSLSHWHLLVPFVTSSLHSQPRRRVPNLLVAFATSSLHFPPPRQHRSHGKECIIMQLRVPNSRDVFVNVEAPLVISQTEDNLGRHFYGCDLYKVTGRKECQFFEWHVLVVNNREKRIIVALMKKVDELKVKEKGLQTKISDMKMKGKILGIGLVLSWVTDEIKVYEVVKELKKSDVGFRKHVEELQEHVCSYLVE

SEQ ID NO: 169729 - protein, 98 aa, Glycine max
  Coding DNA Sequence Number=SeqID_52951
ETACTLQQPVEWILPTPTPYQQVEPVQVIEVSSSEEDLEEDLEELPLEPAVDDLDLPEDDEDPLPDVDFPEDIMSASEADSTEESGLGGTANSDDSSS

SEQ ID NO: 169730 - protein, 301 aa, Glycine max
  Coding DNA Sequence Number=SeqID_52952
  Gene Ontology: Mol. function=protein serine/threonine kinase activity; Cellular component=membrane; Biological process=protein amino acid phosphorylation
  Homolog annotation: Hit_ID=Q2HTU4; Match level="QueryCoverage=97%, HitCoverage=36%, E-value=1e-114, Identity=70%"; Hit description =Protein kinase; S-locus glycoprotein; Curculin-like (Mannose -binding) lectin; Apple-like
  Pfam annotation: Domain name=Pkinase; Domain location=110-300; Score =59.1; E_value=1.4e-14; Accession=PF00069.15; Description=Protein kinase domain
  Pfam annotation: Domain name=Pkinase_Tyr; Domain location=110-300; Score=17.9; E_value=1.4e-13; Accession=PF07714.7; Description =Protein tyrosine kinase
  Pfam module annotation: Pfam domain module=Pkinase::Pkinase_Tyr; Domain location=110-300::110-300
MKMMTSFYDDDVKKNRIVIISTIGAGLICLGIFVWLVWRFKGKLKVLPTVSSVSCCKSSDALPVFDANKSREMSAEFSGSADLSLEGNQLSGPEFPVFNFSCISIATNNFSEENKLGQGGFGPVYKGKLPGGEQIAVKRLSRRSGQGLEEFKNEMMLIAKLQHRNLVRLMGCSIQGEEKLLAYEYMPNKSLDCFLFDPVKQKQLAWRRRVEIIEGIARGLLYLHRDSRLRIIHRDLKASNILLDENMNPKISDFGLARIFGGNQNEANTNRVVGTYGYMAPEYAMEEILSGRRNTKLSSLR

SEQ ID NO: 169731 - protein, 97 aa, Glycine max
  Coding DNA Sequence Number=SeqID_52953
MTPSPLDRKTKANEAEPRWRDRLVLTRVSPITKLEFLTSLCLLFYHSGIQNGATGGDAEATRVGLVRDDIKRSRIESKAQKGSEGSVPPMQCGMARS

SEQ ID NO: 169732 - protein, 261 aa, Glycine max
  Coding DNA Sequence Number=SeqID_52954
  Gene Ontology: Mol. function=sugar binding; Cellular component =integral to membrane; Biological process=protein amino acid phosphorylation
  Homolog annotation: Hit_ID=Q40099; Match level="QueryCoverage=53%, HitCoverage=32%, E-value=2e-34, Identity=55%"; Hit description =Secreted glycoprotein 2
  Pfam annotation: Domain name=B_lectin; Domain location=170-261; Score= 102.2; E_value=1.5e-27; Accession=PF01453.15; Description=D-mannose binding lectin
MQEAVVKSFGWQTIFTLLTEQKQRYQSRRVSLFKIGKALFKGRKSLDQDANECQCRGQFPFLNFLTTGPQYQKNYETKLLFLFLTKHFINSLSLSLQTIMPGFLFFLFCFFFASSQHIAISFSTDTLSSTQILLTNQTLVSPSHIFALGFFPGTNSTWYLGAWYNNITDDKTVVWVANRDNPLENSSGFLTIGENGNIVLRNPSKKNPVWSSDATKANNPVLQLLDTGNLILREANITDPTKYLWQSFDYPTDTLLPGMKM

SEQ ID NO: 169733 - protein, 83 aa, Glycine max
  Coding DNA Sequence Number=SeqID_52955
MLCTGARKLWNEDRASELMDPLLENQFPTAAALRCIQVVRVSWSPNLEGQDYIPRFFSETNSSSGGGLNSGSNDITVTLLEGR

SEQ ID NO: 169734 - protein, 241 aa, Glycine max
  Coding DNA Sequence Number=SeqID_52956
  Gene Ontology: Mol. function=protein serine/threonine kinase activity; Cellular component=membrane; Biological process=protein amino acid phosphorylation
  Homolog annotation: Hit_ID=Q7Y1P1; Match level="QueryCoverage=63%, HitCoverage=18%, E-value=4e-34, Identity=49%"; Hit description =Putative receptor-like kinase
MDNIVVVAREEPAEERGIEEDGGCEEASDSGEEGGKGGGGVVVDNIVVHILPRKWLAVIGSSHVKIVSSSRRMGEGGFGSVYRGKLAHGQEIAVKSGYMSPEYAANGLLSLKSDVFSFGVIVLEILSGIRNNNFYHPDHDRNLLGQAWRLWKEGRTVEFMDVNLDLATIPSELLRCLQVGLLCVQKLPKDRPPTMSSVVFMLSNESITLAHPKKPEFTEQGLEFPGYNNNSMTITLLEARN

SEQ ID NO: 169735 - protein, 721 aa, Glycine max
  Coding DNA Sequence Number=SeqID_52957
  Gene Ontology: Mol. function=protein serine/threonine kinase activity; Cellular component=integral to membrane; Biological process=protein amino acid phosphorylation
  Homolog annotation: Hit_ID=Q1STT5; Match level="QueryCoverage=97%, HitCoverage=97%, E-value=1e-166, Identity=40%"; Hit description =Protein kinase; S-locus glycoprotein; Curculin-like (Mannose -binding) lectin; Apple-like
  Pfam annotation: Domain name=B_lectin; Domain location=70-183; Score =153.5; E_value=5.6e-43; Accession=PF01453.15; Description=D-mannose binding lectin
  Pfam annotation: Domain name=DUF1312; Domain location=4-140; Score= -39.6; E_value=0.093; Accession=PF07009.2; Description=Protein of unknown function (DUF1312)
  Pfam annotation: Domain name=PAN_2; Domain location=332-379; Score =31.5; E_value=7.3e-07; Accession=PF08276.2; Description=PAN-like domain
  Pfam annotation: Domain name=Pkinase; Domain location=429-676; Score =92.0; E_value=1.8e-24; Accession=PF00069.15; Description=Protein kinase domain
  Pfam annotation: Domain name=Pkinase_Tyr; Domain location=429-676; Score=68.9; E_value=1.6e-17; Accession=PF07714.7; Description =Protein tyrosine kinase
  Pfam annotation: Domain name=S_locus_glycop; Domain location=197-323; Score=104.1; E_value=4e-28; Accession=PF00954.11; Description=S-locus glycoprotein family
  Pfam module annotation: Pfam domain module=B_lectin::DUF1312::PAN _2::Pkinase::Pkinase_Tyr::S_locus_glycop; Domain location=70-183::4 -140::332-379::429-676::429-676::197-323
MKKVVIIIFALACLSILQKTSYAADVLTPTSSIKGGQELISAGQNFSLGFFTPGTSKSRYVGIWYKNILPQTIVWVANRDSPLNDTSGNLTVAADGNIVLFDGAGNRIWFTNSSRPIQEPIAKLLDSGNLVLIDGKNSDSDSYIWQSFDYPTDTMLPGLKLGWDKTSGLNRYLTSWKSANDPSPGNFTYRFDQKEFPELVIRQGMNITFRSGIWDGIRFNSDDWLSFNEITAFKPQLSVTRNEAVYWDEPGDRLSRFVMRDDGLLQRYIWDNKILKWTQMYEARKDFCDTYGACGANGICNIKDLPAYCDCLKGFIPNSQEEWDSFNWSGGCIRRTPLNCTEECHVECLKNCSCTAYANSALNEGPHGCLLWFGNLIDIRLLITEEDAGGQLDLYVRLAASEIGHRNHNEDQAPPLFEIYTILAATNNFSIENKIGEGGFGPVYRGKLAHGQEIAVKRLSKTSKQGISEFMNEVGLVAKLQHRNLVSVLDPKQGKTLKWRKRYDIIVGIARGLLYLHQDSKLTIIHRDLKTSNILLDNELNPKISDFGVSRIVEGDHFAVTTNEIVGTIGYMSPEYAVNGLLSVKSDVFSFGVIVLEILSGTKSNNFKVKHPDHDHNLLGQAWRLWNEERAVEFMDVNLDLTTIPSEFMSCLQVGLLCVQNLPEDRPTMSSVVFMLSNESIALGQPKKPDFFEEKLEYRGYSEKESFSNNAMTITLLEARN

SEQ ID NO: 169736 - protein, 118 aa, Glycine max
  Coding DNA Sequence Number=SeqID_52958
MKGDMEAMKEQMTTMMEVMMSMRKMMEVNTATVVAVSTAPKVDPTHLSGLNQVNPLVSDMVGHGGEALGSTSNPHFVQVQNKHSFPPYGLPPNYIPPYVAHATDVNVNNSTPILIESQ

SEQ ID NO: 169737 - protein, 68 aa, Glycine max
  Coding DNA Sequence Number=SeqID_52959
MDKKLASEANPLSEEVNSLSESRTLEYVKSESNVQLARPAKSLSLLALSVSMSAKRLVTNSHSVRHAR

SEQ ID NO: 169738 - protein, 82 aa, Glycine max
  Coding DNA Sequence Number=SeqID_52960
MGARDNSFMHKLWARPGLMQVRHEVKKEYPRLAEVKYKVKPVELSLEWPFVRPTTPAKAPGLGKPHLPLKEKAGLLARPPVP

SEQ ID NO: 169739 - protein, 212 aa, Glycine max
  Coding DNA Sequence Number=SeqID_52961
  Homolog annotation: Hit_ID=Q1SKC8; Match level="QueryCoverage=49%, HitCoverage=24%, E-value=3e-16, Identity=43%"; Hit description =Integrase, catalytic region
MYECARLYKDKVKAYHDKKLLKKELKPGQQVLMFNSKLKLFSSKLKSKWSGPFTIKEVRLYRVVELFDPHSSTLNRTWVVNGQRLKLYHGGNIDRRVTSRAKRINPYSLAEGASLSEPCALSPKNFSGISSFGIGLICMNSLSRHASLSELVAYVRLLKSFCLLLVAERALSMASKKRKATTSRPQEPYDTTRFTSEAELAQGLDLVHGRTH

SEQ ID NO: 169740 - protein, 478 aa, Glycine max
  Coding DNA Sequence Number=SeqID_52962
  Gene Ontology: Mol. function=transferase activity, transferring glycosyl groups; Cellular component=integral to membrane; Biological process=metabolic process
  Homolog annotation: Hit_ID=Q40287; Match level="QueryCoverage=97%, HitCoverage=95%, E-value=1e-130, Identity=50%"; Hit description =Anthocyanidin 3-O-glucosyltransferase
  Pfam annotation: Domain name=UDPGT; Domain location=8-474; Score= -103.2; E_value=2e-05; Accession=PF00201.9; Description=UDP -glucoronosyl and UDP-glucosyl transferase
MELHKSTHVVLLSSPGLGHLIPTIELGKRFVHHHNFQVTVLAVTSQTSKTETEILNSSLCHIIDIPSPDLTGLVNENNGVMTRLSVMMSEAVPAIKSILSKITPRPSALIVDIFGTEAIPIARELNILSYVYVASHAWVLALIVYAPVLDEKIEGEYVDQKEALKIPGCNPVRPEDVVDSMLDRNDRKYKEFLKIGNRIPQSDGLLVNTWEELQRKVLEALREGGLLSKALNMKIPVYAVGPIERESELETSSSNESLVKWLDEQRSESVVYVSFGSGGTLSYEQMRELALGLEMSEQRFVWVVRAPIEESVDAAFFTTGRSESEEVEMSKYLPEGFISRTRKVGLLVPEWAQQVTILKHRSIGGFLSHCGWGSTLESVTNGVPLIAWPLYAEQRMNATLLAEELGLALRTAVLPTKKVVRREEIEHMVREIIQGDENGKSNGIRERVKETQRSAVKALSEGGSSYVALSQVAKIIEG

SEQ ID NO: 169741 - protein, 217 aa, Glycine max
  Coding DNA Sequence Number=SeqID_52963
MAKFKMKEDIAKGNHTLTTKRGMKKKEKSQAKSKESSGEEIRTLFTHELCSINMATPRVPRMKRYCMCLAPASLDNPTPVLATRLDTGLSLSILGGSSNSQPFYSSKTTTLDTGQPTSTSNNLFRPQASSELGGIMYYSGSIKYTCPAMWHLNNHVSILCQTWNRSTDTRPSTVGLPNNLIFMSSRCPLNKGYSPSNVQGLEPTSAMISLTWTISRF

SEQ ID NO: 169742 - protein, 70 aa, Glycine max
  Coding DNA Sequence Number=SeqID_52964
MECLNFVSPNSLFYSEKIHHLFRTSKDLEKQNCLQCLLNLHKDHEEARRKNVGGKGILQAISILWSSVVL

SEQ ID NO: 169743 - protein, 440 aa, Glycine max
  Coding DNA Sequence Number=SeqID_52965
MADGLPLMFSRDGEPHFSFYWKSSPTMFNSFDKDLLTLVERVEKVILDHLSASLDARTILSLLLASDPIATLDGNFAWRKLVKQAGPGDGYMPSFVVVPPTEEMGQLAIEVDPVVGVEVSSKKKSRAYLSLRDLRDVVGLMPSLGHSLSLHSPPLSPSTIEAPTPAVAIVALAADINVPVVMASATTTSLSLAATPSLSASVAAVSFLQMLPPSAIPLAPPSTVSTSPASTSRPRVYLDHIYTTNDSDSLWSVGYKPEQKTSVGFVSTFNKNLIRGLAILEENGHRHQEALNKVASLETEVAKWRATARTVWRVECPKMVMSCMIALACEKADLGGKIEGVAVKKDELLKMVSELEARLKEFELEASKERRPTKGLEELLLFKKEIVEQHEKDFHKAVMQGRYFVKSLDLGLFDPFKDVKDGVLLDKDDVAVGEEDIGRE

SEQ ID NO: 169744 - protein, 86 aa, Glycine max
  Coding DNA Sequence Number=SeqID_52966
MAPRKLPTKRSRKDATGEGSSAALQADVDFDGHRERRVQLRDEEYVEFQEEIAQRQWAQLISPMAKFDPEVVMEFYANAWPIEEGV

SEQ ID NO: 169745 - protein, 131 aa, Glycine max
  Coding DNA Sequence Number=SeqID_52967
  Gene Ontology: Biological process=ubiquitin cycle
  Homolog annotation: Hit_ID=Q2HTR2; Match level="QueryCoverage=74%, HitCoverage=23%, E-value=4e-27, Identity=63%"; Hit description =Cyclin-like F-box
MVVVSVREGEEEEKRKKTKAKIIVARLLLVKPPTTSMISRMSVWLQCFNFSASLIGIAAPSFVGGGFGSKDKFVLKCDHKFVSIRDDTLMMISQWCPNLTQLKLWVCREISDTGMEASKKNCKGLDKLSCR

SEQ ID NO: 169746 - protein, 63 aa, Glycine max
  Coding DNA Sequence Number=SeqID_52968
MEVATDFGGHGRVNGRVKILSSEGCRQKDQADVLMMPKDHMRLKALFKTKKLKIFKMDDQDSL

SEQ ID NO: 169747 - protein, 203 aa, Glycine max
  Coding DNA Sequence Number=SeqID_52969
  Gene Ontology: Cellular component=cellulose and pectin-containing cell wall
  Homolog annotation: Hit_ID=Q1JUZ3; Match level="QueryCoverage=67%, HitCoverage=66%, E-value=1e-15, Identity=33%"; Hit description =Hairpin-induced family protein
  Pfam annotation: Domain name=Hin1; Domain location=44-181; Score =190.0; E_value=5.6e-54; Accession=PF07320.4; Description=Harpin -induced protein 1 (Hin1)
MAHPPSQSNSTAANKPKRSNLLHYIAMFIVALIILVGIAVIIIWLVLKPKRLEYSVENAAIHNFNLTDANHLYANFDFTIRSYNPNSRISIYYDTVEVSVRYEDQTLATNAVQPFFQSHKNVTRLHVALTAQSVALYESVPKDLRLERSSGDIELDVWVRARIRFKVGAWKSRHRVLRIFCSPVLVHFSKGKSFERAPCEVEL

SEQ ID NO: 169748 - protein, 259 aa, Glycine max
  Coding DNA Sequence Number=SeqID_52970
  Gene Ontology: Mol. function=protein serine/threonine kinase activity; Cellular component=membrane; Biological process=protein amino acid phosphorylation
  Homolog annotation: Hit_ID=Q1SF47; Match level="QueryCoverage=99%, HitCoverage=95%, E-value=2e-40, Identity=50%"; Hit description =Protein kinase; EGF-like, subtype 2; S-locus glycoprotein; Curculin- like (Mannose-binding) lectin; Apple-like
  Pfam annotation: Domain name=Pkinase_Tyr; Domain location=76-243; Score=-164.0; E_value=0.021; Accession=PF07714.7; Description =Protein tyrosine kinase
  Pfam annotation: Domain name=S_locus_glycop; Domain location=9-121; Score=-16.8; E_value=0.00063; Accession=PF00954.11; Description=S -locus glycoprotein family
  Pfam module annotation: Pfam domain module=Pkinase_Tyr::S_locus _glycop; Domain location=76-243::9-121
MGFSTHMLPVFLILSNYYINFVTALDTIIVSLLMKDPETVTSNDGTFKPGFFSPGKMSNRYVGIWQVYTSWINRQLVGKRVIQQGNCDIYGFCGAYGSCDSNKLPICSYLRGFERRNREELNRQNRTSGCVRREATAVGYMSPEYAMEGLFSEKSDVFSFGVLLLEIISGRENSSFRNHELLLSLLGYAWQLWNEEEIVSLIDPEIFNPDNVNHILRCIHIGLLCVQELAKETPTMATVVSMLNSEVVNFPPPRQPSFI

SEQ ID NO: 169749 - protein, 89 aa, Glycine max
  Coding DNA Sequence Number=SeqID_52971
MELPKGKKEVGAKWVFRNKLDEVDKVARNKARRSLTCMMKGDENTYASNHISWIGQGIQQGGQPSEQHPDLTLCSVFAYVQGQGYTRIT

SEQ ID NO: 169750 - protein, 161 aa, Glycine max
  Coding DNA Sequence Number=SeqID_52972
MPLKILKKSLQKQENPLEDLQVEQKQLNELHDHLYEQRHDLRRECSQAHHDYENLEASKHDLWIECDNDKKIVKFLNDKLEQNKALKGKPQDVVKLHQEIISLRENLPKFVGGIEKLDKLLGFNRCPSDRFGHGCEGEIYDHDDKTIAFHFYGKIEHDIQL

SEQ ID NO: 169751 - protein, 188 aa, Glycine max
  Coding DNA Sequence Number=SeqID_52973
  Gene Ontology: Mol. function=DNA binding; Biological process=DNA integration
  Homolog annotation: Hit_ID=Q1SFL1; Match level="QueryCoverage=96%, HitCoverage=17%, E-value=8e-40, Identity=44%"; Hit description =Integrase, catalytic region; Peptidase aspartic, catalytic
MTGERCIFQCLTLMHGRTITFNENQKGKIVGVGLKHNMLSISQLCDNGHDFSFKREGVSSKTKMGLSFFLLRGKLGRAKLKLISKVQKHDLVKGLPRLSIKDDFLRETFQKGKQAKKSFSSKNIVSTSRPLKLLHLDLFVPTRTTSVSGKRYGLIVMDDYSRWTWVMFLAHKDESFEVLFKFCKKDSK

SEQ ID NO: 169752 - protein, 37 aa, Glycine max
  Coding DNA Sequence Number=SeqID_52974
MKASTFISYKIRVTEGDVATEEKEVQCRDSNNPEYHI

SEQ ID NO: 169753 - protein, 57 aa, Glycine max
  Coding DNA Sequence Number=SeqID_52975
MGAALRISKELAMGGTSATTVIVLCCVLTWLLEVLHVVGVKFIFETPTPYVNYVNQI

SEQ ID NO: 169754 - protein, 133 aa, Glycine max
  Coding DNA Sequence Number=SeqID_52976
MSKAIGCLCEGSTYYEGWEKAYNSCIPRALYAKNDDKVGDQKAITYNLLCNRAKIWANMLNKSVLHKVYEEAVKQRKQNRLGKAISNKDRGLNSFGITKKIQKIMREQQQRKKTIIQSHRQEEEEEELLAKEA

SEQ ID NO: 169755 - protein, 179 aa, Glycine max
  Coding DNA Sequence Number=SeqID_52977
MNPEGGPAGLANANNQNEVILHLSHDLESLSLLPSFPVDESMQRFNEGLPHQPQLNLPNGPKTVVPLHEFSNVALGSNISPSNSLAGTPQNPSTNLNLSLASGLGHQNAIRSPGMNPSNLLAPRHAVQEQGMRRGTSTNIVHLRTKRSFSDYVFHEFHVGESSKMGEQAALAKRRDTRF

SEQ ID NO: 169756 - protein, 269 aa, Glycine max
  Coding DNA Sequence Number=SeqID_52978
  Gene Ontology: Mol. function=nucleic acid binding; Cellular component= nuclear pore; Biological process=DNA integration
  Homolog annotation: Hit_ID=Q94I37; Match level="QueryCoverage=92%, HitCoverage=24%, E-value=3e-61, Identity=44%"; Hit description =Putative retroelement
MKDKGGDSHGRRNQAIEKNNTWELSSLPKGHEAIGVKWVFKIKKNAKGEVERHKAKLVAKGYKQQYGVDYDELFAPVACMETIRLLISSAAQMKWRIFQLDVKSTFLNGYLEEDVYVEQPMGFVIEGLQESCGSLRYLTNTRPDILYAVGVVCHFTEAPTSPHLKAAKRILRYLKDVDDRKSTTGFVFFMGDCVFTWSSKKQGIVTLSTCEAEYVAATSCTCHTIWLRRLLEELQLLQKESTKIYVDNRSAQELAKNPVFHERSKHIDT

SEQ ID NO: 169757 - protein, 305 aa, Glycine max
  Coding DNA Sequence Number=SeqID_52979
  Gene Ontology: Mol. function=protein serine/threonine kinase activity; Cellular component=membrane; Biological process=protein amino acid phosphorylation
  Homolog annotation: Hit_ID=Q2HTU4; Match level="QueryCoverage=88%, HitCoverage=32%, E-value=4e-84, Identity=57%"; Hit description =Protein kinase; S-locus glycoprotein; Curculin-like (Mannose -binding) lectin; Apple-like
  Pfam annotation: Domain name=B_lectin; Domain location=79-189; Score =107.1; E_value=5e-29; Accession=PF01453.15; Description=D-mannose binding lectin
  Pfam annotation: Domain name=S_locus_glycop; Domain location=203-304; Score=49.3; E_value=1.3e-11; Accession=PF00954.11; Description=S -locus glycoprotein family
  Pfam module annotation: Pfam domain module=B_lectin::S_locus_glycop; Domain location=79-189::203-304
  Subcellular localization annotation: CTP_CleavageSite=27; ConfidenceScore=5.25e-01
MAAATIIYFYFFLFSFVSFHHLLFSFAASSKTRITQGVTIRDKEHETLVSEELNFAMGFFSSDNSSSRYVGIWYDNIPGPEVIWVANRDKPINGTGGAITISNDGNLVVLDGAMNHVWSSNVSNINSNNKNSSASLHDDGNLVLTCEKKVVWQSFENPTDTYMPGMKVPVGGLSTSHVFTSWKSATDPSKGNYTMGVDPEGLPQIVVWEGEKRRWRSGYWDGRMFQGLSIAASYLYGFTLNGDGKGGRYFIYNPLNGTDKVRFQIGWDGYEREFRWNEDEKSWSEIQKGPFHECDVYNKCGSFAA

SEQ ID NO: 169758 - protein, 146 aa, Glycine max
  Coding DNA Sequence Number=SeqID_52980
  Pfam annotation: Domain name=zf-GRF; Domain location=22-66; Score= -3.9; E_value=0.091; Accession=PF06839.3; Description=GRF zinc finger
MENSASSSGSVNVSSNVCHAPVVCNCGSESKLIISWSDDNPGRRSFYGKYNASGRKCKYFSCYDPPTNDFHANLFNKIKKEIKELKATLDAHNQYAIDNVAATSLLSSVGYESIGELQNDIENLKIEVAVQKVELDIKHLQLESKE

SEQ ID NO: 169759 - protein, 118 aa, Glycine max
  Coding DNA Sequence Number=SeqID_52981
CEENQGEEHQQELPRVSVMEVFKDVSDVKLIVEYLKVVVGDLARVVVNNQMFSPSHTPTGVAVTNTNLTSPMDSSTTKRRETQALVDKLASSAKKLIGKKNVAGAAEKTIQSKEAFLI

SEQ ID NO: 169760 - protein, 126 aa, Glycine max
  Coding DNA Sequence Number=SeqID_52982
MASNGAASFHVPLLKGSTYDNLSIKVKALLRAHDVWEMDSRKRDKKAFFLIFQALDDDAFENISDATSIKVAWDKLQSSHKGEDKVKKVCLQTLRECKEEEDKHKNFILVRQQPVPTSSPQATYGP

SEQ ID NO: 169761 - protein, 61 aa, Glycine max
  Coding DNA Sequence Number=SeqID_52983
MNEKVKVILWMNALLTPKLLNPRKTMNCWQPNPITSLERDEMQRLELVLVVYDGISLNTRV

SEQ ID NO: 169762 - protein, 252 aa, Glycine max
  Coding DNA Sequence Number=SeqID_52984
  Homolog annotation: Hit_ID=Q9ZNU6; Match level="QueryCoverage=42%, HitCoverage=20%, E-value=2e-43, Identity=72%"; Hit description=Light- mediated development protein DET1
MKSAYTTADGTNNPATPKWVEVKSHVQSGGYECGYYVMHWMWNIVGGGLKNDWSMWFLDGTTLDNETITTIRQKWAAYFLKVQSIQCTKFRVNDGEDNYTTLPRIDPSVHHARRFYENLVPSYTVCEVECPDHSFCKFTDDGQYLISFSRNHHELIVYRPRWLSFSCKHEDCDKHDLPSRAKRFDSFFTQLYCVALASCNELICKDFFLYWFLGDIFGAHWSNQSVLLLCIWKQYCQCFSGWNYHVSFWELM

SEQ ID NO: 169763 - protein, 180 aa, Glycine max
  Coding DNA Sequence Number=SeqID_52985
  Gene Ontology: Mol. function=O-methyltransferase activity; Biological process=lignin biosynthetic process
  Homolog annotation: Hit_ID=O04899; Match level="QueryCoverage=37%, HitCoverage=28%, E-value=1e-20, Identity=66%"; Hit description =Caffeoyl-CoA O-methyltransferase 5
  Pfam annotation: Domain name=Methyltransf_3; Domain location=42-180; Score=-57.6; E_value=6.5e-08; Accession=PF01596.8; Description=O -methyltransferase
MELTSGGYIPCGSLACKGFYKVERNLKNRRLLGDWITLAWWMDSSGDEGSNGPNNTQFKAAIARSLGWKTKEALMMTQLSRVDPKSMCHLRSTPSLVSAVREEVEEWDVAVCNKDNYLNYHKKVIDLVKIGGLISYDSTLWNGFVVALPDAHMKDYIKHYRGHVIEFNKHLAQDFGIEIC

SEQ ID NO: 169764 - protein, 104 aa, Glycine max
  Coding DNA Sequence Number=SeqID_52986
  Subcellular localization annotation: CTP_CleavageSite=30; ConfidenceScore=5.09e-01
MQNYQHAKRSDSAKAGINRKRIMQQKRHAHAQSSSQPTVNYTSEYDMIASNSSESENSESTQGSNFMTFYEDCQSPTNQPVINTESNDYNSDLQFQMLLYMLLN

SEQ ID NO: 169765 - protein, 72 aa, Glycine max
  Coding DNA Sequence Number=SeqID_52987
MERIERIKKEEEERRGNKAKVLSNRNRDHSVHRSLFGVLHVTVDLKNYVGLNSSSYLRIRRSKEAPMSTPKK

SEQ ID NO: 169766 - protein, 214 aa, Glycine max
  Coding DNA Sequence Number=SeqID_52988
  Gene Ontology: Mol. function=two-component response regulator activity; Cellular component=intracellular; Biological process=two -component signal transduction system (phosphorelay)
  Homolog annotation: Hit_ID=Q4KHP5; Match level="QueryCoverage=96%, HitCoverage=94%, E-value=6e-44, Identity=45%"; Hit description=DNA -binding response regulator, LuxR family
MAVAQVIEQLGVALQAQFEHGVTLLPADGADALVQLQRDFLHGHAGAQQPQHLHFAWRQRLAVALAHAPAAGGLDPLAQASADVGLAPVDRLDGLRQFVHRRTLVDQAEHAAVEHHAQDRQIVGDTEHQYRQVGMAPADHADHGEAVGLWAAGHGVVGHQQVAGLAAKQGHQRLCTVGFADHAANPARFDDGAGTDTDHRVVVCDDDAQAHALV

SEQ ID NO: 169767 - protein, 134 aa, Glycine max
  Coding DNA Sequence Number=SeqID_52989
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q1LEF9; Match level="QueryCoverage=65%, HitCoverage=6%, E-value=4e-11, Identity=35%"; Hit description =PAS/PAC sensor hybrid histidine kinase
MRSWAVRGLVLLLAVLALPAALAQAVPGPLPLTPLQREYVAAHPSIVVGQYDSGWPPFESLRDGQQVGLGPDYLSLLARQLGMKVEARRYSDWTSVLDAACRGEIDVVMNVGLSADLTRCMVYTAAYGEAPLAL

SEQ ID NO: 169768 - protein, 247 aa, Glycine max
  Coding DNA Sequence Number=SeqID_52990
  Gene Ontology: Mol. function=helicase activity; Biological process =viral genome replication
  Homolog annotation: Hit_ID=Q1SRJ5; Match level="QueryCoverage=90%, HitCoverage=27%, E-value=3e-63, Identity=46%"; Hit description =Probable helicase [imported]-Arabidopsis thaliana-related
MVSDSNDTTQNVNIQNDELKEYLDCRYISPCEAAWRIFAFPIHGRKPGVERLYFHLPDQHNILYEDHDDIDDVLSKPTISDSKFLAWMNTNKGFAKARNLTYSQFVSKFVYNKRNRSWQPRKKGYTIGRLIWVPLTTGELFYLRMMLGSCKGPTSFEDIRTIANIQYPTYRETCFAMGFLQDDREYVEAIKEAKDWGTTNYLRKLFILILLTGAMTKPEEVWNQCWHWLADDIAYQYSKSTMNSGRP

SEQ ID NO: 169769 - protein, 131 aa, Glycine max
  Coding DNA Sequence Number=SeqID_52991
MAPTRHPLDPKNSNRALGFLALITCLCQSYGVPVTPNKYCTPRQAQGDAHQAMGAPPPPRQTDPTGPLGVDRYPQHLVRQQAANHRGQVQIHECLYRFSLSQQGQRSIPFACPTLEQFGAEVAWPGDWPDA

SEQ ID NO: 169770 - protein, 137 aa, Glycine max
  Coding DNA Sequence Number=SeqID_52992
MKRMMESNAATAAIASATAEADPTHPCAINQAYQPIPTWWDKEKMLSSTDSPHMGHNRNAYPYSLPPNYMPPTMHVPNENVNHVILVTVEGQQPQPIGGTHEEPRECAQGDLDPYPTFTTEGPTYNAMPQPNTAGAP

SEQ ID NO: 169771 - protein, 80 aa, Glycine max
  Coding DNA Sequence Number=SeqID_52993
MDLGPLALKIIGDNHQEFFQRPLSCITRHHRVWQSLCSSPPIATASATPYVRKRKTKAEEMWGERRKGYEKGTTRERKKG

SEQ ID NO: 169772 - protein, 244 aa, Glycine max
  Coding DNA Sequence Number=SeqID_52994
  Gene Ontology: Mol. function=ribonuclease H activity; Biological process=RNA-dependent DNA replication
  Homolog annotation: Hit_ID=Q1RYI2; Match level="QueryCoverage=80%, HitCoverage=30%, E-value=3e-14, Identity=27%"; Hit description =Ribonuclease H
MATLDENDLLATMSNFITLSGGYGQARQGAPTTSFLGLSKPYWSAYNKDPLFKSIWRWSGLERKCIHAWECARQDLFTNFMRTTRGITISNLCSICNLFPKNVIGCLRDCQYSYKIWECLAEGGSVKELCYEDLNPSLLKNLMHVRAYVNSDWNVTFGIPLYSFWRNRNEVGFSGTASSVGSIVTHVKALTFNVLRFRKATQVTQMPTQGQFYRVPSYWQSPEVGEFNLNCNAAVTSGGELACG

SEQ ID NO: 169773 - protein, 93 aa, Glycine max
  Coding DNA Sequence Number=SeqID_52995
MHLGMDLPSKFKGDRCPRTLGGGDAVHQFPKEPCQDSNSGYGITFRSPRDPKHKFWEISNNASLCLSSKRSIDNVLSTPSHARSVNNGEKPYS

SEQ ID NO: 169774 - protein, 143 aa, Glycine max
  Coding DNA Sequence Number=SeqID_52996
MSITSSTASTRTRYPIVRPPAIIQFRAALHNDQTFIEIPPFYHEQWAPNYPQEVRFKYNGATYPIRVQQHRGRCFFADGLTDFRVDLKIYESIIINFFACDDNTIFYLHFTPPLNQQTCGRPILHSRQHIWTTEITQCILGAP

SEQ ID NO: 169775 - protein, 72 aa, Glycine max
  Coding DNA Sequence Number=SeqID_52997
MVIILPRGNLVVWFCSLHNRPDNYLKEIINSQQHQCFNVPFNGALKGLDDTPQPKSKVVGARWIVVKLTLNL

SEQ ID NO: 169776 - protein, 171 aa, Glycine max
  Coding DNA Sequence Number=SeqID_52998
  Homolog annotation: Hit_ID=Q1SD81; Match level="QueryCoverage=48%, HitCoverage=9%, E-value=1e-09, Identity=40%"; Hit description=H+ -transporting two-sector ATPase, alpha/beta subunit, central region; TonB box, N-terminal
MLDLVTHGASFDGLEKKTEIKEDEKKAQEGGNKGELTEDEQKNEMDLGTFTPSQIAPLFVSRLNSFDSPKELNGIEMPGSAPSALRRPFDIPYDPFEEKLILIGDSFDPELKGLLIEPSKKTLKQEGTGWHTQESEGFKLMEKATQEEIQVEEIMTSLNNYYYPKKPVKEK

SEQ ID NO: 169777 - protein, 44 aa, Glycine max
  Coding DNA Sequence Number=SeqID_52999
MAVTMMARGCLCKSEHEGSAKSKSFRETDGRAKIQSFSVCNIKN

SEQ ID NO: 169778 - protein, 263 aa, Glycine max
  Coding DNA Sequence Number=SeqID_53000
  Gene Ontology: Mol. function=DNA binding; Biological process =regulation of transcription
  Homolog annotation: Hit_ID=Q8LFS2; Match level="QueryCoverage=96%, HitCoverage=67%, E-value=1e-40, Identity=33%"; Hit description =Regulatory protein
MASPGSILDILLQSFKSGDGTQRLLNHMVIITMDPHAFEYCRSLHPYCIHPSIFPHHFVTKRGSIITTPDQNLFTWTRNDVLFEVIQLGYSIIFTEADVLWLRSPLIKLNPSNELTISCNVLSDGQSGSYLHGGGIFFLKANAISLEFFKYWKLTKFMFPNDPAEESLCNTIKARQDAADLYGFRAQLVNTSYFGGFCQPSKNMLREAYTIQANCCDDLESKVHDLRIVLGDWIRFRNHASGVNALDKMDLRWPLKCSTRNYT

SEQ ID NO: 169779 - protein, 144 aa, Glycine max
  Coding DNA Sequence Number=SeqID_53001
MVKEECKEVSVSSKRLVKKESHFAIKTNIKETSLLRQPPNLLLCKRTLVSTAIIPLELKVIPQVKELLDEGLVRKSLNPCALLVPKIGIMRHQIPMIGGMMNVLSGATFFSKITHASNILMVRMHRDSLGSVGSSGLRIIKNGG

SEQ ID NO: 169780 - protein, 207 aa, Glycine max
  Coding DNA Sequence Number=SeqID_53002
  Gene Ontology: Mol. function=RNA-directed DNA polymerase activity; Biological process=RNA-dependent DNA replication
MTRSRMTIHADEGRVEEKVEGYKQQSAAEPTLEPVSDLIELKEREITSAEGKEVPYPLVPSKKDKERHLARFLDIFKKLEITLPFGEALQQMSLYAKFLKDMLMKKNRYIHSDTIIVEGNCSVVIRRILPPKHKDPGSVTIPCSIGEVAVGKALIDLGACINLMPFSMCRRLRELEIMPTRMTLQLVDRSITRPYRVIEDFWLGSNI

SEQ ID NO: 169781 - protein, 332 aa, Glycine max
  Coding DNA Sequence Number=SeqID_53003
  Gene Ontology: Mol. function=DNA binding; Cellular component=oxygen evolving complex; Biological process=DNA integration
  Homolog annotation: Hit_ID=Q1T2A5; Match level="QueryCoverage=69%, HitCoverage=27%, E-value=1e-66, Identity=52%"; Hit description =Integrase, catalytic region
  Pfam annotation: Domain name=Met_10; Domain location=210-331; Score= -75.3; E_value=2.9e-05; Accession=PF02475.7; Description=Met-10+ like- protein
  Pfam module annotation: Pfam domain module=Met_10::RVT_2; Domain location=210-331::1-159
MTTVRLVLSLAASQGWHLHQLDVNTAFLHGDLHEEVYMKASRQWNAKLTSTLLDSGFQQSKDDYSLFTKKSPTGLTIVLVYVDDLVLTAIDLAKIQQLKQSLHAKFSIKDLGILKYFLGFEVARSTSGIFLHQRKYCLDLLQDTGFLAAKPCSLPMDPTLKLHKAFGVPLSDSTVYRRLIGRLLYLTYTRPDTCYVVGKLSQYLQSPTNIHMQAAHHVLRYLKGTAGRGFFTKIGEPVLCIRTSNAYIQNLDTTISVVRIVKRVFANDLNPYAVEYLERNCVLNKLERKIKVFNMDGRRFIKAMYDSDISQSITQVVMNFPSEAAEFLGCLS

SEQ ID NO: 169782 - protein, 72 aa, Glycine max
  Coding DNA Sequence Number=SeqID_53004
  Gene Ontology: Mol. function=isomerase activity; Biological process =metabolic process
  Homolog annotation: Hit_ID=Q1SD05; Match level="QueryCoverage=57%, HitCoverage=11%, E-value=5e-09, Identity=71%"; Hit description=Enoyl- CoA hydratase/isomerase
MARRLLSSSMDKIVRLWHLSNKSCLKVFSHGDYGIYLRLIGKRISTPSDAISVGLETHYVPSGKLSLFKDAL

SEQ ID NO: 169783 - protein, 295 aa, Glycine max
  Coding DNA Sequence Number=SeqID_53005
  Homolog annotation: Hit_ID=Q8D1B3; Match level="QueryCoverage=46%, HitCoverage=75%, E-value=6e-67, Identity=94%"; Hit description =Hypoxanthine phosphoribosyltransferase
  Pfam annotation: Domain name=Cu-oxidase_2; Domain location=11-129; Score=-3.9; E_value=0.0016; Accession=PF07731.4; Description =Multicopper oxidase
  Pfam annotation: Domain name=Pribosyltran; Domain location=160-294; Score=132.9; E_value=9e-37; Accession=PF00156.17; Description =Phosphoribosyl transferase domain
  Pfam module annotation: Pfam domain module=Cu-oxidase_2::Pribosyltran; Domain location=11-129::160-294
MDHGHMKGMDHGSMAGMDHGGAQGKAKPFDFSHGNMINGKAFDMTKPMFAAKRGQYEKWTISGEGDMMLHPFHIHGTQFRILVAQRSAGALRPSGQQRTCVHGPLPPAGARRYRHDDGLHRRRMIAARRSGGGALASPPAKGYAKLCAFLPATDLNTMKHTVDVMISEQEVKTRIAELGRQITEHYRDSGSDMVLVGLLRGSFMFMADLCRAIDVPHEVDFMTASSYGSGMSTTRDVKILKDLDEDIRGKDVLIVEDIIDSGNTLNKVREILALRGPKSLAICTLLDKPERREVQ

SEQ ID NO: 169784 - protein, 135 aa, Glycine max
  Coding DNA Sequence Number=SeqID_53006
  Homolog annotation: Hit_ID=Q5JK69; Match level="QueryCoverage=66%, HitCoverage=7%, E-value=7e-07, Identity=38%"; Hit description =Nodulin-like
MFMNFVEILVNQNKAALSPKKSMENCHAEYDFLSEFGMQPTYSKKAATKNIKSLVSCSNQLLYVLSDLFISPLPEKHFCLKGAIGCLASVTDSSVTKEVLVSLVKRFLFVDCEGEILTSPVGVVDSDQSDLKGYS

SEQ ID NO: 169785 - protein, 106 aa, Glycine max
  Coding DNA Sequence Number=SeqID_53007
  Gene Ontology: Mol. function=sucrose synthase activity; Biological process=sucrose metabolic process
  Homolog annotation: Hit_ID=Q9FX32; Match level="QueryCoverage=82%, HitCoverage=9%, E-value=2e-24, Identity=65%"; Hit description =Sucrose synthase, putative
MSSRQVVKRAKYKTILSKTLAPLCPQIESANPLKLESLFSRLPNMFNIVILSIHGYFGQADVLGLPDTRGQVVYILDQVRALEEELLHKIELQGLDVKPQILVESY

SEQ ID NO: 169786 - protein, 101 aa, Glycine max
  Coding DNA Sequence Number=SeqID_53008
MAQSEVYERGRGFHGNNSSNLEGAWGVEIKEGGRNLYTFRFLHENDRAQVEEGGSWCFDRRLVVLNLSMNIEENPGKVIPETLCLSVMTDVRDCVDKERRE

SEQ ID NO: 169787 - protein, 174 aa, Glycine max
  Coding DNA Sequence Number=SeqID_53009
  Homolog annotation: Hit_ID=Q1S1Q1; Match level="QueryCoverage=22%, HitCoverage=6%, E-value=9e-11, Identity=74%"; Hit description =Generic methyltransferase
MEVSFVPSSLLQLWRNLGEVVAPPPVPFLAPPLVPLSPPTPVPPVAHAPFLSLVLPRAPNPVSPPPPLPPEAPAASAVPRKGATVRGFWSAARTIVFCGSRRGCGRRGVAQEGFDGGERGEKERDGGFAAALIDDPMWVMNTVLVEAKVNTLGAIYERGLIGTYMKWYVISSIF

SEQ ID NO: 169788 - protein, 887 aa, Glycine max
  Coding DNA Sequence Number=SeqID_53010
  Gene Ontology: Mol. function=RNA-directed DNA polymerase activity; Cellular component=chromatin; Biological process=chromatin assembly or disassembly
  Pfam annotation: Domain name=RVP_2; Domain location=312-436; Score= -17.2; E_value=2.2e-05; Accession=PF08284.2; Description=Retroviral aspartyl protease
  Pfam module annotation: Pfam domain module=RVP_2::RVT_1::Retrotrans _gag; Domain location=312-436::560-729::105-195
MADHGTHKTTTDLLEEAIVRLTNSHTAINDRCNDLSGKVDSILEHLRLHNSTSHAPSTPTNPPKHSRSAVKIDIPRFDGRDPLGWIFKITQLFQYQNTPEDERITVASLYLDGAALSWYQWMFSNGLITSWNGFLEALESRFAPTFYEDPKGALFKLTQRGMVNDYLTEFERLANRVIGLPPPFLLSCFISGLNPELKHEVLALQPISLLQATALAKLQEEKLRDRTTPVPRNLPPYKASSSPSPPTVVKPIPLFVQRTPTEMAFRREKGLCYNCEEKWSAENLEVEDNRDDSTADNDQFQGDADCSHISLHALAGVPSSETFRIYGSIRNAKLTILVDSGSTHNFLQPRIAQFLRLPTEANHPLQVMVGNGAMLTSDQVCPDTPLVLQGHPFTISFHLLPISGADAVLGIDWLKRLGPVTTDFTESIMRFRYTGRDISLRADVAIGPEQASTTQLKRLIQTGSTSEFYQLHVIDPNPPDPSNVPHHIHSVERLLLRYAHLFQPPTKLPPPRQIVHRITLQPSTAPVSVRPYRYPHFQKNEIERQVSDLLSAGLIRPSTSPYSSPVLLVRKKDNTWRLCVDYRALNSVMVRDRFPIPTIKELLDELGYASWFSKLDLRQGFHQILMGKHNVEKTAFRTHNGHFEYLVMPFGLCNAPSTFQSAMNQLLQPFLRRFATVFFNDILIYSNSLPSHLHHLETIFRTLQQNEFFLKRSKCLFAQESIEYLGHIVSGKGVKPEPSKIQAMLRWPPPSTTKELRAFLGLTGFYRKFIKNYASIALPLTRLLCKDAFQWAPESQIAFDQLKAAMTSAPVLALPNFSDPFVIKTDASNTAIGAVLMQHGHPLAYFSKTLGPHLSHASAYIHELHAIVATVRKMEAIPPRSSLHDHD

SEQ ID NO: 169789 - protein, 160 aa, Glycine max
  Coding DNA Sequence Number=SeqID_53011
MADREDSNSRIFQQQGFHGNNSANLEGAWGRLVVLTSMNMKENPGEVDLNHCPVWIRVFMIFWWVSKQRRWQSELANEWGILSNGISAMKVLWKNLSRIRVRVDITRPLKRGITLKLGEKMIKKILFKYERFRKSLFLVQMLGSFDEEVTVEKKIQKKLI

SEQ ID NO: 169790 - protein, 99 aa, Glycine max
  Coding DNA Sequence Number=SeqID_53012
MEPDSLARQHEFSLYGSTCIEGGLVRSLNHKRQGTMWNNATKWSLRKRRFRLKLQERVGSFNNKAFMATIAQIWKVHGGVEIKEAGRNLYTSRFLNKKD

SEQ ID NO: 169791 - protein, 59 aa, Glycine max
  Coding DNA Sequence Number=SeqID_53013
  Subcellular localization annotation: CTP_CleavageSite=37; ConfidenceScore=5.06e-01
YLWLSGISRSIAYNWSQPNMKTSVRIIRASSCYGKVPVSRKGKRFVKPSKVTKDMYTDR

SEQ ID NO: 169792 - protein, 52 aa, Glycine max
  Coding DNA Sequence Number=SeqID_53014
MVRLCSVMTPKKLPAKRVKKTVTGEGSSTAPPIEIEFDGHFFQSEELQHCFE

SEQ ID NO: 169793 - protein, 108 aa, Glycine max
  Coding DNA Sequence Number=SeqID_53015
  Homolog annotation: Hit_ID=P20431; Match level="QueryCoverage=34%, HitCoverage=4%, E-value=7e-09, Identity=84%"; Hit description=ATPase 3, plasma membrane-type
MVDQKITKAQKVLAWAAQGKNSKIEDTIIGASKREQGFEVFRIYVKSSFIGHGSCNNHGHCFGQWRNIYKRQWPIFSIYSIHSYITIILKAIVHWENGSHPSTGHDKQ

SEQ ID NO: 169794 - protein, 57 aa, Glycine max
  Coding DNA Sequence Number=SeqID_53016
MSEARRGGEISIPSGVEIGDKSTPHRVSRAGTGENRGDGYSLQLSANRSNEKGQYGN

SEQ ID NO: 169795 - protein, 265 aa, Glycine max
  Coding DNA Sequence Number=SeqID_53017
  Gene Ontology: Mol. function=Rab GTPase activator activity; Cellular component=intracellular; Biological process=regulation of Rab GTPase activity
  Homolog annotation: Hit_ID=Q10N37; Match level="QueryCoverage=97%, HitCoverage=52%, E-value=3e-45, Identity=42%"; Hit description=TBC domain containing protein, expressed
AGDAITLFQSLVGSTFDSSQLVFTACMGYLAVTEARLKELREKHLPSVLDVIEERSKKGRAWKDSKGLASKLYSFKHDPGSLEEERILTEGSDTVADGNVQLESHSSNLDEMLNSLNVDSEVGSLPHLQEQVEQLEQEVAELQQVIADKKEQEAAMLQDQKVTEDARRRSEQDLAAHKFEVHVLQEKYDKAMQSIAEMQKRVVMAESMLEATLQYESGQSKALSSPRFLDEIMKLNNNEAAGASMKGLKSLGKRNARNSLFDILF

SEQ ID NO: 169796 - protein, 267 aa, Glycine max
  Coding DNA Sequence Number=SeqID_53018
  Gene Ontology: Mol. function=glutathione transferase activity; Cellular component=cytoplasm; Biological process=metabolic process
  Homolog annotation: Hit_ID=Q9FQ95; Match level="QueryCoverage=86%, HitCoverage=98%, E-value=1e-118, Identity=90%"; Hit description=In2 -1 protein
  Pfam annotation: Domain name=GST_C; Domain location=125-213; Score =16.4; E_value=0.005; Accession=PF00043.15; Description=Glutathione S- transferase, C-terminal domain
  Pfam annotation: Domain name=GST_N; Domain location=26-101; Score =16.2; E_value=0.024; Accession=PF02798.10; Description=Glutathione S- transferase, N-terminal domain
  Pfam module annotation: Pfam domain module=GST_C::GST_N; Domain location=125-213::26-101
MASLGVQAVHPPPLTSTSDPPPLFDGTTRLYISYSCPYAQRVWIARNFKGLKDKINLVPINLQDRPAWYKEKVYPENKVPSLEHNGKVLGESLDLIKYVDENFEGTPLFPRDPAKKEFGEQLISHVDTFSRDLFVSLKGDAVQQASPAFEYLENALGKFDDGPFLLGQFSLVDIAYIPFAERFQIVFAEVFKHDITEGRPKLATWFEELNKLNAYTETRVDPQEIVDLFKKRFLIVIGFLLIISLLLPLHFYSAVSTVKRCIAAGFL

SEQ ID NO: 169797 - protein, 93 aa, Glycine max
  Coding DNA Sequence Number=SeqID_53019
MHGYNYTIYARYLESTSNERLLSVPLGFEAVEEIETEVRHVRMRWREDEEREGLGFGEIVTEEDERLSLYRRYKSTSVAAGFLQHVSVCSSSR

SEQ ID NO: 169798 - protein, 55 aa, Glycine max
  Coding DNA Sequence Number=SeqID_53020
MSSITSEAMDHSLEEPNPSQLSDAEKKILWAKFGTPSKSLSSDASKSDELKRKAS

SEQ ID NO: 169799 - protein, 265 aa, Glycine max
  Coding DNA Sequence Number=SeqID_53021
  Gene Ontology: Cellular component=integral to membrane
  Homolog annotation: Hit_ID=Q8LCU5; Match level="QueryCoverage=98%, HitCoverage=65%, E-value=3e-56, Identity=47%"; Hit description =Transmembrane transport protein-like protein
  Pfam annotation: Domain name=TerC; Domain location=126-252; Score =85.1; E_value=2.2e-22; Accession=PF03741.6; Description=Integral membrane protein TerC family
MGLASVVHNGVRIPFNLEHIHTPPFRCSALHHPISSFCSVYHYRPPHRFPLLCSRRIGHHNYASEVKRISAQQNDDIGKVEKSPTQESLGNEDYSSSVRTVALWVCTAVAFGVGLGFKEGFDKASEFFAGYILEQSLSVDNLFVFVLIFNYFKVPVAYQNRVLSYGIAGAVVFRLTLILIGTATLQRFEAVNLLLAAILLFSSFKMETPEWFYLPNNILGGSYFLLWYSQFYGLLFASEEDESDLSDNFVVKTCQKFIPVTSNIL

SEQ ID NO: 169800 - protein, 148 aa, Glycine max
  Coding DNA Sequence Number=SeqID_53022
  Gene Ontology: Mol. function=glutathione transferase activity; Cellular component=cytoplasm; Biological process=metabolic process
  Homolog annotation: Hit_ID=Q9FQ95; Match level="QueryCoverage=63%, HitCoverage=51%, E-value=4e-39, Identity=68%"; Hit description=In2-1 protein
MAKVLGEILDLIKYVDVNFEGTPLVPSDPTKNEFGPSFEYLENALGKFDDGPFLLGQFSLVDIAYIPFVERYQVVFAELFKRDITEGRPKLATWIEKNCDWFLTDISLHFYTAVSTVILGLLQASSKIYIDCTNKESFALMGSISSVK

SEQ ID NO: 169801 - protein, 98 aa, Glycine max
  Coding DNA Sequence Number=SeqID_53023
  Subcellular localization annotation: CTP_CleavageSite=74; ConfidenceScore=5.61e-01
MYNYPTAFFLHSNKGYIYNSFKCTTNGNAPSTTVEENRRQRRNVRQTGTRLTPSRRRRGTWRRNNHCGCKQEDKAMTVNKEHVTPPLTAQRRRPSTIT

SEQ ID NO: 169802 - protein, 75 aa, Glycine max
  Coding DNA Sequence Number=SeqID_53024
MLSGTEASRTLQTSSQRSQWVLHYALANLEGLFLVPNVITPPKFKVPDFDKYKGTTCPKNHLKDILSEDGGIRKR

SEQ ID NO: 169803 - protein, 131 aa, Glycine max
  Coding DNA Sequence Number=SeqID_53025
  Subcellular localization annotation: CTP_CleavageSite=46; ConfidenceScore=5.25e-01
MAISSHATGSSEVSSSLRRSEVSLVHARQSKRKLNLAHQWAKRSFSATEESDRASISRLRAKREISALSAAVVFSQAQRTTGAKLKYTYSRGVIRDNLKKAQGTKFHSTPQCLFREKSSGGSKRSSFCRDT

SEQ ID NO: 169804 - protein, 137 aa, Glycine max
  Coding DNA Sequence Number=SeqID_53026
MSSRMRCMLVLSFVTGSRKVHITFLTTHIGHRAPKCTSHERENGHNDGGHYEHEGDNGGQYGCIAEVDLTHPSGLNQISHPTSDVRGKELASTDDPHCVQIQNKHAFAPYGLPSNYTPPNVAYTPGEDVNNSLSHTH

SEQ ID NO: 169805 - protein, 395 aa, Glycine max
  Coding DNA Sequence Number=SeqID_53027
  Gene Ontology: Mol. function=hydrolase activity, acting on glycosyl bonds; Cellular component=cellular_component; Biological process =carbohydrate metabolic process
  Homolog annotation: Hit_ID=O80559; Match level="QueryCoverage=97%, HitCoverage=98%, E-value=1e-150, Identity=63%"; Hit description =Putative polygalacturonase
  Pfam annotation: Domain name=Glyco_hydro_28; Domain location=59-394; Score=393.1; E_value=4.3e-115; Accession=PF00295.8; Description =Glycosyl hydrolases family 28
MARVVETLFLVMSCILCSVLLGFSDAAPTSTYNVVKFGAKPDGKTDSTEPFIKSWQSACTSLNPATIFVPKGRYLLKNTNFRGPCKRKVTFLIAGTLVASEDYHALGNSGFWILFNHVDNLVVSGGRLDAKGAGFWNCRRSGKSCPVGARSMTFNWVNNLVVSGITSINSQLSHIVINACNNVLVKNVRLIAPDQSPNTDGIHVERSTGVTINGCTLQTGDDCISIGDATYNIFMSHIKCGPGHGVSIGSLGQKLDEKGVENVTLTNAIFSGSDNGVRIKTWARPSNGFVRNVLFQNIIMDNVENPIIIDQNYCPNNQGCPGQTSGIKISQITYLNINGSSATPEAVTFDCSPSNPCQGIKLHDVNLTYKNKAATSSCKNIDGTSTGTLAPESCF

SEQ ID NO: 169806 - protein, 198 aa, Glycine max
  Coding DNA Sequence Number=SeqID_53028
  Gene Ontology: Mol. function=DNA binding; Cellular component=nucleus; Biological process=regulation of transcription, DNA-dependent
  Homolog annotation: Hit_ID=Q84WU6; Match level="QueryCoverage=81%, HitCoverage=30%, E-value=3e-34, Identity=46%"; Hit description=Auxin response factor 17
  Subcellular localization annotation: CTP_CleavageSite=39; ConfidenceScore=5.07e-01
PPRPPQSLSSSRTTKILPFYRQRSLDRSHKPSRTTDSDRDATVGVLDENDGVASDELLVVDKLAPAGAEEVATRCAVIDVAEVPLDAADVGDREELDRRIGTEVQRREARVGAEVQHGEAVVVVGIGGSEDLRERNDTVVHAVLIVIVISNLLGVVLEMNLAKTSSEKGSTGDEGERADEKAEVMRGRGTLHVTLGKK

SEQ ID NO: 169807 - protein, 114 aa, Glycine max
  Coding DNA Sequence Number=SeqID_53029
MSNKECHDYDGNKKMKNRYQQCVSCDLERGAEVSQCDSDEEVWCHIASLARNVAVCCGGTNKVETKRRERIGGEKESGSTRGNNGVEMERHRERLQCQQLGSFSVVRAKARDFE

SEQ ID NO: 169808 - protein, 103 aa, Glycine max
  Coding DNA Sequence Number=SeqID_53030
  Subcellular localization annotation: CTP_CleavageSite=59; ConfidenceScore=5.55e-01
MDTSKPYIGAMKGTMHKPQANLGANQKFSPNRFLATRFPTSNVQSFEFGMIDPLDESISCFLIRRATHPRLQRAALPRLQRTTCPRLKRAALPRLQKATSHRL

SEQ ID NO: 169809 - protein, 195 aa, Glycine max
  Coding DNA Sequence Number=SeqID_53031
  Homolog annotation: Hit_ID=Q9FKX9; Match level="QueryCoverage=43%, HitCoverage=11%, E-value=5e-19, Identity=56%"; Hit description =Similarity to myosin heavy chain
MFPSLRDTIEDLRRSLQPKKSAIEALQQLVAEKEQMLEDMRGLLQAAEEKRQAALAELSAKHQKNIQSLEAQLNDALFDKITVSEVEVLHELYTKLRNSIIEDGLIHKESVESPLHHRGNMRFTIAPLFTNAPNFLRFLTGNMLSGNNLSELEEGGLLPCSKISNCPAYSIPCNEGHGLQVSYKQLGEHGTSFFH

SEQ ID NO: 169810 - protein, 241 aa, Glycine max
  Coding DNA Sequence Number=SeqID_53032
  Gene Ontology: Mol. function=oxidoreductase activity; Cellular component=mitochondrion; Biological process=metabolic process
  Homolog annotation: Hit_ID=P50165; Match level="QueryCoverage=89%, HitCoverage=91%, E-value=4e-68, Identity=54%"; Hit description =Tropinone reductase homolog
  Pfam annotation: Domain name=Epimerase; Domain location=20-230; Score= -58.0; E_value=0.023; Accession=PF01370.11; Description=NAD dependent epimerasedehydratase family
  Pfam annotation: Domain name=KR; Domain location=18-175; Score=-79.7; E_value=0.0098; Accession=PF08659.1; Description=KR domain
  Pfam annotation: Domain name=adh_short; Domain location=18-158; Score= 69.7; E_value=9.5e-18; Accession=PF00106.15; Description=short chain dehydrogenase
  Pfam module annotation: Pfam domain module=Epimerase::KR::adh_short; Domain location=20-230::18-175::18-158
MAETKWVMKDKRWSLHGMTALVTGGTRGIGHAIVEELAEFGATVHICARNQDDIDKCLEEWKSKGLNVTGSVNNAATNITKKITDYTAEDISAIMGTNFESVYHLCQVAHPLLKDSGNGSIVFISSVAGLKALPVFSVYAASKGAMNQFTKNLALEWAKDNIRANAVAPGPVKTKLLECIVNSSEGNESINGVVSQTFVGRMGETKEISALVAFLCLPAASYITGQFRVSFSQNSTRQNNC

SEQ ID NO: 169811 - protein, 144 aa, Glycine max
  Coding DNA Sequence Number=SeqID_53033
MVVPPRSIPSVEQFRRMVAWPGTQPSLHREDEGPTAQVAATTPERSLEATSEPHAPVVNLPLPQRIADPSTPILEIPEDPTTPVLAMDTSPPATPVLHLTDEEDVQTKDTQDHVATYPFAGERGEAHECVFHRRKMRGVATNVY

SEQ ID NO: 169812 - protein, 138 aa, Glycine max
  Coding DNA Sequence Number=SeqID_53034
  Gene Ontology: Mol. function=protein phosphatase type 2C activity
  Homolog annotation: Hit_ID=Q9LHJ9; Match level="QueryCoverage=99%, HitCoverage=36%, E-value=2e-42, Identity=60%"; Hit description =Protein phosphatase 2C
MVRSCWKPIADGDEGDGSGRVDGLLWYKDLGNHLYGEFSMAVVQANSSLEDRGELESGPLSSNHLGPQGTFIGVYDGHGGSEASQFVSDNLFCNLKRLASENQGVSEHVIKRAYSATEESFLSLVKKQWLSKPQIAST

SEQ ID NO: 169813 - protein, 99 aa, Glycine max
  Coding DNA Sequence Number=SeqID_53035
  Gene Ontology: Mol. function=DNA binding; Biological process=DNA integration
  Homolog annotation: Hit_ID=Q1T010; Match level="QueryCoverage=63%, HitCoverage=4%, E-value=1e-20, Identity=71%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVLFLLSATPLCRGVYGVEISWIMPLSLQKFSNSPEVNSPPPSVLMIFKLFPNCFSTSILNTLKHRLQAVNTLSPRSQGLLDTQLSPSYVHTTDVNSCR

SEQ ID NO: 169814 - protein, 63 aa, Glycine max
  Coding DNA Sequence Number=SeqID_53036
MTLEVQPAFVDLKVRVSLLLRTREFGEDSEEKLCFRFGVREVHGEEHRVEGLCGGGGGVELGL

SEQ ID NO: 169815 - protein, 41 aa, Glycine max
  Coding DNA Sequence Number=SeqID_53037
MHACFQVRRRLKGSKPPRDLYLSDFSRQNTEQAKALAQAGC

SEQ ID NO: 169816 - protein, 499 aa, Glycine max
  Coding DNA Sequence Number=SeqID_53038
  Gene Ontology: Mol. function=RNA-directed DNA polymerase activity; Cellular component=nucleus; Biological process=DNA integration
MEFYDQDFLEELIISKELDEPSVKSNTIIGLEPHVLVGESEVGGVDGVGQMNPLSCSYKLYNPKKKKVIYGRDVQFDELKYWKDKDNQKEQATVSVQVPMENSVRHQDEAIPHGEGNVEQITEQISSGRMRRMPVRLRDYHMFPNSAITDEDAMNEEIRAIERNKTWELVTFPIGKTPIVVKWVYKTKMKPDGSIAKHKARLQPPRYEVIDSEDKVYRLRKALYGLKQAPRATKDGGVLLICLYVDDFLITGSNPTEIEKLKDNLKSEFEVSDLGLLSYFLDIEFVETKDGIMMHQKKYIKEVLKRFNMDQCNKVDIPVDGNLKLDTGDHEASTDDFMELQVDNKSAIDLARNPVSHGRSKHIETKFHFLRDQVNKGKIRLKHCGVDLQLADIMTKALKADRFKLLRNMLELVLMDELTSGIWDMFLYELEPILLKYSTSCIMSDATVPLVPISTGGNSALSFESRVVDLCMLLLVGVGEKAKSFDLRVVCGFVLEGKL

SEQ ID NO: 169817 - protein, 132 aa, Glycine max
  Coding DNA Sequence Number=SeqID_53039
MEKTYASTFAKQLLHIHLGYGVHTESRGAMDEGPAGAAAGVEGEAQEADPRRVPVPLEPLSRPQGGIRLRFTGPSLLYGALQVPVMWEDDAGSIDINGTLFFLQQAHWHWPAEHTINCRRLISPKLIRTLSS

SEQ ID NO: 169818 - protein, 715 aa, Glycine max
  Coding DNA Sequence Number=SeqID_53040
  Gene Ontology: Mol. function=protein binding; Biological process =apoptosis
  Homolog annotation: Hit_ID=UPI0000162D33; Match level="QueryCoverage =18%, HitCoverage=58%, E-value=1e-12, Identity=35%"; Hit description =protein binding
  Pfam annotation: Domain name=BAG; Domain location=247-324; Score =54.5; E_value=3.5e-13; Accession=PF02179.6; Description=BAG domain
  Pfam annotation: Domain name=IQ; Domain location=221-241; Score=22.5; E_value=0.0015; Accession=PF00612.17; Description=IQ calmodulin -binding motif
  Pfam module annotation: Pfam domain module=BAG::IQ; Domain location =247-324::221-241
MHAPINHIDDTYATWHLHLHIEFVPSSDTQKEETPEMVAEEAISADDKDTETLAQEKTEVSAAPPALQEKNGHGSSSSRSPSPPSSKGNSQATTSETVKTPVSGTRDKAQPNLNHQNAPNTSAKVKPKENTILVSECMTNENKGVDCRDGCQSQMKVNIPSECLKGARETCPDDDDYKTEDKKAEKGAENMMEETTESREEKDSSTQTDAGRKEGRVLSDADAAVFIQAAYRSYLVRKWELLKKLKQIDEVRKEVTHVQGRVQAFERSLELQNDDKQKIAIGETIMRLLLKLDTILGLHPCFREIRKSLARELIILQERLDSIIAKKPQQQMPDADVQEHVEITPMNMQSEEHVQKQQEEKVVVPEDSAEGTRDDVKGPCANDGGSESQSPVDPPSNEGAESVALPNGSDNEDTSQVVTSDALNSSSDLSESDKMAVESEAKSEAKDNPIAEDIPIEVDKLDKTVWEELLVGVIDEDINDVSIEKEEHDDVRSGSLPAMVNDSAQEGSDSENYAMMELPLGLHEEHERDNEMNISNGETWSENEIFIEELHVGLHDEDTTISKDKRDDQAKPKTYKGVLLAQEGEYNADEETSSSIDDTANETQLEQQQKLKEQEEVHSSRVKIEYLKEGELNGDAPMDIRVECKSGEEAGTDTKLLPLTTQVSDNEPENEDVFSEANYVNNKLTEPMEFVPSNDTQTEETPKMVAEEAISVDDK

SEQ ID NO: 169819 - protein, 42 aa, Glycine max
  Coding DNA Sequence Number=SeqID_53041
MNALSGPCRAKRVHPCCQAKRALCAKLECVFVEAELSASMLR

SEQ ID NO: 169820 - protein, 65 aa, Glycine max
  Coding DNA Sequence Number=SeqID_53042
  Gene Ontology: Mol. function=ribonuclease H activity; Biological process=DNA integration
MDDCIKAELKNAFDKKVCPWQIQGKWALNYEGPFIVKKVFLGGALLLASMDDEELPSSVNSDIVK

SEQ ID NO: 169821 - protein, 227 aa, Glycine max
  Coding DNA Sequence Number=SeqID_53043
MAPPKEISTLIYHSGHIVDDPVQGSTYQSQLFDNDDLRGAMETIIQNPQLNYAKFYAVTELIPQPQPSSPQPSCPQLQLPPPQQLPYNNIDLNNPVSSYNNLESQDPFDIYTSYTQILSENDSFFNGQETSFDQQNHPSSPFTPPSQLPQTQTLNRDEHPIANEDLIIRFHHENMDDISEDEDQQFFDHINQQSDDQTDDEGVGRPTSPPSPPLQYQQPRCPVDLNF

SEQ ID NO: 169822 - protein, 59 aa, Glycine max
  Coding DNA Sequence Number=SeqID_53044
MEVEESLMGSRLPLHYQADTGGWCLVLDVHQVDFVADLRVTFVDNWAFLVGRVVSNGKD

SEQ ID NO: 169823 - protein, 99 aa, Glycine max
  Coding DNA Sequence Number=SeqID_53045
MPTTTFLEPSYKDEGRGKIHSIAATCQQLYHAPANYAKSKMTKKPTNVPRFKLLGCINNGDAKGVNDMGIDRGRGMVMVKGTMDVAALAKKLSEKLRER

SEQ ID NO: 169824 - protein, 640 aa, Glycine max
  Coding DNA Sequence Number=SeqID_53046
  Gene Ontology: Mol. function=transmembrane receptor activity; Cellular component=membrane; Biological process=defense response
  Homolog annotation: Hit_ID=Q1SI46; Match level="QueryCoverage=91%, HitCoverage=59%, E-value=1e-180, Identity=54%"; Hit description =Leucine Rich Repeat, putative
  Pfam annotation: Domain name=LRR_1; Domain location=459-480; Score =5.8; E_value=24; Accession=PF00560.23; Description=Leucine Rich Repeat
  Pfam annotation: Domain name=LRR_1; Domain location=482-503; Score =5.5; E_value=27; Accession=PF00560.23; Description=Leucine Rich Repeat
  Pfam annotation: Domain name=LRR_1; Domain location=505-526; Score =15.7; E_value=0.16; Accession=PF00560.23; Description=Leucine Rich Repeat
  Pfam annotation: Domain name=LRR_1; Domain location=528-551; Score =5.4; E_value=27; Accession=PF00560.23; Description=Leucine Rich Repeat
  Pfam annotation: Domain name=LRR_1; Domain location=552-574; Score =7.2; E_value=13; Accession=PF00560.23; Description=Leucine Rich Repeat
  Pfam annotation: Domain name=LRR_1; Domain location=597-618; Score =7.9; E_value=9.3; Accession=PF00560.23; Description=Leucine Rich Repeat
  Pfam annotation: Domain name=LRR_1; Domain location=620-639; Score =6.8; E_value=15; Accession=PF00560.23; Description=Leucine Rich Repeat
  Pfam annotation: Domain name=LRR_3; Domain location=459-478; Score =22.8; E_value=0.0013; Accession=PF07725.3; Description=Leucine Rich Repeat
  Pfam annotation: Domain name=NB-ARC; Domain location=41-304; Score =4.8; E_value=1.4e-10; Accession=PF00931.13; Description=NB-ARC domain
  Pfam module annotation: Pfam domain module=LRR_1::LRR_1::LRR_1::LRR _1::LRR_1::LRR_1::LRR_1::LRR_3::NB-ARC; Domain location=459-480::482 -503::505-526::528-551::552-574::597-618::620-639::459-478::41-304
IPIKEEGEREGEGEGKFHMRVEPRTINFQLREKIVILPLIFIHFLSHSLLYRNDAELLEDIIDHVLKRLNKKPINNSKGLIGIDKPIADLESLLRQESKDVRVIGIWEDVKINTTNGLPNDILRRIGRMKIFIVLDDVNDYDQVEKLVGTLDWLGSGSRIIITARDRQILHNKVDDIYEIGSLSIDEAGELFCLNAFNQSHLGKEYWDYLLLSYWMVDYAKGVPLVLKVLGQLLRGKDKEVWKSQLDKLQKMPNKKVHDIMKPSYYDLDRKEKNIFLDIACFFNGLNLKVDYLNLLLRDHENDNSVAIGLERLKDKSLITISEDNTVSMHNIVQEMGREIAHEESSEDLGSRSRLSDADEIYEVLNNNKVAKILHLRPKGTSAIRSISIDLSKIRKLKLGPRIFSKMSNLQFLDFHGKYNRDDMDFLPEGLEYLPSNIRYLRWKQCPLRSLPEKFSAKDLVILDLSDSCVQKLWDGMQNLVNLKEVRLYRCQFMEELPDFTKATNLEVLNLSHCGLSSVHSSIFSLKKLEKLEITYCFNLTRLTSDHIHLSSLRYLNLELCHGLKELSVTSENMIELNMRGSFGLKALPSSFGRQSKLEILVIYFSTIQSLPSSIKDCTRVRCLDLRHCDFLQTIPESCF

SEQ ID NO: 169825 - protein, 249 aa, Glycine max
  Coding DNA Sequence Number=SeqID_53047
  Gene Ontology: Mol. function=transmembrane receptor activity; Cellular component=membrane; Biological process=defense response
  Homolog annotation: Hit_ID=Q1SI46; Match level="QueryCoverage=94%, HitCoverage=21%, E-value=1e-59, Identity=51%"; Hit description =Leucine Rich Repeat, putative
MDEPSGFILTRYLRTVLFPSTAVEQLKETRKKIEFWNCLCLDKHSLTAIELNVQINVMKFACQHFPAPELDFDDYNDYVVIHDLQSGYEECDSYQATYAYPGSTFPKWLEYKTTNDYVVIDLSSGQLSHQLGFIFCFIVPKDSKRDDKLILYITISDCEGEGEKGSTKMYMNKSDSTKSDHVCVMYDQRCSHYLNSMAKNMKRFKINVTAKTGPISFSCEEEEVLKGFGVSLINTSTYHNFIQQMKFFD

SEQ ID NO: 169826 - protein, 561 aa, Glycine max
  Coding DNA Sequence Number=SeqID_53048
  Gene Ontology: Mol. function=nucleic acid binding; Cellular component= intracellular; Biological process=DNA integration
  Homolog annotation: Hit_ID=Q1S4N1; Match level="QueryCoverage=99%, HitCoverage=44%, E-value=0.0, Identity=73%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTRCMLHEKNLPKKFWAEAAHTTVFLQNRLLSKAVKDQTPYVAWYGYKPSLNFLKIFGCLCFTHVPQNKRDKLDKRASPGIFIGYSTVSKAYKIFQPQTGSIVVSRDVHFVEDEEWNWDEVKKKDQTVVDLQLKSLTSRTEEEEDWQSELADDAPSRRTRSFYDIYERCNICVCEPADFGAAKKDQNWMAVMKEELSMIEKNRTWELVDRPQDRKVIGVKWVYRTKLNVDGSINKHKARLVVKGYAQIFGVDYSGTFAPVARLDTIRILLAVAAQMNWKVYQLDVKSAFLYGVLHEEIYFEQPEGFVKNEEKDKVYLLKKALYGLKQAPRAWYSKIDDHLLSIGFKKSLFEATLYVKHQSNEVLMISLYVDDLLVTGNNAGMIQEFKQEMMKVFEMTDLGLMTFFLGLEIKQAEYEVFICQKKYVKEILKKFKFQECKEVSTPMNQKEKLCKEDGADKADEGYFRSLIGCLMYLTATRPDILNAVSFCPGTSDFGVKFTWSKEFKLVGFSDSDWGGSIDDMRSTSGYYFTLGSSVFSWSLKKQEIVAQSTAEAEFIAATAV

SEQ ID NO: 169827 - protein, 48 aa, Glycine max
  Coding DNA Sequence Number=SeqID_53049
QNPVYWLIGFWKCVLAGLVSLLKWMNLSSQAMSLEELLYIFVSHSQAM

SEQ ID NO: 169828 - protein, 264 aa, Glycine max
  Coding DNA Sequence Number=SeqID_53050
  Gene Ontology: Mol. function=metal ion binding
  Homolog annotation: Hit_ID=Q9FJH4; Match level="QueryCoverage=18%, HitCoverage=11%, E-value=1e-14, Identity=66%"; Hit description =Similarity to ring finger protein
  Pfam annotation: Domain name=zf-C3HC4; Domain location=196-236; Score= 23.1; E_value=0.00064; Accession=PF00097.15; Description=Zinc finger, C3HC4 type (RING finger)
  Subcellular localization annotation: CTP_CleavageSite=87; ConfidenceScore=5.10e-01
MEETTSAIIMSALSTLTPSQFSDLTRSILSATNHHHRRLSSLLSYPTLFSLTLHHLHTLSLPQKTLLIARHLLSSLHLLTATSPHFSTATRQRDLDAALLLLLLCETHNHNPHALEAPVSEWRKILSKLFSDSLLTVSLAPLGTVMIPFVETVSRCWRLVGALDCGGGKEAAEVAASAATVVALPSVEVRHDGRECVICKEEMGIGRDVCELPCQHLFHWMCILPWLGKRNTCPCCRFRLPSDDVFGEIQRLWEVLLKMAAKDS

SEQ ID NO: 169829 - protein, 268 aa, Glycine max
  Coding DNA Sequence Number=SeqID_53051
  Gene Ontology: Mol. function=ATP binding; Cellular component=integral to membrane; Biological process=cobalt ion transport
  Homolog annotation: Hit_ID=Q5W7C1; Match level="QueryCoverage=78%, HitCoverage=74%, E-value=2e-92, Identity=80%"; Hit description =Unknow protein
  Pfam annotation: Domain name=UPF0014; Domain location=14-257; Score =152.9; E_value=8.3e-43; Accession=PF03649.4; Description =Uncharacterised protein family (UPF0014)
MESFFMITPFQNHTFHQHVSFTGTDLSWMVEFLKGMVKPVAATAVVLLAVLLAFLQLSIIGFVLQFIFNQGNAGWIILAYLFMVCVAGYTAGQRAKHVPRGKYVAGASILTGTAVTMFLLVLLNVFPFTPRYIIPVAGMMVGNAMTVTGVTMKRLRDDIKAQMNLVETALALGASPRQATYEQVKRALVIALSPVVDNAKTVGLISLPGAMTGLIMGGASPLEAIQLQIVVMNMLIGASTISSIMSTYLCWPAFFTKAYQLETQVFSK

SEQ ID NO: 169830 - protein, 1359 aa, Glycine max
  Coding DNA Sequence Number=SeqID_53052
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=98%, E-value=0.0, Identity=54%"; Hit description=Chromo
  Pfam annotation: Domain name=Chromo; Domain location=1255-1309; Score= 44.1; E_value=4.9e-10; Accession=PF00385.14; Description='chromo' (CHRromatin Organisation MOdifier
  Pfam annotation: Domain name=RnaseH; Domain location=742-861; Score= -15.1; E_value=0.0015; Accession=PF00075.14; Description=RNase H
  Pfam annotation: Domain name=rve; Domain location=989-1108; Score =25.4; E_value=4.5e-05; Accession=PF00665.16; Description=Integrase core domain
  Pfam annotation: Domain name=zf-H2C2; Domain location=930-971; Score =17.4; E_value=0.0018; Accession=PF09337.1; Description=His(2)-Cys(2) zinc finger
  Pfam module annotation: Pfam domain module=Chromo::RVT_1::Retrotrans _gag::RnaseH::rve::zf-H2C2; Domain location=1255-1309::482-651::133 -223::742-861::989-1108::930-971
MADNTRMKEIYAELKKNADAITHVSEDFHRQIERLEGANHAHMERMEAIQIANESQITQLNSAMTQILQRLQSTPVSSHGASNSNKEQTRTPFQVRSVKLDFPRFDGNNVMDWIFKAEQFFDYYATPDADRLLIVSVHLDHDVVPWYQMMQKTDPLLSWQALTRALELDFGPSAYDCPRATLFKLAQSASVNEFYIQFTTLVNRVDGLSPAAILDCFISGLQDEIRRDVKAMEPRTLSKAVALAKLFEEKYIANKKPNQMTNDDEELQPDRNQATIEEGEEGGNETETHHLSLNAMKGSNGVGTIRFTGQVGSIRVKILVDGGSSDNFIQPRVAQVLKLPIEPAPNLRVLVGNGQTLQAEGMIQQLPLHIQGQEVKVPVYLLQISGADVILGSTWLATLGPHVADYAALTLKFFQNGHFITLQGEVPSSLPPPREQDHAIPLKQGSEPVKVRPYRYPHTQKEQIEKMVHEMLDQGIIQPSTSPFSSPILLVKKKDGSWRFCTDYRALNAITVKDSFPMPTVDELLDELYGAQYFSKLDLRSGYHQIMVKPEDRAKTAFRTHHGHYEWLVMPFGLTNAPATFQSLMNKVFQSALRKFVLVFFDDILVFSSSWHDHLKHLEAVLQILQQHQLYARLSKCSFGASEVDYLGHRVSSKGVSMESTKVQAVLEWPPLTNSKQLRGFLGLTGYYRRFIKAYAHIAAPLTDLLKKDNFVWNSEAEAAFLKLKNAMTIAPVLALPDFTQPFILETDASGIGVGAVLGQNGHPIAYFSKKLAPRMQKQSAYTRELLAITEALAKFRHYLLGNKFIIRTDQRSLKSLMDQSLQTPEQQAWLHKFLGYDFKIEYKPGRDNQAADALSKMFLLAWSEPHSLFLEELRSKLTANPHLKQLMEDYRSSNEASHYAVRQGLLYWKDRLVIPVEEEMVQRILQEYHSSPIGGHAGITRTLARLKAQFYWPRMQEHVKEYVQNCVICQQAKVSNTLPSGLLQPLPIPQQVWEDVAMDFITGLPSVNGFSVIMVVVDRLTKYAHFLPLKADYSSKSVAETFMNNIVKLHGIPKSIVSDRDRVFTSAFWCFTYENPKGWVKALPWSEFWYNTAFHTSLGLTPFKALYGREPPTLTRQPCTTLDPVELREQLINRDNLLAKLKNNLARAQQVMKTQADKKRQEVSMKVGDHVLVKLQPYRQHSAVLRKNQKLAMKYFGPFKIIAKIGTVAYKLELPDTARIHPVFHVSQLKLFKGNSSEPYLPLPLTVTEMGPVMQPVRILANRKLLRGTTQIDQILVQWENGVQEEATWEDIEDIKASYPTFNLEDKVDSKGEGNVMASGARAGHESKDDESRIVEGMNNKLPDDAELGRGKRVRRPS

SEQ ID NO: 169831 - protein, 273 aa, Glycine max
  Coding DNA Sequence Number=SeqID_53053
  Gene Ontology: Mol. function=peptidase activity; Cellular component =extracellular region; Biological process=response to biotic stimulus
  Homolog annotation: Hit_ID=O82086; Match level="QueryCoverage=49%, HitCoverage=82%, E-value=1e-30, Identity=47%"; Hit description =Pathogenesis related protein-1
  Pfam annotation: Domain name=SCP; Domain location=135-256; Score =71.2; E_value=3.2e-18; Accession=PF00188.16; Description=SCP-like extracellular protein
  Subcellular localization annotation: CTP_CleavageSite=66; ConfidenceScore=5.59e-01
MRPFLFSILFTFLATVFAQPLQPSSTPTSFPIDSNAPQRSSPQTPPATSFPADSNAPQQPSPQTPPATSFPADSNAPNLPSPSSENRSLQGVGRHKGGHHSGRRKRVNTRKYFGYVPQTNDTSFTNQTALAQEFLHAHNWIRKQYNLPEYTWDEKLASYARGYLMQRYEDCKLVHSNSNYGENVFWGKKLHWSPSDATYYWYQEKQWYNFQTLSCAPPPKACGHFTQVVWRDSQRIGCALQHCHNPSLGMLIACEYDPAGNYENEDPLKQHER

SEQ ID NO: 169832 - protein, 46 aa, Glycine max
  Coding DNA Sequence Number=SeqID_53054
MCGARAGHENKDDESRIVEGMNNKLPDDAELGRGKRVRRPSWKLTE

SEQ ID NO: 169833 - protein, 158 aa, Glycine max
  Coding DNA Sequence Number=SeqID_53055
  Homolog annotation: Hit_ID=Q10N48; Match level="QueryCoverage=87%, HitCoverage=63%, E-value=2e-26, Identity=44%"; Hit description =Expressed protein
MTVLLDVKRPHAIYAFNGQESWQPLSNFSSKKCKRCGLYEEDSITLDDVFDEWEFCPSDFAAPDGEYIRFKEKEFNATFLCPECLSLAGVDEHDDGKGMHIAVVVLLSVLVSIILILGVVGAIKFWRKKLREQDRARLLKLFEDDDDIGDELGLGSAI

SEQ ID NO: 169834 - protein, 252 aa, Glycine max
  Coding DNA Sequence Number=SeqID_53056
  Gene Ontology: Mol. function=binding; Cellular component =intracellular; Biological process=thiamin biosynthetic process
  Homolog annotation: Hit_ID=Q8H8U1; Match level="QueryCoverage=69%, HitCoverage=70%, E-value=8e-31, Identity=32%"; Hit description =Putative PPR repeat containing protein
  Pfam annotation: Domain name=PPR; Domain location=135-169; Score =10.1; E_value=0.47; Accession=PF01535.11; Description=PPR repeat
  Pfam annotation: Domain name=PPR; Domain location=170-203; Score=8.4; E_value=0.76; Accession=PF01535.11; Description=PPR repeat
  Pfam annotation: Domain name=PPR; Domain location=99-133; Score=31.2; E_value=3.7e-06; Accession=PF01535.11; Description=PPR repeat
  Pfam module annotation: Pfam domain module=PPR::PPR::PPR; Domain location=135-169::170-203::99-133
  Subcellular localization annotation: CTP_CleavageSite=79; ConfidenceScore=5.88e-01
MRIRNLPFPATSDRGSPAPASTSPPVAPPSSATPTTASSARASSSTLASSCTPLHPITSSSPNSSSSTPNLTTRTSRARCDEVGLARNVFDGMSERDIVTWNAMIGGYSQRRLYDECKRLYLEMLNVSGVAPNAVTAVSVMQACGQSMDLVFGMELHRFVKESGIEIDISLSNSVVAMYAKCGRLDYTRELFEGMREKDEVTYGAMISGYMDYGFVDEPIIKSLKLGISSKLVLILLVLILDSLMKLGISSI

SEQ ID NO: 169835 - protein, 78 aa, Glycine max
  Coding DNA Sequence Number=SeqID_53057
MDVHASLEKGKWLRRSSLRRGLEEMPQQKGPVPPPSLIVIIFGALSTNSASRPSKDGRSTERGVSSSGRMSIWTFRRR

SEQ ID NO: 169836 - protein, 101 aa, Glycine max
  Coding DNA Sequence Number=SeqID_53058
MDEDTAKVWKICRTEASYGCSYKNLLKYFPPESCSNSRLFSHINDSLLQEASYELAECRLDADVGGHVKLHPLVMGAVIIVHHVAEVLADAEGLGHALCRD

SEQ ID NO: 169837 - protein, 67 aa, Glycine max
  Coding DNA Sequence Number=SeqID_53059
  Homolog annotation: Hit_ID=Q2RBL5; Match level="QueryCoverage=73%, HitCoverage=41%, E-value=4e-13, Identity=72%"; Hit description =Macrophage migration inhibitory factor family protein, expressed
MVSLEGSTTTCFGGTEEPAAYGELVSMGALNPELNKKLSAGIACVLETKLLGYNCALNGSIMVVESK

SEQ ID NO: 169838 - protein, 178 aa, Glycine max
  Coding DNA Sequence Number=SeqID_53060
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=91%, HitCoverage=69%, E-value=1e-38, Identity=49%"; Hit description =Transcription factor, MADS-box
  Pfam annotation: Domain name=SRF-TF; Domain location=25-75; Score =74.5; E_value=3.3e-19; Accession=PF00319.9; Description=SRF-type transcription factor (DNA-binding and dimerisation domain)
MESNNMPDLNGVAKKTKGQQKIEMKKMRNESNLWVTFSKRRTGVFKKANELATLCGVDVAVIMFSPGNRVFSFGSPSVDSVVQRYKTQGPPPLLTLDLNKVHSTVYEVELHTHLHCLSNQIAIEKKRTKDLNHLAKAAEDQFWWARPIESMTDSQLDKYKKMLEEFKRQLKEKCGNLN

SEQ ID NO: 169839 - protein, 60 aa, Glycine max
  Coding DNA Sequence Number=SeqID_53061
MAPGMVVVKTNPELMWKVLLLAVGLLGCKGLTPSNRRRLGSWPGHLPSELLQGYERLMLS

SEQ ID NO: 169840 - protein, 55 aa, Glycine max
  Coding DNA Sequence Number=SeqID_53062
  Subcellular localization annotation: CTP_CleavageSite=37; ConfidenceScore=5.06e-01
MVGMSSPPLKSSQSLKSSFKDLQDASFGLLSRLWVLYGNPVGGLLLSTNLALSAH

SEQ ID NO: 169841 - protein, 136 aa, Glycine max
  Coding DNA Sequence Number=SeqID_53063
MGDFISRLSFPENTETFSSLTSYPELRRSEFLIGGYVGARASLLSTTPPFVAMTQELVARGDTLRLSAPCHSVTPSVIDEQRPMWSSAPFPEMSAFSDGDFSSLTSYPELRRSEFLIGGYVGARASLLSTTPLLLP

SEQ ID NO: 169842 - protein, 270 aa, Glycine max
  Coding DNA Sequence Number=SeqID_53064
  Gene Ontology: Mol. function=isomerase activity
  Homolog annotation: Hit_ID=Q8XZZ8; Match level="QueryCoverage=99%, HitCoverage=85%, E-value=8e-87, Identity=54%"; Hit description =Probable sugar phosphate isomerases/epimerases protein
  Pfam annotation: Domain name=AP_endonuc_2; Domain location=29-259; Score=124.0; E_value=4.2e-34; Accession=PF01261.14; Description=AP endonuclease family 2
MTLHIANAPCSWGVDDPDNPFLPPWQTVLREAAQAGYRSIELGPWRYLPTDAAELRQQLEAHQLSLVAGTIFDDLVSEANFPAMVELTHNICRNLSQVPCAARTHGDNRPAPYLVIIDFGNPQRAQFAGQTEKAPRLAPADWQRMMQHITQLSHIAWHDYGVRPVIHPHAGGCIEFADELEQLVQDIPHEVAGLCLDTGHLFYSGMDPQTWLQRYWSRIDYLHFKDINAAVWRDVIARGVYFFTACAEGVMCPLGQGAIDYPALRAFLAE

SEQ ID NO: 169843 - protein, 339 aa, Glycine max
  Coding DNA Sequence Number=SeqID_53065
  Gene Ontology: Mol. function=transcription factor activity; Cellular component=intracellular; Biological process=regulation of transcription, DNA-dependent
  Homolog annotation: Hit_ID=Q4IUT5; Match level="QueryCoverage=94%, HitCoverage=85%, E-value=2e-43, Identity=34%"; Hit description =Regulatory protein, LacI:Periplasmic binding protein/LacI transcriptional regulator
  Pfam annotation: Domain name=LacI; Domain location=4-29; Score=22.9; E_value=0.0012; Accession=PF00356.11; Description=Bacterial regulatory proteins, lacI f
MSKVTMIAIAAAAGVGIATVDRVLNRRAPVRAQTEHKVQAAAQLLCYRNSLPPISAWSYGVTLRMGFCLLSTSYSFYQTLTDALRQQTQPFHPAGSEPLFVWHEIDEVAAVVDSLYRLAEQVEAIGVVALDHPLIRHAIAHVSRQGVRVYALFSDFSPCGHAGYFGLDNQKAGRSAGWIASHLLHQPGPAGVLLGDHRFICQESCESGFRSYLREQDSARRVLEPLKTHESIAGGYQATRQLLEQHADLALIYAPCGGIEGVVQALREQPQRKVALICHGPVNDGDLALIDGTITVMLRHQIADMARQLAQTVLQRHAERSDHFSQVTLPFEIVMRENV

SEQ ID NO: 169844 - protein, 108 aa, Glycine max
  Coding DNA Sequence Number=SeqID_53066
MCLNLPFRREGEVKLMGASSKEGKCVESPPTFIRGKHQKNQHGKGQGSAYFENEGSGVVYAWGRQRIKLNVLMMPKVHMRLKALFKTKKLKIFKMDDQDKSLVLERVY

SEQ ID NO: 169845 - protein, 156 aa, Glycine max
  Coding DNA Sequence Number=SeqID_53067
DREKEVHRRVARMLECVKYVEGSMEPGSSVHALVPGLTWRVDMCFGVPLEGDEFVEPPSVDKCLSDVGCGNLSRYSFSLIMSSFLSDSSVGMGGNDSGDLIEQTMMDQEVISIGGSSSEDTCCGVSDSKSSSLERVKALCCTGGGTSHPRLVRNSS

SEQ ID NO: 169846 - protein, 104 aa, Glycine max
  Coding DNA Sequence Number=SeqID_53068
MYLSLINSSFFRTLASVIQFSEDWPAGVAAHDVQRYVKESDRAAQCTRQDEMSNEELKLQDSRCRIQCPGHPARKYWSCCTMHNAGSTMSDTMSRTSCPKILDT

SEQ ID NO: 169847 - protein, 76 aa, Glycine max
  Coding DNA Sequence Number=SeqID_53069
  Gene Ontology: Mol. function=RNA-directed DNA polymerase activity; Biological process=RNA-dependent DNA replication
MGFHEKWVSWMNICLQFVQFPIAINGDPIGQISPRRGLRQGDQLSSYLFILCTGELLDLLKKIKEAKKRHPWVYDK

SEQ ID NO: 169848 - protein, 103 aa, Glycine max
  Coding DNA Sequence Number=SeqID_53070
  Subcellular localization annotation: CTP_CleavageSite=71; ConfidenceScore=5.01e-01
MSPPSLGISQSLKNSLISLKDENLAPCSALHSLKFTIFRPLMTPLALSVNYVQIRLKKGFLISTSRLAPFSCLARGVLAEQMPFQIPLYSPSALVLSFAVDAH

SEQ ID NO: 169849 - protein, 74 aa, Glycine max
  Coding DNA Sequence Number=SeqID_53071
  Homolog annotation: Hit_ID=Q1S175; Match level="QueryCoverage=88%, HitCoverage=19%, E-value=1e-21, Identity=71%"; Hit description=MtN19- related
MEGLYGTSTPKYGTGKEAGNEKGYLIGMSVCYPQPGSIKIHDGEILTLESRYKNEFRTGAMGHFYIYLAEELPQ

SEQ ID NO: 169850 - protein, 189 aa, Glycine max
  Coding DNA Sequence Number=SeqID_53072
  Homolog annotation: Hit_ID=Q8H6Q8; Match level="QueryCoverage=62%, HitCoverage=4%, E-value=3e-09, Identity=26%"; Hit description=CTV.20
MEPEYWDKNPFEATNKAFPPGFHFKPTTINKTRTFYEFILIDSNSVSIKHFKDPKDQSLNTHSTIQILKVIPIGIISMLGPKYYGTKIPNSNIHGLFTLRLPNWFLQWWDFFGPIPEIFPEQKSQLAAFLASARSKESLAKNLKEVLQILQQEEDEGSSSKKEETNSSEDDDPFYQNEDDCFGISLNDD

SEQ ID NO: 169851 - protein, 180 aa, Glycine max
  Coding DNA Sequence Number=SeqID_53073
MSKTAFFTGVLALLLLLLENSVSIAGQTHLSLSVGYFAFCLYLCLVSVVTKRNLHENIHLLFRHEEEEVTEIVVKGITTELSFETIPLLQGQFVFVRRTRCGGSSKRHCPYGGGSVHMVEGENRKAEEEVKTKKDHHWKSPRTTANADTYVALNNHHAEATPDKSIAILGSFNWVRDLWD

SEQ ID NO: 169852 - protein, 204 aa, Glycine max
  Coding DNA Sequence Number=SeqID_53074
  Gene Ontology: Cellular component=integral to membrane
  Homolog annotation: Hit_ID=Q8S1S0; Match level="QueryCoverage=41%, HitCoverage=18%, E-value=2e-15, Identity=50%"; Hit description =Putative lung seven transmembrane receptor 1
GLHKEERRHEEVDPVEGELVGVADVYPEGEEGEVGEGEERVESGELGLAGGEVIAGVFGVGVEVVELGVDEHGDGGFGGAVGEEEGVFVGDCDGGGVRESRTQKLGFCWISIRTCRRDSSLRRKNPNREGSGWDPPEATTKTEETEIDTWPVWVKPNFSKRIMGRVSEVMVRVLISAAEGEMKKKRRRRVATALVEAVMPISER

SEQ ID NO: 169853 - protein, 1173 aa, Glycine max
  Coding DNA Sequence Number=SeqID_53075
  Gene Ontology: Mol. function=nucleic acid binding; Cellular component= intracellular; Biological process=DNA integration
  Homolog annotation: Hit_ID=Q1RSG2; Match level="QueryCoverage=89%, HitCoverage=84%, E-value=0.0, Identity=42%"; Hit description =Integrase, catalytic region; Zinc finger, CCHC-type
  Pfam annotation: Domain name=rve; Domain location=450-608; Score=4.8; E_value=0.0024; Accession=PF00665.16; Description=Integrase core domain
  Pfam annotation: Domain name=zf-CCHC; Domain location=271-288; Score =24.7; E_value=8.2e-05; Accession=PF00098.13; Description=Zinc knuckle
  Pfam module annotation: Pfam domain module=RVT_2::rve::zf-CCHC; Domain location=756-1013::450-608::271-288
MATESSFVQAAIPRFDGHYDHWSMLMENFLRSKEYWSVIESGIQESSVGAVLTDAQKTEFEARKLKDLKAKNYLFQAIDRAIFETILCKETSKDIWESMKRKYEGSVRVKRAQLQALRRDFETLAMKDGEFVTNYFARTMEISNKMRFHGENMTNVTIIEKILRSLTTNFNYVVCSIEESKDIDVPSIDELQSSLLVHKQKMHKSSTTEERALKASTATNTHSFDFRGRGRGRGRGRGRGRGERGNREDNKNPRANTTSKGRGQYSDRSKLECFRCHKFGHYASECYSRLPNDRQKGESSNFTENKEAETLLMAIQEGGKTESDIWYVDAGCNNHMSGCKSSFSYLNEDFHSTVSFGDCSSIKVMGKGDVKIKTKNGFVETISNMLYAPNLKSNLLSAGQLQEKGYVITIQKGACEIYDPVRGAIAIVQMSSNRLLPLKIESIQTCFKTDMEDPSWLWHFRYGHLNFSGLKTLQQKNMVTCLPQITIPSQVCEECVVGKQHRSQFPKGKSWRAKDVLELVHSDICGPINPSSNEEHGIRRELTTAYTLQQNDVSERKNRTIFNMVRSLLARGNVPKSFWPETVNWSIHVLNRSPTFSVQNMTLEEAWKGRRPAVDHFRIFGCIAYAQVPEVKRKKLDDKAEKCVFLGVSEVSKAYKLFNPLTKKIVTNRDVVFDEENTWEWERQQPSQVIYDNDTKHEQILAPYMPENSTNSTPIAVVTSPTTTSINEEEAQSHSCVRRRPVWMKDYLREEKWCKAMNDEIDAIERNDTWELCDLPRGQKTIGVKWVFKTKLNENGEVDKYKARLVAKGYKQQYGTDYTEVFSPVARHDTIRLVVALAAQQSWQIFQLDVKSAFLHGYLEEQVYVDQPPGYVKIGTEEKVYKLKKALYGLKQAPRAWYSRIESYFIQSGFSKCPYEHTLFIKTSDEGKILIVCLYVDNLIFTGNCDAMFKEFKKSMMDEFEMSDIGMMHYFLGREVVQSNAGIFISQKKYVGEILDRFHMQNCNFATTPAAFGCKLHKDHEGKKVDNTFFKQIVGSLMYLTATRPDIMYSVSLVSRYMEYPTEEHHHENTTKDQGEEQKDTNELKEEEADLPAIRSVVDLAEGEIVAGTVGVEVVELCVDGHGDGGFRGTVGEEEAIFIGDGDGVGMAEGRNPAVGGSLGGTAPPRTPTPTAD

SEQ ID NO: 169854 - protein, 203 aa, Glycine max
  Coding DNA Sequence Number=SeqID_53076
  Gene Ontology: Mol. function=receptor activity; Cellular component =integral to membrane; Biological process=ion transport
  Homolog annotation: Hit_ID=Q6L517; Match level="QueryCoverage=99%, HitCoverage=44%, E-value=3e-56, Identity=50%"; Hit description =Putative lung seven transmembrane receptor 1
  Pfam annotation: Domain name=Lung_7-TM_R; Domain location=1-185; Score=-155.7; E_value=0.096; Accession=PF06814.3; Description=Lung seven transmembrane receptor
MHHVKLTGTHGWDVFFFNFDLIRVVLLFSVVILVGTRWTFLHPLVRERGKKVLFLVIPLQVLACCAYSVVHDTGPYIINWVTWNQVFLLLDLISCFAVVFLVVWSMRSLRKITEGEPAAAMKFSLIKRFNLVVIGYLFFTRFVMFAFKTVLSYEYQWVSNLVEETATLVFCIAMFYVFGLLEKDEYSVIGDEEEQVSEIVVKE

SEQ ID NO: 169855 - protein, 97 aa, Glycine max
  Coding DNA Sequence Number=SeqID_53077
  Subcellular localization annotation: CTP_CleavageSite=53; ConfidenceScore=5.11e-01
MGLGVRSTILSFPFHFPTITFTSGVSALLFNSGDQNPHHNLRHPPHDPLWRNSASSTPAPWWHQVGPNSILSEKSLLQVLIETTVASKNEGTVGSPC

SEQ ID NO: 169856 - protein, 126 aa, Glycine max
  Coding DNA Sequence Number=SeqID_53078
  Homolog annotation: Hit_ID=Q8S1S0; Match level="QueryCoverage=39%, HitCoverage=11%, E-value=5e-09, Identity=56%"; Hit description =Putative lung seven transmembrane receptor 1
MAHQEMKLRYQGEEQKDTNELEEEEADLPTVRSVVGLAGGEIVAGTVGVEVVELHVDGHSDGGFRGTVGEEEAIFIGDGDGVGMAEGWGRKKPSRERFAWWDGTTTDTDTDTDGGLVVVCGKDYLI

SEQ ID NO: 169857 - protein, 91 aa, Glycine max
  Coding DNA Sequence Number=SeqID_53079
MNPTQFQAKEEKVKVVDDSLSEANPLSEMHLLSKASSLLSGWETLQEDNPKICTPIAQPARPVRTLSLLALSAPMVAKRKFTNSHSARHAR

SEQ ID NO: 169858 - protein, 106 aa, Glycine max
  Coding DNA Sequence Number=SeqID_53080
  Homolog annotation: Hit_ID=Q00M75; Match level="QueryCoverage=28%, HitCoverage=5%, E-value=5e-10, Identity=100%"; Hit description=PPR -repeat containing protein
MNSRLSIVLTNDKAKEFGGSSLCEGMGEGCCTQPYPCICKEAVSGFEPMTNKSPRHNFTAAPGLALFFVPHCPEALRYAKAVSGFEPMTNKSPRHNFTAAPGLALK

SEQ ID NO: 169859 - protein, 107 aa, Glycine max
  Coding DNA Sequence Number=SeqID_53081
  Subcellular localization annotation: CTP_CleavageSite=16; ConfidenceScore=5.07e-01
MSAVPSPSSVTSIGVVAGVSYGVSSGSGCGSWAIGASPPPTGEGWTPEQATWAIKHKPWWRLCSIGTIVFVLKVEGPEGAVSARGRTGVGIRAGVGARVEVEASEGP

SEQ ID NO: 169860 - protein, 98 aa, Glycine max
  Coding DNA Sequence Number=SeqID_53082
  Gene Ontology: Mol. function=protein binding; Cellular component =cytosol; Biological process=chromosome organization and biogenesis (sensu Eukaryota)
  Homolog annotation: Hit_ID=Q2R178; Match level="QueryCoverage=81%, HitCoverage=5%, E-value=2e-33, Identity=86%"; Hit description=Lipin, N-terminal conserved region family protein, expressed
  Pfam annotation: Domain name=LNS2; Domain location=8-98; Score=48.0; E_value=2e-12; Accession=PF08235.3; Description=LNS2 (LipinNed1Smp2)
MEGVKGRVALWSDVLGQFMPLVGKDWTQSGVARLFCAIKENGYQLLFLSARAIVQAYLTRNFLLNLKQDGKTLPNGPVVISPDGLFPSLYREGGAPLT

SEQ ID NO: 169861 - protein, 114 aa, Glycine max
  Coding DNA Sequence Number=SeqID_53083
  Homolog annotation: Hit_ID=Q10N63; Match level="QueryCoverage=92%, HitCoverage=14%, E-value=7e-11, Identity=39%"; Hit description =Expressed protein
MNGFIEQVARNMQNFKHTVKRLEEVSVSCRGIERVQLLRRWLVALREVERLTLTRTDSNAKDQDNEFLNDESKDLPTQQPTLIYYVDPAAPGELKNFGDVFLSSQALEGISLSM

SEQ ID NO: 169862 - protein, 207 aa, Glycine max
  Coding DNA Sequence Number=SeqID_53084
MTTLTQIWMTLLLSNILLSDHNFDLPLPKCQMVYTILTWMTVHVDQIIADAIYLFAGAAPTRHPLDPKRSNRALGFLALIMGLCQFYGVLVIPSKVIRPPITQAFIEKYCTPRQAKGDAQQAADAPPPQQPDPVIPLSVEQYLRHMVRQQMANHRGQGQGSPPFVCPRDWPTEEGTGPAGSSSEAEEAHMDEDMTDLLGYLGKGGAT

SEQ ID NO: 169863 - protein, 77 aa, Glycine max
  Coding DNA Sequence Number=SeqID_53085
  Homolog annotation: Hit_ID=Q10N63; Match level="QueryCoverage=67%, HitCoverage=8%, E-value=5e-12, Identity=60%"; Hit description =Expressed protein
RLSFIFADLWNLTAGYLFCVTQILDAPNEEEVSLLSEIYGLCIKGGKEEHTALLSSVQELAKAFSGYEDEVLVMMLV

SEQ ID NO: 169864 - protein, 208 aa, Glycine max
  Coding DNA Sequence Number=SeqID_53086
MATKQVTTTMVHVDDDDYIDMELCNSSPNFFSYSLSSPPSNREFEFQMSEKESLTSPADDLFYKGKLLPLHLPPRLQMVQKLVENSSTNAKFEYIKSDSPSTNANTPFESNISPSESRRVSSDVSPNEYQLGWFSDINKYNLSGGDLPKKSLPKKLKQMKQFWLGLRLKASRAYLKTLFNKSGCSDKFCASAASNNNMGAEKKSLKCQ

SEQ ID NO: 169865 - protein, 178 aa, Glycine max
  Coding DNA Sequence Number=SeqID_53087
  Gene Ontology: Mol. function=sequence-specific DNA binding; Cellular component=nucleus; Biological process=regulation of transcription, DNA-dependent
  Homolog annotation: Hit_ID=Q1SD46; Match level="QueryCoverage=91%, HitCoverage=69%, E-value=6e-39, Identity=50%"; Hit description =Transcription factor, MADS-box
  Pfam annotation: Domain name=SRF-TF; Domain location=25-75; Score =76.1; E_value=1.1e-19; Accession=PF00319.9; Description=SRF-type transcription factor (DNA-binding and dimerisation domain)
MESKNMPDLNGVAKKTKGRQKIEMKKMRNESNLRVTFSKRRTGVFKKASELATLCDVDVTVIMFSPGNRVFSFGSPSVDSVVQCYKTHVPPPLLTLDLNKVHSTVDEVELHTHLHCLSNQIAIEKKRTKDLNHLAKAAEDQFWWARPIESMIDSQLDKYKKMLEEFKRQLKEKGGNLN

SEQ ID NO: 169866 - protein, 73 aa, Glycine max
  Coding DNA Sequence Number=SeqID_53088
MAITFLSEVEGKPILNYGSDSWDWAADPWGIYSTNSAYSMFWEEAAVDNLEECFEELWKIKIPSKIAVFTLID

SEQ ID NO: 169867 - protein, 69 aa, Glycine max
  Coding DNA Sequence Number=SeqID_53089
MVAITLAKVHQPPFLREYDPNATCACHGEAPGRSIEHCRALKRKVQERSELSRIGCWTNGLSYLKKKGG

SEQ ID NO: 169868 - protein, 322 aa, Glycine max
  Coding DNA Sequence Number=SeqID_53090
  Subcellular localization annotation: CTP_CleavageSite=40; ConfidenceScore=5.38e-01
MTTPPPSPTQFEIPSDGMSRKTRQATRLRRLTARTLEQARATVSVNPATGRGSGPHKDQFHSYLGVVARDKIPIVHASWNDVPETLKNMIWDDILAKFDIPEGDSAKKKVMSIVATRWRQFKSALTTKYVYGNTDGQAKDDPLVKYGINEKDWAEFAKMRQTPTWQDSLEEQSRQGSIVPSGRDDILNMAIGRPEHPGRVRGAGTGVTITQYFGPSSRRSTSSSNITVEQLANIIGNLKEEWQRQAEQENIKREEVWMRRVEEEKQRTMDTFKGQIQEAIKLELSQIVSQHSAPLQPNDIEVLAARVSTEGKLCSSRDKCIS

SEQ ID NO: 169869 - protein, 463 aa, Glycine max
  Coding DNA Sequence Number=SeqID_53091
  Gene Ontology: Mol. function=translation initiation factor activity; Cellular component=fibrillar center; Biological process=translation
  Homolog annotation: Hit_ID=Q5N7Y7; Match level="QueryCoverage=95%, HitCoverage=96%, E-value=0.0, Identity=65%"; Hit description =Putative eukaryotic translation initiation factor 3 subunit 6 interacting protein
MANQDFEERQQQQQPQELGYDPNFVPDSVKSFVVHLYRHIREKNVYEIHQMYESSFQTLSERLFKDTPWPSVDAVAHYVDNDHVFCLLYREMWFRHLYARLTPTLRQRIDSWDNYCSLFQVVLHGVVNMQLPNQWLWDMVDEFVYQFQSFCQYRAKMKNKTEQEIALLRQFDQAWNVFGVLNFLQALVEKSAIIQILEQEKEGLEQFTATDGYDYNGGSNVLKVLGYFSMVGLLRVHCLLGDYHTGLKCLLPIDITQQGVYTSVIGSHITTIYHYGFANLMLRRLVDETVNSQLREKYGEKMVRMQRYDDEAFAIYDELFSYACPKFITPSAPSFEEPLVNYNQDAYRLQLKLFLYEAKQQQLLSGVRTFLKVYSTISLTKLASYMEVDEPTLRTILMTYKHKTHAVDSDGKITSNADLDFYINDDTIHVMESKPAKRYGDYFLRQIVKLEGVINEMDGIKLE

SEQ ID NO: 169870 - protein, 230 aa, Glycine max
  Coding DNA Sequence Number=SeqID_53092
MPFIYDTVWDLIKLADYLTHREDIDPSRIGISGESFGGMHAWFAAVADTRYAVVVPLIGVQGFRWAIDNDKWQARVNSIKPLFEVARDDLGKDVIDKEVVEKVWDRIAPGLASQFDSPYSIPTIAPRPLLILGGIEAFVWVLRTLGAEDRRCPVAGLEIPRSMASQAYGEFQCLDNLKVQPLKLDVITRTQRGVWLGILFRFIAEPGIWHRLTRFQVKESSDWFDRFLNP

SEQ ID NO: 169871 - protein, 905 aa, Glycine max
  Coding DNA Sequence Number=SeqID_53093
  Gene Ontology: Cellular component=intracellular; Biological process =intracellular protein transport
  Homolog annotation: Hit_ID=Q2V732; Match level="QueryCoverage=83%, HitCoverage=100%, E-value=0.0, Identity=67%"; Hit description=VHS and GAT domain protein
  Pfam annotation: Domain name=GAT; Domain location=273-372; Score =118.5; E_value=1.9e-32; Accession=PF03127.5; Description=GAT domain
  Pfam annotation: Domain name=UQ_con; Domain location=793-905; Score =7.2; E_value=9.9e-06; Accession=PF00179.16; Description=Ubiquitin -conjugating enzyme
  Pfam annotation: Domain name=VHS; Domain location=87-228; Score=2.9; E_value=2.6e-05; Accession=PF00790.9; Description=VHS domain
  Pfam module annotation: Pfam domain module=GAT::UQ_con::VHS; Domain location=273-372::793-905::87-228
MVNPLVERATSSMLVGPDWALNMEICDILNRDPGMGYIHSQINSALDRLKEDWTQQSTMKVVQYLWWMRDSYQTQWVGGDRQPYFGDKDGGLMLSWLRSMFRGHLEVHSVLTEALWGTYVWGPPIFAYMGWHAKDVVKGLKKRIGSKVPRVQILALTTIIKNCGDIIHMHVAERDVLHEMVKIVKKKPDYHVREKILILIDTWQEAFGGPRARYPQYYAAYQELLHAGAAFPQRSKQSAPVFTPLQTQPLSSYPQNIRDTVAQQDAAEPSAESEFPALSLSEIQNARGIMDVLAEMLNALDPGNKEGLQQEVIVDLVEQCRTYKQRVVNLVNSTSDESLLCQGLALNDDLQRVLAKHESIASGTSAQNPAEKPKPAPTGALVDVDDPLVDIGDTSKQTDVRSSSSAGAGSQTLNQLMLPAPPTSNGSVPPAMVDPQVDLLSGEDYNSPKAETSLALVPLGEQQPASPISQQNALVLFDMFSNGSNAPISVNTQLINVAGQTSPLAPQFQQQTFISQGLFYPNVSVPNVGSPRYEQSPFAQSTGPSWNGQVAQQQQPPSPVYGTASGGSFPPPPWEAQPTDNNSPVAGSQYPQPLQVSQMIMTSIQSGTHPQGPQAMGHDQAVGMYMQPHAGHMSTINNHVQSNQLGLYRQHIQGAAGPYMGMVSHQMHNSPVASMYPQQMHGNQFGGYGYGQQPGVQYLEQQMYGLSVRDDGAPKNSYQVSSPSYVPPGKPSKPEDKLFGDLVNMAKVKPKPTPDQTGSMGWFVPDFDAISCNCTEVDFDFGLRFLTQASRARLFKEYKEVQREKAVDPDIQLVCDDSNIFKWTALIKGPSETPFEGGVFQLAFSVPEQYPLQPPQVRDEQAVSRHRDSNIKIVQEIFCVQAMLEGINPWQECTRDLQQCQRKAE

SEQ ID NO: 169872 - protein, 387 aa, Glycine max
  Coding DNA Sequence Number=SeqID_53094
  Gene Ontology: Mol. function=catalytic activity; Cellular component =chloroplast; Biological process=metabolic process
  Homolog annotation: Hit_ID=Q5DQ95; Match level="QueryCoverage=94%, HitCoverage=82%, E-value=1e-121, Identity=62%"; Hit description=4 -amino-4-deoxychorismate lyase
  Pfam annotation: Domain name=Aminotran_4; Domain location=99-371; Score=2.9; E_value=3.7e-10; Accession=PF01063.9; Description =Aminotransferase class IV
MKAVTNCNQSGCLAYSRTEISDVPLLSCSEAMEKLKSFREKVKGKQQFLAMYSSIFGGITTDPAAMVIPMDDHMDLNPQGLVHYERVWPKPPSQNQTSRGNYLSLGQSLVPSSDIARYSICCQMMYFMHYYRYLYELDQHLDRFIRSASTAKINPPYDRGTIRGILIQTVSASKCRNGTLRYWLSAGPGDFDLSPSGCHKSCLYAITIQDLSPINFRGVKVVTSNVPIKPPQFATTKSVNYLPNVLSKMEAEELGAFVGIWLDSDGFVAEGPSMNVAFVTKEKELVMPLCDKILSGCTAKRVLTLAESLVREGKLCGIRMKNVSVEEGKNADEMMLLGSGIMVRSVVQWDEQIIGCGKEGPITQTLLNLVVEDMKSTLPAVGTPVPY

SEQ ID NO: 169873 - protein, 84 aa, Glycine max
  Coding DNA Sequence Number=SeqID_53095
  Homolog annotation: Hit_ID=P16181; Match level="QueryCoverage=44%, HitCoverage=23%, E-value=1e-09, Identity=76%"; Hit description=40S ribosomal protein S11-1
  Subcellular localization annotation: CTP_CleavageSite=45; ConfidenceScore=5.21e-01
MEFVFVEFVSATYQLSSKKTRKGKSPGKGGNRFWKSIVVGFKTPREAIKGDFFVFFSRCQDVDNRASSMHALNVFGTCDLLVTG

SEQ ID NO: 169874 - protein, 399 aa, Glycine max
  Coding DNA Sequence Number=SeqID_53096
  Homolog annotation: Hit_ID=Q00SK9; Match level="QueryCoverage=35%, HitCoverage=29%, E-value=6e-11, Identity=32%"; Hit description =Homology to unknown gene
  Pfam annotation: Domain name=Peptidase_S9; Domain location=120-399; Score=-78.4; E_value=0.039; Accession=PF00326.11; Description=Prolyl oligopeptidase family
MAENKAIEEAQSKFRSEFLQVLRSRRPAQVPLTVEFAKPVVNPLHQNSPPSIEEIKIMESCPRTDIENLEDLLEEENLYLNIEEGEQGRLPLLILKLKESDKQRKRPAVVFLHSTNKYKEVLRPLLKAYASRGYIAISVDSRYHGERATSATTYRDALISAWKTGETMPFIFDTVWDLIRLADYLTQREDIDPSRIGITGISLGGMHAWFAAVADTRYAVVAPLIGIQGFQWAIGNDKWQARVDSIKPLFEVGAVFKTYKGKYDMNLGPICWDSFKHAKSGKLNIYSEAARDDLGKGAIDKEVVEKVWDRIAPGLASQFDSPYSVPTIAPRPLLIVNGAEDPRCPVAGLEIPRAQASQAYGQFDCLDNFKIITEPGVGHQLTRLQVKESSYWFDRFLNP

SEQ ID NO: 169875 - protein, 249 aa, Glycine max
  Coding DNA Sequence Number=SeqID_53097
  Gene Ontology: Mol. function=hydrolase activity; Cellular component =nucleus; Biological process=regulation of transcription, DNA -dependent
  Homolog annotation: Hit_ID=Q65FY2; Match level="QueryCoverage=86%, HitCoverage=72%, E-value=2e-10, Identity=26%"; Hit description=YtaP
  Pfam annotation: Domain name=Peptidase_S15; Domain location=18-216; Score=-102.5; E_value=0.014; Accession=PF02129.9; Description=X-Pro dipeptidyl-peptidase (S15 family)
  Pfam annotation: Domain name=Peptidase_S9; Domain location=54-248; Score=-75.3; E_value=0.024; Accession=PF00326.11; Description=Prolyl oligopeptidase family
  Pfam module annotation: Pfam domain module=Peptidase_S15::Peptidase _S9; Domain location=18-216::54-248
GTLEELLEEENLYLNIEKGEQGRLPVMILKLKRSNKQRKKPVVVFLHSSYTNKESMRPFLKAYASRGYIAISVDSRYHGERATNTTTYIDVWDLIKLADYLTQRRDIDLSRIGITGISLGGMHAWFAAVADTRYAVVVPLIGVQGFRWAIDNDKWQGRVDSIKPLFEVARADLGKGAIDKEVVEKVWSRIAPGLASQFDSPYSVPTIAPRALLIVNGAEDPRCPLGGLEIPRAKATEAYRKFHCLDNFK

SEQ ID NO: 169876 - protein, 65 aa, Glycine max
  Coding DNA Sequence Number=SeqID_53098
MLDLECDALILEMFQHFLKAIRPRRVQWKKNKLGCCLNVKEAKVQWKNKHKEETRVQNNEQARGA

SEQ ID NO: 169877 - protein, 94 aa, Glycine max
  Coding DNA Sequence Number=SeqID_53099
MNFNPNKIIALNSASFVIYLLFSSCYGGGSHSNCKIQNKLAGKEAIVEAQSQSKLRSEFLQVLRSRRPTQVPLTVKPAKPVKNPLYQSLLQRGR

SEQ ID NO: 169878 - protein, 146 aa, Glycine max
  Coding DNA Sequence Number=SeqID_53100
MGLPEEPSLNHRCILNSITFTARASYYLLRWRAVSLLFSIFSTTYYCFGALATQSIFSDKDHRLRQPPSRVRCVSFRLKPPPTKALGCCWLSSSWSTLYCLRKISGVYVGLVDEADLRAMSERPSGTACCHPSSVVCHPVPHYQFH

SEQ ID NO: 169879 - protein, 47 aa, Glycine max
  Coding DNA Sequence Number=SeqID_53101
MTGSGKRRRSEALNYGYATAMCLMDEFGNFLQARTATSFLWFMKERP

SEQ ID NO: 169880 - protein, 183 aa, Glycine max
  Coding DNA Sequence Number=SeqID_53102
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=94%, HitCoverage=63%, E-value=5e-63, Identity=47%"; Hit description=CjMDR1
  Pfam annotation: Domain name=ABC_membrane; Domain location=1-183; Score=-11.8; E_value=0.0038; Accession=PF00664.13; Description=ABC transporter transmembrane region
MYKKTHEVACWVSTGERQAARIRGLYLRAILRQDISFFDKETNTGEVVGRMSGDTLLIQEALGEKVGKFIQCVACFLGGLVIAFIKGWLLTLVLLSCIPPLVISGSMMSFAFAKLASRGQAAYSEAATVVERTIDSIRQVASFTGESQAIAQYNQSLTKAYRIAVQDGVVAGLGLGSILNQSL

SEQ ID NO: 169881 - protein, 43 aa, Glycine max
  Coding DNA Sequence Number=SeqID_53103
MDVHIVTRETPKARPGELKLSAKAMSSPRRVGCFTMKSFGGPG

SEQ ID NO: 169882 - protein, 373 aa, Glycine max
  Coding DNA Sequence Number=SeqID_53104
  Gene Ontology: Mol. function=nucleic acid binding; Cellular component= mitochondrion; Biological process=DNA integration
  Homolog annotation: Hit_ID=Q1RWP6; Match level="QueryCoverage=98%, HitCoverage=28%, E-value=1e-104, Identity=49%"; Hit description=Zinc finger, CCHC-type; Polynucleotidyl transferase, Ribonuclease H fold
MDVNNAFLHGAISEDVYMSQPSSSIHPYFPNHICKLHKALYGLKQAPQAWYQELKSFVVASGFFNVKYVSSLFIYKQDHVIAYFLVYVDDLLLTGNDVTFLAKFKATLATKFSLKDLGTPSHFLGVELLPTANGMFLSREHYIRDILQKGNMIDSKPIGTLMSTTCSLSSHNDTPNCDSSLFCSIIGSLHYSSITRLDVAFAVNKMSQYMQSLTTTHMQALKRILRYLKHTISHGLQLVSTKNLDFTVFCDADWGGDTNDKKFTGVYIVYLDPNAISWSCKIQSTIARSLTEAENRIIGLMASELLWLQQLLLELGIKLTKQPTIFSDNIGATYLCTNPIFHSRMKHLAIDYHFVRDIVVKGELKASHVPSSH

SEQ ID NO: 169883 - protein, 307 aa, Glycine max
  Coding DNA Sequence Number=SeqID_53105
  Gene Ontology: Mol. function=nucleic acid binding; Cellular component= chromatin; Biological process=DNA integration
  Homolog annotation: Hit_ID=Q1SIQ0; Match level="QueryCoverage=89%, HitCoverage=87%, E-value=4e-41, Identity=35%"; Hit description=Zinc finger, CCHC-type
MAPTTSTTTNELKELMEFNNNFQFPIKLTATNYPAWYKQAMLPEKKICPPATVGSGDAAAPNPAYSLWIRQDKLIYLAFLGSCDSEARSVMAVADTSCDAWVALARAFSNRSQSRIMSLRECLSSITKGTSSIFTYLLSIHNIVDELALIGNPIDDLEMVIHTLYGLGPTFREFTASIRTRDSPIAFNKLYDKLVDFEMYLQCEERLSTPIPVTANVVQCHQHGQGRGHSFHGRQHNHHVHSSVSSCNKKPTNPITCQYCEKPGASRHIANDLTNLTLKDDYHGNDNLQVTNGKGPMNEGASSARIE

SEQ ID NO: 169884 - protein, 57 aa, Glycine max
  Coding DNA Sequence Number=SeqID_53106
MDFGSCFYVTQEEFNLFHRMDRELYKILVVSLFRDPEESMQVHAMWLWLERVGFRNV

SEQ ID NO: 169885 - protein, 319 aa, Glycine max
  Coding DNA Sequence Number=SeqID_53107
  Gene Ontology: Mol. function=lyase activity; Cellular component =anchored to membrane; Biological process=pathogenesis
  Homolog annotation: Hit_ID=Q9M3D5; Match level="QueryCoverage=88%, HitCoverage=85%, E-value=1e-127, Identity=74%"; Hit description =Pectate lyase-like protein
  Pfam annotation: Domain name=Pec_lyase_C; Domain location=107-273; Score=122.4; E_value=1.2e-33; Accession=PF00544.9; Description =Pectate lyase
  Subcellular localization annotation: CTP_CleavageSite=51; ConfidenceScore=5.45e-01
MGNAHHSQWHRKHGNSVLPPHKYNPQPPPTTSNSNMLSLPYTHVDTTLRSLAAQAEGFGRFAIGGLHGPLHHVTSLADDGPGSLRNACRRKEPLWIVFEVSGTIQLSSYLNVSSHKTIDGRGQRIKLSGKGLRLKECEHVIICNLEFEGGRGHDVDAIQIKPNSKHIWIDRCTLSDFDDGLIDITRESTDITISRCHFSQHDKAMLIGADPSHVGDRCMRVTIHHCFFNGTRQRQPRVRFAKVHLYNNYIRNWGIYAVCASVESQIFSQHNIYEAGQKKVAFKYLTEQAADKEVGATGTIMSEGDIFLNGAKAGLMAVD

SEQ ID NO: 169886 - protein, 202 aa, Glycine max
  Coding DNA Sequence Number=SeqID_53108
  Homolog annotation: Hit_ID=Q1RYY9; Match level="QueryCoverage=91%, HitCoverage=73%, E-value=1e-14, Identity=28%"; Hit description =Immunoglobulin/major histocompatibility complex
MSCLFSSESSEIPLLQSLVEKEISLQFVYENRSSALQGVAKVMQDVCVRAFTDIMEQAMIRNSAEAAAQKVVTTTRQSSSSSSSSENYNYHHGLVWFGSIGPAEDRTLFVTFSKGYRVEEWEVREFFALAYGDCIEALFMQEVQPNEQALFARIVFRAVSTIDMILRGANKAKFIINGKHVWARKFVPKRNAIRTTLLATTL

SEQ ID NO: 169887 - protein, 611 aa, Glycine max
  Coding DNA Sequence Number=SeqID_53109
  Gene Ontology: Mol. function=RNA-directed DNA polymerase activity; Cellular component=exocyst; Biological process=exocytosis
  Homolog annotation: Hit_ID=Q1S1D5; Match level="QueryCoverage=91%, HitCoverage=88%, E-value=1e-133, Identity=45%"; Hit description =Exo70 exocyst complex subunit
  Pfam annotation: Domain name=Exo70; Domain location=23-600; Score =619.0; E_value=4.1e-183; Accession=PF03081.6; Description=Exo70 exocyst complex subunit
  Subcellular localization annotation: CTP_CleavageSite=28; ConfidenceScore=5.24e-01
MRFICFEPKTQSFSFSRHTPPTSSSSPSTSTKESFEEAETLILKWNPETSAYGRVTSLFYNDKAEAMHYIHCVNMLQKTMHSLISQNASSQKLILAHNLMQMAMKTLQKEFYQILSMNRAHLDPESVSTRSSTTSTRTSFCSDSYDGGTAEEDVRESGDCISEVERVSSEAMADLKSIADCMISNGYAKECVSVYTTMRKSIVDEGIYRLNVEEFSSSKVNKMHWDVLELKIKSWLEAVKIAVRTLFAGERILCDHVFGASQSISEACFAEISRSGANLLFGFPELVAKTKKSPPEKIFRMIDMYAAIAGMWSEIESIFSLDSTTAVKSQAYGLLLGLSESVRTSLSDFATAIQKDSSKSTANFAGVHSLTVQVMNHLTTLADYSNVLSEIFFDVPPPPRSPLPESYLYSPESDNTTTTETEFSVQMARLILILLCKIDGKSRYYKEVSLSYLFLANNLRHILAKVRASNLHYVLGDDWVLNHDAKVKRLTANYERVAWGKVLSSLPENPTAEMSAAEARVMFGNFNFEFEKAYRRENTFTVPEQEFREEIKASLVRKITPIYREAYETHRIVMGTVREIREYVTFAPEDVENYMMNLFSEGRASSGSGGN

SEQ ID NO: 169888 - protein, 159 aa, Glycine max
  Coding DNA Sequence Number=SeqID_53110
  Gene Ontology: Mol. function=nutrient reservoir activity; Cellular component=apoplast; Biological process=auxin mediated signaling pathway
  Homolog annotation: Hit_ID=Q9AR81; Match level="QueryCoverage=78%, HitCoverage=66%, E-value=1e-43, Identity=68%"; Hit description =Germin-like protein precursor
  Pfam annotation: Domain name=Cupin_1; Domain location=18-149; Score =49.6; E_value=1.1e-11; Accession=PF00190.13; Description=Cupin
MDNLFFHSYYNNTGLVVCGLGIAGNTSNIIKAAVTPAFDAQFAGLNGLGISVACLDLAAGGVIPLHTHPGASELLVVIEGRILAGFISSATLSTSKLLGDVMAFPQALTIVRFSSSNPGLQILDFALFKSSFPTPLIVQTTFIDVALVKKLKGVLGGSG

SEQ ID NO: 169889 - protein, 425 aa, Glycine max
  Coding DNA Sequence Number=SeqID_53111
  Gene Ontology: Mol. function=protein binding; Cellular component =nucleotide-excision repair complex; Biological process=nucleotide -excision repair
  Homolog annotation: Hit_ID=Q9C597; Match level="QueryCoverage=88%, HitCoverage=70%, E-value=2e-59, Identity=37%"; Hit description=DNA excision repair protein
  Pfam annotation: Domain name=LRR_1; Domain location=138-161; Score =3.9; E_value=53; Accession=PF00560.23; Description=Leucine Rich Repeat
  Pfam annotation: Domain name=LRR_1; Domain location=164-187; Score =4.3; E_value=46; Accession=PF00560.23; Description=Leucine Rich Repeat
  Pfam annotation: Domain name=LRR_1; Domain location=191-215; Score =4.9; E_value=35; Accession=PF00560.23; Description=Leucine Rich Repeat
  Pfam annotation: Domain name=LRR_1; Domain location=244-271; Score =5.0; E_value=34; Accession=PF00560.23; Description=Leucine Rich Repeat
  Pfam annotation: Domain name=LRR_1; Domain location=296-318; Score =4.4; E_value=43; Accession=PF00560.23; Description=Leucine Rich Repeat
  Pfam module annotation: Pfam domain module=LRR_1::LRR_1::LRR_1::LRR _1::LRR_1; Domain location=138-161::164-187::191-215::244-271::296-318
MKKKVCDAWVPKRNQKGGEKGFFFVPSLQELCLEMLADNADAMVSLEGVPDELIRKLCNLLCDSRKMNTRFLELLLSGSPTEIRLKDCSWLTEEQFAKYFQTCDTTRLEVLQLDQCGRCIPDYALLGTLRQSPRWLPKLITLSLSGACRLSDKGLHVLASSAPALRSINLSQCSLLSSASINILADSLGSLLKELYLDDCLMIDAAQIVPGLKKLKHLEVLSLAGIQTVSDEFIKDYIIECGHNMKELILKDCRKLTDASIKGVAEHCPGLCALDLMNLDKLTDLSLGYLTNSCRALHTLKLCHNPFSDEAIAAFLEITGVSLKELSLNNIKKLLGRDKKLRTLLSRGSSLCEDNELGFIVDSCFSLRLLKIFGCSLVTDVFLNGHSNPEIQILGLKMSPLLQNVKVPEPCQGPLRYSPVSVDLV

SEQ ID NO: 169890 - protein, 108 aa, Glycine max
  Coding DNA Sequence Number=SeqID_53112
MPETIRRAMPNDVGGIFRRIVGANEEAESMKIEKFKQLRRRLVKEHALLTFDLEEAISLSALLLEEGGGFEFIRRVCNIPSEGIQTVSNKEKLCTAKHKLLSLPPDDD

SEQ ID NO: 169891 - protein, 308 aa, Glycine max
  Coding DNA Sequence Number=SeqID_53113
  Gene Ontology: Mol. function=N-acetyltransferase activity; Biological process=metabolic process
  Homolog annotation: Hit_ID=Q10R02; Match level="QueryCoverage=62%, HitCoverage=65%, E-value=3e-34, Identity=40%"; Hit description=GCN5 -related N-acetyltransferase, putative, expressed
MSLLKSPRDPKEAKVLVRLECGALMAMCMLQCVVLMLSCAVHSCWVKDYEELEAEKAASARKRSRRIAEVQEESMANATKMAEIKAKELDEKMKSKTIDTDFLTKKKKQVSVQLPSLTSPVSTVRFCDLNFGRLQPSDDELDPHNRFEFGNFVARQALLHEEYWTAAWLRAEEWASRTHKLYDTEFDAIKKRCKEQQDGQSSTCIITVRKQDKNVKRSIISSVVGTLDLNIRYLRLGETFPGEPVDAPRFCKIERTPSSRYGYIANLCVAKSVRRKGIASNMLYFAVESAKSSGNMNINVRVTFTTNV

SEQ ID NO: 169892 - protein, 189 aa, Glycine max
  Coding DNA Sequence Number=SeqID_53114
MESVPNPNGEEPTSWDELYNINLMPSELFLKFRKELQGIRVGLNMEFYNAPVNEYQAKLVLKPLTPEWKWKIIYEPLHQDVRVLSKKIPITKFLNLQVGVGHNFQMHATGWKWKLTTCLGGDGISRIRNKTSVGLFPGFDLRFGWRADYVLPEITGALGTDEPMFNMHSGRLQASLDRVEAILTHTDAP

SEQ ID NO: 169893 - protein, 607 aa, Glycine max
  Coding DNA Sequence Number=SeqID_53115
  Gene Ontology: Mol. function=nucleotide binding
  Homolog annotation: Hit_ID=Q9FH12; Match level="QueryCoverage=92%, HitCoverage=92%, E-value=1e-170, Identity=55%"; Hit description=Axi 1 (Auxin-independent growth promoter)-like protein
  Pfam annotation: Domain name=DUF246; Domain location=235-567; Score =369.1; E_value=6.9e-108; Accession=PF03138.5; Description=Plant protein family
  Subcellular localization annotation: CTP_CleavageSite=73; ConfidenceScore=5.64e-01
MAIFSESNHHHNTSDGVSQRVNSPRFSGPMTRRAHSFKRNNNNIAANTAATTSHGGAGGSGAGEVELQINSPRSEEASEGVPVGKHSHHHVTQRVHVRGLLKKPLASIVEDLGLRERKKIGHWMFLVFCGVCLFMGVLKICATGWLGSAIERTQSNKELSDSIASLNLMDKSSLGYAYRGGASDVERTLKTVATGDGSHTAMTEDSGIWSKPNSDNFTKCIDLPKLDAKTNGYILVNANGGLNQMRFGICDMVAVAKIMKATLVLPSLDHTSYWADDSGFKDLFDWKHFINMLKNDVHIVEKLPPAYAGIEPFPKTPISWSKAVSWVRIRKQPLCICKGKAAYNIPPPYLRIAKSLWAMGIQLEDTGFESHIGSARFFCGIYKAPDSLTAKDMLAFTGCSHNLTAEEDEELRQMRYEVGHWKEKEINGTERRLLGGCPLTPRETSLLLRALDFPSHTRIYLVAGEAYGRGSMKYLEDDFPNIFSHSSLSSEEELNSFKNHQNMLAGIDYVVALKSDVFLYTYDGNMAKAVQGHRRFENFMKTINPDKMNFVKLVDQLDEGKISWKKFSSKDVFVKQDSSRDSPEDCLSYDGTANAIKRHCGCAAIFF

SEQ ID NO: 169894 - protein, 131 aa, Glycine max
  Coding DNA Sequence Number=SeqID_53116
MAVTRACQRSKRSLTEQLSRTEKNMLTIIDQYKEKLSLAISHGQRLEDEHVKVSTLQVEREARERVIESFHEEAVKWMDRFALTLNGSQEIPRLLARANAMADVYSAPEEVHKLFDYCQHMVELMSHIISD

SEQ ID NO: 169895 - protein, 113 aa, Glycine max
  Coding DNA Sequence Number=SeqID_53117
MESNSKKRKATKDEGEKWKKKFRKTLLPEEEGCLPEEPSSGNIPDDVFPESIPDFFRNHKIYFRKKVLPENETSEMIPEEGSSGKRLRGRAFSPIHCLLGAPTILLGARSNSQ

SEQ ID NO: 169896 - protein, 279 aa, Glycine max
  Coding DNA Sequence Number=SeqID_53118
  Gene Ontology: Mol. function=metal ion binding; Biological process =metal ion transport
  Homolog annotation: Hit_ID=Q7XZS3; Match level="QueryCoverage=93%, HitCoverage=94%, E-value=4e-29, Identity=34%"; Hit description =Putative chloroplast-targeted copper chaperone
  Pfam annotation: Domain name=HMA; Domain location=198-257; Score =53.6; E_value=6.4e-13; Accession=PF00403.16; Description=Heavy-metal- associated domain
  Subcellular localization annotation: CTP_CleavageSite=17; ConfidenceScore=5.18e-01
MKRIDMFCASQASTAICLSMEQASCSSSNSILLGGRTMDRHNPIINDSRRSTSKSLTAPCSSSQSPINPKPYHELHKAKKNSSSKNAAKGHDNHHQKKSTAEKLTEHVTNTSKPVDGIVRRGWLKPPANLITPPGSTRSLLSDTALLDGSSDFDPVLALTTTVNNKTSQVGHQDEANPVSKLSSSSHPKSGSSDQVVVLRVSLHCKGCEGKVRKHLSRMQGVTSFNIDFAAKKVTVVGDVTPLSVLASISKVKNAQLWPASASAVGSGTVETKRKTLSY

SEQ ID NO: 169897 - protein, 422 aa, Glycine max
  Coding DNA Sequence Number=SeqID_53119
  Gene Ontology: Mol. function=catalytic activity; Cellular component =integral to membrane; Biological process=cellular metabolic process
  Homolog annotation: Hit_ID=Q1M0P2; Match level="QueryCoverage=99%, HitCoverage=99%, E-value=0.0, Identity=78%"; Hit description=UDP -glucuronic acid decarboxylase 1
  Pfam annotation: Domain name=3Beta_HSD; Domain location=114-340; Score=-107.0; E_value=4.2e-05; Accession=PF01073.9; Description=3 -beta hydroxysteroid dehydrogenaseisomerase family
  Pfam annotation: Domain name=Epimerase; Domain location=113-341; Score=164.5; E_value=2.6e-46; Accession=PF01370.11; Description=NAD dependent epimerasedehydratase family
  Pfam annotation: Domain name=NAD_binding_4; Domain location=115-326; Score=-47.9; E_value=1.5e-05; Accession=PF07993.2; Description=Male sterility protein
  Pfam annotation: Domain name=Polysacc_synt_2; Domain location=113 -387; Score=-181.7; E_value=0.013; Accession=PF02719.6; Description =Polysaccharide biosynthesis protein
  Pfam annotation: Domain name=RmlD_sub_bind; Domain location=112-410; Score=-131.5; E_value=2.6e-05; Accession=PF04321.7; Description=RmlD substrate binding domain
  Pfam module annotation: Pfam domain module=3Beta_HSD::Epimerase::NAD _binding_4::Polysacc_synt_2::RmlD_sub_bind; Domain location=114 -340::113-341::115-326::113-387::112-410
MKQLHKQTSLNHRREEEMLGSSESSPYSPKSIKHTRSLPRSINYLLREQRLLFILVGILIGSTFFIIQPTLSRMGPPEPAHTFLPRTGLARFSGTRPRTGRVPVGIGGRRQRIVVTGGAGFVGSHLVDKLIARGDDVIVIDNFFTGRKENLVHLFGNPRFELIRHDVVEPILLEVDQIYHLACPASPTNVMGTLNMLGLAKRIGARFLLTSTSEVYGDPLEHPQKETYWGNVNPIGERSCYDEGKRTAETLAMDYHRGAGVEYFPKNSYVRIARIFNTYGPRMCLDDGRVVSNFVAQAIRKQPLTVYGDGKQTRSFQYVSDLVNGLVALMESEHVGPFNLGNPGEFTMLELAQVVKETIDSSATIEYKPNTADDPHMRKPDISKAKELLNWEPKIPLREGLPLMVNDFRNRILNENEGKGMK

SEQ ID NO: 169898 - protein, 122 aa, Glycine max
  Coding DNA Sequence Number=SeqID_53120
MTLGVMVACPSELLLQLEVTLLAQLAFNTIEDFESHESIKTRTLSPMKDKGEDFESYERQARTLSPVKDKGRTLSPVKDKVRTLSPMKDKVRNLSPVKDKVRTLSLVKDKVRTLSPVKQANR

SEQ ID NO: 169899 - protein, 548 aa, Glycine max
  Coding DNA Sequence Number=SeqID_53121
  Gene Ontology: Biological process=regulation of transcription
  Homolog annotation: Hit_ID=Q1SWC6; Match level="QueryCoverage=68%, HitCoverage=64%, E-value=2e-72, Identity=42%"; Hit description =Tesmin/TSO1-like, CXC
  Pfam annotation: Domain name=CXC; Domain location=244-285; Score =87.2; E_value=5.2e-23; Accession=PF03638.5; Description=TesminTSO1 -like CXC domain
FAEAFSARFGNATPYGELLRAVTLQFKSLFYEIGFSSLPKDGTERNGVGFSSEEIGSPIEFRRRLRRSVAPETASTVTVTVTATAVAFSVAIAIGFAAAGATAVVMFRAAGTTGVVIFTAAEASFAGSTNSAPREEASGEGVASGVSTLKAQTKLKRKENGSVFGLPCLNDKEYSDRAQVYHSGIYCDGCNCVNCHNNVDNEAARQEAVGITLERNPNAFRPKIASSPLERRDSKECEIQVIGKHNKGCHCKKSGCLKKYCECFQANILCSENCKCMDCKNFEGSDERRAIFHKDYNLVHIKQAANATISRVAGSSGYGTHLTPKKRKIHEMFPGKSAMDQTDNITAQYQQEIDPMASSPSFLSDSFVSDPSNTRISASSRSTYRSVLADFFQPQNVKNLCSLFVVLSQVAAKTNAEMIGKVDQQTKTGNFEASVASSSKSLQETRDVHQLVCDDHVNKDEADAVDIANYNRPLSPETLALMCDEQDDMIFGNSSANGVACNSTLQNMIQKSSNSDGCTDVCREQERLILTKFLDVLRGLVTHGSIKG

SEQ ID NO: 169900 - protein, 1029 aa, Glycine max
  Coding DNA Sequence Number=SeqID_53122
  Gene Ontology: Mol. function=protein binding; Cellular component =integral to membrane; Biological process=electron transport
  Homolog annotation: Hit_ID=UPI000065D5E2; Match level="QueryCoverage =97%, HitCoverage=99%, E-value=2e-95, Identity=26%"; Hit description =UPI000065D5E2 related cluster
  Pfam annotation: Domain name=DUF1620; Domain location=736-1028; Score= 564.0; E_value=1.5e-166; Accession=PF07774.3; Description=Protein of unknown function (DUF1620)
  Pfam annotation: Domain name=PQQ; Domain location=146-183; Score=8.7; E_value=1; Accession=PF01011.11; Description=PQQ enzyme repeat
  Pfam annotation: Domain name=PQQ; Domain location=55-92; Score=4.0; E_ value=4.5; Accession=PF01011.11; Description=PQQ enzyme repeat
  Pfam annotation: Domain name=PQQ; Domain location=96-135; Score=6.6; E_value=1.9; Accession=PF01011.11; Description=PQQ enzyme repeat
  Pfam module annotation: Pfam domain module=DUF1620::PQQ::PQQ::PQQ; Domain location=736-1028::146-183::55-92::96-135
MAMAIRVFLILLLSLSSTHLSYSLYEDQVGLMDWHQQYIGKVKHALFHTQKSGRKRVLVSTEENVVASLDLRHGEIFWRHVLGTNDIVDGLDIALGKYVITLSSDGSILRAWNLPDGQMVWESFLQGSVASKSILYIPKNLKADKDDLILVFGKGCLHAVSSIDGEVLWKKDFVGESIEVNHIIQSTDEIYVAGFVGSSKFYVYQLNAKNGELLNNDHKTLACDTFGELLSVSGDKFVVLDKTRSKILTLNIKNGGISYKQKPISDLIKDSSGQAVILPLRLPELFALRINSLVLLIKVTNEGELVLVDKIDNAAAVSDALSISEGQHAFAFVQHEDSKIHLFVKDVNDWNGDLLKERVVIDHQRGNIDKIFINNYVRTDRSYGFRALMVMEDHSLLLVQQGEIVWSREDGLASVVDVTTSELPVEKEGVSVAKVEQNLFEWLKNSQQWAHALHGKKPSTHKIKIQNCTSLSQRLGIEVFMWISLITFLTGHVLKLKGTLMIASPEDVVAIQALRLRSSEKSKMTRDHNGFRKLLIVLTRAGKVFALHTGDGRVVWSILLHTLRKTEVCEHPIGLNIYQWQVPHHHALDENPSILVVGRCGPSLAAPSVLSFIDAYTGKELNSLSLAHTVAQVIPLPYTDSTEQRLHLIIDTNQHAYLYPRTPEAIGILQREFSNVYWYSVDADNGVIRGHALKSNCIHKVVDEYCFDFRDLWSIVFPSESEKIIATVTRKSNEVVHTQAKVMTDHDVMYKYVSKNVLFVANAAPKARGEIGTATPEEALLVIYIIDTVTGRVLHRMAHHGCQGPVHAVFSENWVVYHYFNLRAHRYEMSVVEVYDQSRADNKDVWKFVLGKHNLTSPISSYYRPEVVTKSQSYFFTHSVKAIEVTSTAKGITSKQLLIGTIGDQVLALDKRFLDPRRTLNPSQAEKEEGIIPLTDSLPIISQSYITHSLKVEGLRGIVTVPAKLESTSLVFAYGVDLFFTQIAPSRTYDSLTEDFSYALLLLTIVALVAAIFVTWVLSQRKDLQEKWR

SEQ ID NO: 169901 - protein, 433 aa, Glycine max
  Coding DNA Sequence Number=SeqID_53123
  Gene Ontology: Mol. function=galactosylgalactosylxylosylprotein 3 -beta-glucuronosyltransferase activity; Cellular component=membrane; Biological process=cellulose and pectin-containing secondary cell wall biogenesis
  Homolog annotation: Hit_ID=Q4VZ81; Match level="QueryCoverage=81%, HitCoverage=98%, E-value=2e-99, Identity=49%"; Hit description=Beta1, 3-glucuronosyltransferase
  Pfam annotation: Domain name=Glyco_transf_43; Domain location=199 -412; Score=240.5; E_value=3.7e-69; Accession=PF03360.6; Description =Glycosyltransferase family 43
  Subcellular localization annotation: CTP_CleavageSite=13; ConfidenceScore=5.68e-01
MASIRRTLSPVPRVGTVANGEVCSVASPLSKSSSSPQNFSPSVGLDYRALVFGVFSPRSFWALERSKPRGQLWRKVLFHFFICFIVGVSMGLIPLASTHMSSNIMPKQQAFSFEMISAVGNFQPFENVKINVTPSIDKAVNFNATFYSTVKEQELIDGVAYNVSDSQISENPSLESQKLLIIVTPTYNHLFQAYYLHRLSQTLKLVPPPLLWIVVEMTSQSEETADILRSSGIMYRHLVCKTNLTNPSHRSILQRNVAMAHIEIHRLDGIVYFADDDNIYSLDLFQQMRETRRFGTWTVARLSGDKSSIVLQGPICNGSRVIGWHTNESNGKSKRFHAEMPGFSFNSTILWDPKRWHRPTLEPIRQLDSVKESLWVSTLIEQVVEDESQMEGLMHNCSRVMVWQIDLESSYSSYPQKWIAKNNLDAIVHLPLV

SEQ ID NO: 169902 - protein, 78 aa, Glycine max
  Coding DNA Sequence Number=SeqID_53124
MWHVLDFVEFVAGAGMSQLAPGISVLKKLSEIKGNEKKQQKKEKKKGLQSREKGAHIASLQSQSTLAQQEGGYLPLKI

SEQ ID NO: 169903 - protein, 75 aa, Glycine max
  Coding DNA Sequence Number=SeqID_53125
MICGTYRSYYHDKNYYQLMKIEHNRFPIETKDGDQEAQFKSSCKTLGQGEAALVDMLAMVDSGRSGQKDAYQAYI

SEQ ID NO: 169904 - protein, 997 aa, Glycine max
  Coding DNA Sequence Number=SeqID_53126
  Homolog annotation: Hit_ID=Q10N70; Match level="QueryCoverage=87%, HitCoverage=89%, E-value=1e-49, Identity=24%"; Hit description =Expressed protein
  Subcellular localization annotation: CTP_CleavageSite=51; ConfidenceScore=5.08e-01
MDVVSNVRHTWFCFVASSIRIPSSLFMIPDGQIAPQQVQGSTLLHPPTPTTSSSRSRLKLEESLLKNNNYVLFSHRLSLRHGNKEVHRQRQPLNLLSPDSGSSSGGVADKDSFSSKFGWRSTKQLFGTPIKKLLAEEMSPRAESKRRSPGVIAKLMGLDGLPFQQPTNKQHNKGLSVNQQKTAQLEKTRSKGVLYSGQSSRGCSKDQQEFKDVFEVSEIPKVESPRYPSQGCADLMSTDAEISFIEQKFMDAKRLATHQDLQSSKDFCDTLEVLDSNKDLLLKYFKRPDSLFKKHLNDLQAAPIQSHYGHVEAMDIEKYDHDFNLMLDGEKTRLNYNRSSHEKHHDGYPCDLDKRHVMHISPKSSKLLFKGTYEQKAVTSQIVLLKPNLGKVQNGTRIVSSPCSSHNFLSGRENDTELCQPTNLPESAMSWRQDSFESREIAKEVTRQMKISLHSGGMKLSTSRIRGYAGDDSSCSVSGNESPEESEETTATLGNSIDLNNRSRRSSRSSESSVSREAKKRLSERWKMTHKSQELQGISRSNTLAEMLAVPDKVLKAANSYSMASGEGFHDKFTPNSQPSKWVEPLGISSRDGWKDGCIGSLSRSKSLPSSSAAFGSPRRFMRTEALLDERFMVPKEAHRCERRRSGHKKSRSLHSSIPNKLKISLKDSPKLEVLASESLSEIVRDAVDDDVTSESKVGSEPSTKVLPESSSHLLTKDNSSADLDNSIHQDLSAGSSGGSSVLNEPPVRVPGLEASCCKDADQPSPVSVLESSFTDDVSSCSDCFESLNNDLQGLRMQLQLLKLESDEYVEGPMVVSDEDGGEASTGMLEDKGLRRTEDSWECSYIIDVLSESGIDGAQPDTILELWHSLECPVSLSVFDELEKRYGDWTTCSRSQRRLLFDRINLGIVKINEQCTHALPWVGPVTANVIGSNLNKNGFRDGLLRMLVREGKVKGDALGKVLVMESEWLDLRDDIDVVGREVERMLLDDLVSEIIGT

SEQ ID NO: 169905 - protein, 83 aa, Glycine max
  Coding DNA Sequence Number=SeqID_53127
MGKKKNQQVNTLPNKEVKKGETKKKVTKIQFLKGVDLLNNLVAIDCEGGGKHRTGGLAILGKNSIDVEVRSFSLSHNHGEKPT

SEQ ID NO: 169906 - protein, 135 aa, Glycine max
  Coding DNA Sequence Number=SeqID_53128
MDKGKKKVEDDDEDPIVVLSNDEVDHVLRECDKRNEEFDDEELENYPFGPNLRGLSTRTKAQISRHQWMIRLMKKEKKEGPIKEQRMRPLVPCGPLFREHFPSAGRTIKGNNQTFWSEYRGDQECIKEAYREKWT

SEQ ID NO: 169907 - protein, 398 aa, Glycine max
  Coding DNA Sequence Number=SeqID_53129
  Gene Ontology: Mol. function=transcription regulator activity; Cellular component=nucleus; Biological process=regulation of transcription
  Homolog annotation: Hit_ID=Q2HUL6; Match level="QueryCoverage=78%, HitCoverage=68%, E-value=1e-72, Identity=53%"; Hit description=Helix- loop-helix DNA-binding
  Pfam annotation: Domain name=HLH; Domain location=234-281; Score =37.3; E_value=5.4e-08; Accession=PF00010.16; Description=Helix-loop -helix DNA-binding domain
MERYTLPAPPNIIPEEEENIAIAMGAPLIPSFKSMLQQHPQQLDSYFNSSISSTTIPFVPNMDSFLSLDPFSPSFFNNSSSSSNMALDPGFDLGLDTGLHSSAPAPHLFSQAQMMGFEFSELEALAGPGNVNVPFADGAKAAALLRSPHFEPPQQQPTLYRKRRGTAAEIPGLEMVRRKGRKWQEGGGEGEEGSSADVGGSGLNYESDEQNESNGLKLSENGGDNKGKKKGLPAKNLMAERRRRKKLNDRLYMLRSVVPKISKMDRASILGDAIDYLKELLQRINDLHHELESTPPGSSLTPSSSTSFQPLTPTLPTLPCRVKEELYPGTLPSPKNQAAKVEVRVREGRTVNIHMFCTRRPGLLLSTMKALDNLGLDVQQAVISCFNGFALDVFKAEV

SEQ ID NO: 169908 - protein, 133 aa, Glycine max
  Coding DNA Sequence Number=SeqID_53130
  Gene Ontology: Mol. function=RNA-directed DNA polymerase activity; Cellular component=extracellular region; Biological process=RNA -dependent DNA replication
MLLNIKDVSHHGSYLGEGVEKTERVERKLLVKVGKETLIKAIIQSIPTYIMNYFKLPYALCEDIERMIARFYYGVTLKPRNCIGFTGTSYLNLNLMVDWIFVGYTFSTKAFLAMQLWRLIEEEKNLASRVIKA

SEQ ID NO: 169909 - protein, 210 aa, Glycine max
  Coding DNA Sequence Number=SeqID_53131
  Gene Ontology: Mol. function=RNA-directed DNA polymerase activity; Cellular component=extracellular region; Biological process=RNA -dependent DNA replication
MANTLQRASWVDSVVSTLPRHKFEKLWLEREHECEKVISHFWDKGDDSVQSLKRTTSNLMAWGNDSLGNIPKQIKILKKKVEQFQGKEQRSRASWLKNRDKNNVFFHQKASQRQITNSIRKIKNSNGDIITKEKGIELVISNYFAGLFKSSQPQDIDAVTSLVVGRVSEGHCATLNWEFFREEVWDAFHQMHFTKALGPDEALVVFSYWG

SEQ ID NO: 169910 - protein, 748 aa, Glycine max
  Coding DNA Sequence Number=SeqID_53132
  Gene Ontology: Mol. function=catalytic activity; Cellular component =intracellular; Biological process=metabolic process
  Homolog annotation: Hit_ID=Q60D18; Match level="QueryCoverage=99%, HitCoverage=96%, E-value=0.0, Identity=49%"; Hit description =Pentatricopeptide repeat domain containing protein, putative
  Pfam annotation: Domain name=PPR; Domain location=139-173; Score =39.1; E_value=1.6e-08; Accession=PF01535.11; Description=PPR repeat
  Pfam annotation: Domain name=PPR; Domain location=240-274; Score =24.5; E_value=0.00038; Accession=PF01535.11; Description=PPR repeat
  Pfam annotation: Domain name=PPR; Domain location=341-375; Score =36.6; E_value=8.7e-08; Accession=PF01535.11; Description=PPR repeat
  Pfam annotation: Domain name=PPR; Domain location=376-410; Score=7.3; E_value=1; Accession=PF01535.11; Description=PPR repeat
  Pfam annotation: Domain name=PPR; Domain location=38-72; Score=45.6; E_value=1.6e-10; Accession=PF01535.11; Description=PPR repeat
  Pfam annotation: Domain name=PPR; Domain location=442-476; Score =44.1; E_value=4.8e-10; Accession=PF01535.11; Description=PPR repeat
  Pfam annotation: Domain name=PPR; Domain location=477-510; Score =10.5; E_value=0.42; Accession=PF01535.11; Description=PPR repeat
  Pfam annotation: Domain name=PPR; Domain location=513-547; Score =15.2; E_value=0.12; Accession=PF01535.11; Description=PPR repeat
  Pfam annotation: Domain name=PPR; Domain location=580-614; Score=2.2; E_value=4.1; Accession=PF01535.11; Description=PPR repeat
  Pfam module annotation: Pfam domain module=PPR::PPR::PPR::PPR::PPR::PP R::PPR::PPR::PPR; Domain location=139-173::240-274::341-375::376 -410::38-72::442-476::477-510::513-547::580-614
  Subcellular localization annotation: CTP_CleavageSite=29; ConfidenceScore=5.30e-01
MPHKNVISTNTMIMGYLKSGNLSTARSLFDSMVQRSVVTWTMLIGGYAQHNRFLEAFNLFADMCRHGMVPDHITLATLLSGFTEFESVNEVAQVHGHVVKVGYDSTLMVCNSLLDSYCKTRSLGLACHLFKHMAEKDNVTFNALLTGYSKEGFNHDAINLFFKMQDLGFRPSEFTFAAVLTAGIQMDDIEFGQQVHSFVVKCNFVWNVFVANALLDFYSKHDRIVEARKLFYEMPEVDGISYNVLITCCAWNGRVEESLELFRELQFTRFDRRQFPFATLLSIAANSLNLEMGRQIHSQAIVTDAISEVLVGNSLVDMYAKCDKFGEANRIFADLAHQSSVPWTALISGYVQKGLHEDGLKLFVEMHRAKIGADSATYASILRACANLASLTLGKQLHSRIIRSGCLSNVFSGSALVDMYAKCGSIKEALQMFQEMPVRNSVSWNALISAYAQNGDGGHALRSFEQMIHSGLQPNSVSFLSILCACSHCGLVEEGLQYFNSMTQVYKLEPRREHYASMVDMLCRSGRFDEAEKLMARMPFEPDEIMWSSILNSCRIHKNQELAIKAADQLFNMKGLRDAAPYVSMSNIYAAAGEWDSVGKVKKALRERGIRKVPAYSWVEIKQKTHVFSANDTSHPQTKEITRKLDELEKQMEEQGYKPDSTCALHNVDEEVKVESLKYHSERIAIAFALISTPKGSPILVMKNLRACNDCHAAIKVISKIVNREITVRDSSRFHHFTDGSCSCKDYW

SEQ ID NO: 169911 - protein, 181 aa, Glycine max
  Coding DNA Sequence Number=SeqID_53133
  Gene Ontology: Mol. function=nucleic acid binding; Cellular component= intracellular; Biological process=regulation of transcription
  Homolog annotation: Hit_ID=Q1T1Z0; Match level="QueryCoverage=96%, HitCoverage=98%, E-value=8e-37, Identity=50%"; Hit description=Zinc finger, C2H2-type
  Pfam annotation: Domain name=zf-C2H2; Domain location=44-66; Score =17.8; E_value=0.038; Accession=PF00096.16; Description=Zinc finger, C2H2 type
  Pfam annotation: Domain name=zf-C2H2; Domain location=99-121; Score =16.6; E_value=0.089; Accession=PF00096.16; Description=Zinc finger, C2H2 type
  Pfam module annotation: Pfam domain module=zf-C2H2::zf-C2H2; Domain location=44-66::99-121
MAMKRHRENEGTTLESWGMQNCSISITPDTTSVSSSTTSPEEVFECKTCNRKFNSFQALGGHRASHNKRVEMEGEEQQLKLKNKGKIYGLGKQSEPKIHNCFICGQGFSLGQALGGHMRRHRDATNDVFSSINQVVAKVSVLKRSCNGKVFCLDLNLSPLENDLKLLLFGKVSPKVNPSSF

SEQ ID NO: 169912 - protein, 413 aa, Glycine max
  Coding DNA Sequence Number=SeqID_53134
  Gene Ontology: Mol. function=phospholipid binding; Cellular component= coated pit; Biological process=endocytosis
  Homolog annotation: Hit_ID=Q1T1Z0; Match level="QueryCoverage=41%, HitCoverage=98%, E-value=1e-41, Identity=55%"; Hit description=Zinc finger, C2H2-type
  Pfam annotation: Domain name=ANTH; Domain location=164-413; Score =53.0; E_value=1e-12; Accession=PF07651.6; Description=ANTH domain
  Pfam annotation: Domain name=zf-C2H2; Domain location=47-69; Score =18.7; E_value=0.021; Accession=PF00096.16; Description=Zinc finger, C2H2 type
  Pfam annotation: Domain name=zf-C2H2; Domain location=91-113; Score =20.3; E_value=0.007; Accession=PF00096.16; Description=Zinc finger, C2H2 type
  Pfam module annotation: Pfam domain module=ANTH::zf-C2H2::zf-C2H2; Domain location=164-413::47-69::91-113
MVAILKRQGENESEETIIGLAKSLMQLSRVQQQSNKPLLKTFSPTEFECKTCNRKFSSFQALGGHRASHKKPKFEAEELKEEAKKTKPKMHECSICGMEFSLGQALGGHMRKHRGAISENDNNNEALSSIKQAIAKAPVLKRSNSKRVMCLEMDLNLTPLENDLKLLFGNKAPRVDLSLPSITRFHNLCFVFLFTLDSTNASLVTISKRSNKTRDWIVAIKALLLVHRLLLDAHPAFQDEIMHSTHLGTSRILNMSNLRDNMPSNSSNQVGFVKVYSLYLDVKVDFVAYRRKLSDGVVESVEFRDKFGSAERGRNEVTLVREMGAERVLKRLNCLLRMLDRVLGCRPSGATKNNSLVLVALYQVVRDSFKLYAEVCDVLGVLLDRFSPRWSMSIVLLDRCVKAFFNSVQRLVA

SEQ ID NO: 169913 - protein, 640 aa, Glycine max
  Coding DNA Sequence Number=SeqID_53135
  Gene Ontology: Mol. function=nucleic acid binding; Cellular component= beta-galactosidase complex; Biological process=DNA integration
  Homolog annotation: Hit_ID=Q1RSG2; Match level="QueryCoverage=90%, HitCoverage=46%, E-value=0.0, Identity=53%"; Hit description =Integrase, catalytic region; Zinc finger, CCHC-type
MFCTKKLKFFGAIFTTSICAKSYRLSCFIFNTCFEAFKCRKRLVKRKKLDDKAEKCVFLGVSEVSKALTKKIVISRDVVFDEENTWEWERQQPSQVIYDNDTEHEQISVPYMPENSTNSTPIAAQSHSHVRRNCDPTTFESAVKEEKWRKAMNDEIDAIERNDTWELCDLPRGQKTIGVKWVFKTKLNENGEVDKYKARLVAKGYKQQYETDYKEVFSPVARHDTIRLVVVLAAQQSWQIFQLDVKSAFLQGYLEEQVYVDQPPGYVKIGTEEKVYKLKKTLYGLKQAPRAWYSRIESYFIQSGFSKCPYEHTLFIKTRDEGKILIVCLYVDDLIFTGNCDAMFKEFKKSMMNEFEMSDLGMMHYFLGIEVVQSNAGIFISQKKYVGEILDRFHMHPTAFGCKLHKDHEGKKVGNTFFKQIVGSLMYLTATRPNIMYSVSLVSRYMEYPTEEHLLAAKRILRYLQGTRDFGLFYKKDTKSNLLGFTDSDFAGDQDDRRSTSGYAFMFGTSAITWSSKKQPIVTSSSIEAEFVAATACACQAIWLRRILEELQFKQLEATQVFCDNNSSIKLLKNPMLHGRSKHIDVRYYFLRELTKEKIVELIHCRSEDQVADLFTKPLKLASFQKLRALLGVCTMEEAV

SEQ ID NO: 169914 - protein, 164 aa, Glycine max
  Coding DNA Sequence Number=SeqID_53136
  Gene Ontology: Mol. function=nucleic acid binding; Cellular component= intracellular; Biological process=regulation of transcription
  Homolog annotation: Hit_ID=Q1T1Z0; Match level="QueryCoverage=99%, HitCoverage=100%, E-value=3e-39, Identity=52%"; Hit description=Zinc finger, C2H2-type
  Pfam annotation: Domain name=zf-C2H2; Domain location=37-59; Score =16.0; E_value=0.14; Accession=PF00096.16; Description=Zinc finger, C2H2 type
  Pfam annotation: Domain name=zf-C2H2; Domain location=82-104; Score =21.2; E_value=0.0037; Accession=PF00096.16; Description=Zinc finger, C2H2 type
  Pfam module annotation: Pfam domain module=zf-C2H2::zf-C2H2; Domain location=37-59::82-104
MKRQRDGVESIDLVNCLMLLSHHREIKPQKLLGPEEFECMTCNRKFTSFQALGGHRASHKKPKLHVKEQGKILMLGNKPKKHECTICGREFTLGQALGGHMKKHRIAVDQGFSLINEVVVKVPFLKRSNSKRVLFLDLNLNLTPLQNDLKLLFGEKAPKVDSFV

SEQ ID NO: 169915 - protein, 133 aa, Glycine max
  Coding DNA Sequence Number=SeqID_53137
  Gene Ontology: Mol. function=kinase activity; Cellular component =integral to membrane
  Homolog annotation: Hit_ID=UPI0000545E95; Match level="QueryCoverage =79%, HitCoverage=9%, E-value=4e-13, Identity=36%"; Hit description =PREDICTED: similar to RIKEN cDNA 4732495E13, partial
  Pfam annotation: Domain name=DUF300; Domain location=4-133; Score= -47.1; E_value=2.3e-09; Accession=PF03619.7; Description=Domain of unknown function
MHPAQIVLYGSTLCVMITVHFSMKLLAEHVLNWKKPKEQKAIVIIILMAPLYAVDSYVGLINFFGSEAFFTFLDSIKECYEALVIAKFLGLMYNYLNISLSKNIVPDEIKGREIHHSFPMTLFQVVDTHKLFS

SEQ ID NO: 169916 - protein, 93 aa, Glycine max
  Coding DNA Sequence Number=SeqID_53138
MSQTTSLTDKSMHATPLRHPAIDTLPPTPLHCTHTIPVRPQLYQQHQCPSPLATYNTQILPNLTINYNNQAKFAFDLKLSSPLHMRTPIWAVW

SEQ ID NO: 169917 - protein, 208 aa, Glycine max
  Coding DNA Sequence Number=SeqID_53139
  Gene Ontology: Mol. function=DNA binding; Cellular component=nucleus; Biological process=DNA integration
PFSPLSYENVVNSLSVGKDCLTLEEVKSSPVSIQESIGTKLLEMVMRSHRFEMFYLLVEGGVMKIKGKGKFAIILASNDDSLWHMRLGHMSEKRLEILSKGYMEITRVPSLGGARCFFSIIDDYSRMTWVFMMKQQSEDEDIARQHIVRHTLQQNGLPERNNMTLLERAVNTTCYFGNCSLSIALDFKTPIEPRRVPLWAMEMELKDP

SEQ ID NO: 169918 - protein, 213 aa, Glycine max
  Coding DNA Sequence Number=SeqID_53140
  Gene Ontology: Mol. function=nucleic acid binding; Biological process= DNA integration
  Homolog annotation: Hit_ID=Q1SIY6; Match level="QueryCoverage=67%, HitCoverage=14%, E-value=2e-24, Identity=39%"; Hit description =Integrase, catalytic region; Zinc finger, CCHC-type
MELQRWLYGEADEVVEGGARGEEEGEGGRTQGKGRGRRVGGATQGKGEEGWWHKGKRKVKRDKLDKRKEPNIFIGYSLTSKAYRNFQPDTRKILISRNVSFMENERWNWNDETNQQTDDLNQEELVDHPPDIKKQKKILNGEMLCRRPRYDKKIRPGNWLKDLNIRSLLKWLLEGRNYVEQPKGFATKGDEDKVNLLKKALYGLKQAPRAWYS

SEQ ID NO: 169919 - protein, 242 aa, Glycine max
  Coding DNA Sequence Number=SeqID_53141
  Gene Ontology: Mol. function=nucleic acid binding; Cellular component= beta-galactosidase complex; Biological process=DNA integration
  Homolog annotation: Hit_ID=Q1S4N1; Match level="QueryCoverage=92%, HitCoverage=22%, E-value=3e-66, Identity=64%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=BBE; Domain location=197-238; Score =20.1; E_value=0.00026; Accession=PF08031.2; Description=Berberine and berberine like
  Pfam module annotation: Pfam domain module=BBE::RVT_2; Domain location=197-238::1-58
MMRVFETTDLGEMSNFLGIEIKQRQNEIFIYQQKYAKEILKKFYMDNCKSMSTPMCQKEKLCKDDEIAKVNKSEYRSLVGCLMYLTATRPDIMYAVSVLSRFMNCANESHPRAAKRVLRYVKGAVSFGVKFCLTPSFELQVQRSKKLWFNQQPKESSCCNTAIVISNNLVFHGKTKHFNIKLFFVRDVQKNGAVRLKYCNAEDQLTHIFTKPLAKSRLVKIKTNVDPENVFRHGQSIPPLPV

SEQ ID NO: 169920 - protein, 385 aa, Glycine max
  Coding DNA Sequence Number=SeqID_53142
  Homolog annotation: Hit_ID=Q8CME1; Match level="QueryCoverage=37%, HitCoverage=100%, E-value=3e-48, Identity=69%"; Hit description=Cell wall-associated hydrolase
MDCPAEVAGVGYKPLFPKDCGHPPPSWLFINLRWRLFQYRSLLRQAEDLNLRPSGYEPDELPGCSTPRYGPGSDLLSRVLRQSTIGAGAFHGRVRNGIGCSRSAITTRPRPRSRLAEPNWRERYKFIEVCSMDIVNGSDQVDRAISTGKLHALPHFHTRPINVMPSAVIPSIYSYPAMPLARQQVHQRYVHPGPLVLGTDPVNIPTPTADRDRTVSRRSEPSSRTALIGEQPNPWDLLQPQDAMSRHRGAKQPRRYGLLGVISLLSPAYLLSVERWPFHAGPPDHYDRLSSLLDLSVSQSGGLMPLHSTTDFRPSNYPPYTVPDPDNGPRLDIHEDKGGISRMAPQKLACTGSFRLTAGTPHLHGEFNFTESMLETAGKSLRHSC

SEQ ID NO: 169921 - protein, 128 aa, Glycine max
  Coding DNA Sequence Number=SeqID_53143
  Homolog annotation: Hit_ID=Q3PJX1; Match level="QueryCoverage=88%, HitCoverage=96%, E-value=6e-14, Identity=36%"; Hit description =Hypothetical protein precursor
MPVTRMKRLPAGIAVLAVLLMLTACASQIMKSYIGAPISSVMLDYGPPDNVYDLRPGERAYQWRQKKTQVVAGQSSGEVRQTRRGRRYEVTETPGYVEQMECLYTFYARSSGSDWYVTSFRQPSLECE

SEQ ID NO: 169922 - protein, 245 aa, Glycine max
  Coding DNA Sequence Number=SeqID_53144
  Gene Ontology: Mol. function=zinc ion binding
  Homolog annotation: Hit_ID=Q69L44; Match level="QueryCoverage=90%, HitCoverage=33%, E-value=7e-79, Identity=60%"; Hit description=SWIM zinc finger family protein-like
MWLSTMRNFPLASQEASGALEAYHVKLKAKLFDDSHLGALQRVDWLVHKLTTELHSSYWLDRYADESDSFQNVKEKYIASTSWHRALQIPDYAVSLDDKDHLFAKVVSQKDSSLTHIVWNPGSEFAFCDCSWSMQGYQPSMSFRSFQEVLMDLWKKPVDDSFALDLSLAWTHQMLDQIQKQVELNNSTDIGTVVNNMPLKWVSKKGRTYIGKPSSSLALPHGSSNTKSVVVYKKNRKRKRLSRLR

SEQ ID NO: 169923 - protein, 76 aa, Glycine max
  Coding DNA Sequence Number=SeqID_53145
MEHAMVKTASGGAPKVDKIRLNDGAPHDRIVKSHLFRTRGTSMSVRQRFIIRRLPHLTSVILSDCVYDYSIVSVLF

SEQ ID NO: 169924 - protein, 483 aa, Glycine max
  Coding DNA Sequence Number=SeqID_53146
  Homolog annotation: Hit_ID=Q9FNA6; Match level="QueryCoverage=93%, HitCoverage=92%, E-value=2e-47, Identity=30%"; Hit description =Arabidopsis thaliana genomic DNA, chromosome 5, P1 clone:MSH12
MGKSPEGLNDGDMTKDSSRIESKRAHQWFMDDPEVDMFPNKKQAVEAPNNLLSGMLNSNISLWGNSSGFHSLNGHFTEQLFAPDAATMSFEDTNTPSVSIDDKLSVERKDNVDRFGSESSFGLSISTALEDPHLVFNYDGIRKVKFNEVKESENVMPVTTNNPYDRGVSDSVSNPCLYKEEDNSISTSHAYNEEVANIITMDGTYDRTDNNFMPMSQSFNKGNDSLSIHPTFNEICNTISMDLGFSKVDSNVTSIAQGYNKVYGNSVLTNPLFKQGNDVPFVSHSYNNGESTIISFGGCDDDTTPSDLFISDYDLLMCEALSHKSEAVNVKELARSSSNLLPSTAQTSAPETENVPKSKGEIKMSRKATSNNFPSNVRSLLSTGMLDGLSVKYKAWSREVINAFEFERHAGCKTKHPNNHIYFDNGKTIYGVVQELRSTPQSMLFEVIQTITGSPIDQKSFCIWKESFLATAGNSNAYVQNKK

SEQ ID NO: 169925 - protein, 513 aa, Glycine max
  Coding DNA Sequence Number=SeqID_53147
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=97%, HitCoverage=88%, E-value=1e-144, Identity=57%"; Hit description =Inositol polyphosphate related phosphatase
  Pfam annotation: Domain name=Exo_endo_phos; Domain location=122-448; Score=148.6; E_value=1.7e-41; Accession=PF03372.13; Description =EndonucleaseExonucleasephosphatase family
MRTELKKKISKSSWPKFNVRKWLNIRSNDDNFHSDYSLPVLICFFGVKTCLPRGPWVPSERFPIESPRGWLIFWKSNWPMIKPAIAKPQEGWLMDSTNELKHSASVMEAPPVNDTDTLNLRMFVGTWNVGGKSPNEGLNLRNWLMLPSPADIYVIGYIVLSFQEIIPLNAGNVLGPEDSGPASTWLNLIHQALNSNTSSSSGENSPTCSPSEHEQQLYYCLAASKQMVGIFLCLWVRADLYKHVSNLKVSCVGRGIMGYLGNKGSISISMTLYHTTFCFVCTHLASGEKDGDEVRRNLDVSEILKKTKFSQSFKALGQSLPPESILEHDKIIWLGDLNYRLTAGYDDTLELLKKNDWKALLEKDQLRIEQRAGRVFKEWKEGKIYFAPTYKYLFGSDQYVAQTNKSKEKRRTPAWCDRILWKGEGVEQLWYVRGESKFSDHRPVYSLFSVNVDFTSNKLSPSIATSNSSSIISRSCSSRPLTNAALSSSCFAKVQAEEQLLLLTRAHRHRVLT

SEQ ID NO: 169926 - protein, 195 aa, Glycine max
  Coding DNA Sequence Number=SeqID_53148
  Gene Ontology: Mol. function=carboxypeptidase activity; Cellular component=membrane; Biological process=auxin mediated signaling pathway
  Homolog annotation: Hit_ID=Q1SU91; Match level="QueryCoverage=86%, HitCoverage=46%, E-value=9e-59, Identity=66%"; Hit description =Peptidase M14, carboxypeptidase A
  Pfam annotation: Domain name=DUF6; Domain location=21-150; Score =41.8; E_value=2.3e-09; Accession=PF00892.11; Description=Integral membrane protein DUF6
METQNWFERLKPFAAVVSIQFGYAAMDVLSKAAMNKGMSNYVFVVYRHAVAFLVMAPLAWKVRPKMTFSIFMKIAVLSWIEPVIDQNLYFLGMKYTTATFAVTITNMLPAITFIFACILRLEKIKIRSIRSQAKVVGTLTTVSGAMVMTLLKGPVLFGSHGSNDHSQHNGTISFMSNPINLVPKFKFGPKSKFGR

SEQ ID NO: 169927 - protein, 140 aa, Glycine max
  Coding DNA Sequence Number=SeqID_53149
  Gene Ontology: Mol. function=GPI anchor binding; Cellular component =anchored to membrane; Biological process=cell adhesion
  Homolog annotation: Hit_ID=Q2PGX7; Match level="QueryCoverage=81%, HitCoverage=26%, E-value=1e-39, Identity=70%"; Hit description =Putative fasciclin-like arabinogalactan protein
GECDFSVVEIGDVDEASGSGGGAGGLVHCGGEGGAIGVLVVLLGTKVVKEDMEGEDVLDGVDGGVLREKVRHGGFVDGTDGDGGFAVDFGDEVGEGEVVLKGGELRVLCEDVGDVVCVGEGGEDEQCCHEQFPKELHYRK

SEQ ID NO: 169928 - protein, 237 aa, Glycine max
  Coding DNA Sequence Number=SeqID_53150
  Gene Ontology: Mol. function=inorganic diphosphatase activity; Cellular component=cytoplasm; Biological process=phosphate metabolic process
  Homolog annotation: Hit_ID=Q6KBB0; Match level="QueryCoverage=99%, HitCoverage=100%, E-value=1e-103, Identity=78%"; Hit description =Putative inorganic pyrophosphatase
  Pfam annotation: Domain name=Pyrophosphatase; Domain location=54-229; Score=277.3; E_value=3e-80; Accession=PF00719.9; Description =Inorganic pyrophosphatase
MAPPIETPTKVSSYQHSPNPRLNERILSSISRKHVAAHPWHDLEIGPEAPKIFNCVVEIGKGSKVKYELDKRTGLIMVDRILYSSVVYPHNYGFIPRTICEDGDPMDVLVIMQEPVLPGCFLRAKAIGLMPMIDQGEKDDKIIAVCADDPEYRHYNDIKDLPPHRLAEIRRFFEDCNHLACHIKSNYFMFSLIKELDKKNENKEVAVNDFLPASAAYEAIKHSMTLYAEYVVENLRR

SEQ ID NO: 169929 - protein, 62 aa, Glycine max
  Coding DNA Sequence Number=SeqID_53151
MTVTLMAEPIITLVTRVIMVTNNDNGRIVVMLMNCICTVEGTHLFACALISKQDVMLASEKL

SEQ ID NO: 169930 - protein, 147 aa, Glycine max
  Coding DNA Sequence Number=SeqID_53152
MERGVSGSPQTKEPVASKWFLLTQPAVAGHLTPCYRLGGICRLDFQTRREWPQHGLKGSSNAHLPSYYHEYFLALGDKQNKEEQRKHYTLGIGRSIASSDNNPCNSLGGTTNSEPRTRIRTQLRQKVRTTRTTSEQSSISNLPSQNL

SEQ ID NO: 169931 - protein, 103 aa, Glycine max
  Coding DNA Sequence Number=SeqID_53153
  Pfam annotation: Domain name=zf-CCHC; Domain location=32-49; Score =27.0; E_value=3.4e-05; Accession=PF00098.13; Description=Zinc knuckle
MWDTLSLTYEGSSQKGSKKPYRETKDKDKSSIICYKCKKPGHFKSKCLNLDKSNQKKRYFKPKDKKVLMGTREELDDTSSIEETKKEEKANLFLMADPTSEGS

SEQ ID NO: 169932 - protein, 131 aa, Glycine max
  Coding DNA Sequence Number=SeqID_53154
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q43874; Match level="QueryCoverage=99%, HitCoverage=78%, E-value=2e-37, Identity=64%"; Hit description =Ribulose bisphosphate carboxylase precursor
  Pfam annotation: Domain name=RuBisCO_small; Domain location=68-131; Score=1.2; E_value=4.4e-05; Accession=PF00101.10; Description =Ribulose bisphosphate carboxylase, small chain
MASSMMSSPAVTTVNRGSMVAPFTGLKSMAGFPVRKTNYDITYHKQHWKITMHQHTMQIKVWPQIGKKFETLSYLPPLTREQLLKEDGWIPCLEFELESVPKGFVYRENHRSPGYYDGSYQCLGAQTQLRC

SEQ ID NO: 169933 - protein, 102 aa, Glycine max
  Coding DNA Sequence Number=SeqID_53155
MKFLDWYLKIGVVSALVGASMEMFMIKTGFCVRTFLSYSLITLSLPYHFLDFPFDALIFASNDKVTVLESEKRAWENSPDAQAIREALNPWRQIDTEKTKKS

SEQ ID NO: 169934 - protein, 51 aa, Glycine max
  Coding DNA Sequence Number=SeqID_53156
MDTHKNNQKKCLAKMNARCKVIKGEGDKACSGAHTESGEASCPGMKERAFT

SEQ ID NO: 169935 - protein, 88 aa, Glycine max
  Coding DNA Sequence Number=SeqID_53157
MSYYGKGINVRFHSDLKRKGAKGKGKDIFVHLSFQWDARNKNEVQEAIAFFLVDVVVYGSAKTNFVKWLRKVHNPNPNPIGVPNNITN

SEQ ID NO: 169936 - protein, 590 aa, Glycine max
  Coding DNA Sequence Number=SeqID_53158
  Gene Ontology: Mol. function=DNA binding; Cellular component=nucleus; Biological process=protein modification process
  Homolog annotation: Hit_ID=Q9FNS1; Match level="QueryCoverage=99%, HitCoverage=97%, E-value=2e-95, Identity=38%"; Hit description=MYB -like DNA-binding protein
  Pfam annotation: Domain name=Myb_DNA-binding; Domain location=498 -548; Score=20.0; E_value=0.0085; Accession=PF00249.21; Description =Myb-like DNA-binding domain
MAIRCLSFLELQGQLGGTIRKKPDSSQIQAFEILASVAGNFLQENESSNPENVVLAKDPRTLSGTNIKDKHGDERSFKGALFEHGACSEIASVFVPSMQGKHDNHRVMGDSSFLDNHLEGQGQNVPEREDERIKGRSVNGKTIHIKGCSNGLIEPGHGVSKHCSSANNVEKPSLEGRKPLDSFPKCFTSRKLVNRDDDETLDRCTQLNSKNNTSGAPPDTPKLKDASPFISDENNSRDISELESLQRMYPFKKRKFFNQTSSSASDRGSQCQGMFDSSDTIRVNGTNHAIEESSSIVGQQAHFGSRGCNVKLSIKSFKVPELFIDIPETATIGSLKRTVMEAVTAILGDELHVGILLQGKKVRDDSKTLIQTGISQDDKRHRLGFMLEPRHTQSPSSYNDDPCYPTTSSRQKLSRQSTSVTLQQGTYNVSKERSMIKIESYAEGDLNMVTSLADTSANNNMSKCRALVAVPAINMETLAVVPFRRKSENPDFAQRRIRRPFSVLEVEALVQAVEKLGTGRWRDVKQRAFDHAKHRTYVDLKDKWKTLVHTARISPQQRRGEPVPQELLDRVLAAHAYWSQQQCKHQLKPL

SEQ ID NO: 169937 - protein, 64 aa, Glycine max
  Coding DNA Sequence Number=SeqID_53159
MYKPYGWQFHKGPWPFCKSYVGDYSHTIIQVSYRFSKVFNCDGRDLMLKSILFLHYTMPSIGFK

SEQ ID NO: 169938 - protein, 82 aa, Glycine max
  Coding DNA Sequence Number=SeqID_53160
  Gene Ontology: Mol. function=RNA-directed DNA polymerase activity; Biological process=RNA-dependent DNA replication
  Homolog annotation: Hit_ID=Q2HS45; Match level="QueryCoverage=92%, HitCoverage=11%, E-value=4e-21, Identity=59%"; Hit description=RNA -directed DNA polymerase
MRFRHLHGFDLIMPEKQVWKFSTNLDAKVTKAFKAKYFPNGGFLEAPLGHNPSYIWCSIQASQTLVKEDMRWRVGDGLSINI

SEQ ID NO: 169939 - protein, 619 aa, Glycine max
  Coding DNA Sequence Number=SeqID_53161
  Gene Ontology: Mol. function=helicase activity; Cellular component =intracellular; Biological process=metabolic process
  Homolog annotation: Hit_ID=Q84TY4; Match level="QueryCoverage=99%, HitCoverage=88%, E-value=0.0, Identity=40%"; Hit description =Putative pentatricopeptide repeat protein
  Pfam annotation: Domain name=PPR; Domain location=103-137; Score=9.7; E_value=0.53; Accession=PF01535.11; Description=PPR repeat
  Pfam annotation: Domain name=PPR; Domain location=138-172; Score =33.3; E_value=8.7e-07; Accession=PF01535.11; Description=PPR repeat
  Pfam annotation: Domain name=PPR; Domain location=173-207; Score =24.0; E_value=0.00052; Accession=PF01535.11; Description=PPR repeat
  Pfam annotation: Domain name=PPR; Domain location=241-275; Score =41.0; E_value=4.1e-09; Accession=PF01535.11; Description=PPR repeat
  Pfam annotation: Domain name=PPR; Domain location=276-310; Score =53.2; E_value=8.5e-13; Accession=PF01535.11; Description=PPR repeat
  Pfam annotation: Domain name=PPR; Domain location=311-345; Score =30.2; E_value=7.3e-06; Accession=PF01535.11; Description=PPR repeat
  Pfam annotation: Domain name=PPR; Domain location=32-66; Score=15.4; E_value=0.11; Accession=PF01535.11; Description=PPR repeat
  Pfam annotation: Domain name=PPR; Domain location=346-380; Score =43.1; E_value=9.4e-10; Accession=PF01535.11; Description=PPR repeat
  Pfam annotation: Domain name=PPR; Domain location=381-415; Score =38.5; E_value=2.3e-08; Accession=PF01535.11; Description=PPR repeat
  Pfam annotation: Domain name=PPR; Domain location=416-449; Score =36.8; E_value=7.2e-08; Accession=PF01535.11; Description=PPR repeat
  Pfam annotation: Domain name=PPR; Domain location=471-505; Score =36.5; E_value=8.9e-08; Accession=PF01535.11; Description=PPR repeat
  Pfam annotation: Domain name=PPR; Domain location=506-540; Score =33.9; E_value=5.6e-07; Accession=PF01535.11; Description=PPR repeat
  Pfam annotation: Domain name=PPR; Domain location=541-575; Score =46.5; E_value=9e-11; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=103-137::138 -172::173-207::241-275::276-310::311-345::32-66::346-380::381 -415::416-449::471-505::506-540::541-575
LLDLLRRQPDESSALRLFQWASAQPNYSAHPSVFHELLRQLARAGSVDSMLSLLRQMHSSQFPVDESTFLIFLETYANSELHSEINPLIHLMERDFAVKPDTRFYNVGLSLLVQTNKLKLVETLHSKMVADAIQPDVSTFNILIRALCKAHQLRPAILMLEDMPNYGLRPDEKTFTTLMQGFIEAADVDGALRIKELMVESGCALTSVSVNVLVNGLCKEGRIEEALRFIYEEEGFCPDQVTFNALVNGLCRTGHIKQGLEMMDFMLEKGFELDVYTYNSLISGLCKLGEIDEAEEILHHMISRDCEPNTVTYNTLIGTLCKENHVEAATELARVLTSKGVLPDVCTFNSLIRGLCLTSNREIAMELFGEMKEKGCEPDQFTYGILIESLCLERRLKEALTLLKEMESSGCARNVVVYNTLIDGLCKNNRVGEAEDIFDQMEMLGVEDKRVEEAAQLMDQMIMEGLKPDKFTYTTMLKYFCQQGDIKKAADIVQNMTLNGCEPDIVTYGTLIGGLCKAGRVDVASKLLRSVQMKGLVLTPQAYNPVIQALCKRKRTKEAMRLFREMMEKGVPPDVITYKIVFRGLCNGGGSIQEAVDFTVEMLEKGILPEFPSFGFLAE

SEQ ID NO: 169940 - protein, 120 aa, Glycine max
  Coding DNA Sequence Number=SeqID_53162
MQALAPGTLQAYPLHPCTPAPLQLGTSCLANGIGETCSRGVPSQHGSRHCCWRFLHGLCLTRNNGGTLQLSNVLARNNGGTLSAQQPSRYCRWRHSYLANPAYDIHGGTDSPCKKFENRL

SEQ ID NO: 169941 - protein, 93 aa, Glycine max
  Coding DNA Sequence Number=SeqID_53163
MATLLVNGSRKMQWRVPCIRGRLLASGAGGTPTSPCISLVVLAAHPHHHASRQLCWRHAHHAATSRSFSLLTMTAHPSRQSCWRHQRKNRPPP

SEQ ID NO: 169942 - protein, 76 aa, Glycine max
  Coding DNA Sequence Number=SeqID_53164
MVLMFKPNVLGALTMDGNYVVLIVILYVHKHRRYGVRIVKSDTCKVWWEHKEWTKAVKRKKKGGKFHRQQWCKVFS

SEQ ID NO: 169943 - protein, 77 aa, Glycine max
  Coding DNA Sequence Number=SeqID_53165
MGGGGGDCVAFLWVPRKVFILKTNGDLGINTVFGRRDREKYCLFYLSGLAKFVTSGVNYLPLIMEHGSSYDWAKTLG

SEQ ID NO: 169944 - protein, 73 aa, Glycine max
  Coding DNA Sequence Number=SeqID_53166
MEKSGGKQNNFGTMKEREWKIFRSDKFSARLPFSTGDIPPHMNKVEKTETPSFLSKNTSLEKILLVRDRTFDL

SEQ ID NO: 169945 - protein, 177 aa, Glycine max
  Coding DNA Sequence Number=SeqID_53167
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=100%, E-value=3e-18, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=1-155; Score= -43.1; E_value=0.031; Accession=PF02389.6; Description=Cornifin (SPRR) family
  Subcellular localization annotation: CTP_CleavageSite=71; ConfidenceScore=5.22e-01
MSSPQEGCMSSPSEGCMPSPSQDCTSSPSEGCTSSPLEGCTTSPQEGCTSSSSEGYTSSPSEGFTSSPLVECTSSPSGDCMFSPLEGFTSSPSEGYTSLPSKDCTSLPSENCMPSPSVGYMSSPSQGSTSVPSGNSRDHAHKTPSGPEEVQQGPRVSSSDYEPLLVLRSARRPQQGH

SEQ ID NO: 169946 - protein, 254 aa, Glycine max
  Coding DNA Sequence Number=SeqID_53168
  Gene Ontology: Mol. function=sequence-specific DNA binding; Cellular component=nucleus; Biological process=regulation of transcription, DNA-dependent
  Homolog annotation: Hit_ID=O22300; Match level="QueryCoverage=91%, HitCoverage=63%, E-value=4e-46, Identity=42%"; Hit description =Homeobox protein knotted-1-like LET12
  Pfam annotation: Domain name=KNOX1; Domain location=95-139; Score =72.6; E_value=1.2e-18; Accession=PF03790.4; Description=KNOX1 domain
  Pfam annotation: Domain name=KNOX2; Domain location=149-235; Score =58.2; E_value=2.8e-14; Accession=PF03791.4; Description=KNOX2 domain
  Pfam module annotation: Pfam domain module=KNOX1::KNOX2; Domain location=95-139::149-235
MAFHDHLPHEITFQPFTEEQQLGQSRDMQRLLPLSGGAPTWLNNSTAATLRQQNFLHLQPESAATTQQNDDVRGGGGSGMDRNRTESNSEPDDLAEYKADILGHPLYDQLLSAHVSCLRIATPVDQLPRIDAQLQQSQRVVDKYSGIGNGNGVVDDKELDQFMNSYRIVGSSAKSTNWTKKQETQRGEKERGEKTHYVILLCAFKEQLQQHVRVHAMEAVMACWELEQSLQSLTVKKLRRGIKVKLEATQPPEW

SEQ ID NO: 169947 - protein, 63 aa, Glycine max
  Coding DNA Sequence Number=SeqID_53169
MEQCGIGSSGRKYYVVVHETSLRHVPPVGAHVPIGLGSGQPSSPLPLLLSYVVLGFGSAGNKN

SEQ ID NO: 169948 - protein, 76 aa, Glycine max
  Coding DNA Sequence Number=SeqID_53170
MVQWWPIVLSCDCDAEYEIKLPYLATQLYTNLTMTTSLMPLRIWTKFVMLQLQGSFKSLLSCVSRSMHGLTSYSKM

SEQ ID NO: 169949 - protein, 83 aa, Glycine max
  Coding DNA Sequence Number=SeqID_53171
YTMNSVITVLYFNGRVYEDNDGVIFEGSKKVIQIKRGISFNALKKKIGDKENILPCKFVTTKTLKQCWKVLNNKIKCQFWNCT

SEQ ID NO: 169950 - protein, 348 aa, Glycine max
  Coding DNA Sequence Number=SeqID_53172
  Homolog annotation: Hit_ID=Q1SXM0; Match level="QueryCoverage=66%, HitCoverage=46%, E-value=7e-26, Identity=46%"; Hit description =Argonaute and Dicer protein, PAZ; Stem cell self-renewal protein Piwi
  Pfam annotation: Domain name=PAZ; Domain location=188-280; Score =11.5; E_value=0.00014; Accession=PF02170.12; Description=PAZ domain
MKAPSVTVIPQATRKGQEKEMETGVVFIKIPFQSTMPLAQAFFGGTCVLLRGMMEEIPGNEEAAEPPASSQSPADVPHNMETERMTATKYSIISRNGVGTTGKHLPLLVNLFEVVVNVPDTVFFQYSDFQVSINFEDKRAVESKGIGRKVIDKLYQTYSSELGCKRFVYDGGKTLYTVGPLPLNKYELKVLLEKSFTKRLKMMTTIVKGRQWILLFMNILPHARGIELTSSAYLPCLDVGKPKWPIYLPLELCSLVSLQRYTKVLSPMQRASLVEKSCQKPQDRIKILKSAVGNCYNDDPVLSSCGIFIEKQLSLIEGCVLETPKNIERPYTLIEEEPQLRKSNPVAR

SEQ ID NO: 169951 - protein, 195 aa, Glycine max
  Coding DNA Sequence Number=SeqID_53173
  Homolog annotation: Hit_ID=Q9C7X7; Match level="QueryCoverage=13%, HitCoverage=4%, E-value=2e-08, Identity=100%"; Hit description=Heat shock protein, putative
MLPDTDARVRCSEIDSDGWTLSFAGHDAAFLFVCGVGESTTKRDLRETSWQWRLGFEIECRERVRERKSSTMVWITLFIINNRRRNNSEGFIAQILKFTVSTFWVAMLKQFLSKLPRKAPKLDSDKSCRADSSLSDDSPCAVDRNNHLPGGGGPSSVKKTSSSTVFPTKCNGSETMRMTRSLIVARHAGERLLRC

SEQ ID NO: 169952 - protein, 130 aa, Glycine max
  Coding DNA Sequence Number=SeqID_53174
  Gene Ontology: Mol. function=nucleotide binding; Cellular component =chloroplast; Biological process=response to heat
  Homolog annotation: Hit_ID=P27322; Match level="QueryCoverage=99%, HitCoverage=79%, E-value=1e-32, Identity=74%"; Hit description=Heat shock cognate 70 kDa protein 2
MAGKGEGPAIGIDLGTTYSCVGVWQHDRVDLVLLDVTPLSLGLETAGGVMTVLIPRNTIQSQQRKSRVYKGERTRTGDNNLLAKYELSGIPPAPRGVPQITVCSDIDGNDILNVSADDKTTEQDHHYQRQ

SEQ ID NO: 169953 - protein, 210 aa, Glycine max
  Coding DNA Sequence Number=SeqID_53175
  Gene Ontology: Biological process=regulation of GTPase activity
  Homolog annotation: Hit_ID=Q2PER6; Match level="QueryCoverage=93%, HitCoverage=42%, E-value=2e-74, Identity=69%"; Hit description =Putative Asp1
MGHWLIVVAYMSVKEGGYDHKVNETVNVVTQKTSEIGQRTWGIMKGVMAMASQKIEEYTKDDPNWKNDNWQRNENDTNGYYQDFNREKKGWNSSTGREQSSSGEYKTESSSSWDDWDHKDSRKEEPAKGSTHSSGGQFSTYNSSSWDDWEHKDSRKEEPAKGSAPHNNDDWAGWDNAKDDGFDNIYEGANKKGVGHKGKSDGTWTEEGFL

SEQ ID NO: 169954 - protein, 419 aa, Glycine max
  Coding DNA Sequence Number=SeqID_53176
  Pfam annotation: Domain name=SANTA; Domain location=23-120; Score =117.1; E_value=5e-32; Accession=PF09133.1; Description=SANTA (SANT Associated)
MADSTPTATPSNDTVSSYFQRTVTLYDWWLIKAKNDFQGKRLAVAGVSSRKDEAMRVFVSAAVIKRYDVFSLETADGICVMISGFINEQRTLENGFAAEVFNRFLFGFPPDWESYALDCFREESTTGTDLGSAVPDNVPASSLEILSDGVENSIPTSLASPKEAPGDHEKSFPGNECNVSKEMGGVNVACSSGGKRRSARLHDIKVHQQKKKPASGGSLKNPNNENSTLVALENCDVEGLKSPVTPIQSQSSRQLSTSSGQLVKKSASRISRTLSPKTEGCYKKKRVTVERKVGRPKGKLNKSASAVKNPQEKDLSHLTKGSQQKISTVTPESPSFRKSRSGRLLLPPLEFWRNQIPIYNADHEITEIQDGASLISPCKALLLCLPQKSECLNRVWIPLALLISEGCHDSSNPTKQGPK

SEQ ID NO: 169955 - protein, 134 aa, Glycine max
  Coding DNA Sequence Number=SeqID_53177
  Gene Ontology: Mol. function=transcription regulator activity; Cellular component=nucleus; Biological process=regulation of transcription
  Homolog annotation: Hit_ID=Q1SJ77; Match level="QueryCoverage=97%, HitCoverage=33%, E-value=4e-46, Identity=71%"; Hit description=Helix- loop-helix DNA-binding
MVLDEIINHVQSLQRQVEILSMKLAAVNPRMDFSLDSLLATDLKVELGELGELGKCDRDEGASLVDSNLPSMVTPLMWPEIPLNGNRQHYQQQWQLDAFHQPLWEREEVNHNFMTPENSLLSYDSSANSGRIEF

SEQ ID NO: 169956 - protein, 102 aa, Glycine max
  Coding DNA Sequence Number=SeqID_53178
  Gene Ontology: Mol. function=tRNA-intron endonuclease activity; Cellular component=tRNA-intron endonuclease complex; Biological process=tRNA splicing
  Homolog annotation: Hit_ID=Q1SJ76; Match level="QueryCoverage=99%, HitCoverage=56%, E-value=3e-15, Identity=39%"; Hit description=TRNA intron endonuclease, catalytic C-terminal
MAPRWKGKDAKAKKDAEAEALKEPMSKMVSQLQSSLVQFDTRGFLSGNSVHLVAVEQNNLICSKQHALDHDTGPQNDQELGHYMKSKKETFLCFYKAHSLLK

SEQ ID NO: 169957 - protein, 510 aa, Glycine max
  Coding DNA Sequence Number=SeqID_53179
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=36%, E-value=1e-119, Identity=40%"; Hit description =Chromo
  Pfam annotation: Domain name=rve; Domain location=375-510; Score =40.2; E_value=7.2e-09; Accession=PF00665.16; Description=Integrase core domain
MAEEDIHNTAFCTHTEHYEYCVMPFGLCNASVTFQATMNKLFKPFLRKFVAMFFNDTLVYSASWADHFHHLEVVFMVLTKDLFYLYASKCVFDKAKLQYLGHIVSADGVALDPSKISAMLDWPTPATTIDLRGFLGLIGFYRRFIRGYALLAVSLTALLRKDNFAWNDDAQCAFNNLKQVMTMAPVLTPLDFTILLCLEIDAFRVAMGAVLSQRAHPIAFFSKKNCPKLQRSSTYVRELHAITVVVRQWRHYLLGHPFTIITNHQSLKELINQKKIHQNPAANPNYSLSAYWICYRDKLWLPFDNPFIPMLLEEFHSTPLGGHMGKAKTLRWLWENFFWDNIRRDVYRLVSENRVCQQMKHECRKPAGLLQPLPIPSGLWEDLSLDFTMLSLSHGFTTILVFIDQYSKGTHLGALPPRYSAHKVAGLFIDIICKLHRFPHNLVSDKDPIFLSSFWRELFRLSGTKLQYSTTYHPKSDGQIEVLNRTLEQYLCSFIHDRPALWFLFLSLAE

SEQ ID NO: 169958 - protein, 414 aa, Glycine max
  Coding DNA Sequence Number=SeqID_53180
  Gene Ontology: Mol. function=RNA-directed DNA polymerase activity; Cellular component=chromatin; Biological process=chromatin assembly or disassembly
MPKHTTRQTSLERLEDVVNKLTQHQATLAQNHQTLTQTNADLNFKLDSILDHLTALTATPPSPKPPPSLPPITNPRPHMKLDLPHFNGQDPLRWIFKIQQFFDYQGVFDVERLIVASFYMEGPALYWYQWMSRNDFLTSWHAMLLALESRFALSYYEDPYGALFKLQQRNIVNEYLSEFERLTNCVVSLAPPLLLSCFISSLSPDLQREVQALQLMCLSQAMALAKLQEDKLCDRRRSYRTTHHSPVQNHSHHTTTQTHPPQTSFINHPPKLLVRRLSPEEIALKHNKGLCYYCDEKWSLGHRCHPRIHLLITKEEVELPTSPGPPESPRLSRDSSPPLLAVDNPPHLSLNVMSGMPAPETFHVYGTVHHHRLTILVDGGSTHNFMQLRVAKFLGLPSTPITLLPVMVGNGGVI

SEQ ID NO: 169959 - protein, 63 aa, Glycine max
  Coding DNA Sequence Number=SeqID_53181
MDWTCFSSSVFWLWGIGKVMEFVKKGGKVWGKGWLSERRVGEVRSVEGDEDGAGPKWNKAETA

SEQ ID NO: 169960 - protein, 276 aa, Glycine max
  Coding DNA Sequence Number=SeqID_53182
  Gene Ontology: Mol. function=transcription regulator activity; Cellular component=nucleus; Biological process=regulation of transcription
  Homolog annotation: Hit_ID=Q1SJ77; Match level="QueryCoverage=86%, HitCoverage=62%, E-value=4e-69, Identity=63%"; Hit description=Helix- loop-helix DNA-binding
  Pfam annotation: Domain name=HLH; Domain location=207-256; Score=5.7; E_value=0.036; Accession=PF00010.16; Description=Helix-loop-helix DNA- binding domain
MDQAPGGLRGSVHHGATLESIQFNEEIQGLMAPAPENASSFTALLELPPTQAVELLHSPESDSARKPPNCHVSANQKPYLLNSFGSNLTFPSNAALIERAAKFSVFAGENSPPPPGEARLIPAGTGSTLDRVKNEPQETDSNPCSSSRLGCISDPAVENNIQRTAKRKEREKKAKGSSKKRKSAADETSGDGEKLPYVHVRVRRGQATDSHSLAERARREKINARMKLLQELVPGCDKIFYGISLNRASKALRHPVVYSSTYLSPDPKKSLEAHIS

SEQ ID NO: 169961 - protein, 75 aa, Glycine max
  Coding DNA Sequence Number=SeqID_53183
MATGDLKIAYYLGVIRMLQLVINAENSIILSQHEPNAGIFGHHINLLAIAMCTRKLLVHPAQDGQFQFCPSVKMI

SEQ ID NO: 169962 - protein, 119 aa, Glycine max
  Coding DNA Sequence Number=SeqID_53184
  Gene Ontology: Mol. function=nucleotide binding; Cellular component =chloroplast; Biological process=response to heat
  Homolog annotation: Hit_ID=P11143; Match level="QueryCoverage=66%, HitCoverage=12%, E-value=5e-28, Identity=81%"; Hit description=Heat shock 70 kDa protein
MKETAEVYLGSTTRNAVSPMPAYFNDSQRQATKDTSVISRLNVMRIINEPTAAAIAYGLDKKAISSGEKNVLIFYPDGGTHAEGDDNNIVAHTSNTTTSATRTRPNRIWKRPNYLSNYA

SEQ ID NO: 169963 - protein, 47 aa, Glycine max
  Coding DNA Sequence Number=SeqID_53185
MAASVPYSPLAMNSAAIQSIYTLQPYMHDSFCTQDSEKEKKREIERG

SEQ ID NO: 169964 - protein, 103 aa, Glycine max
  Coding DNA Sequence Number=SeqID_53186
MATRMLHPMIMRWKQMTLLSTTKSHNNNSASFISLLRVVVFIEALADKSLIVVIINKALAIVVVGGWHHTHMSDAAFALMFTPMSTMALACLLLTTGFNNLEM

SEQ ID NO: 169965 - protein, 429 aa, Glycine max
  Coding DNA Sequence Number=SeqID_53187
  Gene Ontology: Mol. function=structural constituent of ribosome; Cellular component=intracellular; Biological process=translation
MKPLCSSEFLCDNEKAESIHSESEYFGALNDTLSHVCDQIDSNGSQKEAESMEKCCSETVHDYGNSGLEEEETTKLVFKFEYQKWNCNYDEELKEGYGESRDFVKGGDAVSASTNKYEFMSGTSFSHFLDEPEAENFTVKEFFVHSNDVIQLENHVSNDFGFLSNKKPENCERGVISANLKNFTENAHKDVSEKFKAEELIEQPVEPVVCNFLSDDDFICSSSDSDSISSSLEEGFLSDTDFGTTTEYDTLGRNAAEEDLDFGDEKSYENLDVGYEPDDFTEEDEDIMDEFGKLEEECRLEKSSSKNSEDSNSINSKHEQSVKPNSQALATIDLEDSNRFDTLWEHQDLIEQLKMELKKVRATGLPTILEDSESPRIMEDLKPWKIDEKLQHGSTTNELPKFYRSYRERMRKFDILNYQKMYAIEDTHL

SEQ ID NO: 169966 - protein, 68 aa, Glycine max
  Coding DNA Sequence Number=SeqID_53188
  Subcellular localization annotation: CTP_CleavageSite=38; ConfidenceScore=5.16e-01
MTRAEHVNCIIINDESKDSQNLTQSVTRRFQRRRSYKRPATTSEACTERCAESLGRVQFLRLYLPYGR

SEQ ID NO: 169967 - protein, 186 aa, Glycine max
  Coding DNA Sequence Number=SeqID_53189
  Gene Ontology: Mol. function=Rab escort protein activity; Biological process=intracellular protein transport
  Homolog annotation: Hit_ID=Q9C8Z5; Match level="QueryCoverage=89%, HitCoverage=35%, E-value=2e-30, Identity=42%"; Hit description=Rab escort protein, putative; 48705-51166
  Subcellular localization annotation: CTP_CleavageSite=60; ConfidenceScore=5.38e-01
MDQSFMHMWPKHPPYLPSPPTNSSVSTDTGPSILAPTPTESVIAATTSAVGKTILHLDPNSFYGSHFTSLFFHDLTSYLTSLHSLPFAASFDSDDIVVVDLVHNPSAPTRKPALFCADKTIDLLMKSGAAQYLEFKGIDESFVYEANTDLANVPNSRGAIFRDKKFSLKEKNQLMRFFKLEYKKRD

SEQ ID NO: 169968 - protein, 239 aa, Glycine max
  Coding DNA Sequence Number=SeqID_53190
  Homolog annotation: Hit_ID=Q9FMC8; Match level="QueryCoverage=81%, HitCoverage=82%, E-value=1e-39, Identity=49%"; Hit description =Genomic DNA, chromosome 5, P1 clone:MUK11
  Pfam annotation: Domain name=DUF623; Domain location=137-196; Score =113.5; E_value=6.1e-31; Accession=PF04844.4; Description=Protein of unknown function, DUF623
MGKKSLKLPSLFKTKEAPRNHHHPWQFMPSCGHSKTLSFRGGDDDMFKTVNSMFFDPSAESTIETPKSWFTTSSESASISTESEDYYYCDGESLEMLVRGVRSERLFFEPGDTSSILEKAKASGFPFKESVVLAMESEDPYEDFKRSMEEMVESHGVRDWEGLEELLTWYLRVNGKNNHGFIVGAFVDLLFSLAASNGSNTCSDSTSYSSAVSSFASSPLSGQNEIVEHGIGNDGAVTS

SEQ ID NO: 169969 - protein, 381 aa, Glycine max
  Coding DNA Sequence Number=SeqID_53191
  Homolog annotation: Hit_ID=Q9LVK5; Match level="QueryCoverage=32%, HitCoverage=76%, E-value=1e-12, Identity=37%"; Hit description =Arabidopsis thaliana genomic DNA, chromosome 3, P1 clone: MDC16
  Pfam annotation: Domain name=Ank; Domain location=20-52; Score=29.0; E_value=1.7e-05; Accession=PF00023.20; Description=Ankyrin repeat
  Pfam annotation: Domain name=Ank; Domain location=54-86; Score=15.1; E_value=0.21; Accession=PF00023.20; Description=Ankyrin repeat
  Pfam module annotation: Pfam domain module=Ank::Ank; Domain location =20-52::54-86
MVRQVLLKRKPSLESEVDSEGRFPLHLACAEGNTEVVKALLHTNSDVCLALDKDDMLPLHLAVMRGLIGVIKELTRARPDSIQQKIIDDGSVLHLCVTYDHLEPTAPACHRRRGTAVSALNKAGLTALEALERCPRDFISLKIEHMLTEAGIQTGTSQQGSSSPPSIATQPSQSKRSKIWETLWLKYLQYQSNWIEEKRGTLMVVATVIATMTFLSAISSPGGVWQEDTITGGFNCTTYGNICKAGTAVLAYDWPHGFLKFMTFNTTSFFSSLSVVLLLISGFRLENKLMMWILIMAMTSALTFMGLTYFWAQSLVTPDHIVDKVNRMGIPLSIVWVILLLVTVLVHVVNLFLCVKKLVKKWKKQKLLLAQSHSSESWSSE

SEQ ID NO: 169970 - protein, 483 aa, Glycine max
  Coding DNA Sequence Number=SeqID_53192
  Gene Ontology: Mol. function=transcription regulator activity; Cellular component=nucleus; Biological process=regulation of transcription
  Homolog annotation: Hit_ID=Q10G91; Match level="QueryCoverage=30%, HitCoverage=29%, E-value=2e-33, Identity=55%"; Hit description=Helix- loop-helix DNA-binding domain containing protein, expressed
  Pfam annotation: Domain name=HLH; Domain location=277-326; Score =61.3; E_value=3.3e-15; Accession=PF00010.16; Description=Helix-loop -helix DNA-binding domain
MDDDDEEYPIPVSKKPSTQNDEIMELLWQNGQVVMQNQNQRPFRKQPPTTDGDGPIPAREIRSSEAENYNSQHLFMQEDEMASWLHYPIHEDPPPFDHHDFCADILYPPPNATASQNQSSASVQSSVRTTELQHPAPRPPIPPPRRQEHTLSRIHNFTHFAKHGNASSSSKAAAPAQPTVATAEHVETGRASVSAAAGKTPASDGGRETATCDVTVTSSPGGSSGSAEPVQREPVVNRKRKGREQEESEYQSEDVDFESPEAKKQVRGSTSTKRSHAAEVHNLSERRRRDRINEKMKALQELIPRCNKSDKASMLDEAIEYLKSLQLQVQMMSMGCGMVPMIFPGIQQYMPPMGMGIGMGMGMGMEMGMGMNRSVMPFPNMLASSTLPAATATAHLGPRFPMPPFHMPHVATPDSSRMQGANHPDNNMLNSLGTLDPDQSCIPNFTDPYQQYLSLQQAQLQLMQYYVLQDLFERSSYLKVFVP

SEQ ID NO: 169971 - protein, 498 aa, Glycine max
  Coding DNA Sequence Number=SeqID_53193
  Gene Ontology: Mol. function=nucleoside-triphosphatase activity; Cellular component=protein complex; Biological process=protein catabolic process
  Homolog annotation: Hit_ID=P46466; Match level="QueryCoverage=99%, HitCoverage=100%, E-value=0.0, Identity=77%"; Hit description=26S protease regulatory subunit 4 homolog
  Pfam annotation: Domain name=AAA; Domain location=279-466; Score =294.8; E_value=1.6e-85; Accession=PF00004.19; Description=ATPase family associated with various cellular activities (AAA)
  Pfam annotation: Domain name=AAA_2; Domain location=276-407; Score= -28.1; E_value=0.0012; Accession=PF07724.4; Description=ATPase family associated with various
  Pfam annotation: Domain name=AAA_3; Domain location=279-410; Score= -13.3; E_value=0.0093; Accession=PF07726.2; Description=ATPase family associated with various
  Pfam annotation: Domain name=AAA_5; Domain location=279-413; Score= -10.1; E_value=0.01; Accession=PF07728.4; Description=ATPase family associated with various
  Pfam module annotation: Pfam domain module=AAA::AAA_2::AAA_3::AAA_5; Domain location=279-466::276-407::279-410::279-413
MGQGTPGGMNRQGDRKPDGGDKKEKKFEPAAPPARVGRKQRKQKGPEAAARLPTVTPVTKCKLRLLKLERIKDYLLMEEEFVANQERLKPQEEKAEEDRSKVDDLRGSPMSVGNLEELIDENHAIVSSSVGPEYYVGILSFVDKDQLEPGCAILMHNKFGNGVMINCLIIYTMHKRRSIIILLEEGRNLMCDLGPSEPEKRVGKVVVEMFFRTVLSVVGLLQDEVDPMVSVMKVEKAPLESYADIGGLDAQIQEIKEAVELPLTHPELYEDIGIKPPKGVILYGEPGTGKTLLAKAVANSTSATFLRVVGSELIQKYLGDGPKLVRELFRVADDLSPSIVFIDEIDAVGTKRYDAHSGGEREIQRTMLELLNQLDGFDSRGDVKVILATNRIESLDPALLRPGRIDRKIEFPLPDIKTRRRIFQIHTSRMTLADDVNLEEFVMTKDEFSGADIKAICTEAGLLALRERRMKVTHADFKKAKDKVMFKKKEGVPEGLYM

SEQ ID NO: 169972 - protein, 412 aa, Glycine max
  Coding DNA Sequence Number=SeqID_53194
  Homolog annotation: Hit_ID=Q1SLA4; Match level="QueryCoverage=15%, HitCoverage=11%, E-value=2e-11, Identity=49%"; Hit description=Zinc finger, CCHC-type; Lipocalin
MEYYDESLLLALATLVGKPLKVDIRSVDASRERFARVCIEINLNMYLWLDVFGVVITSSGWNTKGCIRGKQESSSLGVEGLSVDGASPYTVGSQAREGHKGEGQTHKKVHEGMSQVSKKDGPGTTMLGNMVEALREGISSNLKKNLDPPEPPDTIMGTMELGSSSGTGYGVTDAQDALVVDMEKEFGDFSILAWNVRGFTNKRSHTHMRKLLTRYQPDLVFLFETHVRIESSGQFWQRIGYGAIGVEEVQGHEGGVWILSHKGKGKGGLGYLHYQERIQLAMGEVCPRCLQHQEDILHCLVTCHFCTVKAFGGAGSVTTDSALTVELVKKSLKEHHEYNNEMSLVKKLMERDWACMSEHTLREAKQSIDAITKMGLTSARPLVIFTQAAPQELKATMEANALGIICSNDNFC

SEQ ID NO: 169973 - protein, 244 aa, Glycine max
  Coding DNA Sequence Number=SeqID_53195
  Gene Ontology: Mol. function=RNA-directed DNA polymerase activity; Cellular component=membrane; Biological process=RNA-dependent DNA replication
  Pfam annotation: Domain name=Exo_endo_phos; Domain location=3-240; Score=1.5; E_value=0.0098; Accession=PF03372.13; Description =EndonucleaseExonucleasephosphatase family
MGVRSGENNWQNRGNGGKGLEGGKQIGCKIQEPMNIISYNETKKESIDMRSCQALWGDKEIGWEMQPAANTAGGLLCIWSEKAFKLQSSIIGSGFIVLVDQWLKEAQQVHIVNIYSSCDIQGKRSLREAIKQLKTSQNGGLWCILGDFNNIRNNAERLGSCHRGQGGNSIEEFNEWIDELEVQEAPWLGRKFTWYRPNGSAKSKLDRFLLSPDWMTKWPNTIQSTLDRNFSDHCPVILKSKVTD

SEQ ID NO: 169974 - protein, 1371 aa, Glycine max
  Coding DNA Sequence Number=SeqID_53196
  Gene Ontology: Mol. function=binding
  Homolog annotation: Hit_ID=Q1SA51; Match level="QueryCoverage=73%, HitCoverage=85%, E-value=0.0, Identity=73%"; Hit description=Mast C -terminus, putative
  Pfam annotation: Domain name=HEAT; Domain location=1293-1329; Score =23.6; E_value=0.0007; Accession=PF02985.12; Description=HEAT repeat
  Pfam annotation: Domain name=HEAT; Domain location=171-207; Score =28.4; E_value=2.5e-05; Accession=PF02985.12; Description=HEAT repeat
  Pfam annotation: Domain name=HEAT; Domain location=342-378; Score =8.5; E_value=3.9; Accession=PF02985.12; Description=HEAT repeat
  Pfam annotation: Domain name=HEAT; Domain location=37-72; Score=5.1; E_value=10; Accession=PF02985.12; Description=HEAT repeat
  Pfam annotation: Domain name=HEAT; Domain location=466-498; Score =1.4; E_value=29; Accession=PF02985.12; Description=HEAT repeat
  Pfam annotation: Domain name=HEAT; Domain location=77-113; Score =18.1; E_value=0.033; Accession=PF02985.12; Description=HEAT repeat
  Pfam annotation: Domain name=HEAT; Domain location=809-842; Score =1.5; E_value=28; Accession=PF02985.12; Description=HEAT repeat
  Pfam annotation: Domain name=HEAT; Domain location=851-886; Score =19.5; E_value=0.012; Accession=PF02985.12; Description=HEAT repeat
  Pfam annotation: Domain name=HEAT; Domain location=891-927; Score =23.9; E_value=0.00058; Accession=PF02985.12; Description=HEAT repeat
  Pfam annotation: Domain name=HEAT; Domain location=977-1009; Score =9.2; E_value=3.2; Accession=PF02985.12; Description=HEAT repeat
  Pfam module annotation: Pfam domain module=HEAT::HEAT::HEAT::HEAT::HEA T::HEAT::HEAT::HEAT::HEAT::HEAT; Domain location=1293-1329::171 -207::342-378::37-72::466-498::77-113::809-842::851-886::891-927::977- 1009
MEEALELARAKDAKERMAGVERLHEVLEASRRSLSSGGVTSLVDCCLDLLKDSSFKVSQGALQALDSAAVRAGDHFKLHFNALVPAVVDRLGDAKQPVRDAARRLLLTLMEFSELLFVSVKLGKKERQVSSPTIIVERAGSFAWTSRSWRVREEFARTVTSAIGLFSSTELPLQRAILPPILQLLNDLNPAVREAAILCIEEMYTQAGSQFRDELQRHNLPSSLVKAINARLEGIQPNVCSSDGISSGYNAGEIKPVGVNPKKSSPKHKSSSRETSLFGGEGDATEKLIDPIKVYSEKELIREIDKIASTLVPEKDWSIRIAAMQRIEGLVLGGAADYPCFFGLLKQLVGPLSTQLSDRRSSIVKQACHLLCFLSKDFLGDFEACAELFIPVLLKLVVITVLVIAESADNCIKMMLHNCKVARVLPRIADCAKNDRNAVLRARCCDYALLILEHWPDAAEVQRSADLYEDMIRCCVSDAMSEVRSTARMCYRMFAKTWPERSRRLFSSFDPAIQRLINEEDGGMHRRHASPSVRDRGALMSITTQASAPSNLTGYGTSAIVAMDRSSSLSSGTSIASGVLSQAKSLGKGTERSLESVLHASKQKVTAIESMLRGLDLFDKHGSSALRSSSLDLGVDPPSSRDPPFPAAVTASNHLTSSLTTESTASGANKASNRNGGLGMSDIITQIQASKDSGRLSHNTNVGIEPLSTFSSYSSKRVTEKLQERGSIDENSDMRETRCYMNPNIDRQCMDTHYRDGNYRDSQHSYVPNFQRPLLRKNVAGRVTTGSRRSFDDSQLSLGEKSNYVDGPASLHEALSEGLSSGSDWSARVAAFNYLHSLLQQGQKGIQEVVQNFEKVMKLFFQHLDDPHHKVAQAALSTLADIILAFRKPFEGYMERMLPHVFSRLIDPKELVRQACSMNLEVVSKTYSIDSLLPALLRSLDEQRSPKAKLAVIEFAISSFNKHAMNPEGAANIGILKLWLAKLVPLVHDKNTKLKEAAITCIISVYSHFDSSAVLNFILSLSVDEQNSLRRALKQRTPRIEVDLMNYLQNKKERHSKSSYDPSDVVGASSEEGYVGLSRKAHYIGRYAAGSLDIDGSRKWSSQDSALIKGSIGQAVSDETEEHTDSNSGVYGFKTKDLAYTANSMGQNFGLQTSHRHVNSSMNFEGLSSDLDVNGLMSSEHLNITEDFGPDKEHPSELNHNHQSAEDVNVNYMTDTGPSIPQILHMPYPCICKEAVSGFEPMTNKSPRHNFTAAPGLALTSEIGGDGSPISSKQTALQQLVEVSIANEHSIWTLYFNQILTVVLEVLDDSDSSIREHALSLIVEMLKNQKSNDEKEEKFEAVLREDKNWRNAPLTAKNTTRVMEAVWSGSN

SEQ ID NO: 169975 - protein, 100 aa, Glycine max
  Coding DNA Sequence Number=SeqID_53197
  Gene Ontology: Mol. function=hydrolase activity, acting on ester bonds; Biological process=lipid metabolic process
  Homolog annotation: Hit_ID=Q9SVU5; Match level="QueryCoverage=78%, HitCoverage=26%, E-value=2e-29, Identity=86%"; Hit description =Proline-rich APG-like protein
MPVSLRIPIPAEAKLAPTNSFCPVREVVAIGEAAGGATGGIVDAIGRRVGACGGRQVIVVATVNQRVPEHKESASTFNTLCVDEKCHHHQGEDHEDHSHS

SEQ ID NO: 169976 - protein, 44 aa, Glycine max
  Coding DNA Sequence Number=SeqID_53198
MRMQMQMQMRDLKGRDGEFSGGLKMRGEVAVGERNRREDDAEMK

SEQ ID NO: 169977 - protein, 1638 aa, Glycine max
  Coding DNA Sequence Number=SeqID_53199
  Homolog annotation: Hit_ID=Q9FM57; Match level="QueryCoverage=85%, HitCoverage=80%, E-value=3e-20, Identity=40%"; Hit description =Arabidopsis thaliana genomic DNA, chromosome 5, P1 clone:MDF20
MEKHVVQIFERKKRIIDQSRQQCHLWEQHLFPKLRLNGIPPPPWLCNSSRHADPQGLSKDDLVSEVLISQPQYRVPFPSVCSNLDSVSYGVQYPIGLHNEGRALEKECNTGDGVSNFPDCPVNYAVCASSGPPELDSGAVSPPQNQIETRASDSHHDPAPSLAKLQRSKSRQKALELRNSAKAPRRLSGEDDNACVCAGTVTGSAPSTQEAEHAMESDVVKDFHSNIQSCSMEEMEACVYVTNYSGRMTRSKSSSQKFNSLNVASPSVAKEDGPLPNNLNESFEIVNQPCFANASCGINEANKREYQSKEAGKSVYDERLTESRSSSQARCNRELLKLDSTLGSGKGVDFCDHRQPITHAQLTDLSKASDCNNGSGRNTVKDGNSCLSKQESNIHGMIKLLRGSCPSPGHDLMMTGGFVRSIDKSVPLPQPSISQNSQDLVLSVVGTFNSQKDLDFSALKPNDRLSRSGSEKIEKVLKSSRYNFCEQSATCSESAGKKSWNVPPTKLDARRLSSSPEYSKLDTEIGRNSADKENVAALAASGKMRAVVTSANEGSLRPVSSSNLYGGPSNLESVYVEAAVDEKVLDVQENIPYGALPTDNVEHRSAAIVGKVEADFDGLVEKDPYCVIPKVGQNVSVLKPPTDFTMSVMPKQLDFDDVEETSMSGICSPDLKEGQQGVSPEEPLNSLEPVKLLEEETSSVCQSKCNSLGEMPSLQMQEVPIREEEPRMEYCASHLEEEDIARETLSAAPPNKEMPMVQNGFCILTSSLMNHSCPSQVAGENSSRSLSKEVMPTKFVSVNSTLENDESSAKLADSSEAVTGNDLHKSTDANVTNFTVAFPFSAPMADVNVGLARQGPNSITLCQDGDVLRKTLLSEGKITSFSPDFQIFRSSTKSFTYDVEHSCPQHKRRKIEIETERFRAASSNLLEKPCDSIDQRPASRNLSIEEDSREIALEVQNLPSDPEDDIGHQSISNIPTDEMQYNGECQTMEDSSLKVRKEEKCTLDGRDRSEDTLLLAVANPSGFSIDSTMGCTMDEKVESWHHQVSCGQECAEHLSCVEKSTSSRRVYPGGNAKFSDGMSASPGMQCLDLVGTDETIPELEGFIMQADNAQPCITGDQMDLEEMDLEKMDLEEIDLPSNSIDYTSLGKSRFMHSSLCNTLTPYKIHNVPEPYQSLPNGLLKGLGIRTSLPLSDGSPRSLSDCQPNCKGQYTSSVQTLWDRINSNLGSSGKRRSLKLDLPCITEENENVDEIPGTFQRGIGSEGMAGSNIREPLAEIVDNANPSTSVLQDDILTGGRKDILSTEFNLSGTCDKVKNKLDKQDGNRKRFTRKGKENHNISLGANGVKRTAGSVCKRPKLSGKDSMKQGPINNIVSNVSSFIPLVQQKQAAAVVTGKRDVKVKALEAAEAAKRMAEKKENERKMKKEVLRLERERLELELQKKKKEEERKKKEEQMAAKKRQMEDEEKKEKEKKRKRVNDKKKQQQDHMKIQAKKEEIKIQRRATDEVQENKKIIDERENHKNLSVQDKRECNMEKISETEPLTMVDLANDKKESHPDYSESVNDCANNGQVMDNLIKATEDDDLIIKDSLQEQSYDISPYRGSDDEDEDEDDLPNNKLIPSWARFVTVQVFGAYLFYSAIL

SEQ ID NO: 169978 - protein, 38 aa, Glycine max
  Coding DNA Sequence Number=SeqID_53200
MERGIEQNGKANEALKEIQEFQNETKRNVAQIQPHLIS

SEQ ID NO: 169979 - protein, 137 aa, Glycine max
  Coding DNA Sequence Number=SeqID_53201
MLEESLVNGLLILQVWEVEPGIKYAAPFTLLRLKQENRTKFYPSTVPSIFHVCDLHIALSLLLALILRATVSSRRADFDYEDGYDVRGRSWEPLLNPQPGQPSGSSKGDNSGNHSDFWSVRMREKITDEHAGYISVL

SEQ ID NO: 169980 - protein, 213 aa, Glycine max
  Coding DNA Sequence Number=SeqID_53202
  Homolog annotation: Hit_ID=Q9LKC1; Match level="QueryCoverage=98%, HitCoverage=21%, E-value=2e-18, Identity=36%"; Hit description =Arabidopsis thaliana genomic DNA, chromosome 5, BAC clone:F6B6
AEVASPYALKPLMVSSLDSKVDDQEWLLLVHKLLSAAGLDDQHQFDSSYTRWHSLESPLDPSLRDTLYANLNEKEPQPNMHEGRRRRMRSNHKLVFDYVNDALLELVGYGSEKCLKRSGSRCRVLVQEGASASATSSPLSVDHIVAQMKELRASGMRCEWENGGGNSTSLVVENIVRKEVVQIGWVELTDLEIDILGKEIEGDLIQELVENAV

SEQ ID NO: 169981 - protein, 595 aa, Glycine max
  Coding DNA Sequence Number=SeqID_53203
  Gene Ontology: Mol. function=amino acid transporter activity; Cellular component=membrane; Biological process=amino acid transport
  Homolog annotation: Hit_ID=Q9SQZ0; Match level="QueryCoverage=96%, HitCoverage=94%, E-value=0.0, Identity=69%"; Hit description =Putative amino acid transporter; 33388-30195
  Pfam annotation: Domain name=AA_permease; Domain location=48-516; Score=12.1; E_value=4.7e-06; Accession=PF00324.11; Description=Amino acid permease
  Subcellular localization annotation: CTP_CleavageSite=33; ConfidenceScore=5.15e-01
LRAYLSALSHTPTRLALRALSVSTSYDEMSQVRARSGTSMRKTLRWFDLVSLGIGGMVGAGVFVTTGHATLYAGPAVLLSYAIAGFCALLSAFCYTEFAVDMPVAGGAFSYLRVTFGPFPSRDTQNTCSQINLYTTHIREFAAFLTGANLVADYVLSNAAVARGLTAYLGTTIGISSAKWRLTVPSLPKGFNEIDFVAVAVVLLITLVICYSTRESSVVNMILTALHILFIAFVIMMGFWRGNWKNFTEPANPHNPSGFFPHGAAGVFKGAALVYLSYIGYDAVSTMAEEVRDPVKDIPVGVSGSVVVVTVLYCLMAASMTKLLPYDVINAEAPFSAAFSGRSDGWGWVSRVIGVGASFGILTSLLVAMLGQARYMCVIGRSNVVPSWFARVHPKTSTPVNASAFLGIFTAAIALFTDLDVLLNLVCIGTLFVFYMVANAVIYRRYVATGTTNPWPTLSFLCSFSITAIMFTLIWKFVPTGGAKAGMLSVSGVIAIAILQLFHCMVPQVRKPEFWGVPFMPWIPSISIFLNVFLLGSLDGPSYVRFGFFSAVAVLFYVFYSVHASFDAEGDDSLTANKNGEIHVESKEIEDQSFE

SEQ ID NO: 169982 - protein, 421 aa, Glycine max
  Coding DNA Sequence Number=SeqID_53204
  Gene Ontology: Mol. function=siderophore-iron transporter activity; Biological process=siderophore biosynthetic process
  Homolog annotation: Hit_ID=Q8KR55; Match level="QueryCoverage=100%, HitCoverage=79%, E-value=0.0, Identity=82%"; Hit description=IucC
  Pfam annotation: Domain name=IucA_IucC; Domain location=111-421; Score=235.1; E_value=1.5e-67; Accession=PF04183.3; Description=IucA IucC family
MVAKILAELEYERTLRAEPLASDAWRITMGNDSWQFCATRGIWGWLHIDPDSLTTASGTAVEAERALLQLAKVLEMSDAQTAEHMEDLYATLRGDMQLLQAREALDADALIHLDPDELQCLMRGHPKFIFNKGRRGWGLDALRQYAPEYRGRFRLHWVAVQREHLVWSSDVDCDISALLASAMDNAERARFDARWQALGLDESWLPVPLHPWHSPLRTLTNASRRAPFDIKLPLTIYNTSCYRGIPGKYIAAGPLASRWLQQQFASDATLARSGAQVLGEPAAGYLSHPGYAALPKAPYRYQEMLGVIWRENPSCYLQDGEQAVLLAALMETDNAGCALIDAWISRSGLSADAWLEKLFEASVIPFYHLLCRYGVALIAHGQNVTLVMKDSIPQRILLKDFQGDMRLVDEDFPQAQSLPEQ

SEQ ID NO: 169983 - protein, 557 aa, Glycine max
  Coding DNA Sequence Number=SeqID_53205
  Gene Ontology: Mol. function=isomerase activity; Cellular component =periplasmic space; Biological process=carbohydrate metabolic process
  Homolog annotation: Hit_ID=Q1SSI6; Match level="QueryCoverage=62%, HitCoverage=95%, E-value=1e-176, Identity=85%"; Hit description =Galactose mutarotase-like
  Pfam annotation: Domain name=Aldose_epim; Domain location=18-345; Score=441.3; E_value=1.3e-129; Accession=PF01263.10; Description =Aldose 1-epimerase
  Pfam annotation: Domain name=Pkinase_Tyr; Domain location=437-556; Score=-148.2; E_value=0.0022; Accession=PF07714.7; Description =Protein tyrosine kinase
  Pfam module annotation: Pfam domain module=Aldose_epim::Pkinase_Tyr; Domain location=18-345::437-556
ASSGFVNCFDVEKKEKIGIFELNKGDLSLKVTNWGASILSLVIPDKNGKLSDVVLGYDSVKDYTNDTTYFGATVGRVANRIGGAQFTLNGIHYKLVANEGNNTLHGGARGFSDVLWKVKRYQKEGPSPSITFSYHSIDGEQGFPGDLLVTVSYILTGKNQLVILMKGKTLNKPTPVNLANHAYWNLGGHNSGNILNEVVQIFGSKITPVDSKLIPTGKFASVKGTAYDFLKPQTVGSRINQLAETKGYDINYVLDGEKGQKIKLAAIVQDKKSGRVLELFTNAPGLQFYTGNYVKDLKGKGGYVYQSHSGLCLESQAFPDSVNQPNFPSTIVTPEKPYKHYMLFKFSTKNPYISSNIATANGITGNIPYGLGILSKLTYLDLSSNDIKGTISRRPNNIDLDLVVIMKIFLPPTPLLALLCSAYVFHRCYIIEATENFDIIYCIGAGGYGSVYKAQLPSEIRRIFKNEYMERGSLYCILRDDIEAVELDWTKRVNIVKGIAHSLSYLHHDCKPAIIHRDVTTKNVLLNLEMEACLSDFGIARLLNSGSSNRTVLDGTN

SEQ ID NO: 169984 - protein, 63 aa, Glycine max
  Coding DNA Sequence Number=SeqID_53206
MELDDTSICTNFCYMATNSSGSFDGSARDIFDDNTGDNFNGDTGKKANHCVSGCKRDRVRFSA

SEQ ID NO: 169985 - protein, 332 aa, Glycine max
  Coding DNA Sequence Number=SeqID_53207
  Gene Ontology: Biological process=electron transport
  Homolog annotation: Hit_ID=Q01UL0; Match level="QueryCoverage=84%, HitCoverage=64%, E-value=2e-20, Identity=35%"; Hit description =Pyrrolo-quinoline quinone precursor
  Pfam annotation: Domain name=PQQ; Domain location=125-157; Score=6.1; E_value=2.3; Accession=PF01011.11; Description=PQQ enzyme repeat
  Pfam annotation: Domain name=PQQ; Domain location=235-274; Score =27.6; E_value=4.5e-05; Accession=PF01011.11; Description=PQQ enzyme repeat
  Pfam module annotation: Pfam domain module=PQQ::PQQ; Domain location =125-157::235-274
MVHQLVLAGFVVKLLVTAYYVGTSSQEEGLPPEERCTFRGSFSKLNIQAGGILWQTYMIPDNHGQKGEYSGAAVWRISPPIDASRNHIYIATGNLYTAPFDILECQERENNVTQPTHPDECVESDNHSNSIVALDLDDGSIKWYHPLGGFGTNDAHNSCQWNKMLLLCRRVVLLGLCTVTTTSSFGLRSLLDHPTRLQLVEGGWQWKHVVERSCGTQLTLASNAKANGPITVANDIVFVGSTNQKGPIYAINGKTGKIEWSYETGSTVYGDMPVSDGCIYLGNGYKIGNGVFLGNVFAGTSLFALCLSKILWIVDTTDTDDRTTDTGVQLAD

SEQ ID NO: 169986 - protein, 63 aa, Glycine max
  Coding DNA Sequence Number=SeqID_53208
MLVATCASDAKRNFSALSVTREFGRAQESRPLAKGKISSLSEMFISCQAQRVAGAKPISIYSR

SEQ ID NO: 169987 - protein, 89 aa, Glycine max
  Coding DNA Sequence Number=SeqID_53209
MLKIYTGKFYMYCITFYTLKDVQASNKSGIIKYGDVCREVSASVYGGMSISKGCMYVGHGYCVALDPALSLTSGATLFAFCVVPKNLRG

SEQ ID NO: 169988 - protein, 122 aa, Glycine max
  Coding DNA Sequence Number=SeqID_53210
  Gene Ontology: Biological process=electron transport
  Homolog annotation: Hit_ID=Q8P3J1; Match level="QueryCoverage=73%, HitCoverage=16%, E-value=7e-11, Identity=38%"; Hit description =Polyvinylalcohol dehydrogenase
MVDTCLGQQSQDWLNQGGDLYSRRYAYKERKINPETAPNLRLKWKFNAGKDITATPAIYNGTLYFPSWNGNIYAVKEGNGSLVSKQDLQNLTGLNATGFVRSQCKLDCVKDNSHCCWGFIDC

SEQ ID NO: 169989 - protein, 541 aa, Glycine max
  Coding DNA Sequence Number=SeqID_53211
  Gene Ontology: Mol. function=sequence-specific DNA binding; Cellular component=nucleus; Biological process=regulation of transcription
  Homolog annotation: Hit_ID=Q1T4J9; Match level="QueryCoverage=95%, HitCoverage=89%, E-value=2e-68, Identity=33%"; Hit description=DNA -binding WRKY
  Pfam annotation: Domain name=WRKY; Domain location=191-251; Score =130.1; E_value=6e-36; Accession=PF03106.6; Description=WRKY DNA -binding domain
MSKISGPSGPDEIEEKRVTKEEKIKSAKTEMGEVKEENERLKMMLERVEKDYHSLQLRFFDIHHEDVSKKGLADSSTCHDHETEELVSLCLGRSPMVPKKEARIGNSNKLKEDVGPNLTLGLDSKHLLSMEVVSDFSPMNSSEQPKEAEEEVTLSTNQSAKVINVNDDMSDQMPAKRARVSVRARCDTPTMNDGCQWRKYGQKIAKRNPCPRAYYRCTVAPTCPVRRQVQRCAEDLSILITTYEGTHNHPLPVSATAMASTTSAAASMLLSGSSTSHHPTNHNSASFGNAPTTLQSGLSFSHQFDESRTKQVFSPPNHASLHMFPTITLDMTYSASNSSSLTQFHHRLPSTMASISNLKFSPASLSCSQDNNFIPSIWSKGGDTTTPPIIDKIPTRPVIKGNPYFQENFYQQSITNQTPFKEALAETITKAISTDPSLRSVIAAAVSSIVGNGSNSGNQEGAENVLGSGLNLKLGDHLQLASSNPLNQNGKGCLTGYFKSLSSKNSEAGNFIFLQPPLPFSFSKSGTNQLNHYVPEMNTHH

SEQ ID NO: 169990 - protein, 653 aa, Glycine max
  Coding DNA Sequence Number=SeqID_53212
  Homolog annotation: Hit_ID=Q9LKC1; Match level="QueryCoverage=71%, HitCoverage=49%, E-value=1e-50, Identity=36%"; Hit description =Arabidopsis thaliana genomic DNA, chromosome 5, BAC clone:F6B6
MQMLIDKEMSKQKDSKHNLPNVVAKLMGLEALPKGEPNLSMERSHRRDYSQQMYGPIGLPFKHWQQEDRFMDREMLHEVHPSTEHVADKDMYEIWQQTQRGRFSEDVDGKRMALIRQKFMEAKRLSTDERMRQSEQFKDALEVLSSNSDLLIKLLDSQNVCDLYSTSPNETKRITLIKPLKMVDNDKCARKEKKNNRLIKKPSSVDQENPGNSPDNQKVDESPVLTTRIVLLKPSPWRTPEQKAVVSPTTSSSPLNLKSGNFHQGPEYDDVLESIRVANEVTQQMHKGLRSYQKDKTSYSSVFSNGYSDDESSFNKSYHEYASANFSDLEATSMSPLPRLSWDYNYINGCGGSPYSTMSLGRVPCSPESSVCREAKKRLSERWTMMTLDNKGHQEQRQARKKSSTLGEMLSLTHKKKSLTPEVEIIVNEEQEPGKSVSCSHSFNAETSIEGSPKNLPRSNSVPASSSVYENGLSVVVNDHKNTGKAQGSKVQKKSKSVRSSFKGKVASFLFSRSKKSSTKEKTSSSQSKDESKSTSTVTETLVLPANSLGVLRSDVSQSINVDGFEECSLAALCESSGKNSTDSVSNEQEEDMITLEPGLTMPRPMVPEIHSSGNPDQPSPISVLQPPFEDFNNNASHESLDCMKSGDQGNNA

SEQ ID NO: 169991 - protein, 148 aa, Glycine max
  Coding DNA Sequence Number=SeqID_53213
  Gene Ontology: Mol. function=RNA-directed DNA polymerase activity; Cellular component=intracellular; Biological process=RNA-dependent DNA replication
  Homolog annotation: Hit_ID=Q1SMQ1; Match level="QueryCoverage=84%, HitCoverage=26%, E-value=6e-16, Identity=40%"; Hit description =Nucleic acid-binding, OB-fold
MWRIGGGWEAESSGEYSVSSTYCALLDQQGVGDDRPVFAMLWKLPVPPKVKLFLWRLFLNRLPTRSNLFDRGIQIQSTVCLLCSSTVETDVHLILNCRRMRPIWNLSLQWLNEMYVIPGTTIEHFMSQSGVAGCKARVMKQCIWASIS

SEQ ID NO: 169992 - protein, 148 aa, Glycine max
  Coding DNA Sequence Number=SeqID_53214
MASRDQVWSFCTHDTRRYLTVIRPPLPFRHSRVRWQAETKFGHSAHMIRGDTLRLSAPPFAIQTQSCSMASRDQVWSFCTHDTRRYLTVIRPPLPFRHSRVRWQAETKFGHSAHMIRGDTLRLSAPLCHSDTVVFDGKQRPSLVILHT

SEQ ID NO: 169993 - protein, 149 aa, Glycine max
  Coding DNA Sequence Number=SeqID_53215
  Gene Ontology: Mol. function=protein binding
  Homolog annotation: Hit_ID=Q00NU6; Match level="QueryCoverage=72%, HitCoverage=11%, E-value=2e-32, Identity=51%"; Hit description=AIR9 protein
MKLPNRYISCTLRIKTGDTSSDGTKKEIAGATVASYMPSIDDIGSFISVSCEPVRSDWARGPMVLSEQIGPIMPGSPTCHSLEFLGSMIEGQRLNFNAVYTGGEQGDCTHEWFRVKDNGLRDKLSSNGDLFIVVLSAKCSLLVMAKVNA

SEQ ID NO: 169994 - protein, 35 aa, Glycine max
  Coding DNA Sequence Number=SeqID_53216
MYVKNTTLARRNGPNFVKAAETPCGGCAEKGTSHP

SEQ ID NO: 169995 - protein, 128 aa, Glycine max
  Coding DNA Sequence Number=SeqID_53217
  Gene Ontology: Mol. function=transferase activity
MKREREEAMKREREKDVKGWREREGRFYDFRVWDLGEKGKMSVVLNLFAQRSPADSVDKYIRIDECTAIQFLEAFFKGVNEIFGDEYLRRPNNNDINRLLQIGEAHVFPGMLGSIDCMHWKWKNCPPA

SEQ ID NO: 169996 - protein, 49 aa, Glycine max
  Coding DNA Sequence Number=SeqID_53218
MTRIVKLSVIDNGALKRCFRWSVVAMASNSGGGGRSLSLLRRFCHLMKL

SEQ ID NO: 169997 - protein, 203 aa, Glycine max
  Coding DNA Sequence Number=SeqID_53219
MVCNDHADMTDRLLAGSFTFECRIMHYILCRVLLPRSINLAQASDEDLILLWALQTGGQIDWAHLVRYRIYKALRANAPLPYPHLVTLFLQHFNIPLEDEPFVKVKRSFAIGAGVVASFGYRKDVDGQWVHKQDLPPPIPDERTPSPPPQRDTSSSLSNDVLTKLRDLWAFIGDRFDAMDSRITRLEDDMSFIRRCFDPSADS

SEQ ID NO: 169998 - protein, 174 aa, Glycine max
  Coding DNA Sequence Number=SeqID_53220
MVGAGLKKDLRVSRVVPGGSLNAFLFLLIGVISQRLAMESIDSLPIGWTVGAMIYFTGEVSAQLVELRSCNWVVAITGPNMPLKDSTETKTGCQERRGGRMGSWSDLGFLIWDPGEEDQAGPCEQLDALSPFNPLSEMWQKEKESMDRPHRLHPVGTTRSPQGRLRHPGVADRP

SEQ ID NO: 169999 - protein, 383 aa, Glycine max
  Coding DNA Sequence Number=SeqID_53221
  Gene Ontology: Mol. function=cation transporter activity; Cellular component=integral to membrane; Biological process=potassium ion transport
  Homolog annotation: Hit_ID=Q845W9; Match level="QueryCoverage=89%, HitCoverage=61%, E-value=1e-112, Identity=58%"; Hit description =Aspartate:alanine antiporter
  Pfam annotation: Domain name=Asp-Al_Ex; Domain location=1-138; Score =77.7; E_value=3.7e-20; Accession=PF06826.3; Description=Predicted Permease Membrane Region
  Pfam annotation: Domain name=TrkA_C; Domain location=175-244; Score =30.4; E_value=6.4e-06; Accession=PF02080.11; Description=TrkA-C domain
  Pfam annotation: Domain name=TrkA_C; Domain location=258-331; Score =34.7; E_value=3.2e-07; Accession=PF02080.11; Description=TrkA-C domain
  Pfam module annotation: Pfam domain module=Asp-Al_Ex::TrkA_C::TrkA_C; Domain location=1-138::175-244::258-331
VAVVISQVGVQIDNGIKSVLFALFIYAVGFESGPQFFRSLGKQSIREIVLAAVLAISGLATVVVLAKLTGLDKGIAAGIAAGGLTQSAIIGTASSAIEKLGLAADETQRLQANVAIGYAVTYIFGSFGAIIVCVNILPWFMKRGIRDDAVKAEAEMLKGARVYGVGEAPALPDLVGRIFRVEGAAGKSIAELEALSTKGPITIERVKRGSALVGVEPELRLQNGDLVLIVGRRAGVVGLENLIGREVAAAEGLELVVTTRDIVVKDRDFAGQTVARILDRSKDLRHGIYVIQVTRAGVKLELTNDTVIRAGDIVTVHGVQEDLQRLSNRVGSVITPSDKTDFVYHGFGVAIGLLVGLLVLRIGSVPLTLGAGGGALLAGLVFG

SEQ ID NO: 170000 - protein, 73 aa, Glycine max
  Coding DNA Sequence Number=SeqID_53222
MEKSGGKHNNFGSMKEREWKIFRPDKFSARLPFSTGDIPPHMNKEEKTETPRFLSKNTTLEKILLVCDRTFDL

SEQ ID NO: 170001 - protein, 88 aa, Glycine max
  Coding DNA Sequence Number=SeqID_53223
MWGGISPIESDFEWQSQRKNHFKNGFSLCRQSLALSKNLSGFSIRYLLSLEEIPLSFSLGERMRILFMGQGSKQLKVVSQHGLFIMRA

SEQ ID NO: 170002 - protein, 254 aa, Glycine max
  Coding DNA Sequence Number=SeqID_53224
  Gene Ontology: Mol. function=CDP-diacylglycerol-serine O -phosphatidyltransferase activity; Cellular component=membrane; Biological process=phospholipid biosynthetic process
  Homolog annotation: Hit_ID=P23830; Match level="QueryCoverage=50%, HitCoverage=28%, E-value=3e-43, Identity=64%"; Hit description=CDP -diacylglycerol--serine O-phosphatidyltransferase
  Pfam annotation: Domain name=Acetyltransf_1; Domain location=19-95; Score=35.7; E_value=1.6e-07; Accession=PF00583.14; Description =Acetyltransferase (GNAT) family
MTQIDYDREMAIVAVRQHNGADEIIGVTRAISDADNIDAEFSVLVRSDLKGLGMGRRLLEKMIRYTRDHGLQQLNGITMPHNTGMITLARKLNFRVNIQLDDGIVSLNLPLADTGDLAVEKEKKCTVMLSKFKRNKHQQHLAQLPKLSQSVSDVTTLYSPAEFRETLLKKIATAEKRICIAALYLENDDGGRSIMQALYAARQARPELDVSILVDWHRAQRGRIGAARGLTNADWYCEMAAQHPDIAIPVYGIP

SEQ ID NO: 170003 - protein, 76 aa, Glycine max
  Coding DNA Sequence Number=SeqID_53225
MRHVKHEGHAQSVAMGCNNWTQRWPMGLEIYPEVHENPRAFFSSSSPILLEPLAHGSSDWSLPREDCITLSPPSKF

SEQ ID NO: 170004 - protein, 106 aa, Glycine max
  Coding DNA Sequence Number=SeqID_53226
  Homolog annotation: Hit_ID=Q1RX12; Match level="QueryCoverage=49%, HitCoverage=5%, E-value=4e-19, Identity=77%"; Hit description=Zinc finger, RING-type; Transcription factor jumonji, jmjC; Cupin region; Zinc finger, FYVE/PHD-type
MCHVWSTIDTCKSKCTRAALKKLNLVEDRSIPRDKLISFLRISVDLQYKDLRQFQWHWEKGEPVIVSNVLECTSGLSWESLVMWRALRHVTNTKHGQHLAEKTLIA

SEQ ID NO: 170005 - protein, 92 aa, Glycine max
  Coding DNA Sequence Number=SeqID_53227
MGFEFIVQACLVDGQGSDWRPFIHAPWWEDMVLPSGSLHSIVVLAFGNCIFKSSVETMAPSLLSVFLPIKAKYDASASTSRYCMLKLLEILP

SEQ ID NO: 170006 - protein, 224 aa, Glycine max
  Coding DNA Sequence Number=SeqID_53228
  Gene Ontology: Mol. function=transferase activity; Cellular component= cytoplasm; Biological process=spermidine biosynthetic process
  Homolog annotation: Hit_ID=Q9ZS45; Match level="QueryCoverage=44%, HitCoverage=25%, E-value=2e-27, Identity=67%"; Hit description =Spermidine synthase
  Pfam annotation: Domain name=Spermine_synth; Domain location=1-192; Score=-5.8; E_value=3.6e-07; Accession=PF01564.7; Description =Sperminespermidine synthase
MEAARTSVDHLPTIYLMKANLDAFVKKNMGTWVLVIGGGDGGVLREVARHSSVEKIDIFEIDKMVVEVSKQFFPDIAVGFEDPHVTLTVGDGMDNFSHDRLSLNDLGVAFLKNVPKGTYDAVIVDSSDPIGRALLKSCLKNTKCCRNVPFAGERGRGSRVRFPKEERCAELPPTFICGKRWQNRRKQVKMKILSSGVVFTFEEGRQKRGSCSYVPSIEEEIRPT

SEQ ID NO: 170007 - protein, 72 aa, Glycine max
  Coding DNA Sequence Number=SeqID_53229
MVGVVVTYNCYPLSNTILFQKAKPLILAAILQTATPSGEFVGKTPRDTKNVTRSGELPSCRPKGELQLQLAI

SEQ ID NO: 170008 - protein, 77 aa, Glycine max
  Coding DNA Sequence Number=SeqID_53230
MKVKHKRYAENTLYSSLHVMWYHFSVKNLVGRLGVHDRTCLTMGLKEHSNRMTPKACTPKSPLGPLPPDSGPTKKNI

SEQ ID NO: 170009 - protein, 88 aa, Glycine max
  Coding DNA Sequence Number=SeqID_53231
MENSPWPQQQGPSLYERTTKLEETLAQFMQLSLTNHKSTESAIKNLEVQVGQLAKQLAEKSSSTFGANTEQNPKEECKAVMLDQVASE

SEQ ID NO: 170010 - protein, 671 aa, Glycine max
  Coding DNA Sequence Number=SeqID_53232
  Gene Ontology: Mol. function=RNA-directed DNA polymerase activity; Cellular component=chromatin; Biological process=chromatin assembly or disassembly
MVSTRGIDARVEFLEHSYEGFITTHEVLQELRRMFEEERLQRTEIRRQIGELIETVRGMSNSGGHAGGRNNSIPTLIPKTATSGGRNLKFQPLTVSMYMVGRGPSSNGRNGGKCSNMDQWWEFLKQEGTVEEYHERFELYAGPLRGAEPEYLKRDFSEWLKGCSEGRTQTSSSSLPELMDFAQSIDEKNTLLTKGNTPGSKGGGSSRNYTSSRIVVTLDLGNKGSQFKSPEGSSSMDTNSVRSTGSYRGRPFKRLSDAELQDKANRGWCYQCDGREREITVTTTPPYTVEVGDGRMIRCEGVCKQVIFQVQGLEIQQDFFIFGLGEAISCWEWSGWQDWEIKANFKDLTLKVPTPNGKQILKGELAMSRSAASFKTDGGWRFCVDYRALNKITIPDKFPIPMIDELLDEKTAFRTHEGHYEFVGMPFGLTNAPSTFQALMNEGGGTTIYGNTKKKLWLKSPSSVPDFSQNFCIETIVSNKGLGSVLMQQGRPVAFLSQTFSERAQKKSVYERELMANVMASKWTSKLMGFDFEILYKPGNDNRAADALSRQMTYEAISLVHNPSSHLSYTFQNRKLWYKGKLVLPIGSSKIHTLLTEYRSSAIGGTQVCDKTSRGFSLLVRSSNKINISPSQSRVSYNDYLFLHWLGSDISMDFVEGLPKAQGKNAILVVV

SEQ ID NO: 170011 - protein, 133 aa, Glycine max
  Coding DNA Sequence Number=SeqID_53233
  Gene Ontology: Mol. function=hydrolase activity; Cellular component =membrane; Biological process=metabolic process
  Homolog annotation: Hit_ID=Q67Y53; Match level="QueryCoverage=88%, HitCoverage=44%, E-value=4e-43, Identity=72%"; Hit description=MRNA, , clone: RAFL25-14-B08
  Pfam annotation: Domain name=Hydrolase_3; Domain location=1-128; Score=-62.1; E_value=0.0015; Accession=PF08282.2; Description =haloacid dehalogenase-like hydrolase
MAWLLLLLFFVHFSHKMIFLDTDRRVADTLRPYWSDATNGRASVVQAVPDMLEIVPVGTSKGNGVKVLLDHFEVTAKEIMAIGDGENDVEMLELASLGIALSNGSEKTKSVANVIGLSNDEDGAADAIYRYAF

SEQ ID NO: 170012 - protein, 454 aa, Glycine max
  Coding DNA Sequence Number=SeqID_53234
  Gene Ontology: Mol. function=ATPase activity, coupled to transmembrane movement of ions, phosphorylative mechanism; Cellular component=membrane; Biological process=metabolic process
  Homolog annotation: Hit_ID=Q5JNL2; Match level="QueryCoverage=70%, HitCoverage=48%, E-value=2e-95, Identity=57%"; Hit description =Haloacid dehalogenase-like hydrolase-like
  Pfam annotation: Domain name=UPF0054; Domain location=177-270; Score =101.9; E_value=1.9e-27; Accession=PF02130.7; Description =Uncharacterized protein family UPF0054
  Subcellular localization annotation: CTP_CleavageSite=60; ConfidenceScore=5.69e-01
MARAVTCATQPSHFHASLGIATSRHPVSLPSKSSLFCRTFHALARCQSEEMTRRRVAGVRAGQREYRKARRRAPPKSKGKELQLCVDICIEEDLPDDPEILSISNGSSCEQGFYMSAAETAIKNLACESIAELLRLNVPMAMKLVFDGLKGSRYKTRDTAISDVGGFDSVELSVLLCNDEFIRKLNKEWRNEDRATDVLSMSQHVPGLKIPILMLGDVVISVETAARQAEERGHTLLDEIRILMVHGLLHLLGFDHEISEEAEVEMEREEEILLKSLDWKGKGLIRSAFDAETNSNFHQDSADDELSKDRKKEGSLRFYKPKFRYIFCDMDGTLLNSKSQISSTTANALREASSRGVKIVIATGKARPAVIDIFKMVDLAGKDGIVSEFSPGVFLQRTPLPRGSSLCEGMREGYCTQPYPCICKEAVSGFEPMTNKLPRHNFTAAPGLALSILY

SEQ ID NO: 170013 - protein, 114 aa, Glycine max
  Coding DNA Sequence Number=SeqID_53235
  Subcellular localization annotation: CTP_CleavageSite=44; ConfidenceScore=5.44e-01
MLKFMSSLFSCNKPSTNKRIFASGKALLSFAKANCPDEASPAPYAASPATPSLRPLMPATPYAALHGVASLTGNIHAVISQLPLATSIPRVACLHVSPACMANDYTHQYMHNFT

SEQ ID NO: 170014 - protein, 474 aa, Glycine max
  Coding DNA Sequence Number=SeqID_53236
  Gene Ontology: Mol. function=transferase activity; Cellular component= nucleus; Biological process=regulation of transcription
  Homolog annotation: Hit_ID=Q1SV87; Match level="QueryCoverage=78%, HitCoverage=70%, E-value=4e-71, Identity=36%"; Hit description =Pentatricopeptide repeat
  Pfam annotation: Domain name=PPR; Domain location=158-192; Score =13.9; E_value=0.17; Accession=PF01535.11; Description=PPR repeat
  Pfam annotation: Domain name=PPR; Domain location=220-254; Score =48.4; E_value=2.5e-11; Accession=PF01535.11; Description=PPR repeat
  Pfam annotation: Domain name=PPR; Domain location=255-289; Score=4.8; E_value=2; Accession=PF01535.11; Description=PPR repeat
  Pfam annotation: Domain name=PPR; Domain location=321-355; Score =38.0; E_value=3.3e-08; Accession=PF01535.11; Description=PPR repeat
  Pfam annotation: Domain name=PPR; Domain location=356-390; Score=2.0; E_value=4.3; Accession=PF01535.11; Description=PPR repeat
  Pfam annotation: Domain name=PPR; Domain location=88-122; Score=35.4; E_value=2e-07; Accession=PF01535.11; Description=PPR repeat
  Pfam module annotation: Pfam domain module=PPR::PPR::PPR::PPR::PPR::PP R; Domain location=158-192::220-254::255-289::321-355::356-390::88-122
MKVACCTPDINVPYLETPRTRFGSEEALVLLKKCSNFKQLKQVHGKIIRYGLTYDQLLVRKLIQLSPSYGKMKYATLVFDQLNAPDVFTWNVMIRAYTIGGSPKMAFLLFKAMLYQGFAPDKFTYPCVINACMAYNALDVGRVAHALAIKMGFWGDLYVQNTMMNLYFKCENVDDGWNVFDKMCVRNVFAWTTVIAGFVACGKLDTARELFEQMPSKNVVSWTAIIDGYVKHKQPIEAFDLFERMQADNVRPNEYTLVSLVRACTEMGSLKLGRRVHDFALKNGFELEPFLGTALIDMYSKCGNLDDARTVFDMMQMRTLATWNTMITSLGVHGYRDEALSIFEEMEKANEVPDAITFVGVLSACVYMNDLELAQKYFNLMTDHYGITPILEHYTCMVEIHTRAIKLDEIYMSGNTMEANHDVAELLHKNKLTSFDDIKKLIHKKYGDLDFSELVLDHSSTSSSGMQIDISKIR

SEQ ID NO: 170015 - protein, 245 aa, Glycine max
  Coding DNA Sequence Number=SeqID_53237
  Gene Ontology: Mol. function=RNA-directed DNA polymerase activity; Cellular component=mitochondrion; Biological process=RNA-dependent DNA replication
MAGEEEESDYMTPNRNFLIRGVLPSDENEARCLKWKANYYVILDGELLKRGLTTPPLKCLNSQQVDYVMGELHDGICGLHTGERSLTTKFANVPRTPSDNLHSLYSPWPFAMWVMDILGPLPKAPGVVKYLLVVINYFTKWIEDHYGNICRLPSKARHQAPCHLIEHPQTNGQAEAANRVILRALRTRLDKSKDVMIPIEVGDVEPSTRRLLFWQQQNDENIRVEIETTDEVQDMVRIREEATKL

SEQ ID NO: 170016 - protein, 668 aa, Glycine max
  Coding DNA Sequence Number=SeqID_53238
MKAMKEKMATMMEVGMSMKRVMEVNTTTVIVASIATEVDLIHPSSINQASRPASDMVGQGGEALGSTGGPHFVQVQNKHSFPPYDLPPNYASPDVAHAPDENTLEAPRDHNLIDFEPHLGYATEGQAVGVPPAMVEREKFNHIEEMLRAIERGRDHVFVDMAELCLVPDVVIPPKFKVPDFDKYKGTTCPKNHLKMYYRKMEAYAKDEKLLMHFFQESLTGAAVTWQYQYNSDMAPDRMQLQNMCKKEYESFKEYAQSNVSSSLHALRQVVGLTLGSGRPSSVEDVPSAPPIVEAPVVDVVIAITSSPPPPVVLVQEVAPIAAEESEPATLAGSIVGPSSTVVAPLLSVCVATTSASMAFPHSSLPPMVPLSTALASTSTSYHPHVSLDHIYTSNDVDSLWSMEVVARTAWRVECPKVANAIVSLVEAVRSNHQLSSKVGNVLAKLLRIGLDGDELFRRCKDLQEEKKELGWQGRGCGGGKGQAAREMEASKKLKEELLVYKKEAVEQHEKGFNKVVRQVGFFTKGLDLGLFDPFKDVKEYILLDEDDIVMEEEAAGLVTHLVMILSTLPLVEGLANQSKVRFVELGPLTMVVELQRVSGPRRCFGFCRSAYQGADLAYLEFLWRWNLATERAHQGLGFFELVRITKHVLEMSCRESVGITKDGPWIL

SEQ ID NO: 170017 - protein, 76 aa, Glycine max
  Coding DNA Sequence Number=SeqID_53239
  Pfam annotation: Domain name=zf-CCHC; Domain location=46-63; Score =11.2; E_value=0.014; Accession=PF00098.13; Description=Zinc knuckle
MALGVMAARPGPIMCHDPKIERKKKGRPRLTLIHIEMNERQRGQLKHCSLCKTIGHSKNKCPKNQESTSQSCQHTH

SEQ ID NO: 170018 - protein, 250 aa, Glycine max
  Coding DNA Sequence Number=SeqID_53240
MVKKWMKSIIASLEWVVVEGSRMSVLFGLRVGRMVGILTGVEVGLVEAVQDEIFNKATKLGGNGLLHGAKLIGVGPELVVWMMTTIASLEVALCEVDSIEASFGLAFGSIATMIEIISATLGASAVTIVDDEGVGHGLPAFPLSSYGCQRRNGIILSVATISILKSTCVELEEMTPLVSYHAAWFHEVLASYAPSFLMSFRPRSMVDFVWHHVDVNASGDVKSKGMCCCLVWYIHLLIPPIMSSSCKEGL

SEQ ID NO: 170019 - protein, 85 aa, Glycine max
  Coding DNA Sequence Number=SeqID_53241
MDDKRFGLEIFVFDAQQDIKGIMDLNLLRASPGAAKQPLCICKGKAAYNIPPPYLRIAKSLWAMGYEVKLMDLNLLIDSVDSARN

SEQ ID NO: 170020 - protein, 181 aa, Glycine max
  Coding DNA Sequence Number=SeqID_53242
  Homolog annotation: Hit_ID=Q1SUQ2; Match level="QueryCoverage=45%, HitCoverage=37%, E-value=4e-10, Identity=61%"; Hit description=Beta -lactamase-like; RNA-metabolising metallo-beta-lactamase
MELLNRISEIGSTIVMGKNECLHTSGHGYHGELENPAVVLTNEINTKLSGKLNVDGMSTLRKVVDGHEKQNQRTKMQIRGKINLHLKNTYRIVEDAKTKIEKQDRTIGMQNLLLVFKRPGLSLLLQAFMRPGLSLITMLITIDSLLLLRTCHLSYSLLLGLRGRIETSWGQACFDTNLRKF

SEQ ID NO: 170021 - protein, 88 aa, Glycine max
  Coding DNA Sequence Number=SeqID_53243
MEVMTLMRNKIALLPLLWAHKCYTEVRRQTGKTNTEWLLTFPKIGSLLFFQSNLSLSPLCICKGKTAYNISPPYLRIAKSLWAIGLYY

SEQ ID NO: 170022 - protein, 207 aa, Glycine max
  Coding DNA Sequence Number=SeqID_53244
  Gene Ontology: Mol. function=hydrolase activity; Cellular component =peroxisome; Biological process=aromatic compound metabolic process
  Homolog annotation: Hit_ID=Q9ZP87; Match level="QueryCoverage=100%, HitCoverage=68%, E-value=4e-58, Identity=53%"; Hit description =Epoxide hydrolase
GLKLHVVEIGSGQKALVFLHGFPEIWYTWRHKMIVAANAGYRTIAFDFRGYGLSQHHAKPQKANLLDLVDDVVGLLDSLGITKDFGAFPAYIVVALHLEKVDSVIMLGFPFMLPGPSVIQNLPKGSYVIKWQEAGRVEADFVCFDVKSVIRNIYTLFSGSEIPIAGDNQEIMDLYDPTTPLPPWFSEEDLATYESLYKKSGFRFALQ

SEQ ID NO: 170023 - protein, 74 aa, Glycine max
  Coding DNA Sequence Number=SeqID_53245
MTNQSHPQMKRRPGQPKKARRKDITEGESSNNRIMMKRNFPTVTCMRYGLEGHNSRGCNNGGVPPKPKKWNIRH

SEQ ID NO: 170024 - protein, 658 aa, Glycine max
  Coding DNA Sequence Number=SeqID_53246
  Gene Ontology: Mol. function=acetate-CoA ligase activity; Cellular component=cytoplasm; Biological process=metabolic process
  Homolog annotation: Hit_ID=O49063; Match level="QueryCoverage=99%, HitCoverage=98%, E-value=0.0, Identity=78%"; Hit description=Acetyl -CoA synthetase
  Pfam annotation: Domain name=AMP-binding; Domain location=138-558; Score=439.8; E_value=3.6e-129; Accession=PF00501.18; Description=AMP- binding enzyme
MKLLPSGAGHISHLNAVILGESLATEEDDFVLPSEDFASQANVQSPEQYLKMYNRSIEDPAGFWSEIASEFYWKQRWGDKVCDENFDVRKGNIKIEWFKGGITNICYNCLDRNVEAGLGDKVAIYWEGNEPGLDGTLTYTELLQQVCQLANYLKDIGVKKGDAVIIYLPMLMELPIAMLACARIGAVHSVVFAGFSAEALSQRIIDCKPKVVITCNAVKRGPKPIYLKDIVDAAINDSAQNGDVIPQYPTTCPLEWVDAEDPLFLLYTSGSTGKPKGVLHTTGGYMVYTATTFKYAFDYKPSDIYWCTADCGWITGHSYVTYGPMLNGASVIVYEGAPNYPDAGRCWDIVDKYKVTIFYTAPTLVRSLMRDGDAFVTRYSRKSLRVLGSVGEPINPSAWRWFYNVVGDSRCPISDTWWQTETGGFMITPLPGAWPQKPGSATFPFFGVQPVILDEKGVEIEGECNGYLCVKKSWPGAFRTLYGDHERYETTYFKPFAGYYFSGDGCSRDKDGYHWLIGRVDDVINSDVVAIICSGHRIGTAEVESALVSHPQCAEAAVVGVEHEVKGQGIYAFVTVVDGVPYSEELRKDLVLIVRKQIGAFAAPDKIHWAPGLPKTRSGKIMRRILRKIASRQLDELGDTSTLADPNVVNQLIELADS

SEQ ID NO: 170025 - protein, 270 aa, Glycine max
  Coding DNA Sequence Number=SeqID_53247
  Gene Ontology: Mol. function=translation release factor activity, codon specific; Cellular component=cytoplasm; Biological process =translational termination
  Homolog annotation: Hit_ID=Q75I90; Match level="QueryCoverage=98%, HitCoverage=70%, E-value=1e-128, Identity=78%"; Hit description =Eukaryotic peptide chain release factor subunit 1-3
  Pfam annotation: Domain name=eRF1_1; Domain location=5-101; Score =95.5; E_value=1.6e-25; Accession=PF03463.6; Description=eRF1 domain 1
  Pfam annotation: Domain name=eRF1_2; Domain location=105-239; Score =189.5; E_value=8.3e-54; Accession=PF03464.5; Description=eRF1 domain 2
  Pfam module annotation: Pfam domain module=eRF1_1::eRF1_2; Domain location=5-101::105-239
MADGESDKNIEIWKIKKLIRALESARGNGTSMISLIMPPRDQISHVTKMLGDEFGTASNIKSRMARKKKVTIDFEPFKPINASLYLCDNKFHIEALNELLESDDKFGFIIMDGNDTLFGTLTGNTREVLHKFTVDLPKKHGRGGQSALCFACLRMEKRHNYVRNTAELATQFFINPATSQPNVSGLILAGSVGFKTELSQSDMFNPRLQAKILNVVDVSYGGENGFNQAIELSAEMLSNVKFVREKRLIRKYFEEISQDTGKYVFGVEAR

SEQ ID NO: 170026 - protein, 328 aa, Glycine max
  Coding DNA Sequence Number=SeqID_53248
  Homolog annotation: Hit_ID=Q2R300; Match level="QueryCoverage=98%, HitCoverage=40%, E-value=3e-78, Identity=43%"; Hit description =Importin, putative, expressed
  Subcellular localization annotation: CTP_CleavageSite=40; ConfidenceScore=5.12e-01
VDPDISLSLKQNPASYMQVLNASSRGLHRMGTVFSYLPISMATEPAADDSILSLLRVFWPILEKIFGSEHMENGNLSVAACRALSLAVRSSASIVIEEFGHLEEYGPLFVTSFERFTHAASVMALTSSYICDQEPDLVEAYTNFASTFIRSCNKSAYLYLIDDVSQDALSACGSLLEVSIQKAAICCTAMHRGAALAAMSYLSCFLDVGLVSLLECMNCITEGSFNITAIHVISHSGEGLVSNVVYALLGVSAMSRALPAEYLSHGEVEAIVPLWSKALADAATDYLESKNSDGLKSDFGHMQGKGGRVLKRLVREFADAHRNIPNVT

SEQ ID NO: 170027 - protein, 86 aa, Glycine max
  Coding DNA Sequence Number=SeqID_53249
HSQRFATTFNIPPFAYNLPPSSSCYRLSLPTQMHDMGHEDEEKDDDNNNNNNNDDCDDDDDHGGDDVAQQQQIVTHDHPRTRRGRC

SEQ ID NO: 170028 - protein, 179 aa, Glycine max
  Coding DNA Sequence Number=SeqID_53250
  Homolog annotation: Hit_ID=Q2R300; Match level="QueryCoverage=71%, HitCoverage=13%, E-value=4e-24, Identity=45%"; Hit description =Importin, putative, expressed
MLSIKPSDGLKGFICIVYRSLADAVGSFSKWISAFKENFRALLLFLAIGISQPLSSNACASALRKVCEDASVVIYEPSNLEILMWIGEGWDKWHLSLEDEEEVMHAISLVLGSVPNLELKNKLLAKLLSPSYEAIGKLVSLRFPFLFTTDFDCAMPILTSSIELVVSTAFFQHYALIHL

SEQ ID NO: 170029 - protein, 710 aa, Glycine max
  Coding DNA Sequence Number=SeqID_53251
  Gene Ontology: Mol. function=helicase activity; Cellular component =mitochondrion; Biological process=embryonic development ending in seed dormancy
  Homolog annotation: Hit_ID=Q9LSQ2; Match level="QueryCoverage=79%, HitCoverage=89%, E-value=1e-171, Identity=39%"; Hit description=Salt- inducible protein-like
  Pfam annotation: Domain name=PPR; Domain location=209-243; Score =23.3; E_value=0.00087; Accession=PF01535.11; Description=PPR repeat
  Pfam annotation: Domain name=PPR; Domain location=244-278; Score =46.8; E_value=7.4e-11; Accession=PF01535.11; Description=PPR repeat
  Pfam annotation: Domain name=PPR; Domain location=279-313; Score =43.6; E_value=6.8e-10; Accession=PF01535.11; Description=PPR repeat
  Pfam annotation: Domain name=PPR; Domain location=314-348; Score=0.5; E_value=6.5; Accession=PF01535.11; Description=PPR repeat
  Pfam annotation: Domain name=PPR; Domain location=389-423; Score =11.9; E_value=0.29; Accession=PF01535.11; Description=PPR repeat
  Pfam annotation: Domain name=PPR; Domain location=424-458; Score=6.7; E_value=1.2; Accession=PF01535.11; Description=PPR repeat
  Pfam annotation: Domain name=PPR; Domain location=459-493; Score =43.0; E_value=1e-09; Accession=PF01535.11; Description=PPR repeat
  Pfam annotation: Domain name=PPR; Domain location=494-528; Score =47.4; E_value=5e-11; Accession=PF01535.11; Description=PPR repeat
  Pfam annotation: Domain name=PPR; Domain location=529-563; Score =41.8; E_value=2.3e-09; Accession=PF01535.11; Description=PPR repeat
  Pfam annotation: Domain name=PPR; Domain location=571-604; Score =15.5; E_value=0.11; Accession=PF01535.11; Description=PPR repeat
  Pfam annotation: Domain name=PPR; Domain location=605-639; Score =30.8; E_value=4.8e-06; Accession=PF01535.11; Description=PPR repeat
  Pfam module annotation: Pfam domain module=PPR::PPR::PPR::PPR::PPR::PP R::PPR::PPR::PPR::PPR::PPR; Domain location=209-243::244-278::279 -313::314-348::389-423::424-458::459-493::494-528::529-563::571 -604::605-639
  Subcellular localization annotation: CTP_CleavageSite=65; ConfidenceScore=5.44e-01
PRQHHSLRHSLHPNAFSLLRPLPSSKQTNMPLQLQPFFRHIKPPNQTPSTNLIPPKPLNPLQTPPSSPSSPPIDHLYISQLLSRPDWAVLLNHDLSSKTLLLNPSYAVSIFQNQQNPSHAIKFHSWLSHVNPTLAAHNSVHRALRNTLHRKGPALLSVDLLRELRNLGFRVTEDLLCALLASWGRLGLANYSAHVFCQISFLGLSPTTRLYNALIDALVKSNSIDLAYLKFQQMAADNCVADRFTYNTLIHGVCKVGVVDEALRLVRQMKDKGHFPNVFTYTMLIEGFCIASRVDEAFGVFETMKDSGVYPNEATVRALVHGVFRCVDPSKALELLSEFLDREQEQERVHFMLACDTVLYCLANNSMAKEMVVFLRRVLGRGGYFPGNSVFNVVMACLVKGAELRETCDVFEILRKQGVKAGIGAYLALIEVLYKNEWREEGDRVYGQLISDGLISNVFSYNMIINCFCRAKLMDNASEAFRDMQVRGVVPNLVTFNTLINGHCKDGAIDKARKLLESLLENGLKPDIFTFSSIVDGLCQIKRTEEALECFTEMIEWGINPNAVIYNILIRSLCTIGDVARMNKVEKAKKLFDSMSRSGLNPDNYTYSAFIEALSESGRLEEAKKMFYSMEANGCCYIIELLKLKRVQVRGYSTVVELGRLGQPMTARAPSFIATQPILCVEEHEFGVSLMTGQPKISSFLAIGPFGSLL

SEQ ID NO: 170030 - protein, 444 aa, Glycine max
  Coding DNA Sequence Number=SeqID_53252
  Gene Ontology: Mol. function=transferase activity; Biological process= flavonoid biosynthetic process
  Homolog annotation: Hit_ID=Q94CD1; Match level="QueryCoverage=95%, HitCoverage=92%, E-value=5e-52, Identity=31%"; Hit description =Putative N-hydroxycinnamoyl/benzoyltransferase
  Pfam annotation: Domain name=Transferase; Domain location=15-442; Score=448.9; E_value=6.7e-132; Accession=PF02458.6; Description =Transferase family
MGTTCPESPPLLQDLRVTIHETSMVFPSKETEKRSLFLSNIDKVLNFEVETVHFFGANKDFPPQKVAKMFKNALEDALVVYDFLGGRLNLNPETKRLEIDCNAKGAGFVVASSEYKLSEIGHLVYPNPSFAQFVHKSKDFLQQNDQPLCVAQLTSFKCGGFAIGFTTSHTTFDGLSFKTFLDNLAALAANKPLAVIPCHDRHLLAARSPPRVSFPHHELIKLDNLPTGSTESSVFEASKEELDFKVFQLTSHNILSLKEKAKGSTNARATGFNVITAHIWRCKALSAPYNPSRSSTILYAVDIRPRLNPPLPKSFAGNAVLTAYATAKWEELEKGEFSSLVGMVTEGAKRMSDEYTRSMIDWGEVHSGFPHGEVLVSSWWRLGFEEVEYPWGKPKYCCPVVYHRKDIILVFPPFGSGDDGINIIVALPPKEMDKFETLFYMFLN

SEQ ID NO: 170031 - protein, 53 aa, Glycine max
  Coding DNA Sequence Number=SeqID_53253
MVAALEVVVVAMVTVVLQQQSYLINPSEVPKTANYQVPQPQSAPASSIVSKHP

SEQ ID NO: 170032 - protein, 59 aa, Glycine max
  Coding DNA Sequence Number=SeqID_53254
MGDLAYVRKEWACGILIMNDLAYTGENMSKLKFDFVLGGVTQFGIFMWLMLIPWVEVSL

SEQ ID NO: 170033 - protein, 213 aa, Glycine max
  Coding DNA Sequence Number=SeqID_53255
  Gene Ontology: Mol. function=nucleic acid binding; Biological process= DNA integration
  Homolog annotation: Hit_ID=Q1S7C5; Match level="QueryCoverage=74%, HitCoverage=14%, E-value=9e-26, Identity=33%"; Hit description =Integrase, catalytic region
  Subcellular localization annotation: CTP_CleavageSite=33; ConfidenceScore=5.49e-01
MASANNNSSPSPPPPPPLPPAPHSHVSFLHTVTAKLTDSNYLLWRSQVQLIPQKFLTVEDLDNNIVSTAYRFWEQQDQLILSWLQSTISETVLPRIINCATSWHLWDRLYEHFQSTTRAKKKHLHSELRSSSLENRLITAYLLHIQSLIDSLASIGDSISTSAHINLILDGFPNDYRTICTILNNLRDPLNLDNVTSMLLLRNLALKSLARRI

SEQ ID NO: 170034 - protein, 365 aa, Glycine max
  Coding DNA Sequence Number=SeqID_53256
  Gene Ontology: Mol. function=protein transporter activity; Cellular component=nuclear pore; Biological process=protein import into nucleus, docking
  Homolog annotation: Hit_ID=Q2R300; Match level="QueryCoverage=74%, HitCoverage=28%, E-value=6e-52, Identity=45%"; Hit description =Importin, putative, expressed
  Pfam annotation: Domain name=IBN_N; Domain location=72-140; Score =12.3; E_value=0.0038; Accession=PF03810.9; Description=Importin-beta N-terminal domain
  Pfam annotation: Domain name=Xpo1; Domain location=149-306; Score =86.4; E_value=8.6e-23; Accession=PF08389.2; Description=Exportin 1 -like protein
  Pfam module annotation: Pfam domain module=IBN_N::Xpo1; Domain location=72-140::149-306
MRSWCMVGCRGAEPNPHPSLSHSLLCHSLIARSRPMQRKSQPKAHIMELAMKVAEAVHVLNHDTQSCNRVAANQWLVQFQQTHAAWDVATAILTADRRLPLPANFEVEFFAAQILKRKIQNEGYLLQLGVKDALLNALLLAVKRFSTGPPQLLTQICLALSALVLQVAAHGNPIKQLFYSLRNLQSQDDDNIAVLEMLTVLPEEVVDNQHIDSKISTLHKSHYTQELLSHTPMVLEFLLQQSETNFDGSVQQHERNRKILRCLLSWVKAGCFSEISPGTLPAHPLLNFLFNSLQVPLSFDLAIEVLVELVTKHEGIYHALSHELHHDLLDHTNSHHHPSLDYHTQNHNLRRSVCYPELDEPELQK

SEQ ID NO: 170035 - protein, 94 aa, Glycine max
  Coding DNA Sequence Number=SeqID_53257
MRFWMLTFVSKRPFKGNTGSNKIEENHSKCIDLTQGKDGHSHPGSRFMVSWDFGSRLVERLDMIYVRVLDMKGLGVVFTHGEGISTPHVRRKRR

SEQ ID NO: 170036 - protein, 169 aa, Glycine max
  Coding DNA Sequence Number=SeqID_53258
MKLPFYPELLKAFYSNLEIQEDSLISEVYGIKMVIDQSLFFELTQLFSVGVPFKGTLDDEWKFDFSVSDACRMVCTNQADMTGRILAGSLAFECHIMQYLIVRTSYFLDHPTLHRLGGLHTFVGERFDSLDSRIDAMDARFTGMDTRITQLEENMSYIRQCFDLPPPSS

SEQ ID NO: 170037 - protein, 166 aa, Glycine max
  Coding DNA Sequence Number=SeqID_53259
MEDTKPMKTSMHDSNPLRKNESDKPVDQTIYRAQAFPKNLFIPGKWINFQSQKKEGFEMCSGWFDHEQRLDKEITQETMDKFLYGKSHPNGGDKKALHTFLRTTNLTYMCRMIHSVSFNIFMPRVGSRDYVSDKEFFCIYKIMMQAFKDRFNPKVKKNHLPSSPRL

SEQ ID NO: 170038 - protein, 151 aa, Glycine max
  Coding DNA Sequence Number=SeqID_53260
  Homolog annotation: Hit_ID=Q1SM20; Match level="QueryCoverage=79%, HitCoverage=31%, E-value=2e-19, Identity=37%"; Hit description =Nucleic acid-binding, OB-fold
  Pfam annotation: Domain name=DUF223; Domain location=41-135; Score= -0.2; E_value=0.003; Accession=PF02721.5; Description=Domain of unknown function DUF223
MARIPDKIRSIDGSKETLKLAVRITDLWFVGTPNKSEQAKMVFVDSEGDQIHAICKSDHLKSWKADLKENCTYVMHNFKVVKNDGQFRVCEHEYKLFFIGVTVVREADLHELPFKEFRFVEFTNVVASNFVSGLLVGGLSACFIEKYQGCF

SEQ ID NO: 170039 - protein, 152 aa, Glycine max
  Coding DNA Sequence Number=SeqID_53261
  Homolog annotation: Hit_ID=Q9FJY2; Match level="QueryCoverage=43%, HitCoverage=42%, E-value=1e-13, Identity=56%"; Hit description =Arabidopsis thaliana genomic DNA, chromosome 5, TAC clone:K1F13
MDETINADAKLTSTVEEQNGVAGPQCRQQTTQCVANEPPRKANCTGRRRSSNIVVKTSKWCREEECTERVNTGVLGVQKYLVCFICNSNEMKFHDVVSAIDEDQVLQPGQLYFVVPLSLLKHPLQAHEMAALVVKVSSTLMKTADKCGSRQK

SEQ ID NO: 170040 - protein, 235 aa, Glycine max
  Coding DNA Sequence Number=SeqID_53262
  Gene Ontology: Mol. function=catalytic activity; Cellular component =integral to membrane; Biological process=metabolic process
  Homolog annotation: Hit_ID=Q0TDD6; Match level="QueryCoverage=97%, HitCoverage=40%, E-value=9e-81, Identity=70%"; Hit description=AMP -dependent synthetase
MSETSSVHSLPMRYADFPTLVDALDYAALGNTGMNFYDRRNQLVTVLEYRTLQQKAISGARRLLSLKLKKGDRVALIAETSAGFGEAFFACQDAGLVAVPLAIPMGVGQRDSYTAKLKGLIASCNPAAIVSSEEWTPLIASATENTSALHILSDADFNALPEPEIALPAPSPDDIAYLQYTSGSTRFPRGVIITQRAAMANLNAISRDEIKLRAGRPLRFVAALLSRYGSGSVAC

SEQ ID NO: 170041 - protein, 78 aa, Glycine max
  Coding DNA Sequence Number=SeqID_53263
  Homolog annotation: Hit_ID=UPI00006A2901; Match level="QueryCoverage =40%, HitCoverage=20%, E-value=2e-10, Identity=96%"; Hit description =UPI00006A2901 related cluster
  Subcellular localization annotation: CTP_CleavageSite=11; ConfidenceScore=5.34e-01
PNPSGCRWTARAASAARAGRRVPVGGRIGNGPFGASSPGVEQSTQNCALNVKVKKFNQARVNGGSNYDSLKVAKCLVI

SEQ ID NO: 170042 - protein, 180 aa, Glycine max
  Coding DNA Sequence Number=SeqID_53264
MDEGEECDNESSLGGDELLVDFSDNVKRVGGGGHNAKMEAAMWKGLTLSALLMARSNPNRSIGGGTLESIKNTTITNKESLNDYIEVSQPMMMIMLEVERFSFSHGNILIDVTSGHMTFISHVSQDPKWGWRRDRRGGSRGRVVVIREFSLLKMSPMRLTMCLVVESAEVDRGGGEREDN

SEQ ID NO: 170043 - protein, 314 aa, Glycine max
  Coding DNA Sequence Number=SeqID_53265
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-35, Identity=32%"; Hit description= UPI00006A17C9 related cluster
VLAFRGLQILAFRGLHVLTFIGLHVLTFRGLHALAFRGLHFHAFRGLHVFTIRGLHVLAIRRLHALAVRGLHILTIRGLHVLAFRGLHVLAFKGLHVLVFIELHVLAFRGTHILVIRGLHVLSFRTLHIPTFIGLHRTTRPRHHKTTRPRHQRAAWRRLQRETCPHHHRTTRPRIHRTTRPRLQRTTHPRHQKTTRPRHQRATRLHVLAFRGLHVLAFRGLHVLTFRGLHLLILRGLHLPTFRGLHALAIRGLHALAIRGQHALTFRGLHVLTFRGLHVLAFRGLPVHTFRGLHVIPFRGLHVLAFRGLHVLTF

SEQ ID NO: 170044 - protein, 55 aa, Glycine max
  Coding DNA Sequence Number=SeqID_53266
MNRESTLIWQDAKRMNTKCSIECEEDEEMCTIRRYICIEVLVSGCSKVYGIGLKA

SEQ ID NO: 170045 - protein, 62 aa, Glycine max
  Coding DNA Sequence Number=SeqID_53267
MAGDGLRPMFHPEAMGHATLPPLSCYSCLNMCPPNAPWNASMTYEHGLGQREGFKMSARMQF

SEQ ID NO: 170046 - protein, 125 aa, Glycine max
  Coding DNA Sequence Number=SeqID_53268
  Gene Ontology: Mol. function=GPI anchor binding; Cellular component =membrane; Biological process=root hair cell differentiation
  Homolog annotation: Hit_ID=Q8GZ17; Match level="QueryCoverage=96%, HitCoverage=20%, E-value=3e-21, Identity=49%"; Hit description=COBRA- like protein 7 precursor
MSFANAQFCNGILVSYAYTVDVRLPSNVFDPAKEPYQFESTVTVLNNDLDKLKSWEVFGGYDQDELLVSASNVLLADDTTLPVAVEKDRRRNHRQLDPDVDQTCRHHVRGGINQCFNAEIHQPRQ

SEQ ID NO: 170047 - protein, 85 aa, Glycine max
  Coding DNA Sequence Number=SeqID_53269
MMSSLALASVVSLTLEGSPPHQQRVGLLAQATCWIKASGVVNGGSIPRIEVDGGWRRAVGGGGGCAGDGASGAASLAQAQRALGR

SEQ ID NO: 170048 - protein, 60 aa, Glycine max
  Coding DNA Sequence Number=SeqID_53270
MGLQIRFDGGGRTNNARQSIRGAPDLMAINSWGSGLDGGGRTNNARQSIRGAPDLMVEDA

SEQ ID NO: 170049 - protein, 115 aa, Glycine max
  Coding DNA Sequence Number=SeqID_53271
  Gene Ontology: Mol. function=protein binding; Cellular component =nucleus; Biological process=multicellular organismal development
  Homolog annotation: Hit_ID=Q84XL0; Match level="QueryCoverage=51%, HitCoverage=33%, E-value=8e-24, Identity=86%"; Hit description=SP3D
MGIHRLVFVLFRQQFRQRVYAPGWRQNFNTREFAELYNLGLPVAAVFFNCQRESGSGVRKGERNKHEQPCNPRNTICVSKERKEQLNKHIENEWEKEESFTLREGRTLVSHVTRN

SEQ ID NO: 170050 - protein, 92 aa, Glycine max
  Coding DNA Sequence Number=SeqID_53272
  Gene Ontology: Mol. function=nucleic acid binding; Biological process= DNA integration
MDGYHGKEVESLHKNHTWELIELPLGKRTIGCKWVYKRKPLLRHISIRATLALVANEDMHLEQMDVNTTFLHDDLEEHIYMKQNLRLHNGNC

SEQ ID NO: 170051 - protein, 854 aa, Glycine max
  Coding DNA Sequence Number=SeqID_53273
  Homolog annotation: Hit_ID=Q0WVX3; Match level="QueryCoverage=92%, HitCoverage=77%, E-value=0.0, Identity=51%"; Hit description =Chromosome condensation protein-like
MVTDYFRDSPAPYDYLVSLNGTISAQNILGLLDVRKMIVLSLPPSSATSQVIIDCTLDVSESVRKAAYCVLANKFPLQSLSIKLRTVILRRGLADRSVAVSKECFKLLKDEWLMKCCNGDTIELLKYLDVETYESVSESVMEVLLKAGLVKLQNGASIQQYISSNGDRTEGDAVHCPPSIHPMEAEAALYWRTVCKHLQSEAHAKGSDAAATMGTEAEVYAAEASDKNDLLEKILPATVGEYIELVRAHTNAGSNHRFACRQLLLLGCMFDFSDVTNRKTAGAFLHELMCKPPEHEDDDEGNIVVLGDGLSFGGDNDWAEAVASLARKVHAAPGEFEEVILAIIEELAQPCRERTADYVQWMHSLSLTGLLLKNAKSLRFLQGKAIEPDELLQSLLLPGAKQSHLDVQRIAIRCLGLFGLLERKPSAELLKQLRISYIKGPHSISIEACKALIDLVMWYGPQEVDKMLNLSIPCQLNSEKTTFSPLNFSDSEEELDVGTLDILYGGFENDDWASPLPSNEDECVHAILGEGFAKILLLSDNYPSIPASLHPVILSKLIYLYFTDVSEHLHRCITKSFIPAMRSMWPGIFGNSAGSTFMVSQMRKRAVQASRFMLQMVQIPLYVKETQPDCENTSTEHPQVIDSCVEVPFECGEEGLALRLAVEVASFQSKKTAAEKAYVSALCRILVLLQFRISEQGPIKFMRRLLCRVLECASSEKDIVKELKRMSERLMTVDNQPDQELMQDEVNLILGKLELDCDLDLNGSVSMPQTPAAPPTRPTRSRRRVRIEEESSDEDSPSAVPTTHHSVISRSQRASKTAAMNKMSSATRSLKIDEMEELEEEESDVTSEASDAFD

SEQ ID NO: 170052 - protein, 141 aa, Glycine max
  Coding DNA Sequence Number=SeqID_53274
MTGHSTRLRFGEALLLRFCLEAKNTFSPHDSSPPRIHARVPSHDSFPFKENRTRLIAAALPQPTTTPPRKARGPVRLNRGSAGQGRTNLFGPCKNAEQADPVHCQYKLMRVSLTQDKLTGLLTPSFAKEGHKVVYWVRFEH

SEQ ID NO: 170053 - protein, 41 aa, Glycine max
  Coding DNA Sequence Number=SeqID_53275
MGLMGRTVQGFKSTRPASTTTATGEPSHRVRLRIESEKAVR

SEQ ID NO: 170054 - protein, 190 aa, Glycine max
  Coding DNA Sequence Number=SeqID_53276
  Homolog annotation: Hit_ID=Q0WVX3; Match level="QueryCoverage=95%, HitCoverage=18%, E-value=1e-37, Identity=48%"; Hit description =Chromosome condensation protein-like
  Pfam annotation: Domain name=HEAT; Domain location=135-171; Score =10.3; E_value=2.4; Accession=PF02985.12; Description=HEAT repeat
  Pfam annotation: Domain name=HEAT; Domain location=91-127; Score=8.8; E_value=3.6; Accession=PF02985.12; Description=HEAT repeat
  Pfam module annotation: Pfam domain module=HEAT::HEAT; Domain location=135-171::91-127
MEENDAEEAKRLMLKIAAILDEARTSYATHNRKLKELSLLRSKSSSHSHFFSAFSKTLTPLFDFQRRLASADRVVFFVSAFAVATTAAASDEFLDHFLKFLLAAATASNKTARFRACQIVSEIILRLPDDAEVSNEIWDEVIEWMKVRVRDKIPVVRTFAVRALSRFVNDSVNSDILDLFLEVLPLEQNA

SEQ ID NO: 170055 - protein, 243 aa, Glycine max
  Coding DNA Sequence Number=SeqID_53277
  Gene Ontology: Mol. function=transporter activity; Cellular component= membrane; Biological process=transport
  Homolog annotation: Hit_ID=Q107W9; Match level="QueryCoverage=79%, HitCoverage=79%, E-value=2e-46, Identity=50%"; Hit description=Small basic intrinsic protein 1
MVGAIKAAIGDAVLTFMWVFCSSVLGIASGYITNALNLQHITYNGFPYASFLVTTTLVFVLVFLFTIIGNVLGGASFNPTGTASFYAVGLGSDTLFSMALRFPAQAAGAAGGAMAIMEVIPAKYRHMIGGPSLKVDLHTGAVAEGVLTFVITFAVLLIFLRGPRSDLLKTWLLATATVVLVMVGSAYTGPAMNPANLLKRLTCTISRTNLSYSSRLFAPYLLCYLMMSNPVERLHSPYSFGVL

SEQ ID NO: 170056 - protein, 231 aa, Glycine max
  Coding DNA Sequence Number=SeqID_53278
  Gene Ontology: Mol. function=RNA-directed DNA polymerase activity; Biological process=RNA-dependent DNA replication
MVLKEGSRWRIGDGSNINIWHGPWLRKESSYYPTSPISGAESVMNTPLIPQILEDKLIWAHTMDGSWPARIVSLATRANLRTRGVECPITCLYCETDVETTCIVCLRALSVFQAGTTLNWVKKFSSLVISLWRRRNEKVWDDKLLPDFMNQCTAISACIRDNTGTFLVAKSEWKNSCLKVLEGESWALWSALTLVNDLYLSNIYFESDCKIFVDKINGKGKDVSKAGVLIS

SEQ ID NO: 170057 - protein, 74 aa, Glycine max
  Coding DNA Sequence Number=SeqID_53279
MRASGNRLPRGCNRLPGLEMKAAGCGGLCAFFRFSCPEAVIQVWPLIVRAAQLIHDRVEMECLEGAWETLEGNT

SEQ ID NO: 170058 - protein, 269 aa, Glycine max
  Coding DNA Sequence Number=SeqID_53280
  Gene Ontology: Mol. function=metal ion binding; Cellular component =mitochondrial inner membrane; Biological process=electron transport
  Homolog annotation: Hit_ID=Q6YYC5; Match level="QueryCoverage=94%, HitCoverage=63%, E-value=1e-114, Identity=76%"; Hit description =Copine I-like protein
  Pfam annotation: Domain name=Copine; Domain location=41-189; Score =290.9; E_value=2.4e-84; Accession=PF07002.6; Description=Copine
MISNVTIALRKEGLESSNLVLGIDFTKSNEWTGSVSFNNRSLHAIGSTPNPYEKAISIIGKTLAPFDDDNLIPCFGFGDATTHDQEVFSFHSDNSPCHGFEEVLACYQKIVPNLRLSGPTSYAPVIEAAIDIVEKSHGQFHVLVIVADGQVTTSAASEDGELSPQEARTIKAIADASSYPLSIILVGVGDGPWEDMKKFDDKIPARDFDNFQFVNFTDIMAKKSSPSEKEAAFALAALMEIPFQYKAATELGLLGLVPYTQAYVSLDEK

SEQ ID NO: 170059 - protein, 73 aa, Glycine max
  Coding DNA Sequence Number=SeqID_53281
MTGSSISFKDFAKPFKVKQLESIATKMNSPKLNHEKQKWSGMPDLDEKLITTKLLTHTPASDKLGLGNQQDEK

SEQ ID NO: 170060 - protein, 71 aa, Glycine max
  Coding DNA Sequence Number=SeqID_53282
MSKWALATDKDSVDDTVCETYDISKEKWTQFCQSRRDPSWELMEEKKKKQLEEAAKSGSIDTVIDPPSPIR

SEQ ID NO: 170061 - protein, 606 aa, Glycine max
  Coding DNA Sequence Number=SeqID_53283
  Gene Ontology: Mol. function=GTP binding; Cellular component =intracellular; Biological process=RNA-dependent DNA replication
  Homolog annotation: Hit_ID=Q5N752; Match level="QueryCoverage=71%, HitCoverage=80%, E-value=1e-127, Identity=51%"; Hit description =Pentatricopeptide (PPR) repeat-containing protein-like
  Pfam annotation: Domain name=PPR; Domain location=187-221; Score =16.3; E_value=0.088; Accession=PF01535.11; Description=PPR repeat
  Pfam annotation: Domain name=PPR; Domain location=330-364; Score =41.4; E_value=3.1e-09; Accession=PF01535.11; Description=PPR repeat
  Pfam annotation: Domain name=PPR; Domain location=365-399; Score =24.1; E_value=0.00049; Accession=PF01535.11; Description=PPR repeat
  Pfam annotation: Domain name=PPR; Domain location=400-434; Score =39.4; E_value=1.2e-08; Accession=PF01535.11; Description=PPR repeat
  Pfam annotation: Domain name=PPR; Domain location=467-501; Score =23.1; E_value=0.00098; Accession=PF01535.11; Description=PPR repeat
  Pfam annotation: Domain name=PPR; Domain location=502-536; Score =31.9; E_value=2.2e-06; Accession=PF01535.11; Description=PPR repeat
  Pfam module annotation: Pfam domain module=PPR::PPR::PPR::PPR::PPR::PP R; Domain location=187-221::330-364::365-399::400-434::467-501::502 -536
  Subcellular localization annotation: CTP_CleavageSite=73; ConfidenceScore=5.11e-01
MIRIRFNLTLFSVELSRISHSSLTVTHSHKVEHPLMSATFNFFKPFSSETFLAPPKFGFSVKHFSTSSTRNLGASTDAPAHEALSHDDDDDNDDGDDDDHDKNKDTHCSQLRFRDDRLSQDVKTILDIMHEMGSGPSQTKQKLEHCSVDLSAKLVVEVLLRTRNDWEAAFTFFLWAGKQPGYAHSIREYHSMISILGKMRKFDTAWNLIEEMRRGRTGPSLVTPQTLLIMIRKYCAVHDVARAINTFYAYKQFNFQVGLEEFHSLLSALCRYKNVQDAEHLLFCNKNLFPLDTKSFNIILNGWCNLIVSTSHAERIWHEMSKRRIQHDVVSYGSIISCYSKSSKLYKVLRMFDEMKKRKITPDRKVYNAVIYALAKGRLVKEAVNLIGTLEDNDVTPNVVTYNSLIKPLCKAGKVDEAKQLFYEILKRHLSPTIQTFHAFFRILRTKEEVFELLDKMKELGCYPTIETYIMLMRKFCRWRQLDDVFKMWDAMREDGIGHDRSSYIVLIHGLFLNGKLEEAHTYYAEMQEKGFLPEPKTEEMLQAWVSGKQATEGQETNLEPNQLENDTLKKKVKAIPSKFDREKAFLREPETRRVTRERGFSFWEQ

SEQ ID NO: 170062 - protein, 86 aa, Glycine max
  Coding DNA Sequence Number=SeqID_53284
  Homolog annotation: Hit_ID=Q1T3H7; Match level="QueryCoverage=78%, HitCoverage=10%, E-value=2e-08, Identity=45%"; Hit description=Zinc finger, BED-type predicted; HAT dimerisation
  Pfam annotation: Domain name=zf-BED; Domain location=41-84; Score =44.8; E_value=3e-10; Accession=PF02892.5; Description=BED zinc finger
MDDHDDLLASEMAEHSTPPPTASNIANDLQPCTQRCRKNRSRVWDHFTPDPELEYKRATCNHCQSSIKCDNGTSSLLAHSKRCYDR

SEQ ID NO: 170063 - protein, 106 aa, Glycine max
  Coding DNA Sequence Number=SeqID_53285
MGNLKLPYALINQVVNRAIFQHQKRKHNPITIYSSRQSIEGERDERPQGRRDARPQGERERSVMSHNAKERETNRDAIEIREKCDGERYKLQAPRPQLLTAKGSRD

SEQ ID NO: 170064 - protein, 156 aa, Glycine max
  Coding DNA Sequence Number=SeqID_53286
DHRLPMDPKRMKVIPEWPTPPSPLIELVRNYVLSWEDGMMQSYPPRALDRRLQEDWVRDARKSPKYELVATYPFTGEQGEAHRSVFQRRKMHGVATNVYLWKTSEKLKEPVMKNIPDLGVVFTFEEGISTSHVDKSGALAPTYPPSKTKSDLHSSF

SEQ ID NO: 170065 - protein, 157 aa, Glycine max
  Coding DNA Sequence Number=SeqID_53287
  Gene Ontology: Mol. function=nucleic acid binding; Biological process= DNA integration
  Homolog annotation: Hit_ID=Q1S1X7; Match level="QueryCoverage=84%, HitCoverage=11%, E-value=3e-11, Identity=31%"; Hit description =Integrase, catalytic region; Zinc finger, CCHC-type; Peptidase aspartic, catalytic
  Pfam annotation: Domain name=zf-CCHC; Domain location=53-70; Score =20.9; E_value=0.00035; Accession=PF00098.13; Description=Zinc knuckle
MPLKEHLHKLNFVLMELHDIDDSITLKEVKCSLYSRELRLKVSGNGDEASMPRIYNYCKEPGHWKKDCPRIAKNDYVAVMEKSGGNFLMGNNAPCKLVGIGSIQIIKHDGIFRTLTETHHVPQLKKNLVFVGAMYSKGFSCWVEGGVMQIKGKWKSM

SEQ ID NO: 170066 - protein, 95 aa, Glycine max
  Coding DNA Sequence Number=SeqID_53288
  Subcellular localization annotation: CTP_CleavageSite=27; ConfidenceScore=5.52e-01
MSSSFYSIVPSPFPSPPAGAQSSPVSRLSTRQDLSRGYELFPYSDRPQAGTELGEMQDFFLKELEQKLFTHAQLKPTSISSGGRSGGVVQLGLPF

SEQ ID NO: 170067 - protein, 91 aa, Glycine max
  Coding DNA Sequence Number=SeqID_53289
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P30065; Match level="QueryCoverage=31%, HitCoverage=10%, E-value=6e-10, Identity=96%"; Hit description =Plastid 50S ribosomal protein L2
MVVHVPLSLEAQAEARVLRFALYFRGWIVSVDNLEDIIGGHVWLGTICILGGILRVFSTNWGPPFTTPMRMVYRVHNYSSYYRTVSSYNTS

SEQ ID NO: 170068 - protein, 36 aa, Glycine max
  Coding DNA Sequence Number=SeqID_53290
HISLGEHQAQDNGALAPIHECIQDTDTSQHRARTHK

SEQ ID NO: 170069 - protein, 204 aa, Glycine max
  Coding DNA Sequence Number=SeqID_53291
  Gene Ontology: Mol. function=catalytic activity; Biological process =metabolic process
  Homolog annotation: Hit_ID=Q8YN02; Match level="QueryCoverage=55%, HitCoverage=52%, E-value=3e-15, Identity=37%"; Hit description=KHG -KDPG bifunctional aldolase
  Pfam annotation: Domain name=Aldolase; Domain location=40-201; Score=- 35.1; E_value=1.2e-06; Accession=PF01081.9; Description=KDPG and KHG aldolase
  Subcellular localization annotation: CTP_CleavageSite=57; ConfidenceScore=5.68e-01
MGTATATLSLCQWPTSSSSSSVRMHVRFSCRTPHLSPYTVDRTLCQINNSGVIACLRANSAEVAMEAAKAAIAGGISVVLQQLVKEHPTMALGVGTVLRIEDAKSAINAGAKFLMSPATVKDIMEMDYVQSGEILYIPGTMTPTEILSACDEGAKIVKIYPVSALGGFQYISALKKAFPHISMVASQGITIGSFTVFPIALYSE

SEQ ID NO: 170070 - protein, 272 aa, Glycine max
  Coding DNA Sequence Number=SeqID_53292
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9LJI5; Match level="QueryCoverage=91%, HitCoverage=70%, E-value=1e-135, Identity=94%"; Hit description =Probable vacuolar ATP synthase subunit d 1
  Pfam annotation: Domain name=vATP-synt_AC39; Domain location=3-272; Score=180.4; E_value=4.5e-51; Accession=PF01992.7; Description=ATP synthase (CAC39) subunit
MGLGLAEGLIPTTWETEVRIPVWREPSPLHTTTIVEKCTLKLVDDYKNMLCQATEPLSTFLEYITYGHMIDNVVLIVTGTLHERDVQELLEKCHPLGMFDSIATLAVAQNMRELYRLVLVDTPLAPYFSECITSEDLDDMNIEIMRNTLYKAYLEDFYRFCQKLGGATAEIMSDLLAFEADRRAVNITINSIGTELTRDDRRKLYSNFGLLYPYGHEELAVCEDIDQVRAVMEKYPPYQSIFAKLSYGESQMLDKAFYEEEVKRLCLAFEQQ

SEQ ID NO: 170071 - protein, 46 aa, Glycine max
  Coding DNA Sequence Number=SeqID_53293
MDTSKPYAGAMRGIVHEPQTTIGTSKPYTGAMRGIVHEPQVNLGAD

SEQ ID NO: 170072 - protein, 105 aa, Glycine max
  Coding DNA Sequence Number=SeqID_53294
  Gene Ontology: Mol. function=protein binding
  Homolog annotation: Hit_ID=Q1SPZ8; Match level="QueryCoverage=88%, HitCoverage=9%, E-value=3e-24, Identity=60%"; Hit description =Leucine-rich repeat; Leucine-rich repeat, cysteine-containing type
LSGKIPQQLEELTFLSYLNVSLNNLSGPIPQNKQFATFEGCSFEGNQGLCGNQLFKKCEDDAGSPFAPPSATEDDHDSGFYIEFDWTVVLIGYGVDFDNAKFRFN

SEQ ID NO: 170073 - protein, 389 aa, Glycine max
  Coding DNA Sequence Number=SeqID_53295
  Gene Ontology: Mol. function=transcription factor activity; Cellular component=nucleus; Biological process=regulation of transcription, DNA-dependent
  Homolog annotation: Hit_ID=Q1SQ04; Match level="QueryCoverage=99%, HitCoverage=97%, E-value=1e-144, Identity=70%"; Hit description =Pathogenesis-related transcriptional factor and ERF
  Pfam annotation: Domain name=AP2; Domain location=169-234; Score =104.5; E_value=3.1e-28; Accession=PF00847.10; Description=AP2 domain
  Pfam annotation: Domain name=AP2; Domain location=70-140; Score =106.9; E_value=6e-29; Accession=PF00847.10; Description=AP2 domain
  Pfam module annotation: Pfam domain module=AP2::AP2; Domain location =169-234::70-140
MAMMKENIIEVSLGRRQMSMTEGEFQGTRSVKRRRREVAAAAGSGDDNHQQQLPQQEVGENTTVNTTKRSSRFRGVSRHRWTGRYEAHLWDKLSWNITQKKKGKQGAYDEEESAARAYDLAALKYWGTSTFTNFPISDYEKEIQIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTLEANLESHAALEHQKVASPSNYALTEESKSLALHNSFFSPYSLDSPVKHERFGNKTYQFSSNKSSSPTALGLLLRSSLFRELVEKNSNVSGEEDDGEATKDQQTQIATDDDLGGIFFDSFSDIPFVCDPNRYDLELQERDLHSIF

SEQ ID NO: 170074 - protein, 128 aa, Glycine max
  Coding DNA Sequence Number=SeqID_53296
  Gene Ontology: Mol. function=pectate lyase activity
  Homolog annotation: Hit_ID=Q1SQ06; Match level="QueryCoverage=97%, HitCoverage=83%, E-value=6e-24, Identity=52%"; Hit description =Pectate lyase, N-terminal; Pectolytic enzyme, Pectin lyase fold
MEEENDTRRELKQKYHGPCMATNPIDSCWRCRKHWAQDRFRETGSSRPTTTLQRKSHRHYASPEVWSKWQWKSENDLFINGATFLQSGAPLGKLPFNKGLMMKPRPGAEASRLTRFAGTLNCKLGKPC

SEQ ID NO: 170075 - protein, 106 aa, Glycine max
  Coding DNA Sequence Number=SeqID_53297
MRNLASPYHERLYTLGVDGDGSRRGMDKGGEGKNDSRRGIKFTRSRAKCDLLGLARYGGDHTLSEYGGDHTTASELSKYGGDHTLSAKFAPLGFCVGLFCAKLCVG

SEQ ID NO: 170076 - protein, 50 aa, Glycine max
  Coding DNA Sequence Number=SeqID_53298
MNNTDITPTSTITRPAMPNLDAITPLAPPQRHLAQCTIATSMVKVEGEGR

SEQ ID NO: 170077 - protein, 101 aa, Glycine max
  Coding DNA Sequence Number=SeqID_53299
  Gene Ontology: Mol. function=protein disulfide oxidoreductase activity; Cellular component=cytoplasm; Biological process=cell redox homeostasis
  Homolog annotation: Hit_ID=Q6PV94; Match level="QueryCoverage=97%, HitCoverage=97%, E-value=9e-30, Identity=55%"; Hit description =Thioredoxin
  Pfam annotation: Domain name=Thioredoxin; Domain location=25-99; Score=51.1; E_value=3.8e-12; Accession=PF00085.10; Description =Thioredoxin
MGSAFSALFGRGSTVAEGSSESLHVLPFHSSERWQLHFNEVVIDFTASWCGPCRFIAPDVAKDFKVEAMPTFVLCKKGKEVDRVVGARKDELQNKIQKHYQ

SEQ ID NO: 170078 - protein, 88 aa, Glycine max
  Coding DNA Sequence Number=SeqID_53300
LVNELLAEILILSEYSTPKTLVNKPSEFNIHRKVGTEWRRKRERRRHFKEKMSLEEAHHHRRPWIRAWRKKEMNEGRGREEHEILCSK

SEQ ID NO: 170079 - protein, 1373 aa, Glycine max
  Coding DNA Sequence Number=SeqID_53301
  Gene Ontology: Mol. function=RNA-directed DNA polymerase activity; Cellular component=chromatin; Biological process=chromatin assembly or disassembly
  Pfam annotation: Domain name=Chromo; Domain location=1267-1318; Score= 11.8; E_value=0.039; Accession=PF00385.14; Description='chromo' (CHRromatin Organisation MOdifier
  Pfam annotation: Domain name=RVP; Domain location=357-465; Score= -12.0; E_value=0.059; Accession=PF00077.10; Description=Retroviral aspartyl protease
  Pfam annotation: Domain name=RVP_2; Domain location=346-480; Score= -33.3; E_value=0.00039; Accession=PF08284.2; Description=Retroviral aspartyl protease
  Pfam annotation: Domain name=rve; Domain location=1015-1199; Score =78.2; E_value=2.6e-20; Accession=PF00665.16; Description=Integrase core domain
  Pfam module annotation: Pfam domain module=Chromo::RVP::RVP_2::RVT _1::Retrotrans_gag::rve; Domain location=1267-1318::357-465::346 -480::599-768::103-193::1015-1199
MASHDKSTLDRIEDAIAKLVASQIQVTDKLEDLLLHVANLEHTATTHSPSSSSANPHHTNSIITPPKMKLDVPRFDGSDPSGWIFKISQFFAYHSTPESERLTIASFYMEGPALAWFQWLSRNHQLTTWASFLEAIEAHFSHSPYEDPTGILFKLTQKGTVSQYLQQFEALANRIVGLSPSLLLSCFFSGLDHDIRWEVQALQPLTLVHAAGLARLQEEKLADNRRAFRGRATLTTGPPPPQPQPPPTLLSSTTSPHPPPLPLLPTPPKPPPLPLKRLTPTEMALRREQGLCFNCDDKFTKGHRRASRFSLLIADEDNPPEPSDPFISNPNPSPENPNPPNSNQPEQPQAQISFCALLGHSPPETLRLLGQVSHHAVVILVDSGSTHNFVQNRLIHHLGLTPQPTFPLRVLVGNGNEIECHTICPNTMIQIQGYTFTTDLHVLPICGADIVLGVHWLKSLGPILTYCTNLTMKFVHQGALIELRGDSVQDLEVVSPPQLRRMIQTDGVSDFFHIRVCSPIHTSPTTPPEIQSLLHKFEPLFQLPSSLPPSRPTNHCIHLTSASSPVNVRPYRYPYYQKYEIEAQVSAMLQTGIIRPSNSPFSSPVLLVKKRDGSWRFYVDYRALNALTIKDRFPIPTINELLDELGGATWFSKLDLMQGYHQILINEADISKTTFRMHQGHYEFLVMPFGLCNAPSTFQATMNNTFGPYLRKFIIIFFDDILIYSKSFLEHLNHLNTAFEVLRDNQFLLKLSKCSFATQQVEYLGHIVSPRGVEPMAAKIEADAFQWNEAADKAFNQLKEALCRAPVLRLPDFSIPFVVETDASGEGMGAVLSQQNHPIAFFSQQFSPKLLRASTYVRELAAITATVKKWRQYLLGHPFMILTDHHSLKDLMTQAVQTLEQHRYLARLLGFDYTIQYRSGHSNTELRKELNTNTEFLALRDQILTTPEKYPDYSIHSELILQKGRIWLPREFPFISAVLEEFHSTPTCGHMGIAKTLAELNDHKKSSGLLCPLPVPARPWEDLSLDFIVILPPYKGHSALLVVVDRFSKGVHLGSLPAHYTAFEVARLFMEISGKIHGPPRSLVSDRDPLFISHFWQELFKLSGTTLRMSTAYHPQTDGQTEVMNRILKQYLRAFVHTSVHSTMGMSPYEVTFGKKPPNFPQYLIGDSNVDVVDTWLIDRDTMIQSLTKKLHKAQARMKEIADKKSLDLQEIVQKLGPVAYKLALPESSRILLVFHCSLLRPYHTPVTSTITPAILPDSAEDNQPLITPFTILDTKWEGQEPERQLFVLVQWAGLLPEDTSWEPWMTLKETYNLEDKVVLDAGGNVTTIGKARNNTEEPKAIAELHSETIQGIELRPKRAIVKPSYLRDFVEK

SEQ ID NO: 170080 - protein, 429 aa, Glycine max
  Coding DNA Sequence Number=SeqID_53302
  Gene Ontology: Cellular component=nucleus; Biological process =regulation of progression through cell cycle
  Homolog annotation: Hit_ID=Q8GVE0; Match level="QueryCoverage=68%, HitCoverage=89%, E-value=4e-93, Identity=60%"; Hit description =Cyclin D1
  Pfam annotation: Domain name=Cyclin_C; Domain location=224-355; Score= 44.9; E_value=2.8e-10; Accession=PF02984.9; Description=Cyclin, C -terminal domain
  Pfam annotation: Domain name=Cyclin_N; Domain location=89-222; Score =129.4; E_value=1e-35; Accession=PF00134.13; Description=Cyclin, N -terminal domain
  Pfam module annotation: Pfam domain module=Cyclin_C::Cyclin_N; Domain location=224-355::89-222
MKEATCIFHQQLHSLFLHSSPQLTLPAKPPRKPWPENESPPIAMSVSCSNCFPDDDHSFLLCGEDSSGIMDSSPECSSDLDSSPPSEAESIAGFMEDERNFVPGFEYLNRFQSRSLDASAREESVAWILKVQAYYAFQPVTAYLSVNYLDRFLNSRPLPPKTNGWPLQLLSVACLSLAAKMEESLVPSLLDLQVEGAKYVFEPKTIRRMELLVLGVLDWRLRSVTPFSFLDFFACKLDSTGTFTGFLISRATQIILSNIQEASFLAYWPSCIAAAAILHAANEIPNWSLVRPEHAESWCEGLRKEKIIGCYQLMQELVIDNNQRKPPKVLPQLRVTISRPIMRFPREGDFAKCVWVCVRERWEIRYKDAFNGLVVQAWKKEVCSLEFKDALVIGEREENGGGTLLQSLEEEKKHSLRADINRVLKDFEV

SEQ ID NO: 170081 - protein, 84 aa, Glycine max
  Coding DNA Sequence Number=SeqID_53303
  Subcellular localization annotation: CTP_CleavageSite=48; ConfidenceScore=5.22e-01
MVGGCYIGVHWFCTMDLLVKNFVPHPSNPRRAISTRLFGGLGREVSVRSKTMEVLVALFRVWVVIDAVMGDGDDVVSCLVASLD

SEQ ID NO: 170082 - protein, 84 aa, Glycine max
  Coding DNA Sequence Number=SeqID_53304
  Homolog annotation: Hit_ID=Q9FMV4; Match level="QueryCoverage=60%, HitCoverage=26%, E-value=4e-12, Identity=68%"; Hit description =Arabidopsis thaliana genomic DNA, chromosome 5, P1 clone:MLE2
MILLYCGTINWNSKLLMVGVESEKTFDAGSAASPADEAEIDKLEERASSLRRELANKNLHLKTLIDQLRDLITDISTWQSPFST

SEQ ID NO: 170083 - protein, 221 aa, Glycine max
  Coding DNA Sequence Number=SeqID_53305
  Gene Ontology: Mol. function=hydrolase activity, acting on ester bonds
  Homolog annotation: Hit_ID=Q8H965; Match level="QueryCoverage=86%, HitCoverage=29%, E-value=5e-60, Identity=63%"; Hit description =Phosphatidylglycerol specific phospholipase C
MACFYSIGYCINFSGTVVLSAHRYSVISGAKGPAENSEFEHSSIPATIKKMFNLSANFLTHRDAWAGTFEHVVGDLSSPRTDCPVFEIEIKHTIQQLGLRNFPNKNLIMCNKVLRQAYMRIPVTLPDVTPLRSTEAKENAGLSEFQSEVVQLAAVLNGDHFLSSFPDEMSKKMSVKEAHEYVRGAVSRFIRASKEAIKLGADESAIVDMRSSLTTRSSVHN

SEQ ID NO: 170084 - protein, 226 aa, Glycine max
  Coding DNA Sequence Number=SeqID_53306
  Gene Ontology: Mol. function=hydrolase activity, acting on ester bonds; Biological process=metabolic process
  Homolog annotation: Hit_ID=Q8H965; Match level="QueryCoverage=89%, HitCoverage=38%, E-value=6e-93, Identity=81%"; Hit description =Phosphatidylglycerol specific phospholipase C
  Pfam annotation: Domain name=Phosphoesterase; Domain location=29-224; Score=45.1; E_value=2.3e-12; Accession=PF04185.5; Description =Phosphoesterase family
  Subcellular localization annotation: CTP_CleavageSite=35; ConfidenceScore=5.13e-01
MGSSKPKSSILMFVVFLCVFATAQRQQPIKTVVVLVMENRSFDHMLGWMKESINTLINGVTGDECNPVSTKSPRKDSICFTDDAEFVDPDPGHSFEDVLQQVFGSGSGSIPSMNGFVEQALSMSPNLSETVMKGFKPDSVPIYAALVKEFAVFDRWFSSIPGPTQPNRLFVYSATSHGSTSHIKRQLAKGYPQKTIFDSLHENGLDFGIYFQNIPTTLFYRNLRKL

SEQ ID NO: 170085 - protein, 56 aa, Glycine max
  Coding DNA Sequence Number=SeqID_53307
MCSKLTSLHGEMRKRRYGQVRKTKILWPFEKFRGAGRKQEGAGSISLQTDHTSIGL

SEQ ID NO: 170086 - protein, 533 aa, Glycine max
  Coding DNA Sequence Number=SeqID_53308
  Homolog annotation: Hit_ID=Q2RA11; Match level="QueryCoverage=75%, HitCoverage=78%, E-value=1e-102, Identity=47%"; Hit description=CBS domain-containing protein, putative, expressed
  Pfam annotation: Domain name=CBS; Domain location=138-256; Score =98.0; E_value=2.8e-26; Accession=PF00571.18; Description=CBS domain
  Pfam annotation: Domain name=CBS; Domain location=275-393; Score =82.4; E_value=1.4e-21; Accession=PF00571.18; Description=CBS domain
  Pfam annotation: Domain name=PB1; Domain location=454-533; Score =37.5; E_value=4.6e-08; Accession=PF00564.15; Description=PB1 domain
  Pfam module annotation: Pfam domain module=CBS::CBS::PB1; Domain location=138-256::275-393::454-533
  Subcellular localization annotation: CTP_CleavageSite=62; ConfidenceScore=5.79e-01
MCTPAIGSIPVAFKFSFSFSIFHSFSSSLLSSLSRVAFLLSPFLLLPVRRPESYFPAIFPAACNSPSPSELNQSFQFEAVAIFCSDIGAERGKMASQSGASRRSISSSTRRASESGAPRKSISSSRPLALAGERTVKSLRLTKALTVPETTTVYEACRRMAARRVDALLLTDSNALLCGILTDKDIAARVIAKEINLEETPVSKVMTRNPVFVLSETLAAEALQKMVQGKFRHLPVVENGEVLALLDIAKCLHDAIARMERAAEKGKAIAAAVEGVEKHWGTSVSPTDSVLTTTKKMVEFRASCAVVTVNDKPRGIFTSKDILLRVIAQNLSPESTPVEKVMTPNPECVIIDTPIVDALHTMHDGKFLHLPVVDRDGSVVAVVDVIHVTHAAVATVGNNEAATTLMQRFWDSAMALTPNDDDDDTRSEGSLKVASEGGETGRSIPYLSSSIANTFSFKIQDKKGRMHRFTCDTRSMMEVITSILQRLGDDIDPNNIPQILYEDEDHDKVVLASDSDLAAAVDHARTAGLKVNL

SEQ ID NO: 170087 - protein, 162 aa, Glycine max
  Coding DNA Sequence Number=SeqID_53309
  Homolog annotation: Hit_ID=Q9FMV0; Match level="QueryCoverage=85%, HitCoverage=24%, E-value=7e-22, Identity=45%"; Hit description =Arabidopsis thaliana genomic DNA, chromosome 5, P1 clone:MLE2
MVPRQKQGERCLRNEIGDEEYLYVDGIGIKTGDFFQFYYSDPNIALASLTKVHDALKSIKLEKKSKSSKGDGDNATNVFGGIIFACYSRGESFFGRQNVDSSPFLENFPGVPVSGIFCGGEMVRPCTTVIGQCEGASPISCCLHVYSTVYLAMSYTPPSVED

SEQ ID NO: 170088 - protein, 86 aa, Glycine max
  Coding DNA Sequence Number=SeqID_53310
  Homolog annotation: Hit_ID=Q6AVJ1; Match level="QueryCoverage=81%, HitCoverage=6%, E-value=2e-26, Identity=80%"; Hit description =Expressed protein
MGGHFSGIYRKVQLKPLKWIKVAKSNGEGAEERPVEALMVLKYGGVLTHAGRKQLIVNAEELGRYFRNNMYPDYLRFFFQVGMVVA

SEQ ID NO: 170089 - protein, 94 aa, Glycine max
  Coding DNA Sequence Number=SeqID_53311
  Homolog annotation: Hit_ID=Q10BX5; Match level="QueryCoverage=84%, HitCoverage=22%, E-value=9e-20, Identity=53%"; Hit description =Expressed protein
MNEDLKENESPKKDGRVIFYNIGDENGDVPSANEEKFFTFKGSSVEDLKEKLKEETGHDDILVCCRNPLNAKLYPLRLQLPPNNTDIHVVVTPS

SEQ ID NO: 170090 - protein, 416 aa, Glycine max
  Coding DNA Sequence Number=SeqID_53312
  Gene Ontology: Mol. function=transition metal ion binding; Cellular component=cytoskeleton; Biological process=establishment and/or maintenance of actin cytoskeleton polarity
  Homolog annotation: Hit_ID=Q6AVJ1; Match level="QueryCoverage=83%, HitCoverage=33%, E-value=1e-170, Identity=83%"; Hit description =Expressed protein
LVVFAKSCGSLRVSEFAMAEENDEEGVFAAQRITIGVCVMEKKVKCGYELFSGPMEQILQRLQAFGEFEHLEKFGIHVPRYALVNREVPYQHLDYFIEEEDFVEVHGMRFWKPFVEKPIDGDNHSIMIYYPSSAGGGMKELFRKVGNRSSEFHPEVRRVRREGSYIYEEFMPTGGTDVKVYTVGPEYAHAEARKSPVVDGVVMRNTDGKEVRYPVLLTPAEKEMAREVCIAFRQAVCGFDLLRCEGRSYVCDVNGWSFVKNSHKYYDDAACVLRKMFFDAKAPHLSSAIPPTLPWKVNEPVQPSEGLTRQGSGIVGTFGQSEELRCVIAVIRHGDRTPKQKVKLKVTEEKLLNLMLKYNGGRPRAETKLKSAVQLQDLLDATRMLVPRTRPDRESDSEAEVEHAEKLRQVKAVLEE

SEQ ID NO: 170091 - protein, 80 aa, Glycine max
  Coding DNA Sequence Number=SeqID_53313
  Gene Ontology: Mol. function=acetylglucosaminyltransferase activity; Cellular component=membrane
  Homolog annotation: Hit_ID=Q9FLD7; Match level="QueryCoverage=78%, HitCoverage=14%, E-value=4e-26, Identity=82%"; Hit description =Glycosylation enzyme-like protein
LLHAFSHLPRDLNFIDHTSDIGWKDHQRARPIIIDPGLYMTKKQDVFWITQRRSRPTAFKLFTGKKVSVAVSAIGCTSFV

SEQ ID NO: 170092 - protein, 861 aa, Glycine max
  Coding DNA Sequence Number=SeqID_53314
  Gene Ontology: Mol. function=protein binding; Cellular component =membrane; Biological process=defense response
  Homolog annotation: Hit_ID=Q1SWU6; Match level="QueryCoverage=99%, HitCoverage=97%, E-value=0.0, Identity=50%"; Hit description=Disease resistance protein
  Pfam annotation: Domain name=LRR_1; Domain location=376-399; Score =3.9; E_value=52; Accession=PF00560.23; Description=Leucine Rich Repeat
  Pfam annotation: Domain name=LRR_1; Domain location=569-590; Score =12.6; E_value=1.2; Accession=PF00560.23; Description=Leucine Rich Repeat
  Pfam annotation: Domain name=LRR_1; Domain location=592-614; Score =11.3; E_value=2.2; Accession=PF00560.23; Description=Leucine Rich Repeat
  Pfam annotation: Domain name=LRR_1; Domain location=616-638; Score =10.1; E_value=3.6; Accession=PF00560.23; Description=Leucine Rich Repeat
  Pfam annotation: Domain name=LRR_1; Domain location=748-770; Score =7.2; E_value=13; Accession=PF00560.23; Description=Leucine Rich Repeat
  Pfam annotation: Domain name=LRR_1; Domain location=772-794; Score =3.3; E_value=69; Accession=PF00560.23; Description=Leucine Rich Repeat
  Pfam annotation: Domain name=LRR_1; Domain location=819-849; Score =2.9; E_value=83; Accession=PF00560.23; Description=Leucine Rich Repeat
  Pfam annotation: Domain name=NACHT; Domain location=177-329; Score= -34.9; E_value=0.03; Accession=PF05729.3; Description=NACHT domain
  Pfam annotation: Domain name=NB-ARC; Domain location=136-437; Score =268.8; E_value=1.1e-77; Accession=PF00931.13; Description=NB-ARC domain
  Pfam module annotation: Pfam domain module=LRR_1::LRR_1::LRR_1::LRR _1::LRR_1::LRR_1::LRR_1::NACHT::NB-ARC; Domain location=376-399::569 -590::592-614::616-638::748-770::772-794::819-849::177-329::136-437
MAEAVVEIVLEKLNSLIQKELGLFFGFDEDMKRIASLLTTIKATLEDAEEKKFSNIGIKYWLGKLKDAARILDDILDECGPSNKVQSSYLSSFLPKHVVFHYKIVKKMKRVREMLEEISDERNKFNLTEMVLERSRVIEWRKTTSSITDRQIYGREEDKDKIVNFLVDDAPQSEDLSVYPIVGLGGLGKTTLAQLVFNHKKVVSHFELRFWVCVSEDFSLRRMIKAIIKAASGHACEDLDLEPQQRRLQDLLQRKRYLLVLDDVWDDKQENWQKLKSLLACGAKGASILVTTRLSKVAEIMGTIKIPHELSLLSDNDCWELFKHQAFGPNEVELENMGKEIVKKCRGLPLAAKALGSLLHSARKKHEWFMNVKGRNLLELSLEDNSIMASLRLSYFKLPIRLRQCFAYCAIFPKDERIWKQQLIELWMANGFILSNERLDAEDVGEDLWNELYWRSFFQDIEKDEFGKVTSFKLHNLVHDLARSVTEDVCCVTEGNDGSTWTERIHHLSDHRLRPDSIQLHQVKSLRTYLLPHQRGGALSPDVLKCYSLRMLHLGEMEELPSSIGDLKHLRYLNLSGGEFETLPESLCKLWNLQILKLDHCRSLQMLPNSLIILKYLQQLSLKDCYKLSSLPPQIAKLTSLRSLTKYFVGKERGFLLVELGALKLKGDLEIKHLGKVKSVKDASDANMSSKQLNKLTLSWDRYDEEWELQENVEEILEVLHPDTQQLQSLWVGGYKGAYFPQWIFSPSLMYLRIERCREINSLHEALQHMTVLHSLSLYYLRNLESLPECLGNLPLLHELAIGFCSKLRSLPMSLSLGSLKMLRIWGCPELEKQCGKETGEALSKIAQFPEIRVNGYLIKG

SEQ ID NO: 170093 - protein, 429 aa, Glycine max
  Coding DNA Sequence Number=SeqID_53315
  Gene Ontology: Mol. function=chromatin binding; Cellular component =chromatin; Biological process=chromatin assembly or disassembly
  Homolog annotation: Hit_ID=Q1SAV4; Match level="QueryCoverage=90%, HitCoverage=99%, E-value=1e-140, Identity=57%"; Hit description =Integrase, catalytic region
  Pfam annotation: Domain name=Chromo; Domain location=337-387; Score =17.2; E_value=0.0092; Accession=PF00385.14; Description='chromo' (CHRromatin Organisation MOdifier
  Pfam annotation: Domain name=rve; Domain location=34-190; Score =110.3; E_value=5.7e-30; Accession=PF00665.16; Description=Integrase core domain
  Pfam module annotation: Pfam domain module=Chromo::rve; Domain location=337-387::34-190
MATDVKSFIHQCNICQQFKHVTRKLASLLQPILIPNGVWEDLSMDFVTHLPSSHGFTVVFVVVDRFSKGVHLGALPTHFTTFKVANLFLDTICKLHGFPHSIISDRDPIFISSFWRELFGISGTTLRMSTAYHPQFDGQTKVMNRTIEQYLKSFVHNQPTEWYKFLALAEWAYNTSQHSDTSVTPYEVVYGKPPPSIPSYLMSSSCNDAVQTMILTREEIHATLKCKLLKAQDTMKHFADKKRRDVQYEVGQMVYVKLRPHRQLSLRTHQPNKLTKRYFGPFRIVERIGSVAYHLQLPDESRIHPVFHCSLLRPHHGPFELQTSVLPPDALHNHPILEPLTILDSRMDLLTEPPTHLVLVQWVGLVPKDSTWEKWDDVCSTHHLEDKMIFPGQDNDSINVTKVAEDNTTSRNNHPRRVISRPKHLEDYV

SEQ ID NO: 170094 - protein, 720 aa, Glycine max
  Coding DNA Sequence Number=SeqID_53316
  Gene Ontology: Mol. function=RNA-directed DNA polymerase activity; Cellular component=chromatin; Biological process=chromatin assembly or disassembly
  Pfam annotation: Domain name=RVP_2; Domain location=266-383; Score= -59.3; E_value=0.042; Accession=PF08284.2; Description=Retroviral aspartyl protease
  Pfam module annotation: Pfam domain module=RVP_2::RVT_1; Domain location=266-383::515-718
MVEHGTRRTTTDKLEEAISVLSEKHSELANKPPTPQRPPVKLDVPCFDDHDPLGWIFKISQFFNYQGTSKEDRTTVASFYLDGAALRWFQWMFRNGFITSWPTLLQAIETRFAPSFYDDPRSALFKLIHREVQGLQPTSLPHATALARLQEDKLNDRRKHSRSPFPPPQPQALAPPNQNQTPQLKTLFIQRTQEDMAYRCENGLCYNCDEKWNSSHRCKGRVLFFIVDSDDPSPSEFISPENPNPPTVKPTPPFDPTPLQPHISLHAMAGVPATDTFRLYGVVNHARVTILVDSGSTHNFVQPRVAKFLNLPIEDTIPLRVMVDNSSVLDCRQLYSATTLFIQDHPFTVTLRILLLSCADVVLEVEWLRTLGPIITNYTSFTMQFTHLSQPITLRADVQSNTDPASAHHVKCMIHTHSTSGLFHLSLLPVTHPEPSIDPHHPIFAINEFLLKFSSLFQQPSTLPPPRQHDHHINLIPSTNPVNVRPYRYPHFQKTKIEKQVMALLDSGIIQPSRSPFSSPVLLVKKKDETWRMCVDYRALNSITVRDHFLLLTIEELLDELGRASWFSKLDLRQGFHQILMAYKDVPKVAFQTHHGHYEYRRQIDYYGHVVSGNDVQPDPSKIQAISDWPTPRSPKDLRAFLGLTWFYRKFFKGYTAIAAPLTRLLCKDAFQWVPKSQVAFDKLKGAMTYAPMLALPNFTLPFTLETNVSGIAMGVVLYQ

SEQ ID NO: 170095 - protein, 169 aa, Glycine max
  Coding DNA Sequence Number=SeqID_53317
  Gene Ontology: Cellular component=microtubule
  Homolog annotation: Hit_ID=Q9FGA2; Match level="QueryCoverage=65%, HitCoverage=70%, E-value=4e-25, Identity=55%"; Hit description =Arabidopsis thaliana genomic DNA, chromosome 5, P1 clone:MPF21
MGNCQAVDGAVLVIQHPCGKIERLYWPVTASEVMRTNPGHYVSLIIPLPVPPQEQNQEKKTVRFTRVKLLRPNETLNLGHAYRLITTQEVMKVLKAKKHAKTRKPQAAETEKPHTVLPEKQSSASEAHTGGDSTHQEVVFLVYPNSQSTEHFDLSIPPVHIIWHMVYRC

SEQ ID NO: 170096 - protein, 530 aa, Glycine max
  Coding DNA Sequence Number=SeqID_53318
  Gene Ontology: Mol. function=nucleoside-triphosphatase activity; Cellular component=membrane; Biological process=response to abscisic acid stimulus
  Homolog annotation: Hit_ID=Q1S520; Match level="QueryCoverage=81%, HitCoverage=83%, E-value=1e-166, Identity=67%"; Hit description=AAA ATPase
  Pfam annotation: Domain name=AAA; Domain location=275-474; Score =51.5; E_value=2.8e-12; Accession=PF00004.19; Description=ATPase family associated with various cellular activities (AAA)
  Pfam annotation: Domain name=AAA_5; Domain location=275-422; Score= -8.0; E_value=0.0072; Accession=PF07728.4; Description=ATPase family associated with various
  Pfam module annotation: Pfam domain module=AAA::AAA_5; Domain location=275-474::275-422
MLKLPSYMTNIGGPNFPIQQRKSGLDLANITHCQMDSFSTDSDLFFHFNSDSHRFFPAALRDTLQIHCQKVVNLLYPYVEITFPEFSGERLKRSEAYTAIQTYLSENSSQLAKRLKAEVVKDSQKPLVLSMDDDEEVTDEFQGVKLWWAASKTASNPHAYSFSYYSPPDGKRYFKLTFNKKHRDLITVSYIKHVLEEGKEIALRNRQRKLYTNNPSSGWYGYKQSKWSHIVFEHPATFETLAMEHWKKEEIINDLVKFRNGKDYYAKIGKAWKRGYLLFGPPGTGKSTMIAAMANFMNYDVYDLELTAVKDNTELRKLLIETSSKAIIVVEDIDCSLDLTGQRNMRRERGEEEEPKDPSKKDEEEGNKNSKVTLSGLLNFIDGIWSACGGERIIIFTTNFVDKLDPALIRTGRMDKHIELSYCRFEAFKVLAKNYLDVDSHYLFARIANLLEVTNVTPADIAENLMPKCLNEDVESCLLNLIQSLEKKVAEEEEEEAGLNEEKVKGEPTQQENKNNGHSVEDVKENGFVL

SEQ ID NO: 170097 - protein, 61 aa, Glycine max
  Coding DNA Sequence Number=SeqID_53319
MEKIGRMCSAMSTRSSIRFKDTAPSYPGYRNLHTLFVWLPRKCERNKGKIERKVKVESSRN

SEQ ID NO: 170098 - protein, 37 aa, Glycine max
  Coding DNA Sequence Number=SeqID_53320
MAKYGFNVGCELKWISPKSLNSIQALKMRPKLGENLR

SEQ ID NO: 170099 - protein, 441 aa, Glycine max
  Coding DNA Sequence Number=SeqID_53321
  Gene Ontology: Mol. function=protein binding; Cellular component =membrane; Biological process=defense response
  Homolog annotation: Hit_ID=Q1SWW3; Match level="QueryCoverage=99%, HitCoverage=39%, E-value=1e-177, Identity=67%"; Hit description =Disease resistance protein
  Pfam annotation: Domain name=NACHT; Domain location=176-329; Score= -39.6; E_value=0.071; Accession=PF05729.3; Description=NACHT domain
  Pfam annotation: Domain name=NB-ARC; Domain location=135-435; Score =265.8; E_value=8.5e-77; Accession=PF00931.13; Description=NB-ARC domain
  Pfam module annotation: Pfam domain module=NACHT::NB-ARC; Domain location=176-329::135-435
MAEAVLETVLENLNSLIQKELGLFLGFDQDVKRLRQFSDRSIKDWLQKLKDAAHVLDDILDECAYEAWRLEYQGVKCCLSDKVQCSCLSSFHPEHVVFRYKLAKKMKRISERLEEIADERTKFHFTEMVTDKRNGVLEWRQTTSFITEPEVYGREEDQDKIIDFLVGDASHSEDLSVYPIIGLGGLGKTTLAQLIFNHERVVNNFEPRIWVCVSEDFSLKRMTKAIIEVASGRACEDLLLEILQRRLQDLLQSKRYLLVLDDVWDDEQENWQKLKSILACGAQGASVLVTTRLSKVAAIMGTMPPHELAMLSDNDCWKLFKHRAFGPNEVEQEKLVILGKEIVKKCGGVPLAAKALGGLLRFKREEREWLKIKESNLWSLPHNIMPALRLSYLNLPIKFRQCFAYCAIFPKDEKIEKQYLIELWIANGFFSSNDKLDAEDC

SEQ ID NO: 170100 - protein, 392 aa, Glycine max
  Coding DNA Sequence Number=SeqID_53322
  Gene Ontology: Mol. function=RNA-directed DNA polymerase activity; Cellular component=chromatin; Biological process=chromatin assembly or disassembly
  Pfam annotation: Domain name=RnaseH; Domain location=15-133; Score= -33.5; E_value=0.076; Accession=PF00075.14; Description=RNase H
  Pfam annotation: Domain name=rve; Domain location=266-390; Score =37.6; E_value=4.4e-08; Accession=PF00665.16; Description=Integrase core domain
  Pfam annotation: Domain name=zf-H2C2; Domain location=207-248; Score =10.8; E_value=0.013; Accession=PF09337.1; Description=His(2)-Cys(2) zinc finger
  Pfam module annotation: Pfam domain module=RnaseH::rve::zf-H2C2; Domain location=15-133::266-390::207-248
MTCTPVLATPDFTLPFIVETDASAVAIGAVLVQQDHPIAYYSKVLCPRLQRASAYVRELHAITSAVRKWRHYLLGASFTILTDHKSLKELMSQVIQTSEQQTYLVKLLGYDYNIRYKPSPTNTVADALSRIPTGDFLSLTVPHCDFLDTLRRALMADTQYRDLLQAIQTTPADHPALLVRNGLIFKERRIWITVPTPLTSTLLEEFHTSPLGGHTGVAKTLHRLQQSFDWPTIKSDVQHFVSHCLVCQQTKYETKKPSGLLQPLSIPARIWEEMSIDFITGLPPSQGHTVIMVVVDRYSKGAHFGALPTHHTAHQVAVHFLNLVYKLHGFPRSLVSDRDALFLNHFWKELFRLSGTQLRMTTAYHPQFDGQTEVVNRTLEQYLRAYVHHKPS

SEQ ID NO: 170101 - protein, 128 aa, Glycine max
  Coding DNA Sequence Number=SeqID_53323
  Gene Ontology: Mol. function=RNA-directed DNA polymerase activity; Cellular component=chromatin; Biological process=RNA-dependent DNA replication
MSVAFDELSVKACEAEKPTEASGGCRGGPIHHSLNFIRIRGYTCRGDDVAQVELIGGECREDRVQVRDMRRKVAAIDENVVKKHCNKFPDRRALCETRNGPGVCKTQSSGCRKLPCEFDGSPVGDRAS

SEQ ID NO: 170102 - protein, 69 aa, Glycine max
  Coding DNA Sequence Number=SeqID_53324
TASQVAGGDTLWSSAPSSTEGNEFDGFTLVVLKHSSPTTHEILLCWAGTIECNGVGKCRGCPTLSLPRH

SEQ ID NO: 170103 - protein, 137 aa, Glycine max
  Coding DNA Sequence Number=SeqID_53325
  Homolog annotation: Hit_ID=Q9FMV0; Match level="QueryCoverage=44%, HitCoverage=12%, E-value=2e-08, Identity=53%"; Hit description =Arabidopsis thaliana genomic DNA, chromosome 5, P1 clone:MLE2
MVSSPLKRGQRRPTTLEEVVKRCEYCTRLVSLVSVLVFFTSYSSLLWIHFVTGTIRFHVALSNGVSTVGPRYKAASVKSNNADCSTWLTARREGQQENLDGQSILLDINNLVRNYLHIFWAKLQFMLSRNFLKIVKN

SEQ ID NO: 170104 - protein, 61 aa, Glycine max
  Coding DNA Sequence Number=SeqID_53326
MRKAQGSCMSKHVEQKVKKVIWTFQPPVTKDETHIQRMCDGMMQMRKSATGGCTEYDNIHK

SEQ ID NO: 170105 - protein, 77 aa, Glycine max
  Coding DNA Sequence Number=SeqID_53327
MVQKDVKVMMQRIEVEVGDNEKTWTMQRSKRRGYSHGRRRSTLSLRGRRRMLRRDRRGSVLAQMTFSEGFPSFVRFG

SEQ ID NO: 170106 - protein, 1379 aa, Glycine max
  Coding DNA Sequence Number=SeqID_53328
  Gene Ontology: Mol. function=histone-lysine N-methyltransferase activity; Cellular component=intracellular; Biological process =chromatin modification
  Homolog annotation: Hit_ID=Q6YV15; Match level="QueryCoverage=83%, HitCoverage=94%, E-value=0.0, Identity=39%"; Hit description =Putative SET domain protein SDG117
  Pfam annotation: Domain name=Pre-SET; Domain location=1154-1287; Score=31.3; E_value=5.9e-07; Accession=PF05033.6; Description=Pre -SET motif
  Pfam annotation: Domain name=SET; Domain location=1289-1379; Score =33.3; E_value=6.1e-07; Accession=PF00856.18; Description=SET domain
  Pfam annotation: Domain name=zf-C2H2; Domain location=764-787; Score =11.7; E_value=0.57; Accession=PF00096.16; Description=Zinc finger, C2H2 type
  Pfam annotation: Domain name=zf-C2H2; Domain location=798-821; Score =20.1; E_value=0.0079; Accession=PF00096.16; Description=Zinc finger, C2H2 type
  Pfam annotation: Domain name=zf-C2H2; Domain location=832-855; Score =5.7; E_value=2.5; Accession=PF00096.16; Description=Zinc finger, C2H2 type
  Pfam annotation: Domain name=zf-C2H2; Domain location=901-924; Score =15.0; E_value=0.25; Accession=PF00096.16; Description=Zinc finger, C2H2 type
  Pfam module annotation: Pfam domain module=Pre-SET::SET::zf-C2H2::zf -C2H2::zf-C2H2::zf-C2H2; Domain location=1154-1287::1289-1379::764 -787::798-821::832-855::901-924
VIKVLPCSGVQYAGESDCPQQSSGTAFVYLEQPNCPENGEQVNFVAARLNESSHRMQGPQIERQGDLSTNSDCQCIGASCCDCQVDYQHEYCGFHDFEEDMVNEPFLTSENSVSVVDTIESESPNNSREGDLSCSEPKWLEGDESVALWIKAGIRCARADWPSSTLKAKPTHDRKKYFVIFFPHTRIYSWADMLLVRSINEYPHPIAYKTHQVGLKMVKDLTVARRFIMQKLVVGMLNMALTETARDVKVWKEFAMEASRCNDYSNFGRMLLKLHNELFDSILWNGVNTLWDAVAPMQPTLGSEWKTWKQDVMRWFSTPPSLSSSKDTRQQSSDDLYQANLQVCRKRPKLEVRRADTHASQVEIKDQTIALEADPGFFKNQDTLSTLAAESCKQEGVREVSVATASPSNLANKWNEIVVEATDSDFLHTKEMESTPTNELTVANSVEPGSKNRQCIAYIEAKGRQCVRWANDGDVYCCVHLSSRFLGSPTKSEKPVPVDTPMCEGTTVLGTRCKHRALPGSLFCKKHRPHAETEQTSNLPQNTLKRKHKENYTGSEDMFGKDLVLVNLESPLQVDPVSSIGADSVHGESNFNEKPMHSENDHNAMVTMHCIGSPPFDKKNPCMEGPKRYCLYCESHLPSWLKRARNGKSRIVSKEVFTGLLRDCSSWEQKVHLHKACELFYRLFKSILSLRNPVPKDVQFQWALTEASKDSNVGEFFTKLVHSEKARIKLIWGFNDDMDITSVMEEPPLLPSTINDNCDEENAIKCKICSAEFPDDQALGNHWMDSHKKEAQWLFRGYACAICLDSFTNRKLLETHVQERHHVQFVEQCMLLQCIPCGSHFGNTDQLWQHVLSVHPVDFKPSKAPDQQTFSTGEDSPVKHDQGNSVPLENNSENTGGLRKFVCRFCGLKFDLLPDLGRHHQAAHMGPNLASSRPAKRGVRYYAYRLKSGRLSRPRFKKGLAAASYRLRNKANANLKRGIQATNSLGTGGITIPPHVTESETTNIGRLAEHQCSAVSKILFSEIQKTKPRPNNLDILSIARSACCKVSLVASLEEKYGILPEKLYLKAAKICSEHSILVNWHQEGFICPRGCNVSMDQALLSPLASLPSNSVMPKSVNLSDPASGEWEVDEFHCIINSRTLKLGSVQKAVILCDDISFGKESVPVICVVDQELTHSLHMNGCNGQNISSSMPWETITYVTKPMLDQSLSLDSESLQLGCACSYTSCCPETCDHVYLFGNDYDDAKDIFGKPMRGRFPYDENGRIILEEGYLVYECNHMCRCNKSCPNRVLQNGVRVKLEVFKTEKKGWAVRAGEAILRGTFVCEYIGEVLDVQEARNRRKSYFYDIDARVNDIGRLIEGQAQYVIDSTKFGNVSRFINHR

SEQ ID NO: 170107 - protein, 265 aa, Glycine max
  Coding DNA Sequence Number=SeqID_53329
  Gene Ontology: Mol. function=protein binding
  Homolog annotation: Hit_ID=Q75KA7; Match level="QueryCoverage=76%, HitCoverage=40%, E-value=9e-43, Identity=45%"; Hit description =Expressed protein
MRRVLLIAELCIENYNRRNMINKRKREEEKWLNPGGPSDAKILRPKSSKAWNCCESLSLMGDIRLTRVEQGQTKIRNVPIAVTPEGFWCCPTPVGFQKSLKPQNPLNKLKPSSPPPKPSSQKKAVSESQRKTVPSPSRLAVSDAQQCNDDPERPPTSTSVPAQRAPKKVAIEFGEPGTFDMKLLLLGKQGFCVKLSVHRDVLIEKSSFFADKLSEQSSLSCLQVDDCEDVEIYVETVGLMYCKEMKQQLMKQSVSRILRILKVIC

SEQ ID NO: 170108 - protein, 373 aa, Glycine max
  Coding DNA Sequence Number=SeqID_53330
  Homolog annotation: Hit_ID=Q2R457; Match level="QueryCoverage=82%, HitCoverage=87%, E-value=6e-82, Identity=51%"; Hit description =Expressed protein
MGTNRQEHEISGGSEATYQEMIENEVKDTQEGSTHKLITESCKSNSMVIKMFYFMLCSTEAEKWSKLTPKQKRHTLIPAHIIAEAISTIADLDIRWSGPITPKEMEYVEQYVLAKYPEYSGLMKGDGNGINLSSFIIYEEPSESMIDDRGKSPRESSTYFFGSNNLPEMDRAKIQLEPSRLLDILNKKSSFLGSFISIPEIQARNKILNHYGLPDEEYLVLFTPSYKDAMMLVGESYPFVKGNYYMTILDQEEDYIREFASFKESKVISAPKTWLDLRISGSQLSQNFRRRCKISSKGLFSYPVDANGTMHWISEAHRNNWHVLLDASALVVGKDRLHLLALHRPDFVICNLENTHSNPSRVTCLLVRKKSFE

SEQ ID NO: 170109 - protein, 204 aa, Glycine max
  Coding DNA Sequence Number=SeqID_53331
  Pfam annotation: Domain name=DUF1723; Domain location=86-135; Score =17.9; E_value=0.0039; Accession=PF08330.1; Description=Protein of unknown function (DUF1723)
MFLICKSVVWVVMLALLEISQGASAQPSCMVAVGQGCEAWWNARSNCKPQSQPTVVRIIGPPIGGGAIDLSLLRSYRDHCVRHVWIRQERPEVKLVSLDAQDTSSFHLPIGEMTITLDYKSCLLHLPMTRRPIDYVSSVFDKEEVKILLMCYLGSPTKTEAFATAKTGARVSLTCTIFANKSSTRIHVSYLQYLDNLDGFHEYA

SEQ ID NO: 170110 - protein, 220 aa, Glycine max
  Coding DNA Sequence Number=SeqID_53332
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=4e-29, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
IHVLAFRGLHSIAFRGLHALDFRGMHALAFCGLRILTFRWLHALAFKGLHALTIRGVHVLALRGLHDLAFRRLHALTFRGLHVVAFRGLHTLAFSGLHVLTFRGLHAFAFRGPHALTFRGLHVLAFIVLHALSVSRLHALTGLHALTFRGLHAFTFRVLYVLAFKGLHVLAFRELHVLVFRGLHVLAFRGLHAFAIRGLHVLTITRLHILPFGWLHALAF

SEQ ID NO: 170111 - protein, 73 aa, Glycine max
  Coding DNA Sequence Number=SeqID_53333
MVPELNSCCLRLPSHCSQHVLLPCTAAIPTRPTVWPPYINSLVRKTFDTKDFHVHGSTANSSYLSESVTKLNH

SEQ ID NO: 170112 - protein, 437 aa, Glycine max
  Coding DNA Sequence Number=SeqID_53334
  Homolog annotation: Hit_ID=Q6Z867; Match level="QueryCoverage=37%, HitCoverage=54%, E-value=8e-23, Identity=37%"; Hit description=RNA recognition motif (RRM)-containing protein-like
  Subcellular localization annotation: CTP_CleavageSite=61; ConfidenceScore=5.61e-01
MLRSTPIPAPYNSVPVLSRARTCHSLAPARAVHSHSSFVSRLVFPQFRQYIVNVPGRVFVAAAAKKQRRGGAELAVTDDGFDDDEEYDDDDFYDEYDDDDDDEEEEFDDDEDDEGMLSLEKMNKWFEKKPRGFGEGKVYDTSVEDKLLEEMRQSRIAQAENLKKLMSNPVKHASNESVQKKKAGDDLILERKFLFSPERVKNAELVPIGGRVCLVNLPKKKNIHKDLKSALQGIPGIINIVPAVTGNKKTRDPICKGFAYVDFKREEDAVRFVELYTGQTITFGKIQKQIKCELLNVQSSSSLKLSKNLSAAPQLVAAAFEEDSNEDSNLDGSARSSWDETNSSDDLDDLDYQMNGEEQEDDEDNQESVTALGVDHDDNVEMRIDPENISLPSEQVDRNPAAVQKSSAKVKQENARKKKPISKEKTKKVLDVPGSSR

SEQ ID NO: 170113 - protein, 95 aa, Glycine max
  Coding DNA Sequence Number=SeqID_53335
MWVQAIGLFAQATCAPEFGLPRPFNKRLLVLHIGGGAVKQRGQPFPCVQESPTTRDPRSLNPFSEIRRREEEVSLKRDGLYNEDQSNIFIEYASG

SEQ ID NO: 170114 - protein, 75 aa, Glycine max
  Coding DNA Sequence Number=SeqID_53336
MEEPLGIPLSIDFQVQAIGQFAQATCAPEFGLPRPFNQRLLVLHVGGVAVKQRVKFKTNKFQNKKGGSKRKRAFD

SEQ ID NO: 170115 - protein, 73 aa, Glycine max
  Coding DNA Sequence Number=SeqID_53337
MVHGMMVESVGENRMLGLRFTPRHKRSKRFGTIQEDLLFSYLYCVLHGSLPDKKRIEEDNPDNHIQASDRMKL

SEQ ID NO: 170116 - protein, 87 aa, Glycine max
  Coding DNA Sequence Number=SeqID_53338
  Homolog annotation: Hit_ID=Q9FJY0; Match level="QueryCoverage=52%, HitCoverage=7%, E-value=4e-11, Identity=76%"; Hit description =Arabidopsis thaliana genomic DNA, chromosome 5, TAC clone:K1F13
MECTLTSELFSQVRVYTPKRVFQELEVAKDEYIRANLGIRKDQKILLPKLVESFTKDSETVQRNTILQCDNTVNNLCCYSKSDVNVP

SEQ ID NO: 170117 - protein, 147 aa, Glycine max
  Coding DNA Sequence Number=SeqID_53339
  Homolog annotation: Hit_ID=Q9FJY2; Match level="QueryCoverage=63%, HitCoverage=59%, E-value=2e-09, Identity=34%"; Hit description =Arabidopsis thaliana genomic DNA, chromosome 5, TAC clone:K1F13
MGACSSSASVEMETTTASVNKGGGGGGGGAPASESFRRPSSIMVMDMVGRINEYKQPIPARNVLSENPHYYLCNSESVHIGTCMPRVPDEEELLAGRIYFLVPLSHSDTPLSLPLLCDLAVKAGSALPNPNNNRYYGQGKKAADKRR

SEQ ID NO: 170118 - protein, 796 aa, Glycine max
  Coding DNA Sequence Number=SeqID_53340
  Gene Ontology: Mol. function=heat shock protein binding; Cellular component=integral to membrane; Biological process=protein folding
  Homolog annotation: Hit_ID=Q1T494; Match level="QueryCoverage=98%, HitCoverage=98%, E-value=1e-145, Identity=39%"; Hit description =Aminotransferase, class-II; Heat shock protein DnaJ
  Pfam annotation: Domain name=DnaJ; Domain location=66-127; Score =94.6; E_value=3e-25; Accession=PF00226.21; Description=DnaJ domain
MEFNKDGALRAKKLAEKMLLQREFGGARILAKKALELYPNLDGLPQFLATIEVYISSEDRVNGELDWYRILGVQPLADEETIRRQYRKLALTLHPDKNRSVGADGAFSLISQAWSLLSDKAKRITYDQKCNLWRNGNPGGKPSMPASQNGSHSNIFNPVLLKPTFWTFCSFCKTNFEYHNVYVNSNLVCTCCHKPFLASETLPPPGYRNVSSTQMKQHNFNSMRMERNYHFSGRTPMSAVNSSLGSGPFSMPDGISRVPASASSAAEAPGVFRMSSENLKRRHEDSATFLREDAHFGNAHAVDRTGAGSAFQSSRFGSNSIMKGDRPRKNRPTDEHKVGSDRRDMENKTASQNEGINLANEFGSGRVNAAGNHKRTGVRDRSQHQIKNILVEKARKEIVKKLDEWKASSASNNLDKSKNTDTEIREKGKEREGNVVKPGAQVVDSETVNKKCFSADLEPELPGSLSMNVPDPDFHDFDGDRTENAFGENQVWAAYDNDDGMPRYYCLIHDVISKNPLNMRISWLNAKSNDELAPIEWVSSGFPKTSGDFRIGKRVSYSTLNSFSHRVKWTKGSRGVVHIYPKKGDVWALYRNWSLDWNKFTEDEIIQKYDMVEVLEDYCEEKGVNIAPLVKVSGFKTVFRQNADPRKVKNISKAEMFRFSHQVPSHWLTGVEGHNAPKGCLELDPAATPMELLQVLAEDLEQVILMTTEKSVEDELKHKENSREEGLIKMCQTTKDEGSDEGLGEKKRKSESCLTTKKEGSDEGLGEKERKSESCLTTKEERSDEELGEKERKPKI

SEQ ID NO: 170119 - protein, 108 aa, Glycine max
  Coding DNA Sequence Number=SeqID_53341
MHVDYDGGERRILGAAGRERRRQWRGRSCWCRKNNPNIAAQNNNKQREKEGFGTRGSWVSAESEQIAASGFMAVDGKRRWCLTMTEGDLQCPRVAVLRFRDSQRRYWV

SEQ ID NO: 170120 - protein, 582 aa, Glycine max
  Coding DNA Sequence Number=SeqID_53342
  Homolog annotation: Hit_ID=Q6YZD9; Match level="QueryCoverage=99%, HitCoverage=99%, E-value=1e-155, Identity=48%"; Hit description =Nodulin-related protein-like
  Pfam annotation: Domain name=MFS_1; Domain location=11-516; Score= -22.8; E_value=0.0035; Accession=PF07690.6; Description=Major Facilitator Superfamily
  Pfam annotation: Domain name=Nodulin-like; Domain location=11-258; Score=406.4; E_value=4.2e-119; Accession=PF06813.4; Description =Nodulin-like
  Pfam module annotation: Pfam domain module=MFS_1::Nodulin-like; Domain location=11-516::11-258
  Subcellular localization annotation: CTP_CleavageSite=39; ConfidenceScore=5.01e-01
MGWVKGFVGHRWVVFVCAMWDMSFAGTSYMFGSISPVIKSSMGFNQKQVAFLSVAKDLGDNVGLLAGKISQASPVWGLILVGVVQNVVGYGLVWLVVTHQLPALPLWLLCIVIFVGQNGSTYYNTAALVSCVQSFPESRGPVVGILKGFVGLSGAIWTQLIAMIQLPDQASLIFIIAVGPAMVSLTFMFIIRPVESYRQSRSSDGTGFTFIYSICLLLAAYLMGVLLLENMFDLDQSTITLFAVILIILIFLPIIVPILLVFFSGPQSADQEALLEPPMLEATKPKHFVGESSTSTTKVTKHFENEKNPSKLEVLPLSEGPRDVFQFQARLWQAVTKAVKKIKRKNGPHRGEDFTLSQAMAKADFWVMFFSLVMGCGSGLTIINNMGQICQSLGDNNVNVYVSVISISNFLGRVGGGYFSEVIVRNFGYPRLAALAVIQAGMSLGLCYYVLGLVGQVYVVAISNGFGYGAHWSIALAAASELFGLKNFGTLYNFLTMASPAGSLFLSGFVASTIYDYYAEQQAKHQMLTGNNNDLLLCEGNICFSITFGILAVVCLCAASLSLIVAHRTRKFYAQLYGESRT

SEQ ID NO: 170121 - protein, 104 aa, Glycine max
  Coding DNA Sequence Number=SeqID_53343
MGEEEAATARKKKTQQRGRRRGRNQPTVWRGSAEEEENNNEEELVGIGLGCVQEATRLENPKCLTQKMVWPRGNHHHEGWHTSTAPLVQGRHRVHSGSETAATV

SEQ ID NO: 170122 - protein, 89 aa, Glycine max
  Coding DNA Sequence Number=SeqID_53344
MANTDKPMEVVDVAKVRFPTLLADHPWSMQLRLGKQKMEPPTKQSLSHCTTVQASVRATLVAPTSTIINTPIVSIITTTNRPDLYWKTV

SEQ ID NO: 170123 - protein, 59 aa, Glycine max
  Coding DNA Sequence Number=SeqID_53345
  Subcellular localization annotation: CTP_CleavageSite=51; ConfidenceScore=5.13e-01
MTKGQTTQMPFNMSPQNMTVPQMAGIRHSTMTENPIPTWTEVRMTAPQTIDANMIANSI

SEQ ID NO: 170124 - protein, 143 aa, Glycine max
  Coding DNA Sequence Number=SeqID_53346
MSCSRPSSSRWTSLNEELEQFLATVPKHGEWREMANMMQNVAVPPNTIFQTVHARDQVIFSVKLVSHCSRVNSTTRFLPADRRSSSILNSLWMFQATCIIFLKTKAELICTWRTLQNVGLCSIIGGRHLKLELDANIFVKPCP

SEQ ID NO: 170125 - protein, 124 aa, Glycine max
  Coding DNA Sequence Number=SeqID_53347
  Gene Ontology: Mol. function=hydrolase activity; Cellular component =integral to membrane; Biological process=aromatic compound metabolic process
  Homolog annotation: Hit_ID=Q9ZP87; Match level="QueryCoverage=53%, HitCoverage=21%, E-value=1e-18, Identity=61%"; Hit description =Epoxide hydrolase
MMVPEDRLRMSVILRRSRGQKALVFLHGFPEIWYTWRHQIIVAANAGYRAIAFDFRGYGLSEHPGKSQKLNLLDLVNDVMGLLDSLSLTKEGGRAEAYFVRFDVKLVITYGTLTSQRVTSNRTS

SEQ ID NO: 170126 - protein, 285 aa, Glycine max
  Coding DNA Sequence Number=SeqID_53348
  Gene Ontology: Mol. function=guanyl-nucleotide exchange factor activity; Cellular component=integral to membrane; Biological process=signal transduction
  Homolog annotation: Hit_ID=Q7EYZ3; Match level="QueryCoverage=76%, HitCoverage=69%, E-value=5e-78, Identity=63%"; Hit description =Putative placental protein 6
  Pfam annotation: Domain name=DUF1751; Domain location=30-125; Score =152.1; E_value=1.4e-42; Accession=PF08551.1; Description=Eukaryotic integral membrane protein
  Pfam annotation: Domain name=Rhomboid; Domain location=29-182; Score=- 11.6; E_value=0.0022; Accession=PF01694.12; Description=Rhomboid family
  Pfam module annotation: Pfam domain module=DUF1751::Rhomboid; Domain location=30-125::29-182
MEEKRQHARSGVTRSCVWMKKRLEEILEGTIPFAWNLITAGYVEQSIYGVVVSTLSLLFIGKLLEPIWGSREFFKFIFVVNLLTSVCLFITAIALYYITRLETYLYMPLSGFHGVVSGFLVGIKQIIPDQELPFIKIKTKWLPSITVLLSIAISFWTLEATAYLPTIISGTYISWIYLRYWQRKPETKHRGDLSEDFAFSTFFPEFLRPVIDPIASIFHRMLCGRYDASNDGQGNSLESEPLPGSDSIEASRRRERGARALEERLAAERLAVARRELQREAEENV

SEQ ID NO: 170127 - protein, 274 aa, Glycine max
  Coding DNA Sequence Number=SeqID_53349
  Gene Ontology: Mol. function=RNA binding
  Homolog annotation: Hit_ID=Q1T614; Match level="QueryCoverage=87%, HitCoverage=44%, E-value=2e-52, Identity=49%"; Hit description =Cyclin-like F-box; Agenet
  Pfam annotation: Domain name=Agenet; Domain location=10-77; Score =58.6; E_value=2e-14; Accession=PF05641.3; Description=Agenet domain
  Pfam annotation: Domain name=F-box; Domain location=165-212; Score =37.0; E_value=6.4e-08; Accession=PF00646.23; Description=F-box domain
  Pfam module annotation: Pfam domain module=Agenet::F-box; Domain location=10-77::165-212
MAPKHDLAYTKPGSAVEVSIDDDGFSGSWFSATIVSSWAIDRFLVKYHNLVENELSHTPLQEVVCLHQLRPLPPPEKHRDFKSGDKVDAFHNDGWWEGHITGKLGNGRFRVYFRDTEENMVFSKKQLRTHCKWINHNWVFPTTDHKVSVSGKETEGKKRRRDERDRISELPDCILMHIMSFLDTKDAVQTCILSKRWKDLCKCLTDLTFRSPFRCKCKKYFRKFVSWVLSSRNDSCSLLNVDINNSCIETEEFKQQTQFGFPPFGLLQQVFDFP

SEQ ID NO: 170128 - protein, 55 aa, Glycine max
  Coding DNA Sequence Number=SeqID_53350
MAFADNWVVGKEKVCYWLSNDIVGPASILLPAKTKSAKLEGKHLGCQIPPPLGVF

SEQ ID NO: 170129 - protein, 77 aa, Glycine max
  Coding DNA Sequence Number=SeqID_53351
MHWHVHVVYVHGGCIDLVGRPIHAGLECALTLLDGPFMGDKRVYVQAGCFDLVGWPIRGGLVWLKNLSIRCGDAQAL

SEQ ID NO: 170130 - protein, 159 aa, Glycine max
  Coding DNA Sequence Number=SeqID_53352
  Gene Ontology: Mol. function=RNA binding
  Homolog annotation: Hit_ID=Q2HS79; Match level="QueryCoverage=96%, HitCoverage=32%, E-value=2e-20, Identity=46%"; Hit description =Cyclin-like F-box; Agenet
  Subcellular localization annotation: CTP_CleavageSite=80; ConfidenceScore=5.31e-01
MHDNAKVLRISNSTLSHLKITSYISFLTTQAFQIALSTPNLSSFTIIGFAPHQLSSSCNLAFLGSVYIGVWFVSSSTFIRCLQVLANVKILKLSWETLQMILYDLSNSNSTMPQPPCFVRLESLHVEKESCQRSDGEINNVVEYLLQNSPKARVDIISA

SEQ ID NO: 170131 - protein, 284 aa, Glycine max
  Coding DNA Sequence Number=SeqID_53353
  Gene Ontology: Mol. function=transcription factor activity; Biological process=regulation of transcription, DNA-dependent
  Homolog annotation: Hit_ID=Q3KCN9; Match level="QueryCoverage=93%, HitCoverage=93%, E-value=7e-92, Identity=62%"; Hit description =Transcriptional Regulator, LysR family
  Pfam annotation: Domain name=HTH_1; Domain location=3-62; Score=72.3; E_value=1.5e-18; Accession=PF00126.17; Description=Bacterial regulatory helix-turn-helix protein, lysR family
  Pfam annotation: Domain name=LysR_substrate; Domain location=86-282; Score=86.9; E_value=6.2e-23; Accession=PF03466.10; Description=LysR substrate binding domain
  Pfam module annotation: Pfam domain module=HTH_1::LysR_substrate; Domain location=3-62::86-282
MEWSDVRIFLAVMRSGSYGEAARRLGVSHPTVGRRIKVLEAQAHQALFRRTPDGLVLTDAGDAVLGLAESMENAALAMERRLAGNHPRLEGILRISCAEWFATAVLAPVLSELTQRHPAIVPEIIASYRLLNLSRRDADVAFRIVPFTEPDIVQRRLMSMPYALYGTPENARALQHDPASVGLILMNTAQAHFPDVVWLLDQFPQSRRAFTSTSRAVQAQMCRRGMGVAVLPQPLGDATAGLQRIPTPQPPPSRDIWVGYHQDLRHMDRLRAMLDIADALLIAK

SEQ ID NO: 170132 - protein, 96 aa, Glycine max
  Coding DNA Sequence Number=SeqID_53354
  Gene Ontology: Mol. function=3-oxoacyl-[acyl-carrier-protein] reductase activity; Cellular component=cytoplasm; Biological process= metabolic process
  Homolog annotation: Hit_ID=UPI0000383920; Match level="QueryCoverage =98%, HitCoverage=38%, E-value=3e-18, Identity=51%"; Hit description =COG1028: Dehydrogenases with different specificities (related to short-chain alcohol dehydrogenases)
  Pfam annotation: Domain name=adh_short; Domain location=7-96; Score= -22.8; E_value=0.00017; Accession=PF00106.15; Description=short chain dehydrogenase
MKKLQDKVALVTGASKGIGAAIARQLAADGAKIVVNYAADKNGADKVVAAIEAAGGTAVALAADVTDQPQVEALIQSTLAQFGRLDIVVNNAGVYQ

SEQ ID NO: 170133 - protein, 167 aa, Glycine max
  Coding DNA Sequence Number=SeqID_53355
MKVDMEAMKDQMAAMMDAMLSMNKIIESNAAAIATTSTTAEGGEALGSTGSPHVVQSKNPFPPYDLSPNYTPPNVPHTPNESINNSAPIPIGSQQPQSDHAHVSQPIGETHEVPHHNLADFEPRLRYATEGQIRERLRAIKGGGDYAFADIAKLCLVPNVVIPPKFK

SEQ ID NO: 170134 - protein, 318 aa, Glycine max
  Coding DNA Sequence Number=SeqID_53356
  Gene Ontology: Mol. function=helicase activity; Biological process =protein amino acid phosphorylation
  Homolog annotation: Hit_ID=Q1SN45; Match level="QueryCoverage=98%, HitCoverage=19%, E-value=1e-76, Identity=48%"; Hit description=AAA ATPase
MGFLQDDKEFIKAIKEAKDWGSAHYIRKLFVLLLLTATMNKPEQVWDQTWHWMADDIVYNYKKSSASPALQLDDRTLQNLFLLEIEQLLQANQRSLRDYPSMSYLEDANCPTYLDNSFILAELNDNNQELRSEFKHLFSQMTDEGGMCFLYGYGGTGKTYIWKTLASSLRVDNKIVIMVASSGIASLLLPGGRTAHSKFKILVPVFEDSTCNIHQGTQLATLLNQTSLIIWDEAPMTHKFYFEALDHSLRDIIKHNLKDCKIFGGKVMVFGGDVWQILPVIPRGSRSDIVNATINSSYLWDHCQILRLTKNMRLQNNM

SEQ ID NO: 170135 - protein, 38 aa, Glycine max
  Coding DNA Sequence Number=SeqID_53357
MTLSPVKDIDEDFEFYESIKQRMLSPMKQANRYMQPSS

SEQ ID NO: 170136 - protein, 135 aa, Glycine max
  Coding DNA Sequence Number=SeqID_53358
  Pfam annotation: Domain name=Transposase_23; Domain location=27-97; Score=-3.8; E_value=0.0029; Accession=PF03017.5; Description =TNP1ENSPM transposase
VALPPELEVGPSAARVSTKENCVDPSGNDPDKCGLYIDENPPQLVALGRLYEGSTTIHNIPLLHDQVKVGVKEVRDTEAPIFVPTEEVKLVGQALNTFLAWPTHLIKCLSEQLFLKPLRVMWDATVFGVYNDNFP

SEQ ID NO: 170137 - protein, 88 aa, Glycine max
  Coding DNA Sequence Number=SeqID_53359
MKLELKKLKEDNKKREMTLFLHQCLRARRLEPNDNMTATDWDTQTPAPAIVPEETTLLNDGDDGSNMNANGDDEMIMPPFGDDANPQL

SEQ ID NO: 170138 - protein, 153 aa, Glycine max
  Coding DNA Sequence Number=SeqID_53360
MASEEDLILLWALQTGLQIDWAHLVRYRMHKELRANAPLPYPHLVTLFLHYFNVPLDDEPFVKVKCSFAIGACVIPSFGYRKDVDGQWVWKQDLPPLIPNERTPSPPPQRDSSSSLRHDVLIELRDLWAFVGDLFDAMDSCIMRLEDDMSFIR

SEQ ID NO: 170139 - protein, 170 aa, Glycine max
  Coding DNA Sequence Number=SeqID_53361
MVETHEIPHHNLADFEPYLGYATEGQAVSGIPLQNTLEGPQYHPQPHPLHSTVGKNPHAMAEMGKLDHLEERLRAIKGGEDYAFANLKELFLVPNIITPLKFKVPDFDKYKGTTCPKNHLKMYCRKMGAYAKDEELLIHFFQESLTGAAVTCYANLEPSRIHSWKDLSLR

SEQ ID NO: 170140 - protein, 76 aa, Glycine max
  Coding DNA Sequence Number=SeqID_53362
  Subcellular localization annotation: CTP_CleavageSite=36; ConfidenceScore=5.01e-01
MQVGSATFIIRVIKHSGICSGDSKILQVASRFQDVKTSHVTSAFYSPCLHASTAVKQFTAAFCKLQVVSRMSRHLT

SEQ ID NO: 170141 - protein, 39 aa, Glycine max
  Coding DNA Sequence Number=SeqID_53363
MVSSSSCTNGLLWLTRYWKLKKESTKVLPTTSFLQRLTT

SEQ ID NO: 170142 - protein, 110 aa, Glycine max
  Coding DNA Sequence Number=SeqID_53364
VMTRSPDKIKSIDGSKESLKLSVRISDLWFIGTPNKFEQAEMVFVDSDGDEIQAVCKQDQLKECVVGDIPFRKYRFPGFVDVVAGQFERGLLVDVIGVVEEVVFRQVSGK

SEQ ID NO: 170143 - protein, 204 aa, Glycine max
  Coding DNA Sequence Number=SeqID_53365
  Gene Ontology: Mol. function=protein binding; Cellular component =outer membrane; Biological process=aromatic amino acid family biosynthetic process
  Homolog annotation: Hit_ID=P0ADE4; Match level="QueryCoverage=82%, HitCoverage=29%, E-value=5e-74, Identity=82%"; Hit description =Hypothetical protein ytfM precursor
MWVFGQQAVFCRGAAFHLLPGWKQGYSGENVTKIRQLCLVSMLLTSGIASAANVRLQVEGLSGALQKNVRAQLSTIQSDEVTPDRRFRARVDDAIREGLKALGYYEPTIDFDLRPPPKKGRQVLIARVSPGEPVLIGGTNVILRGGARTDRDYLDLLSTRLKIGTVLNHGDYDHFKKELTSVSLRKGYFDSQFNKSQLGIALAR

SEQ ID NO: 170144 - protein, 282 aa, Glycine max
  Coding DNA Sequence Number=SeqID_53366
  Gene Ontology: Mol. function=protein-methionine-S-oxide reductase activity; Cellular component=cytosol; Biological process=protein modification process
  Homolog annotation: Hit_ID=P0A744; Match level="QueryCoverage=64%, HitCoverage=86%, E-value=1e-100, Identity=92%"; Hit description =Peptide methionine sulfoxide reductase msrA (EC 1.8.4.11) (Protein- methionine-S-oxide ...
  Homolog annotation: Hit description=reductase) (Peptide-methionine (S)-S-oxide reductase) (Peptide Met(O) reductase)
  Pfam annotation: Domain name=PMSR; Domain location=22-182; Score =370.6; E_value=2.5e-108; Accession=PF01625.11; Description=Peptide methionine sulfoxide reductase
MPVATLHAVNGHSMTNVPEGMEIALFAMGCFWGVERLFWQLPGVYSTAAGYTGGYTPNPTYREVCSGETGHAEAVRVVYDPAVISYEQLLQVFWENHDPAQGMRQGNDHGTQYRSAIYPLTPEQDAAARASLERFQQAMREAGDTREVTTEIATAKPFYYAEDDHQQYLHKNPYGYCGIGGIGRHASRVARSIADRTVIHHFALQQQVKDRRLRSVQPRLQQVHSLNPQFPAGHRDARDRPFQTVRQIPGKIGGNERNIFRDTQPPRIERLLGLVCRKPLRD

SEQ ID NO: 170145 - protein, 126 aa, Glycine max
  Coding DNA Sequence Number=SeqID_53367
  Subcellular localization annotation: CTP_CleavageSite=34; ConfidenceScore=5.32e-01
MATPHNSPPHPPPTGATSHSPSTLKWTRKATRLRSLAIRPIGAERPLVHVDPDTGKVDNPYRKKLKTYLGIVARDKPTRTVLMILYAKNTALARRNRPNFLRAVKTLCGRMCEKRHRPSRNKTLPS

SEQ ID NO: 170146 - protein, 110 aa, Glycine max
  Coding DNA Sequence Number=SeqID_53368
  Gene Ontology: Mol. function=actin binding
  Homolog annotation: Hit_ID=Q1S960; Match level="QueryCoverage=86%, HitCoverage=14%, E-value=9e-14, Identity=50%"; Hit description =Prefoldin
MKNDTAELKMEAEVTKVVLQDAETTLRVAVEEVEAANAAEASAVDKIKVLCMRTSPSHSSPSEPGARITISREEFESLVYKVKESDKLADIKVAAATTTLKLQRLPKTKL

SEQ ID NO: 170147 - protein, 420 aa, Glycine max
  Coding DNA Sequence Number=SeqID_53369
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=29%, E-value=1e-154, Identity=62%"; Hit description =Multidrug resistance-associated protein 3
  Pfam annotation: Domain name=ABC_tran; Domain location=169-323; Score= 77.5; E_value=4.1e-20; Accession=PF00005.17; Description=ABC transporter
MEFKDKRMKATSEILNSMRILKLQAWEMKFLSKIIQLRKTEETWLKKFLVGTAIVRFLFYNTPTFIAVVTFGECALIGIPLESGKVLSALATFRILQMPIYSLPDTISMIAQTKVSLERIASFLRLDEWKTDVVEKLPRDSSDKAIELVDGNFSWDLSSPNPTLKNVNLTVFHGEVPKISGTLKICGTKAYVSQSPWIQSGKIEDNILFGKEMDREKYDEVLEACSLTKDLEVLPFGDQTTIGEKGINLSGGQKQRVQRARALYQDSDIYLFDDPFSALDAHTRSHLFKECLLGLLKSKTVNYITHQVEFLSDADLILVMREGRITQSGKYNDILRSGTDFMELVGAHKAALSSIKSLERRPTFKTSTTTKEDTSSVSCFELDKNVVYDQNDTSDDIVEPKGQLVQEEEREKGRVGFNVY

SEQ ID NO: 170148 - protein, 199 aa, Glycine max
  Coding DNA Sequence Number=SeqID_53370
  Gene Ontology: Mol. function=transmembrane receptor activity; Cellular component=membrane; Biological process=defense response
  Homolog annotation: Hit_ID=Q7XIJ6; Match level="QueryCoverage=67%, HitCoverage=70%, E-value=3e-29, Identity=46%"; Hit description=TIR/P- loop/LRR disease resistance protein-like protein
  Pfam annotation: Domain name=TIR; Domain location=65-182; Score=52.8; E_value=1.1e-12; Accession=PF01582.10; Description=TIR domain
MTDTCLYIHMLVLPRTENNIITPLGIEVAQTFWTSLNTHTKSKSYMSQFIRAKQCRNIVQPVYDVFINYRKVDNGRTFVPLLYDHLRIKGIKPFLDTMNMKPGHKLFEHINKAIHSSKVGVAVLTHRYCDSYFCLHELTLLNESKKRVVPIFYDIKPSQLQLKGNARYPPQELQRFMSALEETKYTVGVSFDSLNGYRA

SEQ ID NO: 170149 - protein, 183 aa, Glycine max
  Coding DNA Sequence Number=SeqID_53371
MPKRRKLNMDLRNKASDNILSQNPCQNGFSKEAQNIQWWFQSQKRCKGELKLTRNKHRIMVTSRKTTKVRSGFVLNRNREASWKIPLRLKGSSRCGVSTENNGGLWWLWVMEKELGTLEMATRKAKAETLKCFYSRERKRSSHVRRRREDRNGQIVDKCSVKLQTKFRENPTVNEGWVAFLPR

SEQ ID NO: 170150 - protein, 80 aa, Glycine max
  Coding DNA Sequence Number=SeqID_53372
  Pfam annotation: Domain name=SWIM; Domain location=19-51; Score=18.0; E_value=0.0044; Accession=PF04434.8; Description=SWIM zinc finger
MVEVEETFNLITQRDEQKWLVNLNDYYCQCGKYSALHYSCSHIIVVCRYWSIGNEATIPTSDDSWTRIPDPSTIREKGQP

SEQ ID NO: 170151 - protein, 77 aa, Glycine max
  Coding DNA Sequence Number=SeqID_53373
MYQVDVPVYTAGIARGCGWQHFLLILTLQHRYSHHCNKIHADLFNQVRIVSSVMSELREEKLMLVDMAGSENIEQVG

SEQ ID NO: 170152 - protein, 88 aa, Glycine max
  Coding DNA Sequence Number=SeqID_53374
MDMYNFITQQEAKEFGLIDKVIDQRPMALVSEAVGNNKSLNLRLHKECQGKFSSPFSYNRITNIVLKLRESQSPKFPKLEYLPSATNP

SEQ ID NO: 170153 - protein, 198 aa, Glycine max
  Coding DNA Sequence Number=SeqID_53375
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=78%, HitCoverage=48%, E-value=8e-34, Identity=46%"; Hit description =Similarity to MADS-box DNA-binding protein
  Pfam annotation: Domain name=SRF-TF; Domain location=9-61; Score =56.1; E_value=1.2e-13; Accession=PF00319.9; Description=SRF-type transcription factor (DNA-binding and dimerisation domain)
MARKKVDITYISNPTKRKATFKKRKNGLLKKVSEISTLCATEACAIIYSPDEPAKPEVWPSDQGVKSVISSFREVSKLEQSKKMLCQESLLRKNLIKAQEQLKKLKTENRKKEMSLLMSQYFTIENNLENSNTVDLNDNSFLADKNLEEIRMKIDMHQPQEVAPTVEKGGETMYLGDQGLVNYHVQGPETNGDAMPNL

SEQ ID NO: 170154 - protein, 56 aa, Glycine max
  Coding DNA Sequence Number=SeqID_53376
MSQNFTDYLTMGVKYLEAVKRRLHATKQWSPDEIRIVYTPVHIHTYVYTPDTYLLK

SEQ ID NO: 170155 - protein, 67 aa, Glycine max
  Coding DNA Sequence Number=SeqID_53377
MDPKKIKVIPNWPTPPSIREIWGCHDLTNFYKSVEGRSPEYEEPRDLRSNPFQGGEDDAIISPKGIG

SEQ ID NO: 170156 - protein, 193 aa, Glycine max
  Coding DNA Sequence Number=SeqID_53378
MAPKELEQLTQQIRDQLEESITEKPEVGPSAGRVSTKGSCVDPSPIDPDMGDSDKWGLYIEENPSRLVALGRVYEGSTAVHNIPLLHGQVKVGVQEVKDAEAPVPVPANEAVVSPAKPPDRPDHEVMWDATVFGVFNEDFSLHLTETSMRAGNSNVYGFLEPQSIQRSGQSQFESESYMKSSKRDVYLGAYLN

SEQ ID NO: 170157 - protein, 266 aa, Glycine max
  Coding DNA Sequence Number=SeqID_53379
MWAFHKGLQIDWAHLVRYRMHKALRLNASLPCPHLVTLFLQHFNIPLDSEPYVPIKRSFLIGASVIASFGYIKEHDGSWVKKGARNVGEEGNEGEDSSLFLKIMERFDGFQTFIGERFDTLELQVDMRFNEMESRMTKVEEDSCILAILVWYLNNLLFPYLHEVVIIKKGEIIEAKLHSESKVIQRCFDDNNDDDKGDDKKLKDQSKNNSSESRRIQEFKNQEEFKTQEESLESRIKIQGSRSQESRSRFKTQDSRMKKRLNQDKY

SEQ ID NO: 170158 - protein, 160 aa, Glycine max
  Coding DNA Sequence Number=SeqID_53380
  Gene Ontology: Mol. function=helicase activity
  Homolog annotation: Hit_ID=Q2R1R7; Match level="QueryCoverage=89%, HitCoverage=8%, E-value=9e-32, Identity=47%"; Hit description=AT hook motif-containing protein, putative
MSSANEPAINREGYFDLGDQLMQCSHCNANMWYDERISKHERTTNSRFSLCCGGGKVELPLLQNPPKYLYQLLYDHDTSDSKNYQQNIRTYNMMLAFTSAGIKFNKSINHSRGPPTIRIQGQPCHIIGSMLPMPRKEPKFAQLYIFDTENEVQNRINAIR

SEQ ID NO: 170159 - protein, 246 aa, Glycine max
  Coding DNA Sequence Number=SeqID_53381
  Gene Ontology: Mol. function=RNA-directed DNA polymerase activity; Biological process=RNA-dependent DNA replication
  Pfam annotation: Domain name=AT_hook; Domain location=120-132; Score =14.9; E_value=0.061; Accession=PF02178.9; Description=AT hook motif
  Pfam annotation: Domain name=Lipase_3; Domain location=52-209; Score =2.0; E_value=0.00036; Accession=PF01764.16; Description=Lipase (class 3)
  Pfam module annotation: Pfam domain module=AT_hook::Lipase_3; Domain location=120-132::52-209
DEWKIEGDVNHRIQAGWMKWRKASGVLCDAKVPIKLKGKFYRTAVRPAILYGTECWAVKSQHENKVGVAEMRMLRWMCGKTRQDKIRNEAIRERVGVAPIRRPVDSVVRRVDQMERRQTIRGRGRPKKTIREVIKKDLEINGLDRSMLLYAIIILLSTRRGAISITMYNFGSPRVGNKRFAEVYNERVKDSWRVVNHRDIIPTVPRLMGYCHVERPVFLAAGVLRHALAFVDNFNSLIDLAIIDNI

SEQ ID NO: 170160 - protein, 292 aa, Glycine max
  Coding DNA Sequence Number=SeqID_53382
IVARDKVDVTYETWKEVPIAQKDLIWEDIQAELEIPEASDNRTDSVADTVCEKYGISKDKWSQFCKTRRDPSWEDVRKKAQAIQKQNTALHVLSCGGYEYLEEKLISEKTKKKLEEVARGKDVVIDPSSPIRHHVKWKMARTKKTGQMTSESAKEIAQKIISHFQLTIATIIVYYVNAFNKYMSFVQDSLEEQASQGSFVPHGRQDVLTAAIGPRATDPTNQGPAGGVDHKKVTQQLLASFSQMQSQLQSHMQSQGLVLPPKPEVGPSRPHVSTKRSYVDPSGNDPKTGDSD

SEQ ID NO: 170161 - protein, 211 aa, Glycine max
  Coding DNA Sequence Number=SeqID_53383
MGETHEVPRDCTIADFEPHLEYVTKGQAFGGIPLPNTLRGPQYHPQPHLQPLHFAVGRLPPTMVENEKFDHIEERLKAIERGRDYPFADMAKLCLVPDIVIPPKFKVSDFNKYKWTTCLKNHLKMDLAAQVTPPMMEREMITMIVDTLVVFYYEKMVDYMPSSFANLVFAGERIKVGLKRGKFDYAASMNSGDRRPGENGGNKKEGETHVV

SEQ ID NO: 170162 - protein, 75 aa, Glycine max
  Coding DNA Sequence Number=SeqID_53384
MEAMKEQMTIMMEAMMSMRKMMKVNTATVVATSYRGEALGNTGDPHFMQVQSKHYIPPYGLPFNYTSPNVAHASD

SEQ ID NO: 170163 - protein, 78 aa, Glycine max
  Coding DNA Sequence Number=SeqID_53385
  Gene Ontology: Mol. function=protein serine/threonine kinase activity; Cellular component=nucleus; Biological process=protein amino acid phosphorylation
  Homolog annotation: Hit_ID=Q3C254; Match level="QueryCoverage=84%, HitCoverage=17%, E-value=3e-22, Identity=76%"; Hit description =Mitogen-activated protein kinase
  Subcellular localization annotation: CTP_CleavageSite=40; ConfidenceScore=5.13e-01
MRVIGSPNDTSLRFLQSDNARRYVRQLPQYPRQQFTATFPSMSPGAVDLLEKMLVFDPNRRIIEFADLCKFLKLEQPN

SEQ ID NO: 170164 - protein, 169 aa, Glycine max
  Coding DNA Sequence Number=SeqID_53386
MAKVGFRTSHIGFILGVAFVKRTRGNTCKIKDFDTQFFRSTRGLLLLLCISREEKGELSDHLFEYFYCHTLISSGDLCSMTCDHSLVLVRCLAPIIRQFVKFQDMPKNQKNIDAQSQRGVYLVKMGVQIAPRPTWALRNIPPEGGCFWRKQPCSPGRAGRQPPPLFCYK

SEQ ID NO: 170165 - protein, 226 aa, Glycine max
  Coding DNA Sequence Number=SeqID_53387
  Gene Ontology: Mol. function=RNA binding; Biological process =biosynthetic process
  Homolog annotation: Hit_ID=Q7N6P7; Match level="QueryCoverage=90%, HitCoverage=68%, E-value=3e-76, Identity=70%"; Hit description =Similar to unknown protein YbhK of Escherichia coli
  Pfam annotation: Domain name=UPF0052; Domain location=1-223; Score =158.6; E_value=1.6e-44; Accession=PF01933.9; Description =Uncharacterised protein family UPF0052
MFEYRFSGNGELAGHNLGNLMLKALDHLSVRPLEAINLVRSLLKVDAALIPMSEQPVDLMAHDHEGNHVYGEVNVDQLAHMPQELMLSPPVSATREALDAIAQADVILIGPGSFLTSLMPLLLLDDLTQALRRSSASMIYIGNLGRELSVAAAALSLQDKLTLMEEKIGRRMIDALIVGPAVDASEVQDRVVIQQPLEASDIPYRHDRQLLRQALDRALVALAARR

SEQ ID NO: 170166 - protein, 110 aa, Glycine max
  Coding DNA Sequence Number=SeqID_53388
  Gene Ontology: Mol. function=excinuclease ABC activity; Cellular component=excinuclease ABC complex; Biological process=response to DNA damage stimulus
  Homolog annotation: Hit_ID=Q8ZGW7; Match level="QueryCoverage=99%, HitCoverage=16%, E-value=1e-34, Identity=70%"; Hit description =UvrABC system protein B
  Pfam annotation: Domain name=UVR; Domain location=70-105; Score=57.4; E_value=4.7e-14; Accession=PF02151.9; Description=UvrBuvrC motif
MAKAIGETERRRAKQQAYNEANGIVPQGLNKKIGDILQIGQPVNRAKSKGKGKAADGGASLQNLTPKALDQKIRDLEAQMYTHAQNLEFEQAAALRDQIHQLREQFIAIS

SEQ ID NO: 170167 - protein, 136 aa, Glycine max
  Coding DNA Sequence Number=SeqID_53389
MRGVPSEESITPFIAWGFSDPNARVLQGVCKEWDDVRRKDKELRGSSNGIIDGYRKRLRFHTQGLDWLPKQRAARGEEAKAPEESEEVQALKAELEKAQAVKEKFKSTAIKVRRQYDELKDVGSSGLRIIKKRGLN

SEQ ID NO: 170168 - protein, 86 aa, Glycine max
  Coding DNA Sequence Number=SeqID_53390
ALRGLDDTPQPKSKAGARWIIVKCNRQKGNTECGHYVMHWMSTIILGSFKNNWEMYFNDVRPLEAERLKALRIQWTQYHLKVRNQT

SEQ ID NO: 170169 - protein, 138 aa, Glycine max
  Coding DNA Sequence Number=SeqID_53391
MEQRGHGMYYTPPTFSQYPSQMYQYPFEGHDTDMSASEHSFSGVAETHPHFSWPTMTPSQQHDAPMATPNAPLVPQWNVPGAITDMGDLLGVDLRHEFSAEAEQQGRRQRARRNLDREARRWNRPCGTSSHHHGHHND

SEQ ID NO: 170170 - protein, 163 aa, Glycine max
  Coding DNA Sequence Number=SeqID_53392
VMARSPNKIKSINGSKESLKLSVRISDLWFIGTPNKSEQAEMVFVDSDGDEIHAICKQDQLKECVLGDIPFRKYRFAGFADVVTGQFEHGLLVDVIGVVEEVVFRQVLGKGRRVVFKLKDLSQQLLSCTLWDDYCLQFVKFLDDYEGDGPITVLLSHCRIKEA

SEQ ID NO: 170171 - protein, 201 aa, Glycine max
  Coding DNA Sequence Number=SeqID_53393
MAKFDPDIVLEFYANAWPTEEGVRDMRSWVGGQWIPFDAEALSQFLGDPLVLEEGQECKFSQRRNKADGLDEEAIAQLLCTPGHCHSPGPLQGGGCGSCTPYDHLDPDVDDIAAQQCMPPTRYPLDPDKSNRALGFPALIMGLCQSFGVPVKPSKVIRPPITQAFIEKYCTPRQAQGDAPQAADAPPPPHQVDLAGSLVME

SEQ ID NO: 170172 - protein, 46 aa, Glycine max
  Coding DNA Sequence Number=SeqID_53394
MSNASPNESNSRYEEVSREGNKLLILEAYKYLGWEEQGRNKNRGLF

SEQ ID NO: 170173 - protein, 91 aa, Glycine max
  Coding DNA Sequence Number=SeqID_53395
MDNTHRSLTDNWKHIELVQPIYQDGTYTKKKDGEDRIKEQEKGYMPKEKHQFGNDTQGEEGFVKKSQHVLDNGQLARVDSDHNLCEADLPK

SEQ ID NO: 170174 - protein, 52 aa, Glycine max
  Coding DNA Sequence Number=SeqID_53396
MASEKAMGWSMSSDIGDHQPHDPTYLAQATFIHPTSIHLNNNSVILRNSFNA

SEQ ID NO: 170175 - protein, 135 aa, Glycine max
  Coding DNA Sequence Number=SeqID_53397
MYNSIITYIGLHCNAHWQMVIILPKENVVIWFCSLHNRPDNYLKGIINSALKGLDDTQQSKSKPPARWIVVKCNRSKGSTECRYYVMHWMLTIISANFKNNWEMYFTDARPLEPERLKAFRIQWAKYYLKVKNET

SEQ ID NO: 170176 - protein, 97 aa, Glycine max
  Coding DNA Sequence Number=SeqID_53398
MVQEGHLHHSDGALMRVWCVDEREHFRQCGGEKSGGMVVEKCWHNDEGLEVQRVNTNAFLISTVYKVLYIMNFGLVIHAPIKEVVLKQQETPECYPC

SEQ ID NO: 170177 - protein, 67 aa, Glycine max
  Coding DNA Sequence Number=SeqID_53399
PPTNRAFIKKYCGSRQAQGETPQQPGDGQQRAIDAPPSPLEFTSAHPQKAIKRPAQDVKEALLGGNL

SEQ ID NO: 170178 - protein, 136 aa, Glycine max
  Coding DNA Sequence Number=SeqID_53400
MLYGALIELDGARVMGEVEEIQETMKADMEAIKEKMATMMEAMMSVKKIMEANAVAIAATSVVAKVNPTPPSGINESSNLRYGQAVGGIPLQNPLEGPQYHPQLHLLHSTTSKNPHAMAEMGKLDHLEERLRAIEG

SEQ ID NO: 170179 - protein, 38 aa, Glycine max
  Coding DNA Sequence Number=SeqID_53401
EVFGLWKAKSSVGSSLGNWSDSKVLGSTRLSRCAITRD

SEQ ID NO: 170180 - protein, 165 aa, Glycine max
  Coding DNA Sequence Number=SeqID_53402
MCPCLLHLPVTGKHIDHVPSIFDRDAVKILLMTHLGILTEEEAMTVTNAAARVRLTWLVELYHRYIESGSNLDVCHEYTWGVTTLAYLYDHLSYASQYTNNQVGRYMTLLIEIMGYVHLPSVGYSEHGTGALDDPIANRWKPTKGFRFTHLIREKLDKLKMDVVI

SEQ ID NO: 170181 - protein, 68 aa, Glycine max
  Coding DNA Sequence Number=SeqID_53403
MASYGGEFVLDSSCPWSGVSNHVSSFSIPLTLIFEKQRTPLMKKTQGLQASHGATSPLIAKLTLCQKT

SEQ ID NO: 170182 - protein, 81 aa, Glycine max
  Coding DNA Sequence Number=SeqID_53404
MAKIQGQKEGKPILIFTMKSGPNIGPWAHKSTLRFMRILGDAILPPRALERRLQEDWARDAEECPRVLMSLRVDFGPMSEV

SEQ ID NO: 170183 - protein, 492 aa, Glycine max
  Coding DNA Sequence Number=SeqID_53405
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=P09029; Match level="QueryCoverage=60%, HitCoverage=93%, E-value=1e-138, Identity=74%"; Hit description =Phosphoribosylaminoimidazole carboxylase ATPase subunit
  Pfam annotation: Domain name=AIRC; Domain location=20-175; Score =325.4; E_value=9.8e-95; Accession=PF00731.10; Description=AIR carboxylase
  Pfam annotation: Domain name=ATP-grasp; Domain location=231-373; Score=179.4; E_value=8.7e-51; Accession=PF02222.12; Description=ATP -grasp domain
  Pfam module annotation: Pfam domain module=AIRC::ATP-grasp; Domain location=20-175::231-373
MPVFRLRNRVDRMSSNAAPARIAIVMGSKSDWATMQFAEEILNSLDVPFHVEVVSAHRTPDKLFSFAERAADNGFQVIIAGAGGAAHLPGMLAAKTLLPVLGVPVQSAALSGVDSLYSIVQMPRGIPVGTLAIGKAGAANAALLAAQILAIHDRELAARLAAWRQSQTDEAGEPLGIAVYPVGLDAEPSALPIAQSVITAEIERWPETALTRELANHPAFVNRDIFPRLADRLTQKQLLDQLNLATAPWQLLADKSEWPAVFSTLGELAIVKRRTGGYDGRGQWRLRADETATLPDECYGECIVEQGINFSGEVSLADAAKQHQGEAMLSAIMHELKYVGVMAMECFVTPQGLLINELAPRVHNSSHWTHNGASISQFELHLRAVLGLPLPQPVVFAPSVMVNLIGTDLNTDWLQLPLVHLHWYDKEVRAGHKVGHLNLTDSDPARLTAALNALVPLLPDAYASGIAWAVANLYFCGVPLTLALSHKGEGII

SEQ ID NO: 170184 - protein, 153 aa, Glycine max
  Coding DNA Sequence Number=SeqID_53406
  Gene Ontology: Mol. function=sequence-specific DNA binding; Cellular component=intracellular; Biological process=regulation of transcription, DNA-dependent
  Homolog annotation: Hit_ID=Q93EQ3; Match level="QueryCoverage=98%, HitCoverage=93%, E-value=2e-62, Identity=76%"; Hit description =Putative AsnC-family/Lrp-family transcriptional regulator
  Pfam annotation: Domain name=AsnC_trans_reg; Domain location=65-141; Score=94.3; E_value=3.7e-25; Accession=PF01037.11; Description=AsnC family
  Pfam annotation: Domain name=HTH_11; Domain location=4-51; Score =15.6; E_value=0.0017; Accession=PF08279.2; Description=HTH domain
  Pfam module annotation: Pfam domain module=AsnC_trans_reg::HTH_11; Domain location=65-141::4-51
MDKIDRKILAELQADGRLSVTELAERIGLSVSPCHRRVRALEESGVIRGYRAQLDPGSLGYNFSALVFVTMREGDRRAVETFENAMMDIPQVVQAQRLFGDPDYLLHVIARDLPAFQQLYDEKLSALPGVQRLSSTLVMKTVVPERSFLPLGK

SEQ ID NO: 170185 - protein, 80 aa, Glycine max
  Coding DNA Sequence Number=SeqID_53407
  Gene Ontology: Mol. function=cysteine-type endopeptidase activity; Cellular component=endoplasmic reticulum; Biological process =proteolysis
  Homolog annotation: Hit_ID=Q9FS02; Match level="QueryCoverage=98%, HitCoverage=23%, E-value=1e-34, Identity=86%"; Hit description =Cysteine proteinase precursor
MCSSIIRITTFKFENVTATPSTVDCRQKGAVTPIKDQGQCGCCWAFSAVAATEGIHALSAGKLISLSEQELVDCDTKGVD

SEQ ID NO: 170186 - protein, 157 aa, Glycine max
  Coding DNA Sequence Number=SeqID_53408
  Gene Ontology: Mol. function=nucleotide binding
  Homolog annotation: Hit_ID=P76116; Match level="QueryCoverage=76%, HitCoverage=34%, E-value=3e-10, Identity=31%"; Hit description =Hypothetical protein yncE precursor
  Subcellular localization annotation: CTP_CleavageSite=66; ConfidenceScore=5.16e-01
MKISVLALLTGMALSGCAPHQTNSSSPAVQPLAQVAQSDSVVKRQLAYGLYEMALTPGGDALYVASAESFKDVQGGVVYKLDAKTLKTLGTTHTDLKNFAMQAAADGKTLYVSNSLDGGISAIGAADGKVKGRLLFSERNEKGLPYGARQILAHDNT

SEQ ID NO: 170187 - protein, 339 aa, Glycine max
  Coding DNA Sequence Number=SeqID_53409
  Gene Ontology: Mol. function=lysine permease activity; Cellular component=membrane; Biological process=amino acid transport
  Homolog annotation: Hit_ID=Q2XL07; Match level="QueryCoverage=55%, HitCoverage=99%, E-value=1e-53, Identity=54%"; Hit description =Transporter, LysE family precursor
MPISGKRGRSFSTRKAQWFSVQCGAARLRGRRYDARSVRRFLGGIDFVGDHAGYGLGLCDLGGHSRPGGGARRRRLAVWPFVDDCDRSGGRQRAAGRQPAGADGAYLAGSGLPLVDRSAFRLLAALGRQGRVRQRPEPQGVSAVFGAAAAVYRRPGRMVGADADAGVGRRAFDQLRPGVSAGGIRIAVGTAHAPTGCEGGGAHLRRGDDRHRPRAAGRTGAEIALPPIDVRPGDLPDKVGAVDGAIAHFFIEPGGGAGDQHDSPQRRHQRMGLAAFRQPQTQPAFLVRFQHVHVAQIAESGVIGNQPGETDLPGAVIQTEAQAVGEGLADGLFINAFRP

SEQ ID NO: 170188 - protein, 352 aa, Glycine max
  Coding DNA Sequence Number=SeqID_53410
  Gene Ontology: Mol. function=ATPase activity, coupled to transmembrane movement of substances; Cellular component=integral to membrane; Biological process=proteolysis
  Homolog annotation: Hit_ID=Q8ZMV8; Match level="QueryCoverage=94%, HitCoverage=45%, E-value=1e-106, Identity=60%"; Hit description =Putative ABC transporter transmembrane region
MTQLQIPDAPNGNPASAAGGEVPLHGWATAIILIATHYRLPCSPGMIMAASEWQGKQSRDKALRHLARQAGLSLQLYEEHQWEISSWRLPLAVELSDGQVGVITSFDGDDTVRVHLAGDEQPAPIALNTLLPQIRYAAALRPVTAAKDSRVDRYLATVRPDWLRRLVLHDMRPYGYVMLGSFLINLLALVGIIFSMQVYDRVIPAQSYPTLYVLYIGVILSVVFTYILRVGRDHVTDLLGKRADMRVSDRVFGHALRLRNSAVPRSTGTFISQLRELEAVREMVTSTTVTAIVDMPFFLLFMLVMAIIAPQLAWIAPVAVLLMILPGVLSQKKLAKLAQQNLKESTLRNAVL

SEQ ID NO: 170189 - protein, 49 aa, Glycine max
  Coding DNA Sequence Number=SeqID_53411
MDTDDFFWSTFLDESSKDCVAFSNFSSFSSDKWLKGVNAQSFQASNSKV

SEQ ID NO: 170190 - protein, 113 aa, Glycine max
  Coding DNA Sequence Number=SeqID_53412
MRFSSDSRRAKTGSMADIIPNAVGKKDEQQTRLLPAGSHRELHRTAGAQRKRNRGGGRRAGSDKRAHPSVIVKNDPPVTKKPTAHHMWAAVVSVSLRSRKLPTLSAFSPVPGR

SEQ ID NO: 170191 - protein, 113 aa, Glycine max
  Coding DNA Sequence Number=SeqID_53413
  Gene Ontology: Mol. function=oxidoreductase activity; Cellular component=chloroplast; Biological process=electron transport
  Homolog annotation: Hit_ID=Q7CQ23; Match level="QueryCoverage=99%, HitCoverage=72%, E-value=1e-54, Identity=88%"; Hit description =Thioredoxin dependent thiol peroxidase
  Pfam annotation: Domain name=AhpC-TSA; Domain location=1-94; Score =40.2; E_value=7.2e-09; Accession=PF00578.11; Description=AhpCTSA family
MTPGCTVQACGLRDNMDELKKAGVEVLGISTDKPEKLSRFAEKELLNFTLLSDEDHQVSQQFGVWGEKTFMGKTYDGIHRISFLIDAKGKIEKVFDDFKTTNHHDIVLNYLQQ

SEQ ID NO: 170192 - protein, 116 aa, Glycine max
  Coding DNA Sequence Number=SeqID_53414
  Gene Ontology: Mol. function=catalytic activity; Cellular component =chromatin; Biological process=auxin mediated signaling pathway
  Homolog annotation: Hit_ID=P33079; Match level="QueryCoverage=79%, HitCoverage=100%, E-value=8e-48, Identity=100%"; Hit description =Auxin-induced protein 10A5
  Pfam annotation: Domain name=Auxin_inducible; Domain location=24-114; Score=185.5; E_value=1.3e-52; Accession=PF02519.5; Description=Auxin responsive protein
MPEQTLGCQVGNLVATNSEGEKIMGFRIAGIVRRTSFYTTQAASKRVDVPKGYAAVYVGDKMRRFTIPVSYLNEPSFQELLSQAEEEFGYDHPMGGLTIPCKEEEFLNVTAHLNEL

SEQ ID NO: 170193 - protein, 407 aa, Glycine max
  Coding DNA Sequence Number=SeqID_53415
  Gene Ontology: Mol. function=metallopeptidase activity; Cellular component=integral to membrane
  Homolog annotation: Hit_ID=UPI00005F9151; Match level="QueryCoverage =70%, HitCoverage=100%, E-value=1e-111, Identity=70%"; Hit description=COG2321: Predicted metalloprotease
  Pfam annotation: Domain name=Zn_peptidase; Domain location=1-284; Score=687.1; E_value=1.3e-203; Accession=PF04228.4; Description =Putative neutral zinc metallopeptidase
MRWQGRRESDNVEDRRGQSSGLGGGGFRVPVRGKGGIVILVVVLVAGYYGIDLSPLLNGGNVAPQGQQQSANISPKDDELAKFTSVVLASTEDNWKEIFQRMGKTYQPPKLVMYRGVTRTSCGTGQAAMGPFYCPGDRTVYIDLSFYQDMKTKLGAGGDFAQAYVVAHEVGHHVQNLLGIEPKVRQMQQGASQAEVNRLSVKMELQADCFAGVWGKYAEKQQMLEEGDLQAALNAAQAIGDDRLQQQSQGRVVPDSFTHGTSQQRYTWFKQGFDSGDPNTCNTFASRTAAGGDAAGRLAVGGGKPAARPDGVGERRGAPTAGAGTAARGVRRRPIAGRGGIGGAVRRTARRQLAAAADAALAAMASAAGRRQPALERLPTADHHPAFHSPSAAAPGRRPRSDDLAAG

SEQ ID NO: 170194 - protein, 411 aa, Glycine max
  Coding DNA Sequence Number=SeqID_53416
  Homolog annotation: Hit_ID=Q74SE6; Match level="QueryCoverage=30%, HitCoverage=12%, E-value=7e-52, Identity=80%"; Hit description =Multidrug efflux protein
IFPSTTPTGKGTRAGRAAAARYSDCSAYINRRSGFGVGIFIAVTRFKIGEGDIDKADPSAVKVGWRAVRIHHAGGQIMKAVLFIEGQFFRHGIDENLAERRQILHHPVHQPAPQPLPLKARIDRHVGQISDRGQVADGVRGGDQLVADKPPIAKLTVLVNALQGVRIALAQPGGLQQFTQPLPVDGAAVRVGDNFHRFSLTNKTEVGGIVPNGALIPADETGKTSLMRCWATDTALKQMARLSHWKVTETPWERDYRYHSPAAVVLPAGCALPGKRRRTSTKNSGTKKIASRVAEIMPPITPVPTACWLPEPAPLLVAIGSTPKMNASEVIRIGRRRMRDASSVADIRSCPLWFSSLANSTIRMAFFADSPMMVAATAPITPSGTTSITENGIDQLSYSAARHRNTTSSEM

SEQ ID NO: 170195 - protein, 112 aa, Glycine max
  Coding DNA Sequence Number=SeqID_53417
MWFIVLYDHVFSIGFLLTSKNLFRAVNLVGLRFTGCYRSHAYNHLKKHVRCLKHIHHWISHTTMPEQTFGCQVGNLVATNSEGERPLRQYHVILSPSVDPIMAHCAVGLQRS

SEQ ID NO: 170196 - protein, 89 aa, Glycine max
  Coding DNA Sequence Number=SeqID_53418
MAQKKKLRVSPLDEPPIASSFDFKEEEPQQQKPSSQKHEEEKDKEISSAKEEEEEDKDLPPPLVSKNHSPPPTNLQPQHSSSESGFETE

SEQ ID NO: 170197 - protein, 179 aa, Glycine max
  Coding DNA Sequence Number=SeqID_53419
  Gene Ontology: Mol. function=catalytic activity; Biological process =auxin mediated signaling pathway
  Homolog annotation: Hit_ID=P33079; Match level="QueryCoverage=51%, HitCoverage=100%, E-value=1e-47, Identity=100%"; Hit description =Auxin-induced protein 10A5
  Pfam annotation: Domain name=Auxin_inducible; Domain location=87-177; Score=185.5; E_value=1.3e-52; Accession=PF02519.5; Description=Auxin responsive protein
MWFIVLYDHVFSIGFLLTSKNLFRAVNLVGLRFTGCYRSHAYNHLKKHVRCLKHIHHWISHTTMPEQTFGCQVGNLVATNSEGEKIMGFRIAGIVRRTSFYTTQAASKRVDVPKGYAAVYVGDKMRRFTIPVSYLNEPSFQELLSQAEEEFGYDHPMGGLTIPCKEEEFLNVTAHLNEL

SEQ ID NO: 170198 - protein, 105 aa, Glycine max
  Coding DNA Sequence Number=SeqID_53420
  Gene Ontology: Mol. function=catalytic activity; Cellular component =chromatin; Biological process=auxin mediated signaling pathway
  Homolog annotation: Hit_ID=P33081; Match level="QueryCoverage=74%, HitCoverage=96%, E-value=2e-37, Identity=96%"; Hit description=Auxin- induced protein 15A
  Pfam annotation: Domain name=Auxin_inducible; Domain location=1-82; Score=150.0; E_value=6.2e-42; Accession=PF02519.5; Description=Auxin responsive protein
MGFRLPGIRKASKAADAPKGYLAVYVGEKLKRFVIPVSYLNQPSFQDLLSQAEEEFGYDHPMGGLTIPCSEDVFQSARSEAHEVPSLPKQVQNTVGRNTEVYFLP

SEQ ID NO: 170199 - protein, 101 aa, Glycine max
  Coding DNA Sequence Number=SeqID_53421
  Gene Ontology: Mol. function=catalytic activity; Biological process =auxin mediated signaling pathway
  Homolog annotation: Hit_ID=Q1S9X2; Match level="QueryCoverage=67%, HitCoverage=75%, E-value=6e-26, Identity=79%"; Hit description=Auxin responsive SAUR protein
  Pfam annotation: Domain name=Auxin_inducible; Domain location=1-76; Score=117.9; E_value=2.9e-32; Accession=PF02519.5; Description=Auxin responsive protein
  Subcellular localization annotation: CTP_CleavageSite=33; ConfidenceScore=5.11e-01
MGFRLPAVRRASFTASQAASKSVQVPKGYLAVYVGEKQKRFVVPVSYLNQPSFQDLLYQAEEEFGYDHPSVTWTLAQAPTITLAYATTRAYAITPTSVVAS

SEQ ID NO: 170200 - protein, 145 aa, Glycine max
  Coding DNA Sequence Number=SeqID_53422
  Gene Ontology: Mol. function=catalytic activity; Biological process =auxin mediated signaling pathway
  Homolog annotation: Hit_ID=P33080; Match level="QueryCoverage=63%, HitCoverage=100%, E-value=3e-47, Identity=100%"; Hit description =Auxin-induced protein X10A
  Pfam annotation: Domain name=Auxin_inducible; Domain location=1-90; Score=195.6; E_value=1.2e-55; Accession=PF02519.5; Description=Auxin responsive protein
MGFRLPGIRKTSIAANQASSKSVEVPKGYLVVYVGDKMRRFLIPVSYLNQPSFQDLLNQAEEEFGYDHPMGGLTIPCKEDEFLTVTSHLNDLEGHPWDDHIQTLPQLDSTSPGMKGHQIGVMGPNERHGIWGVVLEDFLKNQRNK

SEQ ID NO: 170201 - protein, 134 aa, Glycine max
  Coding DNA Sequence Number=SeqID_53423
  Subcellular localization annotation: CTP_CleavageSite=42; ConfidenceScore=5.10e-01
MTTQLKLSNVKVKCLYSPLLSFKSISPWDRKYRDRSYCRSPYASRSRNKSRSYSLSNSYIHTPPLLGFAKNCLWREKYASHEALQNGGFNPFSFSLTFGNSIRAIRGKIEESQKIARDAAIAVGRHVIPLRGKG

SEQ ID NO: 170202 - protein, 244 aa, Glycine max
  Coding DNA Sequence Number=SeqID_53424
  Gene Ontology: Mol. function=translation elongation factor activity; Cellular component=intracellular; Biological process=translational initiation
  Homolog annotation: Hit_ID=Q8H6S8; Match level="QueryCoverage=66%, HitCoverage=36%, E-value=4e-22, Identity=54%"; Hit description =Translation initiation factor
MAQKLTCSEKLQCTVLDVEVVEDHGTTIDFVLVNGVLHEVEQIVVCGMPARANCHHNPSFIGTSSNKGTLCQGRGSAVCLKGLNSAMMVLFWGTYLHHKKIKAAMGVKITAQGLEHAIAGTDLIGTPICIPSREFIDIGRVASIENNHLPVDYARKGQKVAIKEAKRLYLLHNVEKEKRSLIKISVPPCQKAPHSPRYAKIPGRVIVGMHLLLSYAKSHLAVMLQFLLQIVGSNPGLDDPLLED

SEQ ID NO: 170203 - protein, 97 aa, Glycine max
  Coding DNA Sequence Number=SeqID_53425
MNNAQTHTNRGCGGGGGFGGGGGGDGGGYSGRRRETREEPRGTRVLKNFLEDGLQYVVTYTEHVKRKTGTTMDVVAVLKRQCRVEWCYELPRSVSST

SEQ ID NO: 170204 - protein, 50 aa, Glycine max
  Coding DNA Sequence Number=SeqID_53426
  Homolog annotation: Hit_ID=Q8H6S8; Match level="QueryCoverage=62%, HitCoverage=3%, E-value=4e-09, Identity=90%"; Hit description =Translation initiation factor
MDTDTGRKKPRENENLGSPMLCIMGHVDTGKTKLLDCIRGTNVQERVRLV

SEQ ID NO: 170205 - protein, 125 aa, Glycine max
  Coding DNA Sequence Number=SeqID_53427
  Gene Ontology: Mol. function=voltage-gated potassium channel activity; Cellular component=integral to membrane; Biological process=potassium ion transport
  Homolog annotation: Hit_ID=Q5NT78; Match level="QueryCoverage=70%, HitCoverage=11%, E-value=3e-23, Identity=64%"; Hit description =Potassium channel TORK1
MDPNFKDYNYRSPLRIAAAEGLYFMAKLLLEGGTSVFTKDRWGNTTLEEARMCGNKNLIKLLEDAKSAQQSEFPSQEYTDQNASKEVHNGLHNKLGPGMLSWQPVIGGRRSCLLESKFCYCFPAP

SEQ ID NO: 170206 - protein, 53 aa, Glycine max
  Coding DNA Sequence Number=SeqID_53428
MKKALSDSVDLIQRRTRLRLEVLLLASVKREELELAMDEDEREKNCGSDTIKK

SEQ ID NO: 170207 - protein, 141 aa, Glycine max
  Coding DNA Sequence Number=SeqID_53429
  Gene Ontology: Mol. function=nucleic acid binding; Biological process= DNA integration
MAWTAIDKTFQAQTRARRMALKPQLQTLNKGSLSMIEYIEGKRSIADSLTENLHPISDEDLVGYLLSGLDSSYGPFSTAFMMKDAYASVDDLAGLLLEYKRVSFLYEQKFYSMDPSVRGLGFQLSIPGPSLLCSPSSIEDV

SEQ ID NO: 170208 - protein, 63 aa, Glycine max
  Coding DNA Sequence Number=SeqID_53430
MTLFFSDDREKFTKDSVREQEEYVSYLGVTYWKPMFLTATGARNCGLTRHREIPKVVSCKKSL

SEQ ID NO: 170209 - protein, 1509 aa, Glycine max
  Coding DNA Sequence Number=SeqID_53431
  Gene Ontology: Mol. function=RNA-directed DNA polymerase activity; Cellular component=chromatin; Biological process=chromatin assembly or disassembly
  Pfam annotation: Domain name=Chromo; Domain location=1403-1451; Score= 19.9; E_value=0.0044; Accession=PF00385.14; Description='chromo' (CHRromatin Organisation MOdifier
  Pfam annotation: Domain name=RVP; Domain location=340-446; Score= -6.2; E_value=0.016; Accession=PF00077.10; Description=Retroviral aspartyl protease
  Pfam annotation: Domain name=RVP_2; Domain location=336-460; Score= -42.3; E_value=0.002; Accession=PF08284.2; Description=Retroviral aspartyl protease
  Pfam annotation: Domain name=RnaseH; Domain location=841-962; Score= -28.3; E_value=0.025; Accession=PF00075.14; Description=RNase H
  Pfam annotation: Domain name=rve; Domain location=1097-1253; Score =94.8; E_value=2.6e-25; Accession=PF00665.16; Description=Integrase core domain
  Pfam annotation: Domain name=zf-H2C2; Domain location=1038-1079; Score=25.9; E_value=0.00013; Accession=PF09337.1; Description=His(2)- Cys(2) zinc finger
  Pfam module annotation: Pfam domain module=Chromo::RVP::RVP_2::RVT _1::Retrotrans_gag::RnaseH::rve::zf-H2C2; Domain location=1403 -1451::340-446::336-460::583-752::83-173::841-962::1097-1253::1038 -1079
MADSGTDRVEAALDRLTSRIEDLLQHVTPSPSPPFPSCNPVPAQTHRMKLDVPRFDGTDPMGWIFKITQFFEYHGTPNQDRITIAAFYMEGRALAWFQWMSSNGQFTSWSVFLQALQTRFAPSNYEDPSGSLFKLTQRTTVTEYLSEFEELANRVVGLPTPFLLSCFVSGLAPDIRREVMINQPLTVAQAAGLARLHEEKLRDLRFDFRHPTRPRTPQPPPIVSQHPPTLPSFPSPRAPSLSPLLPLPPRTNPPPPPTFRRLTPEELASRRERGLCFSCDEKFHKGHRCAPRVHLLIADEEDPVEHMGSNIDPSVPIDPGPGPMEIPDSPAHISLNSLAGHLAPETLRLVGDISGIPVLVLIDGGSTHNFLQEQLVVQLGLTSHPTSPLKVMVGNGQYLQCHTICDSVTLILQQHSFTVDFYVLPIAGANVILGVQWLQSLGPVLTDYTHLSMQFFHDGRLVNLQGDPEAHRGLLSSPQFRRACRTQNQSLYFHITMLPNDLDSPLTRTVDPQVQHLLQQFSILFQEPNALPPARDTDHQIHLRPHATPVNVRPYKYPYYQKREIETQVETMLQRGIIQPSKSPFSSPVLLVKKSDNTWRFCVDYRALNALTIKDRFPIPTIDELLDELGGASCFSKLDLLQGYHQIRMQPDDIPKTAFRTHHGHFEFKVMPFGLCNAPSSFQATMNTLFRPYLRRFIIVFFDDILIYSVSLSDHLRHLQTTFQVLYENHFVLKLSKCLFAQPEVEYLGHLVSYKGVQPVIAKLDAIAQWPQPRSVRALRSFLGLAGFYRRFIRGYATIAAPLVKATTVEPLQWTSSTQTAFETLKQALTSAPVLTLPNFQFPFTIETDASAIGMGAVLSQQGHPIAYFSKPFSQKMLRASTYVRELFAITAAVKKWRQYLLGHPFTILTDHRSLKELMTQVVQTPEQHTYLARLLGYDYQIQYRSGSHNQAADALSRLPENAFQALLILFVPCLTFLEELHAQLGANHSFQNMLQEVQHHPDTHPDFSIANKLLLYKGRIWLPSDLPIIQTLLTEYHATPTGGHAGVAKTVARLTTNFFWNGLKDDVTRFVANCVDCQITKYETKKTAGLLCPLPVPSQPWSDLSLDFICGLPPYRGNTTILVVVDRFSKGIHLGMLPQSHSALAVARLFLDLVVKIHGLPRSIVSDRDPLFVSHLWQELFKLSGTQLRLSSAYHPQSDGQTEVLNRVVEQYLRAFVHRKPASWGRLLPWVEWSHNTSWMANTGTTPYEITFGRKPFNFPDYIAGTSRVEAVEEILTDRDATFQLIRKKLLKAQSKMKHYVDQHRRDVQFAVGDWVLVRLRPYRQYSAKEPHRTGEKLARRYYGPFKVAAKLGPVAYRLELPEGVRLHPVFHCSKLKPFRGDPELSSPPSLPPTFHGTQPLISPLAILAYRRATTDPHSPWQVLVQWQGLSPEETSWEDWQQLCQDYHLEDKVILQGPRDDTGAGNIESDKEGAEEEEQKRREEEREVQEEGRPKRKILKPKYLKDYV

SEQ ID NO: 170210 - protein, 343 aa, Glycine max
  Coding DNA Sequence Number=SeqID_53432
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=100%, E-value=1e-164, Identity=79%"; Hit description =Cysteine protease 8
  Pfam annotation: Domain name=Inhibitor_I29; Domain location=39-96; Score=103.3; E_value=7e-28; Accession=PF08246.2; Description =Cathepsin propeptide inhibitor domain (
  Pfam annotation: Domain name=Peptidase_C1; Domain location=125-342; Score=474.7; E_value=1.2e-139; Accession=PF00112.13; Description =Papain family cysteine protease
  Pfam module annotation: Pfam domain module=Inhibitor_I29::Peptidase _C1; Domain location=39-96::125-342
MVAKKHFNHISLAMLLCMTFLAFQVTCRTLQDASMYERHEQWMTRYGKVYKDPQEREKRFRVFKENVNYIEAFNNAANKSYKLGINQFADLTNKEFIAPRNGFKGHMCSSIIRTTTFKFENVTATPSTVDWRQKGAVTPIKDQGQCGCCWAFSAVAATEGIHALSAGKLISLSEQELVDCDTKGVDQGCEGGLMDDAFKFIIQNHGLNTEANYPYKGVDGKCNANEAAKNAATITGYEDVPANNEMALQKAVANQPVSVAIDASGSDFQFYKSGVFTGSCGTELDHGVTAVGYGVSDDGTEYWLVKNSWGTEWGEEGYIRMQRGVDSEEGLCGIAMQASYPTA

SEQ ID NO: 170211 - protein, 110 aa, Glycine max
  Coding DNA Sequence Number=SeqID_53433
  Gene Ontology: Mol. function=isomerase activity
  Homolog annotation: Hit_ID=Q5VPB9; Match level="QueryCoverage=38%, HitCoverage=13%, E-value=4e-09, Identity=50%"; Hit description =Putative ketol-acid reductoisomerase
  Subcellular localization annotation: CTP_CleavageSite=57; ConfidenceScore=5.89e-01
MSSTASSTASICATSRTTFSSKHVARSCFVAVPNRAFSKLNFRFKPVAMATLGARMVAAAPSVTPPASLDFESSVFKKEKINLSGHDEGPAQAQNLRDSLADAKSDIVVK

SEQ ID NO: 170212 - protein, 373 aa, Glycine max
  Coding DNA Sequence Number=SeqID_53434
  Gene Ontology: Mol. function=methyltransferase activity; Biological process=metabolic process
  Homolog annotation: Hit_ID=Q1SVR1; Match level="QueryCoverage=99%, HitCoverage=99%, E-value=1e-155, Identity=73%"; Hit description=SAM (And some other nucleotide) binding motif
  Pfam annotation: Domain name=Methyltransf_11; Domain location=206 -308; Score=98.7; E_value=1.7e-26; Accession=PF08241.2; Description =Methyltransferase domain
  Pfam annotation: Domain name=Methyltransf_12; Domain location=206 -306; Score=77.5; E_value=4.1e-20; Accession=PF08242.2; Description =Methyltransferase domain
  Pfam annotation: Domain name=Ubie_methyltran; Domain location=174 -369; Score=-124.4; E_value=0.0021; Accession=PF01209.9; Description =ubiECOQ5 methyltransferase family
  Pfam module annotation: Pfam domain module=Methyltransf _11::Methyltransf_12::Ubie_methyltran; Domain location=206-308::206 -306::174-369
  Subcellular localization annotation: CTP_CleavageSite=44; ConfidenceScore=5.51e-01
MALSSPLQNLSALISAKGNATAVATPRPPRGRPWAVHAAASDTTASASVQMGEYEEGKLERPKWVGETPLSRLVQALISFKPFYSVLKLGARRALISTAEKNNIPWRQMAKEILESEVYRELDNIQNQSLVYPDYYLNPFHAYDEGNLTWLAAAEAEAATLSIAKRAIPDASSTQEANQILRGNWLRAIEQHHMQYSESSVINDILDIGCSVGISTRYLADKFPTAKVTGLDLSPYFLAVAQHKEKNAPPRKFPIRWIHANGEDTGLPSKSFNLVSIAFVVHECPARAIVNLVREAFRLLRPGGTLALVDSTTKSKVLQELSPVLFTLLKSTEPFLDEYYLTDMDETLREAGFGNITSILTDPRHVTITATVP

SEQ ID NO: 170213 - protein, 108 aa, Glycine max
  Coding DNA Sequence Number=SeqID_53435
  Gene Ontology: Mol. function=methyltransferase activity; Biological process=metabolic process
  Homolog annotation: Hit_ID=Q1SVR1; Match level="QueryCoverage=88%, HitCoverage=24%, E-value=4e-17, Identity=53%"; Hit description=SAM (And some other nucleotide) binding motif
  Subcellular localization annotation: CTP_CleavageSite=43; ConfidenceScore=5.13e-01
MALLWPIQNLSAVISTSGNATTATSWPPRGRHWAVHAAASDAAAAAASVQMGEYEEGKLERPKWVGETPLSRLVQALISFKPLFSVLKLGSRRALIRFLPFLTLLIHW

SEQ ID NO: 170214 - protein, 222 aa, Glycine max
  Coding DNA Sequence Number=SeqID_53436
  Gene Ontology: Mol. function=methyltransferase activity; Biological process=metabolic process
  Homolog annotation: Hit_ID=Q1SVR1; Match level="QueryCoverage=92%, HitCoverage=55%, E-value=4e-86, Identity=75%"; Hit description=SAM (And some other nucleotide) binding motif
  Pfam annotation: Domain name=Methyltransf_11; Domain location=55-157; Score=83.6; E_value=6.2e-22; Accession=PF08241.2; Description =Methyltransferase domain
  Pfam annotation: Domain name=Methyltransf_12; Domain location=55-155; Score=73.5; E_value=6.9e-19; Accession=PF08242.2; Description =Methyltransferase domain
  Pfam annotation: Domain name=Ubie_methyltran; Domain location=14-217; Score=-112.7; E_value=0.00034; Accession=PF01209.9; Description =ubiECOQ5 methyltransferase family
  Pfam module annotation: Pfam domain module=Methyltransf _11::Methyltransf_12::Ubie_methyltran; Domain location=55-157::55 -155::14-217
VAAEAEAATMSMARRALPDASSIQEANQILHGNWLRAIEQHHIEHSESSVINDILDIGCSVGISTRYLVDKFHTAKVTGLDLSPYFLAVAQHKEKRTSPGKFPKRWIHANGEDTGLPSKSFDLVSIAFVLHECPTRVIVTLVREAFRLLWPGGTLDLTDFLVYKVLQELSPVLFTLVKSTEAFLDEYYLTDMDETLREAGFVNITSILTDPRHVTITATVPQ

SEQ ID NO: 170215 - protein, 214 aa, Glycine max
  Coding DNA Sequence Number=SeqID_53437
  Gene Ontology: Mol. function=methyltransferase activity; Biological process=metabolic process
  Homolog annotation: Hit_ID=Q1SVR1; Match level="QueryCoverage=99%, HitCoverage=57%, E-value=1e-93, Identity=76%"; Hit description=SAM (And some other nucleotide) binding motif
  Pfam annotation: Domain name=Methyltransf_11; Domain location=46-148; Score=95.8; E_value=1.3e-25; Accession=PF08241.2; Description =Methyltransferase domain
  Pfam annotation: Domain name=Methyltransf_12; Domain location=46-146; Score=76.2; E_value=1e-19; Accession=PF08242.2; Description =Methyltransferase domain
  Pfam annotation: Domain name=Ubie_methyltran; Domain location=15-212; Score=-118.5; E_value=0.00085; Accession=PF01209.9; Description =ubiECOQ5 methyltransferase family
  Pfam module annotation: Pfam domain module=Methyltransf _11::Methyltransf_12::Ubie_methyltran; Domain location=46-148::46 -146::15-212
MSIARRAVPDASSTQEAIKILRGNWLRAIEQHHIQYSESFVINDILDIGCSIGISTRYLADKYPTAKVTGLDLSPYFLAVAQHKEKSAPPRKFPIRWIHANGEDTGLPSKSFNLVSIAFVFHECPTRVIVNIVREAFRLLRPGGTLALIDSSMKSKVVQELSPVLFTLYKCTEPFIDEFYLTDMDETLREAGFVNITSILTSPRHATITATAPQ

SEQ ID NO: 170216 - protein, 420 aa, Glycine max
  Coding DNA Sequence Number=SeqID_53438
  Gene Ontology: Mol. function=ATP binding; Cellular component =chloroplast; Biological process=response to heat
  Homolog annotation: Hit_ID=Q1SL65; Match level="QueryCoverage=99%, HitCoverage=73%, E-value=1e-164, Identity=68%"; Hit description=Heat shock protein Hsp70; Actin/actin-like
  Pfam annotation: Domain name=HSP70; Domain location=1-420; Score =491.1; E_value=1.3e-144; Accession=PF00012.10; Description=Hsp70 protein
RQATKDAGKIAGLNVLRIINEPTAAAIAYGLNKKGWREGMFKVKATVGDTHLGGVDFDNKMVDYLVSIFKRRYKKDIGENPKALGRLRSACEKAKRILSSSSQTTIELDSLCGGVDLHANFSRALFEELNKDLFMKCMETVEKCLKEARIAKSQVHEFVLVGGSTRIPKVQQLLKDMFSVNGNKELCKSINPDEAVAYGAAVQAAILSGEGDKKVEDLLLLDVMPLSLGIETDGGEMSVLIPKNTMIPTKRESVFSTFSDNQTSVLIKVFEGERAKTEDNFLLGKFELSGFTPSPRGVPQINVGFDVDVDGIVEVTARDRSTGLKKKITISNKHGRLSPEEMRRMVRDAVRYKAEDEEVRNKVRIKNLLENYAFEMRDRVKNLEKVVEETIEWLDRNQLAETDEFEYKRQELEEKVLKFM

SEQ ID NO: 170217 - protein, 252 aa, Glycine max
  Coding DNA Sequence Number=SeqID_53439
MQTVGESVKKLYSEIVGDLLPPGEKVSIELPIDKCADAGLYKKPFHVYKERHVKADTKQTTEDSRIVLGVDNVARLASSTLSLRNSVKESNFSSPSRQYVRRMDVISNLGIDENPVNKKMAVTNIINETTLAETVACRTSQSCEISNENENQNHGVTVSKPASAKVARLASDTDCSNEIEDASTKQFPNVPQLVKAAEEKPVDKSSSSCVPFGEPVELRSTNWFQAHGPIFGGNLNIEKVYHGAVCFLANIA

SEQ ID NO: 170218 - protein, 129 aa, Glycine max
  Coding DNA Sequence Number=SeqID_53440
MDEGLTGDLIPIVLEINATCRRRNAEKNRKFLQDLEAAATPEEKARSSEVSSRFPIPGKSHIDLIEEVIMAEEPRRVTLEDYCQVCCNFSPALHNQREAKRWLHSFKGNSLKTWDKVVEKFLKKYLHGV

SEQ ID NO: 170219 - protein, 313 aa, Glycine max
  Coding DNA Sequence Number=SeqID_53441
  Gene Ontology: Mol. function=potassium ion transporter activity; Cellular component=integral to membrane; Biological process =potassium ion transport
  Homolog annotation: Hit_ID=Q8W4I4; Match level="QueryCoverage=99%, HitCoverage=40%, E-value=1e-107, Identity=61%"; Hit description =Potassium transporter 6
  Pfam annotation: Domain name=K_trans; Domain location=1-313; Score= -121.3; E_value=1.2e-16; Accession=PF02705.7; Description=K+ potassium transporter
LAVITVMLVTTCLMSLVIVLCWHQNVLLALGFVFIFGYIEVLFFSASLIKFLQGAWVPIALALVFLTCMCAWHYGTLKKYEYDVQNKVSTNWLLSLCPGLGIVRVRGVGLIHTELVSGIPVIFSHFVTNLPAFHQVLVFLCIKHVPVPHVTPEERFLVGRVGPKEFRLYRCIVRYGYRDVHRDDVEFENDLLCCIAEFIRTERTGSNSSNDEPVKDDRMAVVGTCSTHSLLMTENKVDNVENVDLPGPSELKEIKSPNVIQQQKKRVRFLVPESPKIDTSVMEELEEVMEAWEAGVAYIIGQTHMRAKSGSSM

SEQ ID NO: 170220 - protein, 87 aa, Glycine max
  Coding DNA Sequence Number=SeqID_53442
MDPPLPVVKRVSPLEESKELDSLWKRRSGMGRPALKSLQLQQIQDPRICFQPSTFPSVACLLDFLGASHMAAMQSMGHACVNTSVNW

SEQ ID NO: 170221 - protein, 76 aa, Glycine max
  Coding DNA Sequence Number=SeqID_53443
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=84%, HitCoverage=4%, E-value=8e-18, Identity=60%"; Hit description=Chromo
MYIGVEGVTLVILVNKKDETWRMCVDFYALNKVIILDKYPIPTISELLDELHGSQIFTKIDLKSGIHQIWMRKKDI

SEQ ID NO: 170222 - protein, 77 aa, Glycine max
  Coding DNA Sequence Number=SeqID_53444
MTIDHKCLELKVTNGGMFSAVLAHDEIRDVHFDSDRFIFKYINDIKFQIKSKQIHLTQPTPCNFKKVSHPPPKTKKP

SEQ ID NO: 170223 - protein, 300 aa, Glycine max
  Coding DNA Sequence Number=SeqID_53445
  Homolog annotation: Hit_ID=Q2R3Q7; Match level="QueryCoverage=47%, HitCoverage=25%, E-value=3e-50, Identity=62%"; Hit description =Expressed protein
  Pfam annotation: Domain name=SRP19; Domain location=199-278; Score =34.4; E_value=3e-07; Accession=PF01922.8; Description=SRP19 protein
MFKGLRITDSRRRDWGTAPRWVAFVDFFLASRAKYAAISGAHHRVGTTYAQLIAALAAAYNLGDKSSSRFTFLSSFQSNLLIDGLKNQGGWGHVWNRYAGPLSCRNQGNQCAFTPVLPSAWWDGLWQSPIPRDINRLASYGIKLSALGTMEHGWVDWADQYRRPSSSSFLLLSVSVCAIVELKIQFGIFALRPQFAARRRIGLAKACENPTCAEIGDCCSYLKLPFAIEIDKAYPRDFMQRGRVRVLLKKEDGTLFNSTISSRKQLMVKVAEMVPRHHGRTKKQETSSTSTAGPSTKSGK

SEQ ID NO: 170224 - protein, 86 aa, Glycine max
  Coding DNA Sequence Number=SeqID_53446
MGFFLGGLKEELKWQPWNQSVDFQRWETRKEVKDKISSNVRGQFKGTSNLSYQELMERQSKRRNNNPTPILGQASQAPYFGREMEI

SEQ ID NO: 170225 - protein, 84 aa, Glycine max
  Coding DNA Sequence Number=SeqID_53447
MEKNLAENSGKAEDMNTGDNTTNSPAAPEPEDNKLDAKTDGEGEKAADSDHAEGDQDPKEEEKRKKRRETAEAPPDSPPPNLGE

SEQ ID NO: 170226 - protein, 337 aa, Glycine max
  Coding DNA Sequence Number=SeqID_53448
  Gene Ontology: Mol. function=transmembrane receptor activity; Cellular component=exocyst; Biological process=exocytosis
  Homolog annotation: Hit_ID=Q9FFX6; Match level="QueryCoverage=97%, HitCoverage=45%, E-value=1e-126, Identity=67%"; Hit description =Putative leucine zipper protein
  Pfam annotation: Domain name=Exo70; Domain location=1-330; Score= -37.6; E_value=1.2e-09; Accession=PF03081.6; Description=Exo70 exocyst complex subunit
MIQLLNFAESVAMTKRASEKLFKFLDMYETLRDVIPDMESLFPADDGEIKAETTSAKCRLGEAAVLIFCDLENSIKSETGKTPVAGGAVHPLTRYIMNYLRLACEYKDTLEEVFKEHSKMERADSTSRPQYEDTKPNNNNKQKENVSPFAAQLMRVMELLDTNLEGKAKLYKEVPLSCIFMMNNGRYIVQKIKGSTEIYEVMGETWCRKRSTELRTYHKNYQVETWSKILSSLSPKGLNENGKVHKPVLKERFKSFNAAFEEIHKTQSAWVVYDEQLQSELRVSISALVIPAYRSFLGRFSQYLDPGRQTVKYIKYQAEDVETCIDELFDGNPHGRR

SEQ ID NO: 170227 - protein, 659 aa, Glycine max
  Coding DNA Sequence Number=SeqID_53449
  Gene Ontology: Mol. function=protein binding; Cellular component =nucleus; Biological process=response to molecule of bacterial origin
  Homolog annotation: Hit_ID=Q0Z845; Match level="QueryCoverage=86%, HitCoverage=99%, E-value=0.0, Identity=73%"; Hit description=Auxin -responsive factor TIR1-like protein
MNFFPDEVIEHIFDYVTSQRDRNDLSLVCKNWHRLERCSRKSLFIGNCYSISPERVIERFPELKSLTLKGKPHFADFNLVPHGWGGFVSPWIEAMVKSRVDLEELRLKRMVVTDKSLELLSRSFMNFKSLVLVSCEGFTTDGLAAIAANCRFLKELDLQENEVDDHRGQWLSCFPDCCTSLVSLNFACLKGQINLGALERLVARSPNLKSLRLNHTVPLNALQRILRRAPQIVDLGIGSFIPDPNSNVFIKLMNTIIECKSITSLSGFFEVTPRCLPAIYPVCMNLTAMNLSYAAGIQSRELIKLICRCGKLQRLWIMDCIGDFGLHVVASTCKDLQELRVFPSVRVGRNDPAGVTEKGLVAISMGCPKLHSLLYFCQQMTNAALITVAKNCPNFIRFRLCILDPTKPDPDTVQPLDEGFGAIVQSCKQLRRLSLSGQLTDQVFLYIGVYAEQLEMLSIAFAGESDKAMLYVLNGCKKLRKLEIRDSPFGDSALLMDVGKYETMRSLWMSSCDVTIGACKALAKKMPGLNVEIFNGNEKVDRDVDDGQKVEKTYLYRTLVGRRKDAPEHAPHGGDGDPRAGSGSAAAEAAVDARYRSNPDRSRTADAAAAAAEGTHRIREAAAAAEGTLHEAVRMGNPVGVEGWDSCDILWKLLIGLVF

SEQ ID NO: 170228 - protein, 97 aa, Glycine max
  Coding DNA Sequence Number=SeqID_53450
MYGKWIADGYGSPYPPPQPGYPSAPPHEGYPPPPPPPHGYGGYPPPQPPQRPPYDSYQGYFDNGHPPPPPPPHYHYQHVDHHHHHEEPGCFSFLRGW

SEQ ID NO: 170229 - protein, 79 aa, Glycine max
  Coding DNA Sequence Number=SeqID_53451
  Gene Ontology: Mol. function=DNA-directed DNA polymerase activity; Cellular component=intracellular; Biological process=DNA replication
  Homolog annotation: Hit_ID=Q9FNY4; Match level="QueryCoverage=81%, HitCoverage=12%, E-value=4e-15, Identity=63%"; Hit description=DNA polymerase lambda
MMGLVIELWFFFFRVLGHRLRLQAESKGFRLDDTGLFPATQGSGGKRGAKGSASLKFNTEKEIFDFLDFPCLEPHERNL

SEQ ID NO: 170230 - protein, 375 aa, Glycine max
  Coding DNA Sequence Number=SeqID_53452
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q2HUJ7; Match level="QueryCoverage=99%, HitCoverage=100%, E-value=0.0, Identity=84%"; Hit description=V -ATPase subunit C
  Pfam annotation: Domain name=V-ATPase_C; Domain location=2-374; Score= 839.7; E_value=1.5e-249; Accession=PF03223.5; Description=V-ATPase subunit C
MATRYWVVSLPVQNSASTLWNKLQEQISKHSFDTPLYRFNIPNLRVGTLDSLLSLSDDTVKSNSFVEGVSHKIRRQIEELERVSGVVSSGLTVDGVPVDSYLTRFVWDEARYPTMSPLKEIIDGIHGQVAKIEDDLKVRVSEYNNIRSQLNAINRKQTGSLAVRDLSNLVKPEDIITSENLTTLLAIVPKYSQKDWLSSYETLTNYVVPRSSKKLYEDNEYVLYTVTLFSRVADNFRTSAREKGFQIRDFEYSHESYDSRKQELEKLVEDQESLRSSLLQWCYASYGEVFSSWMHFCAVRVFTESILRYGLPPSFLACVLAPSVKAEKKVRSILEGLSGSSNSAYWKTEDEGVGMAGLAGDADAHPYVSFTINLV

SEQ ID NO: 170231 - protein, 327 aa, Glycine max
  Coding DNA Sequence Number=SeqID_53453
  Gene Ontology: Mol. function=nucleoside-triphosphatase activity; Cellular component=membrane; Biological process=defense response
  Homolog annotation: Hit_ID=Q1STU9; Match level="QueryCoverage=90%, HitCoverage=25%, E-value=3e-56, Identity=42%"; Hit description=H+ -transporting two-sector ATPase, alpha/beta subunit, central region; Disease resistance protein
  Pfam annotation: Domain name=NB-ARC; Domain location=147-327; Score= -97.0; E_value=0.00042; Accession=PF00931.13; Description=NB-ARC domain
MDAIAHVPDVSEIAHLPGVSQIATVITFIKDQIGYISSYEENLEKLMTEVQRLKDTQDGVQHRVVEAERNGEKIENIVQNWLKKANEIVAAANKVIDVEGTRWCLGQYCPYLWTRCQLSKSFEKMTKEISDVIKKAKFETISYRDTPDVTITPSSRGYVALESRTSMLNEIKEILKDPKMYMIGVHGMGGVGKTTLVNELAWQVKKDGLFGAVAIAAITNSPDVKKIQGQIADALDLKLEKESERGRAINLRQRIKKQEKVLIILDDIWSELNLPEVGIPFGDEHNGCKLVITSREREVLTYMETQKDFNLTALLEEDSWNLFQKIA

SEQ ID NO: 170232 - protein, 71 aa, Glycine max
  Coding DNA Sequence Number=SeqID_53454
MSVLKKEHANELNKWARRFEGLEALLTCFMKQSNPNLDDEALDDMLRNVVANENSNVAMLSSTSTNIYNNY

SEQ ID NO: 170233 - protein, 69 aa, Glycine max
  Coding DNA Sequence Number=SeqID_53455
AEEVDLVEELGAAGLEGGKEVGVSVGLDQGVAVECEEGEERRQDSAMWRKWQGQCGGGGSCGGSDDGGG

SEQ ID NO: 170234 - protein, 696 aa, Glycine max
  Coding DNA Sequence Number=SeqID_53456
  Gene Ontology: Mol. function=nucleoside-triphosphatase activity; Cellular component=membrane; Biological process=defense response
  Homolog annotation: Hit_ID=Q1SI90; Match level="QueryCoverage=99%, HitCoverage=75%, E-value=4e-69, Identity=27%"; Hit description =Disease resistance protein; AAA ATPase
  Pfam annotation: Domain name=LRR_1; Domain location=107-127; Score =8.3; E_value=8; Accession=PF00560.23; Description=Leucine Rich Repeat
  Pfam annotation: Domain name=LRR_1; Domain location=129-150; Score =14.8; E_value=0.32; Accession=PF00560.23; Description=Leucine Rich Repeat
  Pfam annotation: Domain name=LRR_1; Domain location=152-175; Score =10.9; E_value=2.6; Accession=PF00560.23; Description=Leucine Rich Repeat
  Pfam annotation: Domain name=LRR_1; Domain location=177-194; Score =1.2; E_value=1.7e+02; Accession=PF00560.23; Description=Leucine Rich Repeat
  Pfam annotation: Domain name=LRR_1; Domain location=317-341; Score =2.2; E_value=1.1e+02; Accession=PF00560.23; Description=Leucine Rich Repeat
  Pfam annotation: Domain name=LRR_1; Domain location=374-397; Score =3.9; E_value=53; Accession=PF00560.23; Description=Leucine Rich Repeat
  Pfam annotation: Domain name=LRR_1; Domain location=478-500; Score =6.5; E_value=17; Accession=PF00560.23; Description=Leucine Rich Repeat
  Pfam annotation: Domain name=LRR_1; Domain location=505-529; Score =3.6; E_value=60; Accession=PF00560.23; Description=Leucine Rich Repeat
  Pfam annotation: Domain name=LRR_1; Domain location=623-645; Score =1.5; E_value=1.5e+02; Accession=PF00560.23; Description=Leucine Rich Repeat
  Pfam annotation: Domain name=LRR_1; Domain location=649-672; Score =0.7; E_value=2.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=107 -127::129-150::152-175::177-194::317-341::374-397::478-500::505 -529::623-645::649-672
MEARDTHYTFINELRDSSLLLEGELDWVGMHDVVRDVAKSIASKSRPTDPTYSTYADQFRKCHYIISEYLTKVPDDNFFFGMGEVMTLSVYEMSFTPFLPSLNPLISLRSLNLNSCILGDIRIVAELSNLEILSLGGSSITELPGEIKHLTRLRLLNLTYCDSLRVIPTNLISSLMRLEELYMGGCYNIEWEVEGKKSESNNANVRELQNLHNLTTLEISFINTWVLPRNFRFPANLKRYNILIANHMLAYNILIGSDRGKWELSSIWYGGALERTLKLTDYWQTSRSLFTTVEDLSLAKLKGVKDLYDLDVDGFPQLKHLYIHGNGELLHLINPRRLVNPHSAFLNLETLVLYNLYKMEEICHGPMQTQSFAKLKVIEVTSCHRLKNLFLYSLSGNLSQLHEMKISSCEGMTEIIAVEKQEDQKKLLQIVLPELHSVTLRGLLELQSFYCSVTVDQGNPSSQSIPLALFNQKVVTPKLETLELYDMNVCKIWDDKLLVLSCFQNLTRLIVVKCNCLTSLFPSGVARVLVKLQHVEISSCERLKVIFAQEEKIEAVSPTCDMTHVYLEVLAVRECQNMKTIIPSFVLFQCLDELIMPSCDGQEICGSSNEGDGPVLDEIAFMKLEELTLKYLPRLTSFCQGSYSFKFPSLQKVHLKECPMMETFCHGNLTTTSHIEVRCLYDESEDHWDGDLKYYC

SEQ ID NO: 170235 - protein, 36 aa, Glycine max
  Coding DNA Sequence Number=SeqID_53457
MNYPISVVSNSKAWYMALGNPRIHEVHSRLQFVTAD

SEQ ID NO: 170236 - protein, 257 aa, Glycine max
  Coding DNA Sequence Number=SeqID_53458
  Homolog annotation: Hit_ID=Q9FI62; Match level="QueryCoverage=38%, HitCoverage=5%, E-value=7e-14, Identity=43%"; Hit description =Nuclear pore protein-like
MALGAELDGPIKYEVHGKVAAMRCIDGHVLGLYEPGEDLLRESGIPYAIVRPCALTEEPAGANLILDQGDNITKYQEKVASKSKKKSNNLACIQAKDRTTGRTEIASCVKVVEIRVGAHIYPQNPVLHIGSPFNLSIKGLSDTVSGQWFTTNGSVISVDTLSGMAKAIGEGCAQDPVEADSCKEHLVPLADMVNTCYKAAGNHVLPNLAVKRHVQMGSHQQEPWLLQNGKPRVLTKETRHGRSAHRMSSTSLRKKSS

SEQ ID NO: 170237 - protein, 104 aa, Glycine max
  Coding DNA Sequence Number=SeqID_53459
MDFICLGASAIGKCLVTYSPTRTTLKSLKRKGWRILKPVCNTVLMRLKGIMEKKIEDVVLNWQKEVNVCNANARKLIDCEVGYIVWDKVPIHGQENNLVGDLKK

SEQ ID NO: 170238 - protein, 233 aa, Glycine max
  Coding DNA Sequence Number=SeqID_53460
MASPPQLDLLIEMLGDSKEPKLSDGMISDVILPRKGPVTRAMSKRLQEDWARAVEEGPRILMSLRLPFYASYPGHSLGGEASSSMAYFLDLIEAQRSSLHRSFSSKLPSISPLLELEDFELDRLLLDDAHIPTATVGILPMEFASHDRLTTTLKGDVLANEEEWTSLAEDLDAEKGIAKLCKPQADQARHLKLLYIKAMINGRPINQAFVDNDTFHNVMSYSTIKKPRHTSLR

SEQ ID NO: 170239 - protein, 124 aa, Glycine max
  Coding DNA Sequence Number=SeqID_53461
  Gene Ontology: Mol. function=RNA-directed DNA polymerase activity; Biological process=RNA-dependent DNA replication
MVGKQHSTLMENPIPTWTKARTNSPQTIQLPDGLRIPPPKELRNKRYCKWPNAYSHSTTNYLVFRNTTQRARKEGQLGLVKKGNGIQVDVNPLPLAEISMVSTSRCLLEGDTTQNKGDCLVKGK

SEQ ID NO: 170240 - protein, 38 aa, Glycine max
  Coding DNA Sequence Number=SeqID_53462
MDKDAEELAKVEAKLVGLSLLFDFLLIKIGRLAMELKK

SEQ ID NO: 170241 - protein, 79 aa, Glycine max
  Coding DNA Sequence Number=SeqID_53463
MAHIDPSIGPNISMCVQRIDKGVALAPMYPQAKGHFGPVAARPGKLKLSAEAMSSPRRAGIFIMKLFGGQASQRLAWAS

SEQ ID NO: 170242 - protein, 121 aa, Glycine max
  Coding DNA Sequence Number=SeqID_53464
MIQTSVKRVLLEKERSNKAQGPRSNKVCINKVRLSGTPPSDKSHSRTWRTNSNKKPFDQRKKCSTIIWQEHKKCLATVGPSKIVPDAKCYGSNTNKNGYDKTYPARTTTSSSRRSTSKRSY

SEQ ID NO: 170243 - protein, 77 aa, Glycine max
  Coding DNA Sequence Number=SeqID_53465
MGYDWLNGPQRNKHGVYRHKCLSSYVRESILMGTISQTILIVGGEKLRSPSVANHIVEEAQLLKKSRKIANVIVKNK

SEQ ID NO: 170244 - protein, 167 aa, Glycine max
  Coding DNA Sequence Number=SeqID_53466
NWTLQKPVQDLRIKRRCSGLHHVCTIVVAKELQQLQVLEIGRFENIETIVGKSDSGDAQDETASTKLEEQKARSENKGDTLGGFASMNLEELIPRNGNKGDAPGEIVFTKLEALFLISLPSLTSFCKASYNFKYPALDVVMVSNVMWRRQVGAAGTGSSCSIALVGQ

SEQ ID NO: 170245 - protein, 185 aa, Glycine max
  Coding DNA Sequence Number=SeqID_53467
MAYANHLGEVVSMKQASSMEVSTRDLLLELLLTRKESSDADLAHVDGGFSHTVVDLVVMVVLVVSGTISIESCLLLGLSSEVEGSKGLMWEIRMLRNSSSKWATAIWMAELTLLEEAETETEERECSTTLSLSLFIVVEDLDDIGKRRKEEGQQEEDSEPEERNEHTHFKVKIIHIQRQFLRNHL

SEQ ID NO: 170246 - protein, 228 aa, Glycine max
  Coding DNA Sequence Number=SeqID_53468
  Gene Ontology: Mol. function=nucleoside-triphosphatase activity; Biological process=defense response
  Homolog annotation: Hit_ID=Q1STU9; Match level="QueryCoverage=88%, HitCoverage=17%, E-value=2e-20, Identity=34%"; Hit description=H+ -transporting two-sector ATPase, alpha/beta subunit, central region; Disease resistance protein
  Pfam annotation: Domain name=LRR_1; Domain location=196-221; Score =0.8; E_value=2e+02; Accession=PF00560.23; Description=Leucine Rich Repeat
  Pfam annotation: Domain name=LRR_1; Domain location=27-47; Score=6.4; E_value=18; Accession=PF00560.23; Description=Leucine Rich Repeat
  Pfam annotation: Domain name=LRR_1; Domain location=3-25; Score=7.5; E_value=11; Accession=PF00560.23; Description=Leucine Rich Repeat
  Pfam annotation: Domain name=LRR_1; Domain location=49-70; Score =12.3; E_value=1.4; Accession=PF00560.23; Description=Leucine Rich Repeat
  Pfam annotation: Domain name=LRR_1; Domain location=72-95; Score =12.2; E_value=1.5; Accession=PF00560.23; Description=Leucine Rich Repeat
  Pfam annotation: Domain name=LRR_1; Domain location=97-127; Score =3.8; E_value=55; Accession=PF00560.23; Description=Leucine Rich Repeat
  Pfam module annotation: Pfam domain module=LRR_1::LRR_1::LRR_1::LRR _1::LRR_1::LRR_1; Domain location=196-221::27-47::3-25::49-70::72 -95::97-127
MREVKVLDLHGMRLAPSPPPSLRLLTKLISLNLYGCVLKDIAMVAELTRLEILNLEGSEIQELPKEIGQLVYLRLLNLTNCLQLEIIPANVLSSLTNLEELYIGNCNIQWEVGGGKDRASLGELNHLNQLTTLDISIQHASVLPVDMNVLANLQRYNIFIGQMWNGDARETSRTLKLIDSYTNIWSNRGLQLLFPTLEYLSLHHLNFDKGEFDHPHILSPVSNQKVNT

SEQ ID NO: 170247 - protein, 182 aa, Glycine max
  Coding DNA Sequence Number=SeqID_53469
  Gene Ontology: Mol. function=nucleoside-triphosphatase activity
  Homolog annotation: Hit_ID=Q1RST0; Match level="QueryCoverage=26%, HitCoverage=3%, E-value=1e-18, Identity=89%"; Hit description =Peptidase S1 and S6, chymotrypsin/Hap; Immunoglobulin/major histocompatibility complex; ...
  Homolog annotation: Hit description=AAA ATPase, central region
DDATVQVPVPKVLSPLPPPFDVVPLGPDALDESASMKAFVLCSRGGLSVALLEITGGKASIQVNGKTYRKNSRLILSGGDEETLCKALAKHFGARLLIVDCLSLPGDQAMAPGAKFCLLLKIIGLQKLGLGLINQFHMAMILEAFVRMIVGSFVLFFTGPKDASIPEEVYLTPFSVLCIGYL

SEQ ID NO: 170248 - protein, 42 aa, Glycine max
  Coding DNA Sequence Number=SeqID_53470
MLAKAVATEAGANFINISMSSITSKIDRASMLDEAIEYLKQL

SEQ ID NO: 170249 - protein, 94 aa, Glycine max
  Coding DNA Sequence Number=SeqID_53471
MQQTSLHAEQNPNNNWSVILKDMEMLNCGWTLNTKQRPSWRQTHRARQGQEEQHRTEAEVATEPWGRGPERWRRPCMCRRGSHGALKRRGAQEP

SEQ ID NO: 170250 - protein, 102 aa, Glycine max
  Coding DNA Sequence Number=SeqID_53472
MDVHNAFLHEDLEEVVYMMPPPGFLPQQYGIAPKEAHWEAVLCVIRYLKGNPGQVNGEYLLKVGGFNDSFTCKPETAFNIYVIVKRWGIQEEITVSVIIYKI

SEQ ID NO: 170251 - protein, 221 aa, Glycine max
  Coding DNA Sequence Number=SeqID_53473
  Gene Ontology: Mol. function=protein binding; Cellular component =integral to membrane; Biological process=protein amino acid phosphorylation
  Homolog annotation: Hit_ID=Q1T2W9; Match level="QueryCoverage=97%, HitCoverage=57%, E-value=7e-42, Identity=41%"; Hit description =Leucine-rich repeat; Leucine-rich repeat, cysteine-containing type
  Pfam annotation: Domain name=LRR_1; Domain location=103-122; Score =13.1; E_value=1; Accession=PF00560.23; Description=Leucine Rich Repeat
  Pfam annotation: Domain name=LRR_1; Domain location=129-151; Score =11.7; E_value=1.9; Accession=PF00560.23; Description=Leucine Rich Repeat
  Pfam annotation: Domain name=LRR_1; Domain location=23-45; Score =15.4; E_value=0.21; Accession=PF00560.23; Description=Leucine Rich Repeat
  Pfam annotation: Domain name=LRR_1; Domain location=47-68; Score =15.0; E_value=0.27; Accession=PF00560.23; Description=Leucine Rich Repeat
  Pfam module annotation: Pfam domain module=LRR_1::LRR_1::LRR_1::LRR _1; Domain location=103-122::129-151::23-45::47-68
MEVLEMASCNLKTIPGFLKNCSSLVLLDLSDNQIQGIVPNWIWKLDNLVELNISHNFLTGLEGPFKNLTGEMTLAITCLSHIMSLSNNTLHDNISYSLCNASYLQVLDLSINSISGTIPSCLMMMMNGTLEALNLKNNNLSGPIPNTVPVSCGLWTLSSWKSIRWANSKVSCLLLKVRGIGPWIKSNHRWLSMLLKRNIHASCLDFEEQQISRFPKMFESQ

SEQ ID NO: 170252 - protein, 99 aa, Glycine max
  Coding DNA Sequence Number=SeqID_53474
  Gene Ontology: Mol. function=protein binding
  Homolog annotation: Hit_ID=Q1T2W0; Match level="QueryCoverage=96%, HitCoverage=9%, E-value=7e-25, Identity=64%"; Hit description =Leucine-rich repeat; Leucine-rich repeat, cysteine-containing type
MTNPVNSHSYRRRIFRFLKWENVSATGDDKLLLSRTMTDRFSSLAKEGSRGPERLHLNMLNSCRSCIDICTTPFMSSSGYSYTIQIQFPNIGEIMDKLL

SEQ ID NO: 170253 - protein, 102 aa, Glycine max
  Coding DNA Sequence Number=SeqID_53475
IQSKYGFSNMESAKCTSLAVEWTSNQWGLKHLVILQYSVGMLLPLQILWGKSNRRDTSKLEDQAVKSENKSLLTCDITNYKETQVINKMRKLQIKTYLQPLL

SEQ ID NO: 170254 - protein, 103 aa, Glycine max
  Coding DNA Sequence Number=SeqID_53476
  Homolog annotation: Hit_ID=Q1SYR3; Match level="QueryCoverage=48%, HitCoverage=2%, E-value=1e-10, Identity=66%"; Hit description=RNase H, putative
MAEYEALIRQALKSVVFHLLAKSICLGVGGPPSKAIHAEPYYLVLLSEFDIVYVTLKVIKGSTLADYLAQQPLNDYQPMHPMFPDEDIMALFMEKLEDEDKDK

SEQ ID NO: 170255 - protein, 120 aa, Glycine max
  Coding DNA Sequence Number=SeqID_53477
MVSLPLLATIPTKEWFSSTAERYLRRAFRNWRRICRGVCVCGFVDFISEEGDSVSVFLVHMTSPLTSIQPHHQYLLRIEQFVIAITLGKDEEPSRWKHVDEIEVVGERKLERKMSVKLGF

SEQ ID NO: 170256 - protein, 702 aa, Glycine max
  Coding DNA Sequence Number=SeqID_53478
  Gene Ontology: Mol. function=nucleoside-triphosphatase activity; Cellular component=membrane; Biological process=defense response
  Homolog annotation: Hit_ID=Q1STU9; Match level="QueryCoverage=97%, HitCoverage=67%, E-value=6e-82, Identity=32%"; Hit description=H+ -transporting two-sector ATPase, alpha/beta subunit, central region; Disease resistance protein
  Pfam annotation: Domain name=AAA; Domain location=59-244; Score= -35.1; E_value=0.095; Accession=PF00004.19; Description=ATPase family associated with various cellular activities (AAA)
  Pfam annotation: Domain name=LRR_1; Domain location=377-398; Score =9.7; E_value=4.4; Accession=PF00560.23; Description=Leucine Rich Repeat
  Pfam annotation: Domain name=LRR_1; Domain location=400-423; Score =10.8; E_value=2.7; Accession=PF00560.23; Description=Leucine Rich Repeat
  Pfam annotation: Domain name=LRR_1; Domain location=425-442; Score =1.0; E_value=1.8e+02; Accession=PF00560.23; Description=Leucine Rich Repeat
  Pfam annotation: Domain name=LRR_1; Domain location=551-575; Score =0.1; E_value=2.7e+02; Accession=PF00560.23; Description=Leucine Rich Repeat
  Pfam annotation: Domain name=LRR_1; Domain location=581-604; Score =0.9; E_value=1.9e+02; Accession=PF00560.23; Description=Leucine Rich Repeat
  Pfam annotation: Domain name=LRR_1; Domain location=608-631; Score =2.2; E_value=1.1e+02; Accession=PF00560.23; Description=Leucine Rich Repeat
  Pfam annotation: Domain name=NACHT; Domain location=58-207; Score= -32.6; E_value=0.02; Accession=PF05729.3; Description=NACHT domain
  Pfam annotation: Domain name=NB-ARC; Domain location=22-316; Score =147.0; E_value=5.1e-41; Accession=PF00931.13; Description=NB-ARC domain
  Pfam module annotation: Pfam domain module=AAA::LRR_1::LRR_1::LRR _1::LRR_1::LRR_1::LRR_1::NACHT::NB-ARC; Domain location=59-244::377 -398::400-423::425-442::551-575::581-604::608-631::58-207::22-316
MTKEILDVIKKAKFDNRFSYRDAPDVTITPLERGYETLESRTSMLNEIKEILKDPKMYVIGVHGMGGVGKTTLVNELAWQVKKDGLFGAVAIADITNSQDVKKIQGQIADALDLKLEKESERGRATELRQRIKKEEKVLIILDDIWSELNLTEVGIPFGDEHNGCKLVITSREREVLTKMNTKKYFNLTALLEEDSWNLFQKIAGNVVNEVSIKPIAEEVAKCCAGLPLLIAAVAKGLIQKEVHAWRVALTKLKKFKHKELENIVYPALKLSYDNLDTEELKSLFLFIGSFGLNEMLTEDLFICCWGWGFYGGVDKLMDARDTHYALINELRASSLLLEGELGWVRMHDVVRDVAKSIASESPPTDPTYPTYIELSNLEILSLAKSSFAELPGGIKHLTRLRLLNLTDCSSLRVIPTNLISSLMCLEELYMGGCNNIEWEVEGSKSESDNANVRELQDLHNLTTLEISFIDTSVLPMDFQFPANLERYNILIGSWALSSIWYGGALERTLKLTDYWWTSRSLFTTVEDLSFAKLKGVKDLLYDLDVEGFPQLKHLYIQDTDELLHLINPRRLVNPHSAFLNLETLVLDDLCKMEEICHGPMQTQFFAKLKVIEVTSCDGLKNLFLYSLTGNLSQLHEIEISSCEGMTEIIAVEKQEDQKELLQIDLPELHSVTLRGLPELQSFYCSVTVDQSIPLALFNQQI

SEQ ID NO: 170257 - protein, 194 aa, Glycine max
  Coding DNA Sequence Number=SeqID_53479
  Gene Ontology: Mol. function=transporter activity; Cellular component= integral to membrane; Biological process=oligopeptide transport
  Homolog annotation: Hit_ID=Q7XAK5; Match level="QueryCoverage=89%, HitCoverage=29%, E-value=7e-64, Identity=66%"; Hit description =Nitrate transporter
  Pfam annotation: Domain name=PTR2; Domain location=3-193; Score= -81.1; E_value=0.0063; Accession=PF00854.12; Description=POT family
MCFQGVTILTISTIIPSLHPPKCIRDATRRCMPANNMQLMVLYIALYTTSLGIGGLKSSVSGFGTDQFDESDKGEKKQMLKFFNWFVFFISLGTLTAVTVLVYIQDHIGRYWGYGISVCAMLVALLVLLSGTRRYRYKRLVGSPLAQIAMVFVAAWRKRHLEFPSDSSLLFNLDDVADETLRKNKQMLPHSKQF

SEQ ID NO: 170258 - protein, 68 aa, Glycine max
  Coding DNA Sequence Number=SeqID_53480
  Homolog annotation: Hit_ID=Q7XAK5; Match level="QueryCoverage=67%, HitCoverage=7%, E-value=7e-14, Identity=76%"; Hit description =Nitrate transporter
MSYSGLNSREDGNSEVSVNQRMKVIDKGMVTNLPIKVSATKPPNKQSMKEVPMKLVTVLAELALPKCI

SEQ ID NO: 170259 - protein, 424 aa, Glycine max
  Coding DNA Sequence Number=SeqID_53481
  Gene Ontology: Mol. function=nucleoside-triphosphatase activity; Biological process=defense response
  Homolog annotation: Hit_ID=Q6Y133; Match level="QueryCoverage=88%, HitCoverage=95%, E-value=1e-22, Identity=25%"; Hit description =Resistance protein RGC2
  Pfam annotation: Domain name=LRR_1; Domain location=126-145; Score =5.7; E_value=25; Accession=PF00560.23; Description=Leucine Rich Repeat
  Pfam annotation: Domain name=LRR_1; Domain location=160-182; Score =3.2; E_value=72; Accession=PF00560.23; Description=Leucine Rich Repeat
  Pfam annotation: Domain name=LRR_1; Domain location=186-209; Score =2.8; E_value=85; Accession=PF00560.23; Description=Leucine Rich Repeat
  Pfam annotation: Domain name=LRR_1; Domain location=289-308; Score =3.5; E_value=64; Accession=PF00560.23; Description=Leucine Rich Repeat
  Pfam annotation: Domain name=LRR_1; Domain location=323-345; Score =3.0; E_value=77; Accession=PF00560.23; Description=Leucine Rich Repeat
  Pfam module annotation: Pfam domain module=LRR_1::LRR_1::LRR_1::LRR _1::LRR_1; Domain location=126-145::160-182::186-209::289-308::323-345
MSIKNDRESIRPNQVPPNSFHHKLKIDISGCESMDFVFPISAATELRQHQFLEIRSCGIKNIFEKSDSTSDMTHVYLEKIIVERCTGMKTVIPSCVLFQCLDELIVFSCHTLLNIIRPSTTTSLPKLRILRIRGCNELEEICGSSNEGDGAVLDEIAFMKLEELTLNNLPRLRSFCQGSYDFRFPSLQIVRLENCPMMETFCQGNITTPSLTEVEYGSYDYRHMLSDGPPNSFHCMDSTGMKKITVEKCTGMKTIIPSCALFQCLDELIVFSCHTLVNIIRPSTTSLPKLRILRIWDCNELEEICGSSNEGDAPVLDEIAFMKLEELTLECLPRLTSFCQGSYHFRFPSLQIVRLIKCPMMETFCQGNITTPSLTKVEYESYDFRHTSEDHRRMLSDGRPHMMRQYNWYGDLNTTVRTVFTKKL

SEQ ID NO: 170260 - protein, 274 aa, Glycine max
  Coding DNA Sequence Number=SeqID_53482
  Gene Ontology: Mol. function=transporter activity; Cellular component= integral to membrane; Biological process=oligopeptide transport
  Homolog annotation: Hit_ID=Q7XAK5; Match level="QueryCoverage=98%, HitCoverage=45%, E-value=1e-106, Identity=71%"; Hit description =Nitrate transporter
  Pfam annotation: Domain name=PTR2; Domain location=1-192; Score= -62.1; E_value=0.0013; Accession=PF00854.12; Description=POT family
MERKWYLSTLTDVEEVKMVQRMLPVWATTIMFWTVYAQMTTFSVQQATTMDRRIIGNSFQIPAASLTVFFVGSVLLTVPVYDRVITPIAKKLSHNPQGLTPLQRIGVGLVFSILAMVSAALIEIKRLRMARANGLAHKHNAVVPISVFWLVPQFFFVGSGEAFTYIGQLDFFLRECPKGMKTMSTGLFLSTLSLGFFLSSLLVTLVHKATRHREPWLADNLNHGKLHYFYWLLALLSGVNLVAYLFCAKGYVYKDKRLAEAGIELEETDTASHA

SEQ ID NO: 170261 - protein, 256 aa, Glycine max
  Coding DNA Sequence Number=SeqID_53483
  Gene Ontology: Mol. function=protein binding; Cellular component =intracellular; Biological process=steroid metabolic process
  Homolog annotation: Hit_ID=Q9SU36; Match level="QueryCoverage=85%, HitCoverage=30%, E-value=1e-101, Identity=77%"; Hit description =Putative SWH1 protein
  Pfam annotation: Domain name=Oxysterol_BP; Domain location=1-254; Score=-127.3; E_value=0.013; Accession=PF01237.9; Description =Oxysterol-binding protein
MTFNYLITVFSNIVQVSHHPTVVGCHCEGRGWKFWADSNIRSKFWGRSIQLDPVGVLTLEFDDGEIFQWSKVTTTIYNLILGKIYCDHHGNMDVRGNRQYSCRLKFKEQAILDRNPHQVHGFVEDVTGKKVATLFGKWDDSIYYVNGEVNVKPKDFTMSSVTNLLWKRTMPPSNLTRYNLTSFAITLNELTPGLKEKLPPTDSRLRPDQRHLENGEYEKANMEKQRLEKRQRMVCLNSFVLCSRNVHSILSFYLSL

SEQ ID NO: 170262 - protein, 265 aa, Glycine max
  Coding DNA Sequence Number=SeqID_53484
  Gene Ontology: Mol. function=protein binding; Cellular component =endoplasmic reticulum; Biological process=steroid metabolic process
  Homolog annotation: Hit_ID=Q9SU36; Match level="QueryCoverage=87%, HitCoverage=28%, E-value=3e-80, Identity=66%"; Hit description =Putative SWH1 protein
MALFTDPLSHPKKNHNHEPCMCLVSRCGSFCSPAANIEPEATALHDSEYQLTKNEFSSLGRGKYSECSTTESSDDIEKQEMEEVSDEDEISYYDTKEYFTEHGFRCGSTGGLDPMNMSGEVNTQCIDLENSLVGQTINEFRYPLIARRKKLPDPVEKEKGVSLWSIIKDNVGKDLTRVCLPVYFNEPISSLQKCFEDLEYSFLLDRAYEYGKSGNSLLRALNVAAFAISGYASSEGRHCKPFNPLLGETYEADFPDKGVRFFSEK

SEQ ID NO: 170263 - protein, 142 aa, Glycine max
  Coding DNA Sequence Number=SeqID_53485
  Gene Ontology: Biological process=steroid metabolic process
  Homolog annotation: Hit_ID=Q9SU36; Match level="QueryCoverage=76%, HitCoverage=15%, E-value=5e-28, Identity=59%"; Hit description =Putative SWH1 protein
MKIGESYCIYLEMDDGGRGGGRRFVILTAHGGGCGFSGETVGGDFSDEADVVDRREEVEVFRPADLGVGEDAIAEEEPAGSPSLAVIGPLVENSGHSSLRSPPRNDVRSARRKTPRPRQRRRLRLRRVAPDPRTLQRDAAQR

SEQ ID NO: 170264 - protein, 438 aa, Glycine max
  Coding DNA Sequence Number=SeqID_53486
  Gene Ontology: Mol. function=nucleoside-triphosphatase activity; Biological process=defense response
  Homolog annotation: Hit_ID=Q1SI90; Match level="QueryCoverage=92%, HitCoverage=32%, E-value=3e-34, Identity=26%"; Hit description =Disease resistance protein; AAA ATPase
  Pfam annotation: Domain name=LRR_1; Domain location=232-254; Score =4.1; E_value=50; Accession=PF00560.23; Description=Leucine Rich Repeat
  Pfam annotation: Domain name=LRR_1; Domain location=281-305; Score =0.9; E_value=1.9e+02; Accession=PF00560.23; Description=Leucine Rich Repeat
  Pfam annotation: Domain name=LRR_1; Domain location=307-326; Score =3.9; E_value=52; Accession=PF00560.23; Description=Leucine Rich Repeat
  Pfam annotation: Domain name=LRR_1; Domain location=341-363; Score =4.6; E_value=40; Accession=PF00560.23; Description=Leucine Rich Repeat
  Pfam annotation: Domain name=LRR_1; Domain location=367-390; Score =2.3; E_value=1.1e+02; Accession=PF00560.23; Description=Leucine Rich Repeat
  Pfam annotation: Domain name=LRR_1; Domain location=56-90; Score=4.8; E_value=37; Accession=PF00560.23; Description=Leucine Rich Repeat
  Pfam module annotation: Pfam domain module=LRR_1::LRR_1::LRR_1::LRR _1::LRR_1::LRR_1; Domain location=232-254::281-305::307-326::341 -363::367-390::56-90
MTHVYIEVLAERECQNMKTIIPSFVPFQCLDELIVPSYDGQVNITISPLSTTSLQKLRILRISECDELEEICGSSNEGDPPLGEIAFMKLEELTLKCLPRLRSFCQGSYDFRFPSLQIVRLKECPMMEIFCQRNITTPSLTKVEYRLSGDNWYTSGDHWYGDLNTTVRTVFTKKDQYNPDLGKLAIRDNNDLKSIWPNLVTPNSFPNLTKIVISSCESQYVFPIHVAKVLRQLQVLKISFCTIENIVEESDSTCDMMVVYLQVQKCHDMMTIVPSSVLFHSLDVLHVYWCERLVNIIRPSTTTSLPNLRILRISECDELKEIYGSSNEGDGPVLDDIAFMKLEELTLNNLPRLTSFCQGSYGFRFPSLQKVHLKDCPMMETFCHGNLTTTSHIEVRCLYRWRNEESEDHWDGDLNTIRKFSLERYMSTKLPNFQTSGF

SEQ ID NO: 170265 - protein, 95 aa, Glycine max
  Coding DNA Sequence Number=SeqID_53487
  Subcellular localization annotation: CTP_CleavageSite=36; ConfidenceScore=5.15e-01
MARQESLMKSLSKAKTRGSAVDAGISLKLVPTSQVVAMATMVVPSKECWWWLRVGRRKKMKEFYKLRKRSKWPAAHPPWELKCSRSPTSNGDPES

SEQ ID NO: 170266 - protein, 458 aa, Glycine max
  Coding DNA Sequence Number=SeqID_53488
  Gene Ontology: Mol. function=nucleoside-triphosphatase activity; Biological process=defense response
  Homolog annotation: Hit_ID=Q1SI90; Match level="QueryCoverage=99%, HitCoverage=32%, E-value=9e-57, Identity=31%"; Hit description =Disease resistance protein; AAA ATPase
  Pfam annotation: Domain name=LRR_1; Domain location=222-246; Score =0.0; E_value=2.8e+02; Accession=PF00560.23; Description=Leucine Rich Repeat
  Pfam annotation: Domain name=LRR_1; Domain location=252-275; Score =3.6; E_value=59; Accession=PF00560.23; Description=Leucine Rich Repeat
  Pfam annotation: Domain name=LRR_1; Domain location=26-46; Score=6.8; E_value=15; Accession=PF00560.23; Description=Leucine Rich Repeat
  Pfam annotation: Domain name=LRR_1; Domain location=279-302; Score =2.3; E_value=1e+02; Accession=PF00560.23; Description=Leucine Rich Repeat
  Pfam annotation: Domain name=LRR_1; Domain location=384-406; Score =7.5; E_value=11; Accession=PF00560.23; Description=Leucine Rich Repeat
  Pfam annotation: Domain name=LRR_1; Domain location=411-434; Score =0.2; E_value=2.6e+02; Accession=PF00560.23; Description=Leucine Rich Repeat
  Pfam annotation: Domain name=LRR_1; Domain location=437-458; Score =5.8; E_value=24; Accession=PF00560.23; Description=Leucine Rich Repeat
  Pfam annotation: Domain name=LRR_1; Domain location=48-69; Score =11.3; E_value=2.2; Accession=PF00560.23; Description=Leucine Rich Repeat
  Pfam annotation: Domain name=LRR_1; Domain location=71-94; Score =11.6; E_value=1.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=222-246::252 -275::26-46::279-302::384-406::411-434::437-458::48-69::71-94
MGEVMTLSVYEMPFIPFVPSLNPLISLRSLNLNSCILGYIRIVAELSNLEILSLAGSSIAELPGEIKRLTRLRLLNLTYCNLLRVIPPNLISSLMCLEELYMGGCDSIEWEVEGSKRESNNTNVRELQNLHNLTTLEISFKNTSDLPMDFQFPANLKRYNILIGICQFSSLWYGGALERTLKLTDYSWTSRSLFTTVEDLSFAKLKGVKDLLYDLDVEGFPQLKHLYIQDTDELLHLINPRRLMNPHLAFLNLETLVLDNLHKIEEICQGPMHTQSFAKLKVIKVTSCHRLKNLFLYSLTVNLSQLHEIEISSCEGMSEIIAVEKQEDQKELQQIVLPELHSVTLRRLLELQSFYCFLTVDQGSPSNQSYTLALFNNQQVLIPKLETLELYDMNVCKIWDDKLSVLSCFQNLTRLIVIKCKHLTSLFSSGVARALVKLQHVEISSCERLKIIFVLEEL

SEQ ID NO: 170267 - protein, 359 aa, Glycine max
  Coding DNA Sequence Number=SeqID_53489
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=91%, HitCoverage=16%, E-value=1e-97, Identity=56%"; Hit description =Glucan synthase-like protein
MSEIVPAEPIGGIYFEPGETSTATASASEAPRVTLAITNGSNTVEYVPEPFDSERLPTVFASEIQRFLRVANLLGKEEPRVAYLCRVHAFVIAHNLDKNSSGRGVRQFKTSLLHRLEQDEHVTKKKGTSDIRELKNVYRAYRDYYIRHEKAFDLEQSRRERLINARDIATVLFEVLKTVTDPASSQALIQGNAIHKKTEFNILPLEQGGIQHAITQKSEIKAAVAVIRNVRGLPPAQDFKKHGAFVDLFDFLQHCFGFQEANVANQREHLILLLANMQTRQTHNQTSVLKLGEGGVDELMRKFFKNYTNWCKFLERKSNIRCSSDKRQGVFLFSDLLFYLVSPLLVLQFTFSEAGIPTI

SEQ ID NO: 170268 - protein, 218 aa, Glycine max
  Coding DNA Sequence Number=SeqID_53490
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=96%, HitCoverage=10%, E-value=1e-63, Identity=55%"; Hit description =Glucan synthase-like protein
MAYELHGILCGAISLTTWEKVMPAYGGEPESFLNNVVTRIYTVIKQEVDNSKGGAADYSVWRNYDDLNEYFWSPDCFKIGWPMRLDHEFFFVKSRNKPKPDVKNALVVSPGKTKEKKKREKRDEEEPEDTREEIHEPQWLGKTNFVEIRSFWQIFRCFDRMWSFFILSLQAIIIIACHDLGSPIQLLDAVVFEDIITIFITSAYLKLIQGMVFFYIIN

SEQ ID NO: 170269 - protein, 109 aa, Glycine max
  Coding DNA Sequence Number=SeqID_53491
MKLEELNLRGLSRLRRFCKESYNFKFPVLQTVSVIQYNVYQVNTFCRGNLIRPSLSKVQYSWGDREEDRWDGDLNTTLERIAKEFKSDNIKTSQYGIKKPDSEMSDNEI

SEQ ID NO: 170270 - protein, 109 aa, Glycine max
  Coding DNA Sequence Number=SeqID_53492
MAVHGGNFVFSARTPRYRPPFVTDASLPELVAAVCAGASLPEVVAAVCACGCGCRGWVRVWGAGGMRLGARMGCGRDAIFRHPAITATTAMAMAAVMAPPSQTRHATAI

SEQ ID NO: 170271 - protein, 491 aa, Glycine max
  Coding DNA Sequence Number=SeqID_53493
  Pfam annotation: Domain name=RRM_1; Domain location=70-140; Score =21.4; E_value=0.0015; Accession=PF00076.12; Description=RNA recognition motif. (a.k.a. RRM, R
MSRERNSSERECREANTGEWERVRYRVRNTERNGASGFRVPRRIHEGNRDGQKLSYNRANWRDKNDISSFYFTRIAEGVTELDIWNQFRKWGAVREIFISKQRNRNGWRFGFARFTGVEDAHRLAKQLDQIIIGGLRLYVNVPKYGRDETRKVGAQMQPERMDGKKQNENLHRKQYQASTDMTSYAEVVARGKRNNSHSSKPINQRGESQSSLQLDITATDKEWLRNTWVGRLKNLRWYDRLDEDPLWDFGEDITPKYIGSDMVLLLGLTDEMAECMAKEITEAEALFYSLEKWHPSLRPGNRLTWVHCWGIPLEAWDKKNIQRIVSVLGDMVDIDDDTEESRRMDRARVLLRTSRGPAIHHTINVDIRGDAHRVQVVEEVSRSGETCQCWRRRSEWSSEEIESDDSAFGSPINESFDPCRGEDRFRTWNLADMLETARNPAKDTAGTIVGHQLQAPEVPSPLLPKGPSIDVGPMYNQHYSVDTVSNSDGP

SEQ ID NO: 170272 - protein, 1755 aa, Glycine max
  Coding DNA Sequence Number=SeqID_53494
  Gene Ontology: Mol. function=RNA-directed DNA polymerase activity; Biological process=RNA-dependent DNA replication
  Homolog annotation: Hit_ID=Q1SYP9; Match level="QueryCoverage=47%, HitCoverage=94%, E-value=1e-138, Identity=33%"; Hit description=Myb, DNA-binding
  Pfam annotation: Domain name=Exo_endo_phos; Domain location=716-924; Score=14.5; E_value=0.0015; Accession=PF03372.13; Description =EndonucleaseExonucleasephosphatase family
  Pfam annotation: Domain name=RRM_1; Domain location=90-155; Score =34.5; E_value=3.6e-07; Accession=PF00076.12; Description=RNA recognition motif. (a.k.a. RRM, R
  Pfam module annotation: Pfam domain module=Exo_endo_phos::RRM_1::RVT _1; Domain location=716-924::90-155::1146-1430
MALSTIEHNMCKALHPNFIIQNPKYIKNALGKGLIYEDRGHARVVGYSDARWSDSFSDRRSISGIQDHGVSNLRTHMAESLKQLHRELKFPEDTTEKDLWYHFKQAGDVREIFISPKRNRNGRRYGFVRFKGVEDVHQMEKKLDSMVFGGLKMYVNTPKFGRTHRVNSQPVVRGRMEGQHHTEGVRDVYQGTKQAANVKFPQGSYVEAVRRHTPRTEQRWTQAKENSRCCISTSSVSLDIQVIGQQWLKGAWVGRLKNLALFDSLEDEMLWDIDETISPRYIGDDMVLLIGLTDKKAQNVMEEEDAGWSELFYSVEKWTPQLRPGYRLTWVQCWGIPLIAWDMQHIKQIVPSIGDMVDADDDIRGELHVVHIVEENGKYCANCQHRRSNSQSSSEEIQSEESNVGTLLGDVPPPWWNEMRLKDKMGVCSEPSGNAPRSGEGKEEESSPETKGPCRSEGTSPPTIVDVQGGDAGNQLAESPTWQDDNMQEPLEYQTGNDDEEQPPTGHGTAENQADGGGPISDGMVVAQGPDGLSLGPDSASKAINRWILNLADTVQPYVAGVQSQSWGEGETAKSTVHQIGERSDPRGYASGEIRESIHKKGKVEAEMNVGEPDNFKYGRPKARDKEVERQMDLGGKKKLGHKSVALSSWDDTNTTGNSSTISQQQHEETKKGNQLSKLLQKHQITTQARSDGENKKTANIQHAEQIWSMIKDLGMTTGTSQRDYTQQLVEMEVRDGIRRLVREHHIDMLCIQETKKESVERSMCQVLWGDSGFSWESYPSSNAAGGILCIWNEKSFKVERRISGAGVIMVTGKWGQESQPRHIINIYSPCSLQDKRLLWERIKQLKYQNPGGYWGFNEWIEEMEVEEVPWVGKSFTWFKPNGKVKSKLDRFLVSPKWLSKWPGSYQTALHRNFSDHCPILLRSNNADWGPKTFRILDCWLAEKSFKKLIEENWSSNQWSGWGGYVIKQKIKAIKAKIKVLLRKQLQQQLWEAAKAHESLLRQKARSKWIKEGDCNSRFFHLLINARRRSNCLNGVLVDGVWLEEPAMVKEEVRRFFMQRFQENDHSRPTLDGIRFQTIDIQHNDMLVERFGEEEVKRAVWSCGSDKSPGPDGINFKFIKQFWDIIKSDFLRFLDEFHANGVFPRGLNASFIALIPKKVDPQLLNEYRPISLIGCTYKILAKVLSNRMKKVMHILINERQSAFIEGRHMLHNVMIANEVVEEAKRGQKPCIIFKVDYVKAYGSVSWEFLFYMMKRMGFCTKWIHWIAGCLKSASVSILVNGSPSPEFIPQRGLRQGDPLSPMLFNIVAEGLNGLMTNALEKGLFRGFLSGTNKVEISLLQYADDTIFFGEATMENLWGFWDVGPVDKRCSQLSSLWLDILSFHIPWHPYWGQSEKMVPKKVENKLVRLQRKFLWGGASEQDKIAWISWDKVCLPKEDGGLGVKDIRSFNTTLLGKWKWKLFQNQGDLWARVIESKYGGWRSLSEAPRANKESTWWKDLKNISQHPQQGQLLNAPISWKVGRGDKFKFWEDNWIGGDICLLEKYQRLYNISVQQDQLIQDMGEFKETGWEWDFKWRRPLFDNEIDQAVAFIQEVEGIRIQNVIEDQWVWEADISGRYSVKSAYSVLRKDILQEAPAEAFKELWKLKVPSKVTTFAWSIEESASHLFFHCSKVLSLWWESLSWVNMVVVFPNHPRQHFIQHMYQSYEGLMATRWKWWCVFIMDLAETFREGVVPSQTILSDYGTIPMATSFLYFSTS

SEQ ID NO: 170273 - protein, 70 aa, Glycine max
  Coding DNA Sequence Number=SeqID_53495
MSLARQIVGSLEFEEAQCKLWERHSFSAIEVGNECEEKLCEAEAMEVEEGYGKFEEKNFYEKLALYTILD

SEQ ID NO: 170274 - protein, 144 aa, Glycine max
  Coding DNA Sequence Number=SeqID_53496
  Gene Ontology: Mol. function=RNA-directed DNA polymerase activity; Biological process=RNA-dependent DNA replication
MGTFKDAGWEWEFRWRRPLFDNEIDMAVSFLSDVASHPIQPHKGDQWVWKADPSGQYTAKSAYDMVWGQTYEQQQDGVFQQLWKLKLPSKITMFAWRSSILSLWQDNASMVGVLILGGYVGCLPKSPEAALSPTYTWSDRGNEV

SEQ ID NO: 170275 - protein, 464 aa, Glycine max
  Coding DNA Sequence Number=SeqID_53497
  Gene Ontology: Mol. function=DNA-directed RNA polymerase activity; Cellular component=mitochondrion; Biological process=transcription
  Homolog annotation: Hit_ID=Q84LK6; Match level="QueryCoverage=89%, HitCoverage=39%, E-value=1e-168, Identity=68%"; Hit description=RpoT1
EKENKSSHVVPVEQRGELTEENGEMDKKQSRLRKRVAALMKKQKKLQAMGIVRGQDDWKAWGQEAQVKVGSRLMQLLIETAYIQPPANLIGDGPPDIRPAFKHTLKTLSSESQKETRRYGVIECDPLVQNGLEKSVSNSRECLYLNSCPHFIKRARHMVIPYMPMLVPPINWTGYDKGAYLFLPSYVMRVHGAKQQREAVKRAPKSQLDPVFEALNTLGSTKWRVNKRVLCVIDQIWANGGRLADLVDRENVPEPKEPDTKDEAEIRKWKWKVKAVKKENNERHSQRCDIELKLAVARKMKDEEGFYYPHNLDFRGRAYPMHPYLNHLGSDLCRGILEFSEGRPLGKSGLCWLKIHLANLYAGGVDKLSYDGRIEFTENHLDDIFDSADRPLEGKRWWLQAEDPFQCLAACTNLSEALRSPTPETTISHMPVHQRASPGAAVKLCLGDLLVMGSNPETASLHLQ

SEQ ID NO: 170276 - protein, 117 aa, Glycine max
  Coding DNA Sequence Number=SeqID_53498
MKNILGLQAPMELTSQPWPMGSEIYPKVHENPRAFFNSSSPILLEPLAHGSSDRSLPKAERKVAQVPDEVVLEAVKALPEEKQHKAKLAKRIQSAMEQSAKIFSTYTAEREDNYNKQ

SEQ ID NO: 170277 - protein, 261 aa, Glycine max
  Coding DNA Sequence Number=SeqID_53499
  Gene Ontology: Mol. function=nucleic acid binding
  Homolog annotation: Hit_ID=Q1T034; Match level="QueryCoverage=86%, HitCoverage=41%, E-value=4e-10, Identity=23%"; Hit description=Zinc finger, CCHC-type
  Pfam annotation: Domain name=zf-CCHC; Domain location=164-181; Score =13.6; E_value=0.0056; Accession=PF00098.13; Description=Zinc knuckle
MVTWSLDDKQANICLMAGADDKTKEKACYESNTFSSASSDDEENMPYDVLLHNYHMISLQCKRFKEKFKAFVCQNIELMKSNEDLKKKIQTLGESLSKASKTDESSPIKRLREEVACLTKDFGKFLESSKTLTMLLKFHQHPHKKSGLGLEKGTSSSKSQSKSDKCYFCGRIGHSKFKCIHKKKKNSKGTNYDGHKKIWVPKSQIVHVADTLGRKMLGFKLVPGQWMLMTHNGGKVLMMPKHLLDEHGLNQINKQDQENLR

SEQ ID NO: 170278 - protein, 54 aa, Glycine max
  Coding DNA Sequence Number=SeqID_53500
MVQELFTHRKGKKAKGTVKALDLEMISSGKGHLVQLELAQVSQLLRLEGISLPR

SEQ ID NO: 170279 - protein, 503 aa, Glycine max
  Coding DNA Sequence Number=SeqID_53501
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=93%, HitCoverage=26%, E-value=1e-167, Identity=59%"; Hit description =Glucan synthase-like protein
MDLMMMPVSSELFSAKVRWPVFLLANKFSTALTIAKDFEGKEEILVKKITKDKYMFYAVRECYQSLKYVLEILVVGSIEKRIICDILSEIEKHIQETSLLKNFNLKVLPALHAKVVELAELLGDKDHQHKVVKALLDVFELVTNDMMVDSRNDDQLFDSVEMNRDFYPFANENSIHFPLPESGPLMEKIKRFHLLLTVKDTAMDVPANLDARRRISFFATSLFTDMPDAPKVHNMMPFCVITPHYIEDINFSLKELGSDKEEDSIIFYMQKIYPDEWTNFLERMGCDNRKSLEDEHKTEDLRLWASFRGQTLSRTVRGMMYYREALKLQAFLDMAEEEDILEGYETAERGNRALFARLEALADMKYTYVISCQSFASQKASNDPRYQDMIDLMIRYPSLRVAYVEEKEEIVQGKPHKVYSSKLVKVVNGFEQDNYLEEALKMRNLLQEFLQRQGRRPPTILGLREHIFTGRKLSKIPDAAKHEGKGKGKRGLNISLIPKNTEG

SEQ ID NO: 170280 - protein, 85 aa, Glycine max
  Coding DNA Sequence Number=SeqID_53502
  Homolog annotation: Hit_ID=Q3V655; Match level="QueryCoverage=43%, HitCoverage=4%, E-value=7e-07, Identity=59%"; Hit description=MAP kinase phosphatase 1
  Subcellular localization annotation: CTP_CleavageSite=26; ConfidenceScore=5.44e-01
MTTQPHFYFHFSANSKVFFTSLCCIRFSLSPSTNTTFWSGLAPTATISFKKDYYAFYDKECSRIAEHVYLGSDTMAKSVELLRQH

SEQ ID NO: 170281 - protein, 575 aa, Glycine max
  Coding DNA Sequence Number=SeqID_53503
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=98%, HitCoverage=28%, E-value=0.0, Identity=72%"; Hit description=Glucan synthase-like protein
  Pfam annotation: Domain name=Glucan_synthase; Domain location=1-451; Score=-41.5; E_value=0.00017; Accession=PF02364.6; Description=1,3 -beta-glucan synthase component
MDVLDALFNFSVSSLAWFMSYQETSFVTIGQRLLANPLRVRFHYGHPDVFDRVFHITRGGISKASKTINLSEDVFAGFNSTLRRGCISYHEYLQIGKGRDVALNQISKFEAKVANGNCEQTISRDMFRLGRQFDFFRMLSCYFTTIGFYFSSLISVIGIYVFLYGQLYLVLSGLERALIIEARIKNVQSLETALASQSFIQLGLLTGLPMVMEIGLERGFLTALKDFVLMQLQLAAVFFTFALGTKTHYYGRTLLHGGAKYRPTGRKVVFHASFTENYRLYSRSHFVKAFELLLLLIVYNMFRRSYQSSMAYVLITYAIWFMSLTWLCAPFLFNPAGFSWTKTVDDWKEWNKWIRQQGGIGIQQDKSWHSWWHDEQAHLRWSGFGSRLTEVLLSLRFFIYQYGLVYHLDISQHSKNFLVYVLSWIVIVAIFLLVKAVNMGRQLLSANYQLGFRFFKAFLFLAVLAIIFTLSIICELSLTDLFVCCLAFMPTAWGLIMMAQAARPKIEHTGLWDFTRALAREFDYGMGIVLFGPIAILAWLPIIKAFHARFLFNEAFKRHLQIQPILAGKKKKHRT

SEQ ID NO: 170282 - protein, 394 aa, Glycine max
  Coding DNA Sequence Number=SeqID_53504
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=26%, E-value=1e-131, Identity=59%"; Hit description =Integrase, catalytic region
MQVELHALQMNNTWTLTTHKTAIGCRWVYKIKYKADGSIKQYKARLVTKGYMQMEGLDFLDTFSPVAKLTTVRFLLALAALNGWHLRQLDINNAFLHGELHEEVYMQLPPGLSVANPHQVCCLQRSLYGLKQASRQWFTCLSSFLISHGFQQAAVDHSLFLSFIGNSTTALLVYVDNIVLTGNNINVIRHITTLLDHTFKIKDLGILKYFLGLEVARSQHGTHLCQRKYTLDILSDFGMLGSRPNTTPIDYVTRLHATLGDPLSTKALSSYRRLVGRLIYLTNTRPDIAHAVQQLSQYMAQPTTAHSQAASRVLQYLKGTPSSGIFFSAKGSLQLKSFSDSDWAGCRDSRRSITDFSVYLGHSIISWRSKKQSIVSRSSSEAEYRALASTTCEL

SEQ ID NO: 170283 - protein, 88 aa, Glycine max
  Coding DNA Sequence Number=SeqID_53505
  Gene Ontology: Mol. function=nucleic acid binding; Biological process= DNA integration
  Homolog annotation: Hit_ID=Q1T2A4; Match level="QueryCoverage=93%, HitCoverage=21%, E-value=1e-18, Identity=48%"; Hit description=Zinc finger, CCHC-type
MSERVEQTPSMDSCLYLHPSENPTVALVSPVLDSSNYHSWSRSMMTSLSAKNKVEFVDGSVLEPPKTDRTHDAWCRCNNMVVSWIVHL

SEQ ID NO: 170284 - protein, 78 aa, Glycine max
  Coding DNA Sequence Number=SeqID_53506
MDARELQKLSEAKHPRCTLIHGFHTNILQFYPILHLYTKIQNFKVIDASLSELQDEIAEYVQNNMWSPEYPTLVYKKE

SEQ ID NO: 170285 - protein, 46 aa, Glycine max
  Coding DNA Sequence Number=SeqID_53507
MEYDSLSRCLGGEIVDTRDSKSRAKERGDSPLKTLVDVNLKEESSI

SEQ ID NO: 170286 - protein, 46 aa, Glycine max
  Coding DNA Sequence Number=SeqID_53508
MPSIIEEHEVDDVMATPPSSLPQSSTPSKSTSKRPKQSTRLRSLTT

SEQ ID NO: 170287 - protein, 160 aa, Glycine max
  Coding DNA Sequence Number=SeqID_53509
MAQQIPPTGAKYVNHSSSSEVHLDIPLSGRKWLQDAWVGRLKNLTMFDRLEEDMLWDFGLNTMPKYIGDDMVMILGLTEEKARQMMEREEEGRDVLFCSLERWNPIVRAGYRLTWVQVWGIPLMALDSQQMTKIVAGIGKAVDVDDDVEELRKMDRARIL

SEQ ID NO: 170288 - protein, 171 aa, Glycine max
  Coding DNA Sequence Number=SeqID_53510
  Gene Ontology: Mol. function=oxidoreductase activity, acting on the CH-OH group of donors, NAD or NADP as acceptor; Cellular component =mitochondrion; Biological process=malate metabolic process
  Homolog annotation: Hit_ID=P37221; Match level="QueryCoverage=90%, HitCoverage=24%, E-value=3e-69, Identity=83%"; Hit description=NAD -dependent malic enzyme 62 kDa isoform, mitochondrial precursor
  Pfam annotation: Domain name=Malic_M; Domain location=1-134; Score =47.1; E_value=1.6e-14; Accession=PF03949.5; Description=Malic enzyme, NAD binding domain
VLEALKGSTSTRPAIFAMSNPTKNAECTAEEAFSILGDNIIFASGSPFSNVDLGNGHIGHCNQGNNMYLFPGIGLGTLLSGARIVSDGMLQAAAERLATYMSEEEVLKGIIFPSTSRIRDITKQVATAVIKEAVEEDLAEGYHGMDARELQKLSEASYVCLRILNIFACLS

SEQ ID NO: 170289 - protein, 96 aa, Glycine max
  Coding DNA Sequence Number=SeqID_53511
MELGNRTIMKQKLNSNDQWVRQWSQHLQNLNHEEQKGESERVIKDQRGQKRYFIGIYHTHNELMAQNSSIKHSLSFVSHFSFDPPLADHAPCDFSD

SEQ ID NO: 170290 - protein, 79 aa, Glycine max
  Coding DNA Sequence Number=SeqID_53512
MTQESFVPYGHQDILTIVIGQPEHPSHVRAMGLGVTISQYFGHASHGSKSSTSIIPQHLTKMIQNLKEEWKIETKEENK

SEQ ID NO: 170291 - protein, 195 aa, Glycine max
  Coding DNA Sequence Number=SeqID_53513
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=65%, HitCoverage=8%, E-value=1e-34, Identity=53%"; Hit description=Chromo
MAKNTRLKDLQAEVRGQADDIKKLMELLDLRDLEPRDHTKQPPFNSGSPGNNSTCGVTPLRSVIHVRDISLGFPHFDGHSSVLEWIFKAKNFFDYHHTPDANRVDIAAIHFEKEVVPWFQMLQRLSAIKTWAELTTVLKSQFGPSPFDCSMVELFKLQQIGTVSDYYLKFMSLANRSSGLSDDALLNCFLSGLHA

SEQ ID NO: 170292 - protein, 65 aa, Glycine max
  Coding DNA Sequence Number=SeqID_53514
MWKLMTSPAYFAEVMMRMRLTYSSLVLTSCRYGGNRDHGSGDITFGGSSPRRSRRSRSVMEKAVP

SEQ ID NO: 170293 - protein, 565 aa, Glycine max
  Coding DNA Sequence Number=SeqID_53515
  Gene Ontology: Mol. function=oxidoreductase activity, acting on the CH-OH group of donors, NAD or NADP as acceptor; Cellular component =mitochondrion; Biological process=malate metabolic process
  Homolog annotation: Hit_ID=P37221; Match level="QueryCoverage=99%, HitCoverage=56%, E-value=1e-57, Identity=47%"; Hit description=NAD -dependent malic enzyme 62 kDa isoform, mitochondrial precursor
  Pfam annotation: Domain name=Malic_M; Domain location=385-556; Score=- 29.4; E_value=7.9e-10; Accession=PF03949.5; Description=Malic enzyme, NAD binding domain
  Pfam annotation: Domain name=malic; Domain location=86-299; Score =80.2; E_value=6.5e-21; Accession=PF00390.9; Description=Malic enzyme, N-terminal domain
  Pfam module annotation: Pfam domain module=Malic_M::malic; Domain location=385-556::86-299
MAVVDLKRLEVQARDGPSDPNALAKWRILNRLHDRNETMYYKSNIGWRWFGRLLSSVEVPRLGTNKGSLGGDMFGGSPILVICLLSGELYRESSVLIAKIEEYAPIVYTPTVGLVCQNYSGLFRRPRGMYFSAEDRGEMMSMVYNWPAEQHVNLLENVIPNFHPSLDLFPMRASPGAAAAYNIPPPYLRIAKSLRAMGYEPLCICKGKAAYNIPPPYLRIAKSLWAMGILGLGDLGVQGIGIAIGKLDLYVAAAGINPQRVLPVMIDVGTNNEKLLEDPLCKDPLMDCVRKSYIACLNSWGVAYISVGQLHLVHLWRGGVRKSHIACLSSWGTAYISVGQLHLVLIGFKLKSNGLEQHRLDGDDYLAVVDEFMEAVFTRWPNVIVQGTAGVAIAGLLGAVRAQGRPMIDFPKQKIVVAGAGSAGIGVLNAARKTMARMLGNNEVAFESAKSQFWVVDAQGLITEGRENIDPDALPFARNLKEMDRQGLREGASLVEVGYGIVSSTLNLEIELGALRAFLKLGGAFALIWFILIPLCFYFLSVTVKQVKPDVLLGLSAVGGLFSKE

SEQ ID NO: 170294 - protein, 71 aa, Glycine max
  Coding DNA Sequence Number=SeqID_53516
MEGRWPSVVVKGRDSSKCAAVTWRFSSDDEFLTCFNSIAIFFCSLFSVKMRSNLSVLSLRFTSYRCGQGRK

SEQ ID NO: 170295 - protein, 79 aa, Glycine max
  Coding DNA Sequence Number=SeqID_53517
  Gene Ontology: Cellular component=integral to membrane
  Homolog annotation: Hit_ID=Q1S566; Match level="QueryCoverage=65%, HitCoverage=17%, E-value=9e-15, Identity=64%"; Hit description =GNS1/SUR4 membrane protein
MSNVTILTTITDTLTLPPLATFSRKKLRNSNKIAPLSTELKTHAPIPLHPPVKKCDKSNVTWQTKLHPSSAIWQLSTSE

SEQ ID NO: 170296 - protein, 93 aa, Glycine max
  Coding DNA Sequence Number=SeqID_53518
MAAEWRRKRERRRHFKEKMSLEEAHHHRRPWIRAWRKKEMNEGRGREEHEIRGRLEVLTWISPCHQVLAGLTDPWHHSMTLNQESFTWSHTKV

SEQ ID NO: 170297 - protein, 204 aa, Glycine max
  Coding DNA Sequence Number=SeqID_53519
MKMQKARRGPKGCIEGIQHFEIKTNWSMNKERTKNIEERCRNRSRKLFGSASALFFFFLLLLTNFTKMLSIYEAEPLPSAPSCLFIGNEGRRLNSSLPRRAGYFTPKFSSGPRGLKKPPNDPFTLLLGYYRNMPFGGQARRGSQVRFPKEERCPESPPMFICGKHQKNRRKPVKKNVPSSGVVFTFEEGISTSHVCLKGQQPIF

SEQ ID NO: 170298 - protein, 247 aa, Glycine max
  Coding DNA Sequence Number=SeqID_53520
  Gene Ontology: Mol. function=DNA-directed RNA polymerase activity; Cellular component=mitochondrion; Biological process=transcription
  Homolog annotation: Hit_ID=Q8L6J5; Match level="QueryCoverage=76%, HitCoverage=14%, E-value=6e-64, Identity=65%"; Hit description=DNA -directed RNA polymerase 1B, mitochondrial precursor
  Pfam annotation: Domain name=RNA_pol; Domain location=1-218; Score= -117.8; E_value=1.3e-06; Accession=PF00940.10; Description=DNA -dependent RNA polymerase
MATSVYIHQVIERSMGTSTVIASTNQAVQWITPLGLPVVQPYRQFGRHLIKTSLQILTLQRETNKVMVKRQRTAFPPNFVHSLDGSHMMMTTVACKKAGLNFAGVHDSYWTHACDVDEMNRILREKFVELYDAPILENVKYFVSLFTGFFIGLNVPPFKLSSLGFLYNETNYVADCIHVELLLESFQKTFPALNFPPLPERGDFDLQEIKSNSVKFVCIYMHGIEKAPTTTVMEKKEVCEARTRLPN

SEQ ID NO: 170299 - protein, 184 aa, Glycine max
  Coding DNA Sequence Number=SeqID_53521
  Homolog annotation: Hit_ID=Q00M75; Match level="QueryCoverage=18%, HitCoverage=5%, E-value=1e-10, Identity=91%"; Hit description=PPR -repeat containing protein
MTKTNEVRASPGAAVKLCLGDLLVMGSNPETASLHMQGMTSQRLDAVEADLAAIKLALQSHESSISTQSSKLDSLVSSISELSKSISILCDEMHESRSSISDSPLRHAPDDGNLYLKRVDLLPFTGNNPIGWLAKMETYFSVQNTPPEMHISLAQICMEGMTRHWFMVLSYSNPHLIRFWLLIA

SEQ ID NO: 170300 - protein, 71 aa, Glycine max
  Coding DNA Sequence Number=SeqID_53522
MTPTPKNFSIYQLIPHGSNGHRFKCFRNRDLIRLAKEGIEDKLVDAFEDLGEPLASTRTKRYKGIGRETQP

SEQ ID NO: 170301 - protein, 217 aa, Glycine max
  Coding DNA Sequence Number=SeqID_53523
MAPKKLSTKRSRRDTAAERSSAAPEFDSHHFWSAEHQQCFEAIKGWSFHKERRRRECERRNRADGFDDYGDLLVLEEGQQCEFGQRRNRADGFDDYRPLPVIRGSRHPQQVQGDAHQAANAQPPPHQADPAGSLGMERYLQHLVRQRTTNHRGQGQGFTPFACPTPEQFGAEVAWPGDWPEAQAGEEPAGSPGEVEEARMDEEMTDLLGFLGGSGAT

SEQ ID NO: 170302 - protein, 48 aa, Glycine max
  Coding DNA Sequence Number=SeqID_53524
  Homolog annotation: Hit_ID=Q5N6W3; Match level="QueryCoverage=85%, HitCoverage=8%, E-value=4e-08, Identity=69%"; Hit description=ABC1 -like
MKTHETNVALLDYGQVKDLPDQLRLAYANLVLAIANGDPLRAVESYRY

SEQ ID NO: 170303 - protein, 217 aa, Glycine max
  Coding DNA Sequence Number=SeqID_53525
IQSQGLALPSEPEVGPSTACVSTKKSCVDPSGNDPETGDLDKCRLYIKENLPCLVVLGRVYDGSATIHNIPLLHDQVKVDVEEVKDAAAPVPTLNTFLAWPTYLVKRLSEQGVVGAVGPAKPADRPDHEVDDPLYLLTLDARWIVVKCNRQKGSTECGYYVMHWISTIILGSFRNNWEMYFNDARPLEAKRLKAFRIQWAQYYLKLRNQTLDVTELC

SEQ ID NO: 170304 - protein, 207 aa, Glycine max
  Coding DNA Sequence Number=SeqID_53526
  Gene Ontology: Mol. function=transferase activity, transferring glycosyl groups; Cellular component=intracellular; Biological process=protein amino acid ADP-ribosylation
  Homolog annotation: Hit_ID=Q9ZP54; Match level="QueryCoverage=57%, HitCoverage=11%, E-value=7e-25, Identity=52%"; Hit description=Poly [ADP-ribose] polymerase 1 (EC 2.4.2.30) (PARP-1) (ADPRT 1) (NAD(+) ADP-ribosyltransferase 1)
MTNLSAGQERFRTLNNSYYRKAQGIILGMLTLCVHKNNFVLIFYEAILQAEWKCKIDGICGMFHAKVNKDTNCLVVGGSLNYEAEMRKARVIYGRMKIPIVRKDYLIGCLARKKRLPFDMYKVEMIGEASSMVTIKVKGHSAVHEASGLQDSGHILEEGGGAIETPTNNADAIETPTNNATARTFSLYRASCPPVIITLHGSPLDPL

SEQ ID NO: 170305 - protein, 82 aa, Glycine max
  Coding DNA Sequence Number=SeqID_53527
MMRICGSYSQADQGKYSKEEKHGECEREKYRERDDEEDPVAQKGLCEKEKEEDIGKKELDEETDGEDAMDLFALGCAEQEST

SEQ ID NO: 170306 - protein, 172 aa, Glycine max
  Coding DNA Sequence Number=SeqID_53528
  Gene Ontology: Mol. function=DNA binding; Cellular component =mitochondrion; Biological process=chromosome organization and biogenesis (sensu Eukaryota)
  Homolog annotation: Hit_ID=Q9LTA2; Match level="QueryCoverage=89%, HitCoverage=54%, E-value=2e-17, Identity=34%"; Hit description =Similarity to AT-hook DNA-binding protein
  Pfam annotation: Domain name=DUF296; Domain location=28-155; Score =66.3; E_value=1e-16; Accession=PF03479.5; Description=Domain of unknown function (DUF296)
MPRGRPSGSKNKPKTTSLLVAQPVEPSMKLVIINVDRGKDIMQTILNVAHQGCVSLTVLSASGTVTSVTLCNSPNDGGGALMLHGPFTLLSINGSYFYNNNQYNLHSGATRSPPVSFGIHLSTSKGKILGGAIGGNVIAGDDVSITLSTFSHPEIYMYVPKDEEEDNDEKKQ

SEQ ID NO: 170307 - protein, 161 aa, Glycine max
  Coding DNA Sequence Number=SeqID_53529
  Homolog annotation: Hit_ID=Q5QLQ3; Match level="QueryCoverage=49%, HitCoverage=43%, E-value=3e-15, Identity=49%"; Hit description=60S ribosomal protein L18A-like
MTDEDKPKAFSGHHHHPPPPQPQPFPAAQYGTFQGVANYPPPPQPHPAIGFPHPVPPPGAADSSAPPPPYYPGYQAVPGYAVAEGRPVRERHLGCCGLGCGWCLFILGFFLAGIPWYVGAIIMLCSRVDYREKPGYIACVVAAVLGTIAIILGVTKGVDDW

SEQ ID NO: 170308 - protein, 65 aa, Glycine max
  Coding DNA Sequence Number=SeqID_53530
MALQGEDESRTSSPPYEVMDKNLKLKRETDKEARAPKERRKGGFPNFFIEHGLCWPPRYNLISVV

SEQ ID NO: 170309 - protein, 73 aa, Glycine max
  Coding DNA Sequence Number=SeqID_53531
MSDLIKDGVFVNTVVDISTVKDGRCLLLRSISVAPLSAPQKEGYIVTAPLPLRRVLFAAPPQPRVHCRGTIAT

SEQ ID NO: 170310 - protein, 366 aa, Glycine max
  Coding DNA Sequence Number=SeqID_53532
  Homolog annotation: Hit_ID=Q1SRI1; Match level="QueryCoverage=25%, HitCoverage=18%, E-value=8e-13, Identity=33%"; Hit description=RNA -directed DNA polymerase
MGVTLSEKREKLVDKLTVMEQWDSKLKKNTMEMMNPSINSTGGLLCVWNKDTFHMNNVFRGHGFIGLEGVWLDGLENSHCFHGMLKEVWRNIKMEGWDAFVLKKKLKGVKEALKKWNVKEFGLLNVKIKKIEKDFNELDIIEEQQGELCEKDCKKRLQLQEDYWRVAELNESLLCQKSRPKLDGVEFKYLSSEANLMLITKFNEEKVNDAIWECGKVPSLVGDNSYIMRLVANEVADDEDKTTVEKYASMLNCKILTLQFSYQGLPIGANPRKVEMWHPIIRKFEKRLALWKHKHIYFVGWEVCSKLVGIQRRILWGGDDVNNKIAWVKWEDICKTKKLGGEVWSEVLISKYDGWHGLREDNHQID

SEQ ID NO: 170311 - protein, 101 aa, Glycine max
  Coding DNA Sequence Number=SeqID_53533
MERASPRVDLGFVEPWTRDVFVLGFVKPTELCRGLPRTGLGFCRPDLPRVDLGFCELSGELTRELFNLGFVHHGHAYMPLTVGDTHWRRGDILLYICHYCG

SEQ ID NO: 170312 - protein, 249 aa, Glycine max
  Coding DNA Sequence Number=SeqID_53534
  Subcellular localization annotation: CTP_CleavageSite=3; ConfidenceScore=5.34e-01
IASASTSAAPTPSSPPMDVVEKVTPAAVEAVVLATQADSIVVPSSSIVAPLLSAGVVATSAPMVLPPSSTALVASPSTVLVLVMSPSSSSCPCVSLDHLYTSSDAYSLWGATYKSNFSRKEFGNSRGDWATTPRDYVEGGDLTGEGWQHPKVANATIAFAKVVKSNNQLFAKVGGVLGKLLHTQLDGDELFTRCKDLQIEKIDLGGKVECMEDEKDRLAKVVADLEAWLKESESRLEEFELGVAKERGA

SEQ ID NO: 170313 - protein, 93 aa, Glycine max
  Coding DNA Sequence Number=SeqID_53535
MDVYVFSNNVERRDDRRDKNKRLFDGGLDGGLEEFGFSHDPLKMVHQVQLSLLVDASYRGVKQQDGSSAHNDGGTEGFHRTGIGALVQGIWTK

SEQ ID NO: 170314 - protein, 108 aa, Glycine max
  Coding DNA Sequence Number=SeqID_53536
MAQLSEPFVSLVIINVDSDRDITKSILEIAHRGHVNLIGLSISSTVTKVTLHNSLHGIVAFTLHGPFALLPLNDSYLFNNHYNLNYGATLPLPLVVPLVAKSSPVTMS

SEQ ID NO: 170315 - protein, 335 aa, Glycine max
  Coding DNA Sequence Number=SeqID_53537
GTSFVVQVDGISTWVVVTENKRWYISCGSVLGEGTSTRLFKENKGGYIPCGSLLVKDFTRLKRNLNDRRSLGEWILDGRTFQLSIVVPPAKEGGQPAVEVGPIAGIVEIPRGAPSSALNKRKQATKLTPDLGRPLILQDLPLTPSAVEASAHAVAEVAKWRATACKIKRVEHPKSNHQLSSKVGTVLEMSLCTKLDGDELFESYKDFHKKKKDLTGRVEHITVDRGKLAKIMADFEAWLKELESKLKEFEQRATREREVRQQLEEELLIYKNEVLEQHEKGFKKVVKQAGFFQKDLDLGLFDPFNCFWKLVDDKVHISSKQLTGLANIVVSILAN

SEQ ID NO: 170316 - protein, 91 aa, Glycine max
  Coding DNA Sequence Number=SeqID_53538
MGGIKDAEADAALVIDINNRLHDVQPGSTLMIKSFMEGATSWGTGGKRRKEILGKGVRHGIVCHNDKEVNGMRGGKNVFPEVIKNTLIDYF

SEQ ID NO: 170317 - protein, 144 aa, Glycine max
  Coding DNA Sequence Number=SeqID_53539
MLMLCQILLRAKCAEDALSGERGCPLSKEMVPCRGKLSDVEGSSLDKFIKLVKPFSLDKCCPGYFCRVVPSGHAFGFVGERTHNTLVYVSLMEWARTEDMVHGEKKESHEESTSGGFNPFSVSLTFGNSIRAVGGKTEGISGNR

SEQ ID NO: 170318 - protein, 48 aa, Glycine max
  Coding DNA Sequence Number=SeqID_53540
MEASCTTEFVEPVVTIGFVQKSMVLCFFRRKISRNCTSQFSSFPKVHA

SEQ ID NO: 170319 - protein, 118 aa, Glycine max
  Coding DNA Sequence Number=SeqID_53541
MPRSFFSEVWQFWKKMGKGTKRDIAHTVMRVECPKVANATITFVEAVKSNHQLSSKVGSVLGKLQCTRVNEKEKGLIGRVEKGELAKVVVDFEARLKDLKSKLEESELWATKEREANK

SEQ ID NO: 170320 - protein, 188 aa, Glycine max
  Coding DNA Sequence Number=SeqID_53542
  Homolog annotation: Hit_ID=Q8H2M0; Match level="QueryCoverage=20%, HitCoverage=13%, E-value=6e-11, Identity=84%"; Hit description=KH domain-like protein
  Subcellular localization annotation: CTP_CleavageSite=69; ConfidenceScore=5.16e-01
MPLPPLPIRRHQSPQPLTAVLEPTRGSLMPSAPLVPPPRDKASPLHPPPLHNGPLTRAHQTPNNRTHPSAAESATLTEQLKKESEWETLEAAIEVEFEAIRSRGAKAHVFFKISEEVVIDATDKGNIARLINHYEQSKTGQSVPIRVGGRTSEAWTLHASASHMQPPPKSSYFKGLEIVALQQFLFGK

SEQ ID NO: 170321 - protein, 153 aa, Glycine max
  Coding DNA Sequence Number=SeqID_53543
  Gene Ontology: Mol. function=protein-tyrosine kinase activity; Cellular component=integral to membrane; Biological process=protein amino acid phosphorylation
  Homolog annotation: Hit_ID=Q2HVC0; Match level="QueryCoverage=75%, HitCoverage=55%, E-value=1e-18, Identity=72%"; Hit description =Protein kinase
  Subcellular localization annotation: CTP_CleavageSite=31; ConfidenceScore=5.44e-01
MVREKSLVKPKTGPVSPSSMRTPGPSSVPKEASTDSTSSLTFVRYEGITQLHIVGETRALLLPRNFSIDSFVTTLVRLPSLKFLTLVSLGIWDPLPEEIVAAKGYISQTMKFRTIGLPPYRAFSLEEIVAATNNFDSASFMGEGSHGKLCHLF

SEQ ID NO: 170322 - protein, 430 aa, Glycine max
  Coding DNA Sequence Number=SeqID_53544
  Gene Ontology: Mol. function=monooxygenase activity; Cellular component=membrane; Biological process=electron transport
  Homolog annotation: Hit_ID=Q1RYU2; Match level="QueryCoverage=98%, HitCoverage=81%, E-value=1e-166, Identity=66%"; Hit description=E -class P450, group I
  Pfam annotation: Domain name=p450; Domain location=1-426; Score =204.2; E_value=2.9e-58; Accession=PF00067.12; Description=Cytochrome P450
MNLIMYGKNSFLWEGTTPKVIITDPEQIKEVFNKIQDFEKPKLSPLINLLGNGLTNLQGEKWRIHRKIIDPAFHFEKLKVMLPTFFKCCDEMVSKWEGMLSSDNKCEIDVWPFLQNLTCDIISRTAFGSSYEEGKRIFELLKEQAGLIMKLRNVYIPGWWLLPTTTHRRMKEIDTDIRASLKGIINKREKAMKAGEVLHHDLLGMLLESNRMEIHEHGNNKTVAMTSQEVIEECNAFYIAGQEATSTLLVWTMILLSRYSDWQAHAREEVLHVFGNQKPDYDGLSHLKIVTMILYEVLRLYPPAVYFNRAIKNDVELGKMSLPKGVQVSLPILLIHQDHDIWGDDATEFKPERFADGVAKATKGQVSFFPFGRGPRVCIGQNFALLEAKMVLSLLLQKFSFELSPAYAHAPTIGFTLNPKFGAHIILHKL

SEQ ID NO: 170323 - protein, 192 aa, Glycine max
  Coding DNA Sequence Number=SeqID_53545
  Gene Ontology: Mol. function=transporter activity; Cellular component= integral to membrane; Biological process=transport
  Homolog annotation: Hit_ID=Q1BJ60; Match level="QueryCoverage=91%, HitCoverage=40%, E-value=4e-36, Identity=45%"; Hit description=Major facilitator superfamily MFS_1
  Subcellular localization annotation: CTP_CleavageSite=53; ConfidenceScore=5.18e-01
MALIYAGASAAGSTLSVWSPQLLKSFGLDNFTTGLMNAIPYGLASILMIVWGRSSDRSGERRWHTALTLFLIAGGLLAAFLTDTLAGSVVILSLVLIGAYSMKGPFWALASGWMSSTTAAAGLAAIGAMANLIGGGLMVNVYGIINEKTGSHAMAMIPLALLCAAGGIAVLLMGRSKKLHVEAEQPVASTGK

SEQ ID NO: 170324 - protein, 359 aa, Glycine max
  Coding DNA Sequence Number=SeqID_53546
  Gene Ontology: Mol. function=transporter activity; Cellular component= integral to membrane; Biological process=transport
  Homolog annotation: Hit_ID=Q1BJ65; Match level="QueryCoverage=88%, HitCoverage=69%, E-value=1e-106, Identity=66%"; Hit description =Major facilitator superfamily MFS_1
  Pfam annotation: Domain name=DUF1109; Domain location=143-310; Score=- 121.3; E_value=0.0089; Accession=PF06532.2; Description=Protein of unknown function (DUF1109)
  Pfam annotation: Domain name=DUF1228; Domain location=177-257; Score=- 19.4; E_value=0.015; Accession=PF06779.4; Description=Protein of unknown function (DUF1228)
  Pfam annotation: Domain name=MFS_1; Domain location=3-313; Score =24.2; E_value=2.5e-05; Accession=PF07690.6; Description=Major Facilitator Superfamily
  Pfam module annotation: Pfam domain module=DUF1109::DUF1228::MFS_1; Domain location=143-310::177-257::3-313
GRAHLDRAHHDFVGIDFDGDRVHQRPRQLCRCALLSRRSRGRLSPGIYLFFTYWFPGSWRAKITAAFLVGIPVANIIGSPISGALMQITGHEHIRNWQWLLLIEGLPAVILGVMCLFVLSDRPEKARWLAPREQQLLSRWLADEQQQIAATHGSQMRDALRNPLLYLLAFINFCGIVGSIGVGLWMPQIIKQLGVSHTATGFLAALPYVCGAVSMLLWARRANASAHRIRWISGALVIAALALMCSALSDAPVIKMLALCCTVSGILAFQASFWALPSGFLTGNAAAGGLAMIVSIGNLGGFFGPSLIGYVRQSTGGFMWALLAVAAVLMIGALAVAMDESRITADVISQIRALPGTGS

SEQ ID NO: 170325 - protein, 77 aa, Glycine max
  Coding DNA Sequence Number=SeqID_53547
  Gene Ontology: Mol. function=transporter activity; Cellular component= integral to membrane; Biological process=transport
  Subcellular localization annotation: CTP_CleavageSite=57; ConfidenceScore=5.19e-01
MLVAQQLPQGDMTNRFALGILFSQFAAQPVALFSAGRKPARPAQSPGNLFDDKQPVPAAQVGTSRPSSGLRPRSASQ

SEQ ID NO: 170326 - protein, 319 aa, Glycine max
  Coding DNA Sequence Number=SeqID_53548
  Gene Ontology: Biological process=peptidoglycan metabolic process
  Homolog annotation: Hit_ID=Q026E3; Match level="QueryCoverage=85%, HitCoverage=86%, E-value=3e-83, Identity=54%"; Hit description =ErfK/YbiS/YcfS/YnhG family protein precursor
  Pfam annotation: Domain name=ErfK_YbiS_YhnG; Domain location=182-316; Score=119.9; E_value=7.4e-33; Accession=PF03734.5; Description =ErfKYbiSYcfSYnhG
  Pfam annotation: Domain name=PG_binding_1; Domain location=41-101; Score=44.9; E_value=2.8e-10; Accession=PF01471.9; Description =Putative peptidoglycan binding domain
  Pfam module annotation: Pfam domain module=ErfK_YbiS_YhnG::PG_binding_ 1; Domain location=182-316::41-101
MPVCRPALLALSLLMPPAFAQVPPPVQLPEPIAEKTGPDTAARSPLHAQVLLDRANFSPGEIDGEVGSNQRRAVAGFQAAHGLTVSGELDDATWKALQADATTPLASYTLTAEDVAGPFIAVPKTPAAQAKLKALGYSSVEESLGERFHASPALLKALNPGVDLAKAGSRIQVPNIAPAALPKAAKIVVDKSDSTLQLLDVQGKVIAQVPVSSGSQHDPLPIGEWKILGVYRDPPFHYNPKLFWDARKGEKKATLPPGPNNPVGRVWIDLSKPHYGLHGTPVPGHVGKTESHGCVRMTNWDALRVADAVDTSVPVVMQE

SEQ ID NO: 170327 - protein, 32 aa, Glycine max
  Coding DNA Sequence Number=SeqID_53549
EGPKERTAAMKEQKEDIAEFMASFKTSSDYLA

SEQ ID NO: 170328 - protein, 146 aa, Glycine max
  Coding DNA Sequence Number=SeqID_53550
  Pfam annotation: Domain name=zf-CCHC; Domain location=110-127; Score =28.9; E_value=1.7e-05; Accession=PF00098.13; Description=Zinc knuckle
YILCGTSRAYIYLGCNTENKREYISCGSVQVECISTWLFKENKGGYIPCGSLLVKDFTRLLEISGTSGCLGTGCNLSSPSTQSLHGKSTMPNAGANHNFASSSNTDTKNMKCFKCLGRGHIASDCPTRMMEACLWSFYGGWIFELQ

SEQ ID NO: 170329 - protein, 126 aa, Glycine max
  Coding DNA Sequence Number=SeqID_53551
MSISPSTIIILQIPTANMRGSEAGTTYQIFTTIQRLMSQDRGFTETVLGFYRKRKSYDAKGLVISQPTLRREGDARAHGCVFQERNTRGVATNVYLRKTSEKLEKMWSTNFKCERFESCIYARGRY

SEQ ID NO: 170330 - protein, 174 aa, Glycine max
  Coding DNA Sequence Number=SeqID_53552
MKKIDTVHQSVSLENKTGDSTVLKIGDSAKVVIKQDMKGGEHKYGFNNNKREKPQKVRLVDDETGDKHELFDCSYIELYKNILFAAAATNAVPAITFIMAVLIRMESISIKRVYGLAMILGSVLSLAGAITFALVKGPHLGFMKWYQENHNHTSHPLTIVHSKGDTIRGSLLML

SEQ ID NO: 170331 - protein, 162 aa, Glycine max
  Coding DNA Sequence Number=SeqID_53553
MGFKNSIGEDDVVPMLRNRITESKPPPLPSFSLQPYRSSIDMLNKVLTRMIQVEHQKSCCDKVQQVVQRSEEMCKSAACHYVENLSNGSALEVLPTAKNGVWRVKLLIDLRLGNCLWLEWKTRVLEGMINDWSQIKGKREALPWSLVREGKGRHILQITTLL

SEQ ID NO: 170332 - protein, 53 aa, Glycine max
  Coding DNA Sequence Number=SeqID_53554
MELPPTIATCFLMNASKSQQSTSSLSDDKNVAPHIVTFNHHIVNKFDTELFFS

SEQ ID NO: 170333 - protein, 66 aa, Glycine max
  Coding DNA Sequence Number=SeqID_53555
MDSHDIYKLDNINVPSSNQTVLDKAEDLWHDEDGSTCCVEELVTEVLKEGKEAKVEDFDVANGIQK

SEQ ID NO: 170334 - protein, 147 aa, Glycine max
  Coding DNA Sequence Number=SeqID_53556
MASRCGGPSMALKQWAWDTAAQKLDNSGDEGARLGQKKMRELNVNMSENKFEVVSIVYFHEQCLWAKVVLGVGPESGRVTLTGHLMISLSESDLTYPLCGVPCYVILGALILFFIDKVNHLMMMIMLEMKRLSLSQGKCSNRCDIGA

SEQ ID NO: 170335 - protein, 166 aa, Glycine max
  Coding DNA Sequence Number=SeqID_53557
  Gene Ontology: Mol. function=oxidoreductase activity; Cellular component=membrane; Biological process=electron transport
  Homolog annotation: Hit_ID=Q2MJ18; Match level="QueryCoverage=91%, HitCoverage=29%, E-value=1e-57, Identity=65%"; Hit description =Cytochrome P450 monooxygenase CYP72A59
MLLVEFSNSFISGKNSFLWEGPTPKVIITDPEQIKEVFNKIQDFEKPKLSPIINLLGTGLANLQGEKWRIHRKIIDPAFHFEKLKVMIPTFYKCCEEMVSKWEGMLSSDNKCEIDVWPFLQNLTCDIISRTAFGSSYEEGKRIFELLKEQAGLIMKLRNVYIPGWW

SEQ ID NO: 170336 - protein, 322 aa, Glycine max
  Coding DNA Sequence Number=SeqID_53558
  Gene Ontology: Mol. function=protein kinase activity; Biological process=protein amino acid phosphorylation
  Homolog annotation: Hit_ID=Q5QLZ5; Match level="QueryCoverage=99%, HitCoverage=42%, E-value=3e-74, Identity=49%"; Hit description =Putative kinase-like protein splice variant 1
MYEVFSRLRLGETEELRNIGSIPKSLLPDYQRLLSSMPSRRLNTSKLIENNEYFQNKLVDTIHFMEILSFKDSVERDTFFHKLPNLAEQQPCQILLPLLASALEFGLAAASALIALLKMGSWLSVEEFNIKLPFFNILINMESRSQRKLLMSKRKICLRGGMKLVTLSLIIVSKDNARVIIEVSVKVVGHRSFFEPYVVDISYLSKFTDNLTANLIAILQTRKRVLINAFTVRALRDTFPPARGAGIMALCTTSSYYDITKVATRILPNVVVLTIDPDRTKTFQVVDQFFQIPKQHYEKTYAADTSCGVGSSFVPGNATLLR

SEQ ID NO: 170337 - protein, 79 aa, Glycine max
  Coding DNA Sequence Number=SeqID_53559
MGDQEQTQEQMKADVSALKEQMASMMEAMLGMRQLMEKNMGTAAAVSSAAEADPSLLATGHHPPPKRGRTRKEHTGAQQ

SEQ ID NO: 170338 - protein, 261 aa, Glycine max
  Coding DNA Sequence Number=SeqID_53560
  Gene Ontology: Mol. function=monooxygenase activity; Cellular component=membrane; Biological process=electron transport
  Homolog annotation: Hit_ID=Q1RYU2; Match level="QueryCoverage=99%, HitCoverage=49%, E-value=1e-108, Identity=71%"; Hit description=E -class P450, group I
  Pfam annotation: Domain name=p450; Domain location=1-257; Score= -100.2; E_value=2.1e-06; Accession=PF00067.12; Description=Cytochrome P450
MKEIDTDIRASLKGIINKREKSIKAGEVLHHDLLGMLLESNRMEIHEHGNNKTVAMTCQEVIEECNAFYLAGQETTSTLLVWTMILLSRYPDWQAHAREEVLHVFGNQKPDYDGLSHLKIVTMILYEVLRLYPPAVYFNQAIKNDVELGNVSLPKGVQVSLPILLIHQDHDIWGDDATEFKPERFAEGVAKATKGQVSFFPFGRGPRVCIGQNFALLEAKMVLSLLLQKFSFELSPAYAHAPTIVFTLNPKFGAHIILHKL

SEQ ID NO: 170339 - protein, 226 aa, Glycine max
  Coding DNA Sequence Number=SeqID_53561
  Gene Ontology: Mol. function=3'-5'-exoribonuclease activity; Cellular component=intracellular; Biological process=RNA processing
  Homolog annotation: Hit_ID=Q01GI2; Match level="QueryCoverage=71%, HitCoverage=17%, E-value=2e-11, Identity=30%"; Hit description=[S] KOG1972 Uncharacterized conserved protein
  Pfam annotation: Domain name=DUF1740; Domain location=2-168; Score =21.6; E_value=4.2e-09; Accession=PF08424.1; Description=Protein of unknown function (DUF1740)
MGSSTEIAIGVVVLVSMLLASRVPKVEDPVTNPNAYRNVVFTRNFSRFKVSEVRKMYAHAIEDLSASCSKHSRQVLQAANPSSPDPVFVQLELGLVDIFLSLCRFEWQTCYIELATALFQAEIEFSLFCPPLLLTDQSKHRLFEHFLNSDGARVGEEGALGWSTWLDKEEETRQQLMNEELSRENEGGGWTGWSEPWSKDNEGIANVEHETMNDVVMENIQDEEEY

SEQ ID NO: 170340 - protein, 83 aa, Glycine max
  Coding DNA Sequence Number=SeqID_53562
MGVEIFLDFDYGESDKFLEQDWLFMEFYAILKMGVRIFLVFASGFEAVFFGFDLFGKVAQGVAEKKRGRRGPGSVIGSKSKCH

SEQ ID NO: 170341 - protein, 313 aa, Glycine max
  Coding DNA Sequence Number=SeqID_53563
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=50%, HitCoverage=48%, E-value=7e-33, Identity=44%"; Hit description =Similarity to MADS-box DNA-binding protein
  Pfam annotation: Domain name=SRF-TF; Domain location=9-60; Score =38.4; E_value=2.4e-08; Accession=PF00319.9; Description=SRF-type transcription factor (DNA-binding and dimerisation domain)
MAPGKLKLTFIGNDSKRKNVCKKRKQSLLKKTEELSMLCGVEACAIVYGPNDPRPVIWPSEFGVENVLRKFMSMPHWEQSKKMVNQESFIAQSIMKSKEKLQKIVKENKDIEMSLFMAHCFKTGMFQPDINMTTADMNVLASIIEQNLKDIDKRMEMLKANQVIPNQPDVETSTLQPQIMHTLTYQPPMQTFAFQPQIQIPEFQTQIQTPEFPTQTYQSKMQTQTFQPQMQSPALFQPRMQSLAFFQPQIMQTPSYQPQIMQTPSYQPHMQTPALEDMTLLNYGNGSGMQMQQFNGNGYETTMLAFGGANFPL

SEQ ID NO: 170342 - protein, 869 aa, Glycine max
  Coding DNA Sequence Number=SeqID_53564
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=92%, HitCoverage=60%, E-value=1e-125, Identity=33%"; Hit description =Putative retroelement
  Pfam annotation: Domain name=RVP_2; Domain location=311-434; Score= -56.7; E_value=0.026; Accession=PF08284.2; Description=Retroviral aspartyl protease
  Pfam module annotation: Pfam domain module=RVP_2::RVT_1::Retrotrans _gag; Domain location=311-434::451-640::76-161
MAEHGTRPTTTDRLEEAIAALSERHSDLANKFEAWCERLSHLTSASPASSQPSPHPQPPVKLDVPRFDGHDPLGWIFKVSQFFDYQWPLFTSMDQLSAALLQAIEARFAPSFYDDPRGTLFKLVQRGSVTNYLTEFERLANRITGLSPSILLSCFISGLNPKIRREVQAFQPISLPQATALARLQENKLLDRKKHTTRASFGPSLPPNPTVPHTPTQLAPRPRAPFIQRTQEEMAFRREKGLCYNCDEKWSSSHRCKGRVFLLIADPDDPATSEPPSTDYPHFPATEPNPTPDETNPVLDPNAPHPHISLHALAGVPASDTFRLYGLINSARVTILVDSSSTHNFVQPRVAKFLSLPVKETTTLRVMVGNGSVLQCHQSCSDTQVLMQGHTITVTLWVLPLSGADIVLEVEWLHTLGPITTDYSSFTMQFVYNDKPVNLHADVHVDNSPASTTQALQVSALLEDENREASIGVVDFRPHTAKLKPLFISGITGEEERWIVAHDHFPILTIEELLDELGNASWFSKLDLRQGFHQILMANEDIPKIAFRTHHGHFEYRVMPFGLCNAPSTFQAAMNDLLRPFLRKFAAVFFDDILIYSVTLQDHVHHLDSIFSSLSKAKHYLKRSKCLIGERQLDYLGHIVSGDGVRPDPSKIHAIVDWVTPQNPKELRAFLGLTGFNRKFVKGYAAIAALLTKLLCKDVFHWVPESQIAFENLKTAMTTTLVLALPDFTIPFNLETVASNTAMGAVLHQQGHPIAYFSKPFCPRLQQASTYVRELHAIVAAVCKWRPYLLGHRFTIFTDHHSLCELMSQIIQTPEQKFYLAKLLGYDYDIQYKSGASNTVADSLSRRDTSSSSQYMVLSVPHPEFMTQL

SEQ ID NO: 170343 - protein, 65 aa, Glycine max
  Coding DNA Sequence Number=SeqID_53565
  Pfam annotation: Domain name=SRF-TF; Domain location=9-59; Score =31.1; E_value=3.9e-06; Accession=PF00319.9; Description=SRF-type transcription factor (DNA-binding and dimerisation domain)
MGRKKVKLALIANNTKRITTFRKRKKSLMKKAEELNTLCGIEAWNVQPCKNMTTADLNVLSSMIE

SEQ ID NO: 170344 - protein, 91 aa, Glycine max
  Coding DNA Sequence Number=SeqID_53566
  Gene Ontology: Mol. function=adenosylhomocysteinase activity; Biological process=one-carbon compound metabolic process
  Homolog annotation: Hit_ID=O23255; Match level="QueryCoverage=73%, HitCoverage=16%, E-value=7e-12, Identity=51%"; Hit description =Adenosylhomocysteinase 1
  Subcellular localization annotation: CTP_CleavageSite=27; ConfidenceScore=5.65e-01
MALLVEKTTQVVSSTRSMTFPRPRSVSGPATSSPPRTTPPPLLPATEYWWRTERALDWTPTKDPTLLSMTVVTLPSSFTKASRPMSFMRRF

SEQ ID NO: 170345 - protein, 115 aa, Glycine max
  Coding DNA Sequence Number=SeqID_53567
MALKCENKIPVNGAKNLLALWQVYQIARSNNFSAIARGLATHGHECFTMRGGVEVPVHENRVKYRWRCICSGRKLIALEVLGADLDLDEEVVNAEGVKHGATRAVMGGKLRDDGI

SEQ ID NO: 170346 - protein, 69 aa, Glycine max
  Coding DNA Sequence Number=SeqID_53568
MNAATMSDQYFMYSTTLLQQVHFTPVKLIILHRLWIDVVKDIVKRELVFYDGRGRRVITAKCEKGRFNK

SEQ ID NO: 170347 - protein, 94 aa, Glycine max
  Coding DNA Sequence Number=SeqID_53569
  Subcellular localization annotation: CTP_CleavageSite=13; ConfidenceScore=5.39e-01
MKNKIPNLQDGPSSMGDLSPPSPTMTTTTTMITPSPPLLPYLLFSEFPKYSLENRCQRVEVGGHGSSNVMVAARIDILLKPPVPTKSLTHHCHQ

SEQ ID NO: 170348 - protein, 65 aa, Glycine max
  Coding DNA Sequence Number=SeqID_53570
MAPTKESPSNISYCCLSAPMNGGSRSSQVPITWYKIARVLTDKVFTIFMKLCNLKHGYHHCTDLG

SEQ ID NO: 170349 - protein, 54 aa, Glycine max
  Coding DNA Sequence Number=SeqID_53571
MVLNRQLWQSVVFHSFAKCNIQWLSARKNLEEDELSCSLSAPLQSSSAPLQLIR

SEQ ID NO: 170350 - protein, 105 aa, Glycine max
  Coding DNA Sequence Number=SeqID_53572
  Gene Ontology: Mol. function=structural constituent of ribosome; Cellular component=large ribosomal subunit; Biological process =translation
  Homolog annotation: Hit_ID=Q9FLF3; Match level="QueryCoverage=81%, HitCoverage=31%, E-value=6e-26, Identity=69%"; Hit description =Genomic DNA, chromosome 5, P1 clone:MUB3
MAGLLPVSAVVGGSTIKVSRVTVRAKEAVEAAGGSVRRVYYNKLGLKALVKPEWFEKKGRLLPRAARPPPKQKDKVDSIGRLPAPTKPIPFLVEASKDLPVQHLS

SEQ ID NO: 170351 - protein, 606 aa, Glycine max
  Coding DNA Sequence Number=SeqID_53573
  Gene Ontology: Mol. function=nucleic acid binding; Cellular component= nucleus; Biological process=RNA splicing
  Homolog annotation: Hit_ID=Q1SKZ7; Match level="QueryCoverage=67%, HitCoverage=51%, E-value=2e-94, Identity=47%"; Hit description=RNA -binding region RNP-1 (RNA recognition motif); Concanavalin A-like lectin/glucanase; ...
  Homolog annotation: Hit description=U2 auxiliary factor small subunit
  Pfam annotation: Domain name=zf-CCCH; Domain location=226-252; Score =20.1; E_value=0.0029; Accession=PF00642.15; Description=Zinc finger C-x8-C-x5-C-x3-H type (and similar)
  Pfam annotation: Domain name=zf-CCCH; Domain location=388-408; Score =0.5; E_value=1.1; Accession=PF00642.15; Description=Zinc finger C-x8- C-x5-C-x3-H type (and similar)
  Pfam module annotation: Pfam domain module=zf-CCCH::zf-CCCH; Domain location=226-252::388-408
MAVDGDNGRRRPSPSPPPFVNQHNRVSHREDRNGGEGFDGRSKSMSREEKRKAMKKMKRKQARKEASERERREEEERLIDPEEQRQMQLLEQQEAERMQRDMILFQEREKEWMDTVIARKQQQQQHQQQREEEDEDDEFDCVEEEGPPEIIWQGNEIIFKKKQLRVRVTDKDKPKPNETNQNDHQPFIIDYHPLQQEDNRPTSNPLPPDSTLENVAQQIPNFGTEQDKAHCPFHLKTGACCFGIRCSRVHFYPDKSSTFLIKNMYNGPGLACDRDQDEGLEYKDEEVERCFEEFYEDVHTEFLKFGEVVNFKYKSLDSALLAYNSVNGRYFAGKQRKFSSILKAYVRFKVQSEFFQRMVVLVHRCFTIKCRRLELLDVVHMFFSLFSSGYDLWQTCSHGTACNFIHCFRNPGGDYEWADSDKPPPKFWVKKMITLFGFSDDYETSREQGNLSLSKTDSDRKQQDETKHRTPDKDWNANFKRKSRGRTPDSDSDSDWEWLEKEENRERHHVYTLNSRSHEEDSDVEWDSRGGGDASESDKDLLGRGEMETQHDYYSRKRSRHRRRSGLQDEYKYHENENDKVYGDWSRTGSRIILRRLADLSIGGNK

SEQ ID NO: 170352 - protein, 112 aa, Glycine max
  Coding DNA Sequence Number=SeqID_53574
MERSKVVSQQEKENNNKLHRAREKSLYTELILDEEIKEGINSIMGSSIQEVSNEAVSKLSKINTKPLHVATEKKMKKKVATPAKLISQKLFVLVQRRRFYSHHSPLSLYSPT

SEQ ID NO: 170353 - protein, 57 aa, Glycine max
  Coding DNA Sequence Number=SeqID_53575
MIMTGYFRPPLERPPINNVGFQHANPSNMPAHPMSGYGVPQMSCRPDIPALNCWRPT

SEQ ID NO: 170354 - protein, 37 aa, Glycine max
  Coding DNA Sequence Number=SeqID_53576
MNQGARGQVRVDARPAIGMSSPRVRLRMINKHYWEAA

SEQ ID NO: 170355 - protein, 109 aa, Glycine max
  Coding DNA Sequence Number=SeqID_53577
MALKKLSTKRSRKDATGEGSSAALEFDSHRNGAYKAPSGPREVQQGPGIFGFDHGPLPVLWSSCHPQQGCGRTATTSAGRFGWVTERGEVSIAFGSPAGGQPPWTGADT

SEQ ID NO: 170356 - protein, 91 aa, Glycine max
  Coding DNA Sequence Number=SeqID_53578
  Gene Ontology: Mol. function=translation elongation factor activity; Cellular component=cytoplasm; Biological process=translational elongation
  Homolog annotation: Hit_ID=P13905; Match level="QueryCoverage=98%, HitCoverage=22%, E-value=6e-37, Identity=93%"; Hit description =Elongation factor 1-alpha
  Pfam annotation: Domain name=GTP_EFTU_D3; Domain location=1-75; Score= 58.0; E_value=3e-14; Accession=PF03143.7; Description=Elongation factor Tu C-terminal domain
MVMLLFLTATLLTLLSSKEIEKEPKFLKNGDAGYVKMIPTKPMVVETFSEYPPLGRFSVRDMRQTVAVGVIKSVEKKDPTGAKVTKAAEKK

SEQ ID NO: 170357 - protein, 55 aa, Glycine max
  Coding DNA Sequence Number=SeqID_53579
  Homolog annotation: Hit_ID=Q2HV31; Match level="QueryCoverage=100%, HitCoverage=9%, E-value=2e-10, Identity=66%"; Hit description =Prefoldin
MSFRIRDQERGTDSPREAGEIDTRAPFQSVKAAVSLFGEVAVSKEKHSIKRRSSE

SEQ ID NO: 170358 - protein, 309 aa, Glycine max
  Coding DNA Sequence Number=SeqID_53580
  Gene Ontology: Mol. function=transporter activity; Cellular component= intracellular; Biological process=transport
  Homolog annotation: Hit_ID=Q2HV32; Match level="QueryCoverage=99%, HitCoverage=98%, E-value=1e-137, Identity=76%"; Hit description =Cellular retinaldehyde binding/alpha-tocopherol transport; Cellular ...
  Homolog annotation: Hit description=retinaldehyde-binding/triple function, N-terminal
  Pfam annotation: Domain name=CRAL_TRIO; Domain location=82-259; Score= 21.7; E_value=1.8e-07; Accession=PF00650.10; Description=CRALTRIO domain
  Pfam annotation: Domain name=CRAL_TRIO_N; Domain location=2-72; Score= 20.1; E_value=0.00022; Accession=PF03765.5; Description=CRALTRIO, N -terminus
  Pfam module annotation: Pfam domain module=CRAL_TRIO::CRAL_TRIO_N; Domain location=82-259::2-72
MGLVSQDALNQLQALMDQVLLEEEPLQRTFQNVHQGCVTETLTRFLKAREWNATKAHKMIVDCLKWRVQNEIDNILSKPIIPTDLYRGIRDSQLIGLSGYSREGLPVFAIGVGLSTFDKASPSASKKHERPITTCVKILDMTGLKLSALNQIKLLTIISSIDDLNYPEKTNTYYIVNAPYIFSACWKVVKPLLQERTRRKVQVLQGCGRDELLKIMDYASLPHFCRREGSGSSRHSGNGNENCYSLDHPFHQQLYNYIKEKSRIHEAVEPIKQGSFHVDFPEPPAEKAEIVKTLESELHKFKISNVNGD

SEQ ID NO: 170359 - protein, 522 aa, Glycine max
  Coding DNA Sequence Number=SeqID_53581
  Gene Ontology: Mol. function=actin binding; Cellular component=proton- transporting two-sector ATPase complex; Biological process=protein modification process
  Homolog annotation: Hit_ID=Q2HV31; Match level="QueryCoverage=99%, HitCoverage=90%, E-value=1e-174, Identity=66%"; Hit description =Prefoldin
  Pfam annotation: Domain name=DUF827; Domain location=1-481; Score =292.9; E_value=5.9e-85; Accession=PF05701.2; Description=Plant protein of unknown function (DUF827)
  Pfam annotation: Domain name=Pox_A_type_inc; Domain location=261-283; Score=2.4; E_value=37; Accession=PF04508.3; Description=Viral A-type inclusion protein repeat
  Pfam annotation: Domain name=Pox_A_type_inc; Domain location=35-57; Score=11.6; E_value=1.6; Accession=PF04508.3; Description=Viral A -type inclusion protein repeat
  Pfam annotation: Domain name=Pox_A_type_inc; Domain location=357-379; Score=2.6; E_value=34; Accession=PF04508.3; Description=Viral A-type inclusion protein repeat
  Pfam annotation: Domain name=Pox_A_type_inc; Domain location=91-113; Score=2.7; E_value=33; Accession=PF04508.3; Description=Viral A-type inclusion protein repeat
  Pfam annotation: Domain name=Prefoldin_2; Domain location=229-316; Score=-9.1; E_value=0.092; Accession=PF01920.10; Description =Prefoldin subunit
  Pfam module annotation: Pfam domain module=DUF827::Pox_A_type _inc::Pox_A_type_inc::Pox_A_type_inc::Pox_A_type_inc::Prefoldin_2; Domain location=1-481::261-283::35-57::357-379::91-113::229-316
NVLEKETQLLLAQRELNKIKKQLESAENTRSKTLSELDKAKVTLQELTKKLNSVRESKQSAIEAAEAVKNQAKELEQALSQKAIGYEAWKQELEHARKEYKTTVKELDASKQELNKIRQDFDIALEAKLAAFQTAGEAQRSAKLNSEKLHELKNQIATMKEQIEHLKLASSQAEEDQAKIMREREAQQSFYENAKEEAQNKLITLKNEYEPELTQSLEAKLAETSEEIQVLQEQMKEAHASEMDSVRRITLEIKEATKTLQEVAEEENSLRNLVDSLSTELEQVKKEQEELKEKEKAAEALAVDLTDQLQSKPGDTMEKESDKIDEIELKIKHLSFETETARREEEEMRSKTQELKQEAEKSKAVAEELEKKLELYLKQAEGAKASEQRAIEEMKMMSDSDNNTQDTVSVADSNGKIVLTVDEFAALSGKIKESEDMIDRTETAAMAQVEAINTRRNEVDRKVEANLKAIEEIKAATDMALRNAEMADSAKVAVEGELRKWRQEEQNMDYSDNSSRPISLRI

SEQ ID NO: 170360 - protein, 268 aa, Glycine max
  Coding DNA Sequence Number=SeqID_53582
  Homolog annotation: Hit_ID=Q9FIK5; Match level="QueryCoverage=26%, HitCoverage=41%, E-value=4e-10, Identity=42%"; Hit description =Arabidopsis thaliana genomic DNA, chromosome 5, P1 clone:MCA23
MTQVYVTYGWAANVFKVVLIVNKNCRLKSINYERCEVFASDFSLLCTLHSEGNIVPKLNRWTCNIVGKTAGVNLIGKPSEDSEELFEINLKEPYLDTISEENFESSVFLSDIHINDKDVVHVAVDHVGESSMEALLWTLNHALTPSTTVKVEIILTEGDNIAKTITDNVRDHSIRKLVIGITKSNLSKSVSRRRNAIADKALKNAPEICDIKIICDGKEVIDQMIGCNSSCSSDCNSSRVSPEENESCGFVPLMCFVPNPIWLFRPRF

SEQ ID NO: 170361 - protein, 109 aa, Glycine max
  Coding DNA Sequence Number=SeqID_53583
MQSMIRLVKLNSAGTPTRQESTQKHKNSLRVGLGRPREESEGRERDQDGKRVKLEGVMEETEVGEEKNWKRGKYEENKRVPNLKDQNTASLLLQRERDTVDRELLVLVA

SEQ ID NO: 170362 - protein, 115 aa, Glycine max
  Coding DNA Sequence Number=SeqID_53584
  Gene Ontology: Mol. function=RNA-directed DNA polymerase activity; Cellular component=mitochondrion; Biological process=DNA integration
  Homolog annotation: Hit_ID=Q1ST43; Match level="QueryCoverage=77%, HitCoverage=6%, E-value=2e-21, Identity=56%"; Hit description =Integrase, catalytic region; Peptidase aspartic, catalytic
MAIVRVVLALASINQWHLHQLDVSNAFLHGDLREDVYMEIPPGLLGYTSSQSCKMKKSRYGLKQSSRQWHSIIGYFFFIVMQSYPLRVLDRRLQEDWARTAKEGLGVLMNLRIDF

SEQ ID NO: 170363 - protein, 105 aa, Glycine max
  Coding DNA Sequence Number=SeqID_53585
MTDRLEDATARLSNNQASLTSKYSELSGKVDSILDHLRLRETNHNHSNSSAQFNHRNLVKLDIPRFNGVEAMTSKIILMMPKNQELSKFQRIRSQKASRIKIQEQ

SEQ ID NO: 170364 - protein, 478 aa, Glycine max
  Coding DNA Sequence Number=SeqID_53586
  Gene Ontology: Mol. function=metal ion binding; Cellular component =integral to membrane; Biological process=ubiquitin cycle
  Homolog annotation: Hit_ID=Q5XF85; Match level="QueryCoverage=58%, HitCoverage=76%, E-value=2e-50, Identity=37%"; Hit description=RING -H2 finger protein ATL4J precursor
  Pfam annotation: Domain name=zf-C3HC4; Domain location=136-177; Score= 31.3; E_value=3.3e-06; Accession=PF00097.15; Description=Zinc finger, C3HC4 type (RING finger)
MANCNIICNYPFKNHLPVFINMMVLSFISNVQAQDSTDTDTLPADFPQPVRPSKVVVIVALSILFTFSFLLLLYIRFRRITPLELIQRSSHHSPNFQATTRSNSRSRLSGIDRQVIEALPFFRFSSLKGSKQGLECTVCLSQFEDTEILRLLPKCKHTFHMNCIDKWLESHSSCPLCRNSIDPLDIKNFTYSISSRSLRVPSNLTEDTNLEIFVHRESSSRFNMGSRFWNLGRNNKEERLLDQQVDGKHMHKFNHKIVVSDVVTRSRWSDLNSSDMLSLNSEMLLDMSSRRFSPSNEMIRGDSSLPFIFNDDESSFTLLNTAEKRSMSEIARVPRFIETCKQNRTEAGVASSGSNEREERLRRIWLGIAQRTVQCGAGKRHKWNKAEVDPVRIKRLTWGIETGSGPFATFAHSMPRTASVPLIGSRWKVTLKGGGGGIEKKVEELGDAGLEKIVGADAINEDSEASMVDDAKETESFR

SEQ ID NO: 170365 - protein, 152 aa, Glycine max
  Coding DNA Sequence Number=SeqID_53587
MWGTLVVIYKGRSQVKSNKLSLLTCKYGLFSMEESKDIQSRHFKFECPKLEKGRDEKKYFKIKEKRGLMSSWEDLNDTSYDEDGEEANICLMADTNSEESKSDKEDEGQVKISLNISTQTCGACTNLKEEESELCLEIETISREKATLHKNF

SEQ ID NO: 170366 - protein, 94 aa, Glycine max
  Coding DNA Sequence Number=SeqID_53588
  Homolog annotation: Hit_ID=Q1RVN6; Match level="QueryCoverage=62%, HitCoverage=7%, E-value=3e-08, Identity=46%"; Hit description =Integrase, catalytic region
MDIMCPSRKISMLFYAKIGLPYSLPREKATSTKSDWENSQIKRCHAYCLLKKIIGYGIENIDLQVRGVEGRSPRYEEPRDLKSNPFQGGGNLGI

SEQ ID NO: 170367 - protein, 75 aa, Glycine max
  Coding DNA Sequence Number=SeqID_53589
MKMKTNKTRNELKVSDSNTCRLKTEEQTKNGRRTTENLHGFAHGNVSKALWKYLSLELLQGNTFFFHPKQLKCIA

SEQ ID NO: 170368 - protein, 42 aa, Glycine max
  Coding DNA Sequence Number=SeqID_53590
MEEAGLSRDWLIAQTQSEPPLDLHKMMAQTWIQEPVGSQTSR

SEQ ID NO: 170369 - protein, 221 aa, Glycine max
  Coding DNA Sequence Number=SeqID_53591
  Gene Ontology: Mol. function=DNA binding; Cellular component=oxygen evolving complex; Biological process=DNA integration
  Homolog annotation: Hit_ID=Q1SA33; Match level="QueryCoverage=72%, HitCoverage=15%, E-value=4e-51, Identity=59%"; Hit description =Integrase, catalytic region
MSVMGELKLYLGLKIKQTPKGIYIHQTKYVKELLKKFNMKEAKDMKTPMHPTTYLGLDEESTKVDRTQYRTMIGLLLYLAASRLNVMFSVCLCARFQKEQREVHLTVVKRIFRYLIRTSNLGLLFKRRESFRLIIYNDVDYVGDKVERKSVSGSCQLIGGKLSHVDMPCIRQIVGSLLNFLNMDIYRKESRGAQKFAQTNCSSPKRICDLVLKAPIPPGEL

SEQ ID NO: 170370 - protein, 237 aa, Glycine max
  Coding DNA Sequence Number=SeqID_53592
MVKFDLEIVMEFYANAWPTEEGVRDKRSWVTGQWIPFNEDAINQFLGNLLVLEEGQRCEFSQRRSQASGFDKEAISHLLCVPGQDFARSVEGRRLHSPQQPQFRPPPAKVSAGLRNHDSGLCQFYEVSVAPTKLIRSPISRAFIEKYCVPKQVQGQAPQQPEKDQQQPVVDAPPPLLNESQDPIPFPWPTPEQFKAMVAWPGDKIDLETRSEPAGGPGDDRGAQEDDDMADVLDFFT

SEQ ID NO: 170371 - protein, 221 aa, Glycine max
  Coding DNA Sequence Number=SeqID_53593
MSLKLPVYSELVKAFYSNLEIQESTLISKVFGIKMIVDQSLLYDLTQLSSDGVPFEGTLNDDWKFDFSLHDARRLVCTNQADLTGRLLAGSLALESRILHYLIVRMLLPRSSNLAQRSFLIGAAVIASFGYRKEHDGSWAKKGAQPIDDEGHLPVGEDSSLLQKFLDRFDGLQTYVGERFDALELQVDMRFDEMDSRITKVEGDVTCIRICFDLPPPPPSS

SEQ ID NO: 170372 - protein, 95 aa, Glycine max
  Coding DNA Sequence Number=SeqID_53594
  Gene Ontology: Mol. function=ribonuclease H activity; Biological process=DNA integration
MGAVEATNKNIKKIVQKMIVSYKDWHEVLPFVLHVYGTEAVLPFEVEVPSLRILAESRLKESEWAQACFDQLNLIEEYTLSILSPESFGSVNGVP

SEQ ID NO: 170373 - protein, 69 aa, Glycine max
  Coding DNA Sequence Number=SeqID_53595
MVGYAPSSFSDLVFTDKRIKVGMERGKYDHPALMNAKTGANEEGENEGETHAAIVIPTWPNFPPAQQCQ

SEQ ID NO: 170374 - protein, 201 aa, Glycine max
  Coding DNA Sequence Number=SeqID_53596
  Gene Ontology: Mol. function=oxidoreductase activity; Biological process=electron transport
  Homolog annotation: Hit_ID=Q97UH0; Match level="QueryCoverage=99%, HitCoverage=57%, E-value=3e-93, Identity=84%"; Hit description =Dehydrogenase, putative
MATTLAGAREMVSRAERNEVKLGVIFQERYAPDIRRLKNDILKELGRIYLIESELKWYRDMKGYYKRDEIARSWRGMWNTEGGGVMTNQVEEVSGFVDNLTHDGIEVEDTAVAIMRYKNGALGTISQTVSMKPTTYQYRKIRVNGSNGFVEITDGSLSTVAIEGKIEESKSSVEYKKETIAQPGNLHKEFAQRFPKGSIRG

SEQ ID NO: 170375 - protein, 132 aa, Glycine max
  Coding DNA Sequence Number=SeqID_53597
MVMGDFISRLSFPENTETFSSLTSYPELRRSEFLIGGYVGARASLLSTTPPFVAMTQELVARGDTLRLSAPRHSVTPSVIDEQRSMWSSAPFPEMSAFSDGDFSSLTSYPELRRSDFLIGGYVGARALLIGE

SEQ ID NO: 170376 - protein, 78 aa, Glycine max
  Coding DNA Sequence Number=SeqID_53598
MELLKERRERERERNITLPNDSEFFPHLGTLGWYDMWNCSPDLAALVDTLQNQLEERAERMRIWSGQDIGVDKIVASA

SEQ ID NO: 170377 - protein, 101 aa, Glycine max
  Coding DNA Sequence Number=SeqID_53599
  Subcellular localization annotation: CTP_CleavageSite=83; ConfidenceScore=5.08e-01
MMRQEESGSGLLSLWWLRFHSLFDLTLRQSHLPHPLSTSFSPTSLPPTTIFSSSIIDDGRSHNCMGTTRHVGMITTTTERKCMSSHEVRMVPERSRWWRAA

SEQ ID NO: 170378 - protein, 187 aa, Glycine max
  Coding DNA Sequence Number=SeqID_53600
  Gene Ontology: Mol. function=RNA-directed DNA polymerase activity; Biological process=RNA-dependent DNA replication
  Homolog annotation: Hit_ID=Q1SQP0; Match level="QueryCoverage=72%, HitCoverage=24%, E-value=5e-11, Identity=53%"; Hit description=RNA -directed DNA polymerase
MGRLSFNEKRVRWIKGGIESATISILVNRSPTNEFKAQRGLRQEILFHHSFLVGSRRVKWVDEASKETKCFQWVLGFSIGVNHSRASMWEPIVQKFKNMLSTWEQRTLSIGGRGNGDGGYIVVIIAFGNKCYVLNIAKMGNYNLKDRYGRVSMNSNQTVEMIGVMGSWVGGSWEWNFHWRRPWFQWG

SEQ ID NO: 170379 - protein, 64 aa, Glycine max
  Coding DNA Sequence Number=SeqID_53601
MTYSDQTAETKQHKRTSSHCRSDTKRCKHEPEVNFVFLDPYSLKIDEIRIERGRKMDQIQKTNF

SEQ ID NO: 170380 - protein, 351 aa, Glycine max
  Coding DNA Sequence Number=SeqID_53602
  Gene Ontology: Mol. function=RNA-directed DNA polymerase activity; Biological process=RNA-dependent DNA replication
  Subcellular localization annotation: CTP_CleavageSite=57; ConfidenceScore=5.42e-01
THLLLEVASPLSLPSPFRCHSSSKKKSNPLMKKILGLQAPMELTSLPSSSLHSTIVIAFAPGEVALTEGGHQVHVASGLESLTCKAKELIRVRDIYGTALVDKDPGHHEVCNDHRDDHGVVLDDGVDAFEWCIDKVNINVSNGMAMAFSGLAGLSSIGKFARDGVDYTSNVLGGSYAAPLGVLWVLSFLVDHGVQCNLGVNILDLDSCAPKSIHELSERLIIYLSQTGQGGRGHGVRLVGGVLRTKSFNEGVEAIYGFGWESIVLGQCCPLEGRREDTTKNHVVTGVEVEWFPPQGYVCLYNAIDKGMPIDGLPYWTARCGQIAHRPRDSVCVSHSSQMRMGVFEGGLAFE

SEQ ID NO: 170381 - protein, 873 aa, Glycine max
  Coding DNA Sequence Number=SeqID_53603
  Gene Ontology: Biological process=pollen maturation
  Homolog annotation: Hit_ID=Q5Z6I4; Match level="QueryCoverage=88%, HitCoverage=75%, E-value=0.0, Identity=62%"; Hit description =Putative Osnop
  Pfam annotation: Domain name=C2; Domain location=409-491; Score=73.5; E_value=6.6e-19; Accession=PF00168.20; Description=C2 domain
  Pfam annotation: Domain name=GRAM; Domain location=560-626; Score =85.8; E_value=1.3e-22; Accession=PF02893.10; Description=GRAM domain
  Pfam module annotation: Pfam domain module=C2::GRAM; Domain location =409-491::560-626
  Subcellular localization annotation: CTP_CleavageSite=21; ConfidenceScore=5.07e-01
MESNGSGDLLLHPRMTESPTRSSTGPSNSSSPVREEITSAKDEKSSTQKTITGRIAQIFSKSSDMSSTASRRSIDLDQSESSKVEVSEMKAEDQSSNETFEEAMRKLQSADQGSEIPSNLPAGVFIDQQYVIAPEDLNELLFSSDSNFLKSLAEVQGNTELEIGPWKFENDGEIFKRLVTYLKAPSKLIKAVKAYEEHTYLKADGKNFAVLVSVSTPDVMYGSTFRVEVLYVITPGPEFPTGEQCSRLVVSWRMNFLQSTMMKGMIENGARQGMKDSFDQYATLLSQTVKTADVKDLSSNKEQALASLHAEPESDWRLAVRYFANFTVFTTVFMGLYVIVHIWLAAPSTIQGLEFGGLDLPDSIGEFVVCAILVLQGERMLGIISRFIKARAQKGSDHGIKAQGDGWLLTVALIEGSSLASVDSSGLSDPYVVFTCNGKTRTSSIKFQKSNPTWNEIFEFDAMDDPPSVLDVVVYDFDGPFDEAASLGHAEINFLKANIADLADIWVPLEGKLALACQSKLHLRIFLDNTRGGNVAKDYLSRMEKEVGKKINLRSPQTNSAFQKLFGLPPEEFLINDFTCHLKRKMPLQGRLFLSARIIGFHANLFGNKTKFFFLWEDIEEIQVIPPTFSSMGSPIIVITLRKGRGVDARHGAKTQDEQGRLKFHFQSFVSFNVAHRTIMALWKARSLSPEQKVEFVEEQSDSKSLISEESGSFLGLDDASYLMEIFSGGELDRRVMEKLGYLNYSYTPWVSENHDISERAVYYKFEKRISSYKGEVTSTQQRSPLADGKGWLVEELMNLHGVPLGDYFNIHLRYQIEDLPPKAKGCRVQVLFGMEWLKSSKNQKRLTKNILENLLERFKVTFSLAEKELLPK

SEQ ID NO: 170382 - protein, 141 aa, Glycine max
  Coding DNA Sequence Number=SeqID_53604
  Homolog annotation: Hit_ID=Q1RSY3; Match level="QueryCoverage=41%, HitCoverage=9%, E-value=5e-08, Identity=47%"; Hit description =Protein kinase
  Pfam annotation: Domain name=LRRNT_2; Domain location=29-70; Score =23.5; E_value=0.00076; Accession=PF08263.3; Description=Leucine rich repeat N-terminal domain
MKPMPTTRNLNVLLIFWSLFSLFMAGYGAESDIYCLQTIKKLDRFNNLPSWDFESNTEGDICKFNGVECWNQHDVEDRVISLLLSTTTVLLAFMYYYEPWTEFKKRSNAIHPLRKKQNHQKETRQKAELLPLALQDQGSKE

SEQ ID NO: 170383 - protein, 60 aa, Glycine max
  Coding DNA Sequence Number=SeqID_53605
MKARQPLLIRTDRRDEGRQGDFPLPAPSSLSGDRSPVLSAGEYAQEDPTLTDNDSPYRSS

SEQ ID NO: 170384 - protein, 675 aa, Glycine max
  Coding DNA Sequence Number=SeqID_53606
  Gene Ontology: Mol. function=transmembrane receptor activity; Cellular component=membrane; Biological process=defense response
  Homolog annotation: Hit_ID=Q1SI46; Match level="QueryCoverage=96%, HitCoverage=66%, E-value=1e-151, Identity=46%"; Hit description =Leucine Rich Repeat, putative
  Pfam annotation: Domain name=LRR_1; Domain location=27-43; Score=3.2; E_value=72; Accession=PF00560.23; Description=Leucine Rich Repeat
  Pfam annotation: Domain name=LRR_1; Domain location=419-440; Score =8.8; E_value=6.5; Accession=PF00560.23; Description=Leucine Rich Repeat
  Pfam annotation: Domain name=LRR_1; Domain location=442-463; Score =5.1; E_value=31; Accession=PF00560.23; Description=Leucine Rich Repeat
  Pfam annotation: Domain name=LRR_1; Domain location=465-487; Score =11.8; E_value=1.8; Accession=PF00560.23; Description=Leucine Rich Repeat
  Pfam annotation: Domain name=LRR_1; Domain location=552-573; Score =3.1; E_value=76; Accession=PF00560.23; Description=Leucine Rich Repeat
  Pfam annotation: Domain name=LRR_3; Domain location=419-438; Score =30.5; E_value=6.1e-06; Accession=PF07725.3; Description=Leucine Rich Repeat
  Pfam annotation: Domain name=NACHT; Domain location=65-219; Score= -3.2; E_value=0.0001; Accession=PF05729.3; Description=NACHT domain
  Pfam annotation: Domain name=NB-ARC; Domain location=27-321; Score =125.1; E_value=2e-34; Accession=PF00931.13; Description=NB-ARC domain
  Pfam module annotation: Pfam domain module=LRR_1::LRR_1::LRR_1::LRR _1::LRR_1::LRR_3::NACHT::NB-ARC; Domain location=27-43::419-440::442 -463::465-487::552-573::419-438::65-219::27-321
MFFYFQSLILLYRTEVELLGEIINIVNLELMRLDKNPVSLKGLIGIDRSIQYLESMLQHESSNVRVIGIWGMGGIGKTTIAQEILNKLCSGYDGYCFFVNVKEEIRRHGIITLKEIFFSTLLQENVKMITANGLPNYIKRKIGRMKVLIVLDDVNDSDLLEKLFGNHDWFGPGSRIILTTRDKQVLIANKVHVDDIYQVGVLNPSEALELFILHAFNQKHFDMEYYKLSKRVVCYAKGIPLVLKVLGGLLCGKDKEVWESQLDKLKNMPNTDVYNAMRLSYDDLDRKEQKIFLDLACFFIGLDVKVDLIKVLLKDNERDNSVVVGLERLKDKSLITISKYNIVYMHDIIQEMGWEIVRQESIEDPGSRSRLWDADDIYEVLKNNKGTESIRSIRADLSAIRELKYFPLKSLPENFSAKNLVLLDLSYSRVEKLWDGVQNLKNLKEVKVSGSKNLKELPNLSEATNLEVLDISACPQLASVIPSIFSLNKLKIMKLNYQSFTQMIIDNHTSSISFFTLQGSTKQKKLISVTSEELISCVCYKEKPSSFVCQSKLEMFRITESDMGRLPSSFMNLRRQRYLRVLDPRELLMIESGSVDVIDCKSLKDVLVLVEQFRYNSSDVDIQNYQGLIEESVVVALDAISSTVETVFDHSELIDDKILIHIDEEKLNPSKIIDE

SEQ ID NO: 170385 - protein, 49 aa, Glycine max
  Coding DNA Sequence Number=SeqID_53607
MRTVVSANADNTKVHPPTSKNMVYYPQVLNNHPGIQNLIMCPASSLKGN

SEQ ID NO: 170386 - protein, 231 aa, Glycine max
  Coding DNA Sequence Number=SeqID_53608
  Gene Ontology: Mol. function=DNA-directed RNA polymerase activity; Biological process=transcription
  Homolog annotation: Hit_ID=O48890; Match level="QueryCoverage=43%, HitCoverage=81%, E-value=6e-11, Identity=36%"; Hit description=15.9 kDa subunit of RNA polymerase II
  Pfam annotation: Domain name=RNA_pol_Rpb4; Domain location=65-164; Score=-8.3; E_value=0.092; Accession=PF03874.6; Description=RNA polymerase Rpb4
  Subcellular localization annotation: CTP_CleavageSite=49; ConfidenceScore=5.15e-01
MEKGGKGASLFSKGGLGSLKGKDDIATKSAKGRRVQFSTDGPLFESGVSSNSATSLKSGGKELPENIKCLMDCEAVDILQGIQERMVMLSRDSTVKMPISFDKGLQYAKSNSNRLAKCGVTDSEICVIGNVCPETIDEVFALLPSLKLSTYLNILKHMYHDRRNIDSQVLKDSLSELAKFRQTIVQILFISYLAVQIVDDNLMNFACTRPWLDLVYGNGTGKLGECKRRYM

SEQ ID NO: 170387 - protein, 392 aa, Glycine max
  Coding DNA Sequence Number=SeqID_53609
  Gene Ontology: Mol. function=hydrolase activity, hydrolyzing O -glycosyl compounds; Cellular component=anchored to membrane; Biological process=carbohydrate metabolic process
  Homolog annotation: Hit_ID=O23562; Match level="QueryCoverage=88%, HitCoverage=67%, E-value=1e-153, Identity=74%"; Hit description =Glucanase like protein
  Pfam annotation: Domain name=Glyco_hydro_17; Domain location=1-251; Score=80.7; E_value=4.7e-21; Accession=PF00332.9; Description =Glycosyl hydrolases family 17
  Pfam annotation: Domain name=X8; Domain location=270-352; Score =137.9; E_value=2.8e-38; Accession=PF07983.3; Description=X8 domain
  Pfam module annotation: Pfam domain module=Glyco_hydro_17::X8; Domain location=1-251::270-352
MEAKVSVFIITLVTASMLIHRFLLAFNLCTFYNGQYQNLIMPAILNIQQSLVKANLAGYIKLVVPCNADAYQSSALPSQGAFRPELTQIMSQLVQFLNSNGSPFVVNIYPFLSLYNNGDFPQEYAFFEGTTHAVQDGSNVYTNAFEGNYDTLVAALTKLGYGQMPIVIGEIGWPSDGAIGANITAAKVFNQGLINHIASNKGTPLRPNAPPTDVYLFSLLDEGAKSTLPGNFERHWGIFSFDGQAKYPLNLLLGNKELKNARNVEYLPSRWCVANPSGDLNDVVNHIRLACSVADCTTLNYGGSCNEIGEKGNISYAFNSYYQLQMQDSRSCNFDGLGMVTFLDPSVGDCHFLVGVTDKGSDSSTSQTMAPSHQWWTLVLLLILHGTFLLSM

SEQ ID NO: 170388 - protein, 105 aa, Glycine max
  Coding DNA Sequence Number=SeqID_53610
MFQAMPANPIGQSTGEKKQHRHGYQTDCSGSRKKCHSSYKPTTYFSEPVGIKGSRACLYTNSRKREMCKVALVSYGLVDDSRKLLSYISLLDSSGASPIILRGPK

SEQ ID NO: 170389 - protein, 125 aa, Glycine max
  Coding DNA Sequence Number=SeqID_53611
MDACKAQMGCELVRQNIRRTASKSIVELQNKDEDSKSSIKVEGAEGSADEKESDDKGSKLRKSALKRLEKGIEESLLSQATIKGYFPLGGWGGRKEQDVLNAMGSMYVVVTSIGVINGSSVQPSN

SEQ ID NO: 170390 - protein, 82 aa, Glycine max
  Coding DNA Sequence Number=SeqID_53612
  Gene Ontology: Mol. function=oxidoreductase activity, acting on the CH-OH group of donors, NAD or NADP as acceptor; Biological process =electron transport
  Homolog annotation: Hit_ID=Q46LS4; Match level="QueryCoverage=65%, HitCoverage=13%, E-value=4e-09, Identity=60%"; Hit description=UDP -glucose 6-dehydrogenase
MEKRARKGTQRRRKHERVNGEEGSASEIGRVKYNLKWHTNLWSAELFKLADNAFLAQRISYINAMSAFCEATGPKFHKFLML

SEQ ID NO: 170391 - protein, 126 aa, Glycine max
  Coding DNA Sequence Number=SeqID_53613
MHKCYKDYKVDHSKAEVEDKNSENNNDWGLTGGVWPKKLGLTGGGSKEAIIQKFQQMEERDRVQVEAKSLLKERNSENNNKWGTKSLLKERKAELDHSKTKAKGEEDPKKASTRTPMDKPTSTTTK

SEQ ID NO: 170392 - protein, 219 aa, Glycine max
  Coding DNA Sequence Number=SeqID_53614
  Gene Ontology: Mol. function=DNA binding
  Homolog annotation: Hit_ID=Q1SWX1; Match level="QueryCoverage=94%, HitCoverage=39%, E-value=4e-19, Identity=31%"; Hit description=IMP dehydrogenase/GMP reductase
MGTNQIGKRFYQVKIKGLDVTSLKELGRLMGPLQRQAFRKAYEKILDLTIAEVFTEAVVSLTQYYDQPLRCFTFGNFQIVSTVEEFEEILGCPLGRRKPYLFSGFLPSLSKIAAVVGDLARELDRIKQTRNGVVGLPQKYLEGKARDMANQEEWVPFADVLALLISGVVLFPNMDSLVDLVAIDAFLAYHHRKESPMVAILADLFDTFDRRCEKNNARI

SEQ ID NO: 170393 - protein, 272 aa, Glycine max
  Coding DNA Sequence Number=SeqID_53615
  Homolog annotation: Hit_ID=Q1STZ2; Match level="QueryCoverage=47%, HitCoverage=33%, E-value=1e-09, Identity=32%"; Hit description=IMP dehydrogenase/GMP reductase
DFQLVPTVKEFEEILGCLLGGRKPYLFSGFYPSSTRVAKVVKISAQELDRANGLSFIDILALLIFGVVLFPNMEGLVDLVVIDAFLAFQHGKESPVVAILAMYDTIDRGCEKSGARIVCCALALYVWLVSHPFLQEGRPVYPLQGHRSCVEKGKANWDQLLANMEGRLLIGSLARRKEESGFYLHAKDECHQTKASRLSSHGVLVTTTRGYSKEFARHGMRREERIESLGEATVRDDEVKASEESDEVQALKAELERARVVEEKFKSIAIKV

SEQ ID NO: 170394 - protein, 88 aa, Glycine max
  Coding DNA Sequence Number=SeqID_53616
  Subcellular localization annotation: CTP_CleavageSite=79; ConfidenceScore=5.65e-01
MAMDLNFSSTTRALSSSAFRACTSSLSSEALTSSSLTPLMIAADDPITASPKLSILSSRRIPCLANSLEYPRVVVTKTPCDERRDAFV

SEQ ID NO: 170395 - protein, 68 aa, Glycine max
  Coding DNA Sequence Number=SeqID_53617
MPKDRGTCLDFRDCHHQKWGDCRQRIKLNVLIMPKVHMRDDAKVHMRLKALFKTKQSKIFKMDDQDSL

SEQ ID NO: 170396 - protein, 431 aa, Glycine max
  Coding DNA Sequence Number=SeqID_53618
  Gene Ontology: Mol. function=DNA binding
  Homolog annotation: Hit_ID=Q1RUD8; Match level="QueryCoverage=87%, HitCoverage=75%, E-value=7e-42, Identity=31%"; Hit description=IMP dehydrogenase/GMP reductase
MGSNQAPLSKKRFYQVKIKSLEVASLQELGQLMDQLQLQAFRKTYGKIWDLAMIEVSIEAIASLTQYYDQPLRCFMFGDFQLVLTMEEFEEILGCPLGERKPYLFSGFYPSMARIAKVVKISAQELDRVKQNNNGIVKIPRKHLEEKAKALVDQGEWDSFIDVLELLVFGIVLFPNVDGLVDLVAIDAFLAYHHSKESPVVAVLVDAYDIFDRRCKKSGARIVCCTPVLYVWLVSHLFHHESRPVCPLQGHCLYAEKGKENWERLLASMIGAFINWFPRWKEGRTRFLSSCEGFSNVPLMGTRGCINYNPVLAIRQLGYPMRGALSEESIVPFIAWGFSNPNARILQGVHKAWSTVQRKDKELRGSNNGIIGSYHKWLKAWTQELDWLLKLKVSSEEEAETPEESEEVKALKAKLERAQAVKEKFKTTTIM

SEQ ID NO: 170397 - protein, 175 aa, Glycine max
  Coding DNA Sequence Number=SeqID_53619
  Gene Ontology: Mol. function=aspartic-type endopeptidase activity; Cellular component=lysosome; Biological process=sphingolipid metabolic process
  Homolog annotation: Hit_ID=Q94IA2; Match level="QueryCoverage=64%, HitCoverage=22%, E-value=2e-52, Identity=90%"; Hit description =Aspartic proteinase 1
  Pfam annotation: Domain name=SapB_1; Domain location=103-141; Score =65.0; E_value=2.5e-16; Accession=PF05184.5; Description=Saposin-like type B, region 1
SHWFSIVFMLAFKVVVMVLRFELEGGSDGVGVVGEGWDWSTGVGGLGGGVTTRWWCRVWGMDTAEEDLFPNWIVCFDGTRGVDVGIKSVVDENERKSSGDHHGAACPACEMAIVWMQNQLSRNQTQDQILSYINQLCDKMPSPMGESAVDCANISSLPVVSFTIGGRTFELIPEE

SEQ ID NO: 170398 - protein, 299 aa, Glycine max
  Coding DNA Sequence Number=SeqID_53620
  Gene Ontology: Mol. function=nucleic acid binding; Biological process= DNA integration
  Subcellular localization annotation: CTP_CleavageSite=43; ConfidenceScore=5.11e-01
MASDQHNTFHKEGGGKSTCSRSRKGPKKPPQRGLGVAQLERLRLQESWKKMNEGSSSGGGVLQHPPRLFRADNVVINNAVFANLLNPYYTHPNENPGVAIVAQVLNGANYHSWSRAMLLALKTKKKVQFVDSSLPCPAVNDPNFTIWDHCNTLVVSWLHHSLDPEILQTIMWMENTLDIWNTLKKCYYQGDVFHISDLQEELYLLKQGDATITTYFTKLKGGLNEQYSTVRSNIMMMDPLPDLDKVFSILIQQERQLVVQFDDSRVFAQLETSHGAYGRGQMDTSHASYGRGHSLSGRG

SEQ ID NO: 170399 - protein, 111 aa, Glycine max
  Coding DNA Sequence Number=SeqID_53621
MNKIDSLDQGAVTVVVRGRDHNDGKSDGDGCAREGPRWWWRNIMDPNIDLDEVLEQMIDEELKDNTDEQIIRLILESQQQLYGNTTRCSQRRRVVHRNCEEGHDRLFNDYF

SEQ ID NO: 170400 - protein, 57 aa, Glycine max
  Coding DNA Sequence Number=SeqID_53622
MSQLITHTYTCQVQAEASSLVDIVIYSDWRNDVLVWLPRCHGVKQTSQLSQSNMKSV

SEQ ID NO: 170401 - protein, 118 aa, Glycine max
  Coding DNA Sequence Number=SeqID_53623
MSALMVMVVTMTMVGGGGSDVGGGDCSDVGGGCGGGDIVGNGGGDDNDSDGDIDGSGGGNSGDGDVDENDGGSDVGGGTNYFRKILIGGSNLDKSLFYYWYSFLLVEPTRVGKDLLEH

SEQ ID NO: 170402 - protein, 826 aa, Glycine max
  Coding DNA Sequence Number=SeqID_53624
  Gene Ontology: Mol. function=transferase activity, transferring glycosyl groups; Cellular component=cytoplasm; Biological process =carbohydrate metabolic process
  Homolog annotation: Hit_ID=Q9SCM1; Match level="QueryCoverage=92%, HitCoverage=99%, E-value=0.0, Identity=43%"; Hit description =Imbibition protein homolog
  Pfam annotation: Domain name=Raffinose_syn; Domain location=62-813; Score=924.1; E_value=6e-275; Accession=PF05691.3; Description =Raffinose synthase or seed imbibition protein Sip1
  Subcellular localization annotation: CTP_CleavageSite=53; ConfidenceScore=5.69e-01
MAATSTTHLFQTRMFFPPTTIAPLTSPFSTFLGPHQRLLSKGCRRIGQRRRCRHSMFVNAKLLLKDGTLSVNGKDALKGVPENVVVTPFTGSSAFIGATCADASSRLVFKLGVIQYAFFSVGYDRICDICLQFLAILLIAIRDVRLLCLYRFKIWWMIPRVGNSGRDIPIETQMLLMEAREGNSQSSKEHNSYFIFLPVLDGEFRSSLQGNSSNELELCVESGDPEVVTSQFLNAVFMNYGGHPFDLVKESMKVLSEHTGTFSLRETKQARMLDCFGWCTWDAFYHSVNPQGIKDGLGSLSEGGTPAKFLIIDDGWQDTVNEFQKDGEPFIEGSHIKENSKFRAVGDVTESGAPVSLKDFVSEIKSSFGLKYVYVWHALLGYWGGLDPNASGTKKYDPKLRYPVQSPGNLANTRDLSIDAMEKYGIGVMDPAKISEFYDDLHSYLVSQNIDGVKVDVQNILETISSGLGGRVLLTRRFQQELEKSISTNFQDNSIICCMAHNTDSTYHSKQSAITRASDDYYPKNPTTQSLHIAAIAFNSIFFGEIVVPDWDILHDAAEFHAVARAVGGCGVYVSDKPGQHDFNVLKKLVLPDGSVLRARYPGRPSRDCLFIDPVMDKKSLLKIWNLNKCGGVVGIFNCQGTGSWPGLESNAEEDITFELSGKVSPSDIEYFEEVSTGPWTQDCAVFRFNTGWSMDYRFLFEISGSLTRLSKEESFDITLKVLQCEVFTVSPIMVYNQTIQFAPIGLTNMYNSGGAVEAVDSSDSSGSKIHITGRGGGDFGAYSNLKPKSCYVNSEDLEFQFREEDNFFGVTIRAKTSSWEITICY

SEQ ID NO: 170403 - protein, 1165 aa, Glycine max
  Coding DNA Sequence Number=SeqID_53625
  Homolog annotation: Hit_ID=Q9LTT9; Match level="QueryCoverage=94%, HitCoverage=82%, E-value=1e-123, Identity=47%"; Hit description =Arabidopsis thaliana genomic DNA, chromosome 3, P1 clone: MDC11
  Pfam annotation: Domain name=WD40; Domain location=62-101; Score =27.3; E_value=5.3e-05; Accession=PF00400.22; Description=WD domain, G-beta repeat
  Pfam annotation: Domain name=WD40; Domain location=942-978; Score =4.7; E_value=10; Accession=PF00400.22; Description=WD domain, G-beta repeat
  Pfam module annotation: Pfam domain module=WD40::WD40; Domain location=62-101::942-978
MAFFAEDLHLLASASTDGRIFVWKINEGPDEDDKPQITGKVILALQILGEKEPLKCSIDKLIDGVQLVGKHDGNVTELSMCQWMKSRLASASADGTVKIWEERKATPLAVIRPHDGKPVNSVTFLTAPHRPEHIVLITAGPLNQEVKIWVSDNEEGWLLPSDSESWNCIQTLDIRSSFEANPEDAFFNQVVALSRAGLYLLANAKKNTIYAVHIEYGSNPTATRMDYIAEFTVTMPILSLTGTSDSLPDGEHIVQIYCVQTQAIQQYGLNLSQCLPPPLDNVELEKTESHLSRAFDALDGSMETGNMPQVLCGSSESAPVVSVAVNLPSSDISGLPEASISSISDSETKSNDLPPRNGFELVHSASPPLPQSPRLSPKLSGLKNSSNNLETSSTSADHSSEQTNLDSSAEQKVESKKDMADVPGSGDNLRKDDKVVQSDVSVVSNAPTTYKHPTHLVTPSEIFSNAALSSDNSHNSQGMNGQDVAAHRDAENSQVDVEVVGETDSIQENTEYERDRDSHTNVAEKKEKLFYSQASDLGIQMARETYNIEGACQADNIKTINAPDQSGNSVEEEIQDTSKDVPANISESETVAAAVQSPAPSVKGKRQKGKNSHVSGASSTSPSPFNSTDSSNDQGGNSGGSSMEAALPQLFAMQEMMSQLLSMNKEMQKQMNAMVSVPVTKEGKRLEGSLGRNMEKVVKAHTDALWARLQEENAKQEKLERDRTQQITNLISNYVNKDMVSILEKIIKKEISSIGTTITRSISQVIEKTISSAITESFQKGVGDKALNQLEKSVSSKLEATVARQIQAQFQTSGKQALQEALKTSVEASVVPAFEMSCKALFEQIDIKFQNGLVKHTTAIQQQFDSTHSPLAMTLRDTINSASSITQTLSGQLADGQRKLLAIATNSKVAADPFVAQINNGLHEMTEDPTKELSRLISEGKFEEAFTGALHRSDVSIVSWLCSQILSFSYGKIVNFWGSSMKIFVWLYLIKSTTMSLMYSFTSLHNQVDLARILAMVPLPLSQGVLLSLLQQLSCDINTETPKKLTWMTDVAAAINPADPRIAAHVRQILDQVSRTLGHHRILPTTSPSEASTIRLLMHGRQQLRLGVAVASIDWSLYPATAGLAFTRNSQAMQKQLLSTSGSNQCVTKPEQILCSEKKLDPRQY

SEQ ID NO: 170404 - protein, 162 aa, Glycine max
  Coding DNA Sequence Number=SeqID_53626
MERGKNKRAREDDEVEIGSSFENYNNNIAKKRNVYGISFKKEKNNEVEEKDCFKAWDYSHLTMGVFDFPWLKDGVISKSYECLDFEDNFLSSLERQDTFFKASSGIDFSEEYGLCEIPEASMAHIQEAKLVEDMWKPFESNGLELEPEGGDCIWSFLLNKPL

SEQ ID NO: 170405 - protein, 298 aa, Glycine max
  Coding DNA Sequence Number=SeqID_53627
  Gene Ontology: Mol. function=adenyl-nucleotide exchange factor activity; Cellular component=mitochondrion; Biological process =protein folding
  Homolog annotation: Hit_ID=Q8LDE9; Match level="QueryCoverage=68%, HitCoverage=76%, E-value=5e-15, Identity=31%"; Hit description =Chaperone GrpE-like protein
  Pfam annotation: Domain name=GrpE; Domain location=87-241; Score= -46.0; E_value=0.0044; Accession=PF01025.9; Description=GrpE
  Subcellular localization annotation: CTP_CleavageSite=97; ConfidenceScore=5.62e-01
MKQRRVWLTPSLKHTGDNDGTHRSSAILSRSFTLFSVSRNSQPFSTTLSNNFHSLLHPSPNKLIPLQTNFLNSSLTSRFGFSSIASHEHASEEAKVSDQSEQAEAVDQTKESDVESECDLSRDDLIKLVVEKEQLLKLKHKEIEKMQRWRMSWIGQENFAKSLLDVDDNLGRASSVVKDSFSKIESLEESSEAAQLLKTLLEGVEMIEKQLAETHGELNHMHENTLNYVLQRVWAQVGISSGAAAVNKVFYISRKRTIVEHMTNYIGRKRTVVEHVINKVIPTTAPMQKVVLSASVLS

SEQ ID NO: 170406 - protein, 149 aa, Glycine max
  Coding DNA Sequence Number=SeqID_53628
MVWLWLDSVCEMMSHFATPDGLQDYTLWSWELGDRYTLYSYVAITPYYHPCGCVRPSTPGRLGGIVGPCYVSSVKLWALRHQECCLPRKTTRHDYERSTHPYNQQLSGTNIRGDHDDFMLVEIKEYKELLWQLEPSPKEDEDDPSEDPS

SEQ ID NO: 170407 - protein, 129 aa, Glycine max
  Coding DNA Sequence Number=SeqID_53629
MGTRVWLHHNPILGKLIIYGYGKTRNPNKEHRHTKREGDLTRIRPNSDLYSPPQLKDSNTTLFSLRTLKNVIKNLKCQNHTPKNILLGFVKSYENRLSQDLKFLNRHQKKSSTTQTCSNKKEVMSGCSV

SEQ ID NO: 170408 - protein, 729 aa, Glycine max
  Coding DNA Sequence Number=SeqID_53630
  Gene Ontology: Mol. function=binding; Cellular component=nucleus; Biological process=metabolic process
  Homolog annotation: Hit_ID=Q10MA5; Match level="QueryCoverage=82%, HitCoverage=75%, E-value=1e-120, Identity=39%"; Hit description =Pentatricopeptide, putative
  Pfam annotation: Domain name=PPR; Domain location=157-191; Score =38.4; E_value=2.5e-08; Accession=PF01535.11; Description=PPR repeat
  Pfam annotation: Domain name=PPR; Domain location=219-253; Score =36.9; E_value=7.1e-08; Accession=PF01535.11; Description=PPR repeat
  Pfam annotation: Domain name=PPR; Domain location=281-315; Score =30.0; E_value=8.6e-06; Accession=PF01535.11; Description=PPR repeat
  Pfam annotation: Domain name=PPR; Domain location=343-377; Score =21.9; E_value=0.0023; Accession=PF01535.11; Description=PPR repeat
  Pfam annotation: Domain name=PPR; Domain location=405-439; Score =41.4; E_value=3.1e-09; Accession=PF01535.11; Description=PPR repeat
  Pfam annotation: Domain name=PPR; Domain location=503-537; Score =42.4; E_value=1.6e-09; Accession=PF01535.11; Description=PPR repeat
  Pfam annotation: Domain name=PPR; Domain location=538-572; Score=2.8; E_value=3.4; Accession=PF01535.11; Description=PPR repeat
  Pfam annotation: Domain name=PPR; Domain location=641-675; Score=5.6; E_value=1.6; Accession=PF01535.11; Description=PPR repeat
  Pfam module annotation: Pfam domain module=PPR::PPR::PPR::PPR::PPR::PP R::PPR::PPR; Domain location=157-191::219-253::281-315::343-377::405 -439::503-537::538-572::641-675
MPLAQGSEGLHHKAAKESHFNTLPRASSKLADLAGVASHGVENCQATFKGCHHCPLDFMNNALKGLCEICVVVSKLFTSHFKASISNDPEKGLVKNANLVLISNSGTPLMPKNLSLKPRSSDDALHKRNVEITILGRHGKLDEARKLFDEMPQRDDVSYNSMIAVYLKNKDLLEAETVFKEMPQRNVVAESAMIDGYAKVGRLDDARKVFDNMTQRNAFSWTSLISGYFSCGKIEEALHLFDQMPERNVVSWTMVVLGFARNGLMDHAGRFFYLMPEKNIIAWTAMVKAYLDNGCFSEAYKLFLEMPERNVRSWNIMISGCLRANRVDEAIGLFESMPDRNHVSWTAMVSGLAQNKMIGIARKYFDLMPYKDMAAWTAMITACVDEGLMDEARKLFDQIPEKNVGSWNTMIDGYARNSYVGEALNLFVLMLRSCFRPNETTMTSVVTSCDGMVELMQAHAMVIHLGFEHNTWLTNALITLYSKSGDLCSARLVFEQLKSKDVVSWTAMIVAYSNHGHGHHALQVFARMLVSGIKPDEVTFVGLLSACSHVGLVHQGRRLFDSIKGTYNLTPKAEHYSCLVDILGRAGLVDEAMDVVATIPPSARDEAVLVALLGACRLHGDVAIANSIGEKLLELEPSSSGGYVLLANTYAAEGQWDEFAKVRKRMRERNVKRIPGYSQIQITGKNHVFVVGERSHPQIEEIYRLLQQNLQPLMREMGSTPENLLLVLS

SEQ ID NO: 170409 - protein, 536 aa, Glycine max
  Coding DNA Sequence Number=SeqID_53631
  Gene Ontology: Mol. function=metal ion binding; Cellular component =integral to membrane; Biological process=defense response to bacterium
  Homolog annotation: Hit_ID=Q4VG19; Match level="QueryCoverage=99%, HitCoverage=96%, E-value=1e-140, Identity=49%"; Hit description =Pollen ankyrin-like protein
  Pfam annotation: Domain name=Ank; Domain location=111-153; Score =18.2; E_value=0.03; Accession=PF00023.20; Description=Ankyrin repeat
  Pfam annotation: Domain name=Ank; Domain location=258-290; Score =39.6; E_value=1.1e-08; Accession=PF00023.20; Description=Ankyrin repeat
  Pfam annotation: Domain name=Ank; Domain location=294-319; Score=7.1; E_value=2.9; Accession=PF00023.20; Description=Ankyrin repeat
  Pfam annotation: Domain name=Ank; Domain location=44-76; Score=39.5; E_value=1.1e-08; Accession=PF00023.20; Description=Ankyrin repeat
  Pfam annotation: Domain name=Ank; Domain location=77-109; Score=27.2; E_value=5.8e-05; Accession=PF00023.20; Description=Ankyrin repeat
  Pfam annotation: Domain name=zf-C3HC4; Domain location=386-435; Score= 8.8; E_value=0.019; Accession=PF00097.15; Description=Zinc finger, C3HC4 type (RING finger)
  Pfam module annotation: Pfam domain module=Ank::Ank::Ank::Ank::Ank::zf -C3HC4; Domain location=111-153::258-290::294-319::44-76::77-109::386- 435
MGNSFGCSASGERLVSAARDGDLVEAKMLLECNPCLAKYSTFGGLNSPLHFAASKGHNEIVALLLENGADVNSRNYCGQTALMQACRYGHWEVVQTLLLFRCNVVKADYLSGRTALHFAAINGHARCIRLVLADFVPSAPFEALHARIDAEGDGSNVKNKHEQRFAQQWGHDLWVCHSPPAESPFLASDEHPNHVGIIRGLLFSICDGLIAVDWVTGISALLLPATNSFLGLSFLKLKGAMRLWVPVLSKFVNKTADAGITALHMAALNGHFDCVQLLLDLNANVSAATFHYGAGSTPLHYAACGGNLKCCASRMALNCNGWLPLDVARMWGRHWLEPLLTPTSDATISSFPSSNYLSLPLMSVLNIARECGLQSTTTSSNEVDVCAVCLERQCSVAAEGCGHELCVRCALYLCSTSNVSSETCGPPGSIPCPLCRHGIISFVKLPDRPTVSHTPEIRRNRVASVPSEMLCPVTCTPFPSVAIPLCTCNNGPCPSFEPREAEAQGGSPLHSHASMMDQDKMDGPRLEKTTCSGMFW

SEQ ID NO: 170410 - protein, 72 aa, Glycine max
  Coding DNA Sequence Number=SeqID_53632
MEALKNKETKSNEREEANLNAMGCGRNCDGDVAPSSLYLSNFVRQRRIKQKEGLKVVARNVIEVGVNGGFVI

SEQ ID NO: 170411 - protein, 200 aa, Glycine max
  Coding DNA Sequence Number=SeqID_53633
MVAHGREDVLITAIGRPQLPGHVHVVGVDVPIRKYFGPTSAELDRLKQNIKEKLTQNIWETTNVVLKPNAVQLVGQTLNIVHAWLAHLVQPFPKKDKHVPKGLTKPVHRLKHDDDSIYHMKLMIPQLFLKPMQVLWDATMFRVYNDNVPLYIKHEDLGEITHSGQCLNIVVIQLWIMHMNELNLRSGNGSMHGFLESQSI

SEQ ID NO: 170412 - protein, 88 aa, Glycine max
  Coding DNA Sequence Number=SeqID_53634
MMHPPKKEVDRFTGGRMHASMEEACMFTTERGWCIHHKKRPMHLWIAFEYTDVSVLAIKFGKFQAKGLDTWMTVDRPGQISLERLAHT

SEQ ID NO: 170413 - protein, 59 aa, Glycine max
  Coding DNA Sequence Number=SeqID_53635
MVKKKLSHEVSKVIVELSSAVGLSVHPPLSATEESGRASISRPRAKREISALSAAGAFS

SEQ ID NO: 170414 - protein, 228 aa, Glycine max
  Coding DNA Sequence Number=SeqID_53636
GDKEWTTKQRRKGKSRVNQVTFYFMHFPYAYLEEELHKVFSYWGFVKEVFMVPRRNKGGKGKAVMQDKEKVVMGEETSYGPSREAVSYAQATNKAKSNVTRIWRKKQQPYMVVDDWRAWDPNTEISNMEWLIKSLVGKMRNPQKLTIVMERFIIQGFSMIKICLLGKEGFSRAFNVEEVKAEKVWGKGVTGVCVDNGTMQIHDYREEQHKRGLYDRWIGFDVYGRGDG

SEQ ID NO: 170415 - protein, 142 aa, Glycine max
  Coding DNA Sequence Number=SeqID_53637
MELMDTPMVGRKFMWYRSSEVVKNSWTEYWSRRIGGLNVSYKKNQESNDSRRDDNTKFFHSINNWKRRSNGLKGVMKYGRLVEDPNIVKEEVKCFFEKKFKESDDLNLNLDGVAFNSIGREDNEIRVARFSKFEIKQAIHSV

SEQ ID NO: 170416 - protein, 150 aa, Glycine max
  Coding DNA Sequence Number=SeqID_53638
  Gene Ontology: Mol. function=RNA-directed DNA polymerase activity; Biological process=RNA-dependent DNA replication
  Homolog annotation: Hit_ID=Q1SKV6; Match level="QueryCoverage=100%, HitCoverage=37%, E-value=7e-25, Identity=37%"; Hit description=RNA -directed DNA polymerase
MVEEAKRKKKSMMVFKVNFEKAPYDQVRWGFLYYMLRRMGFCEVWINWIKCCVESVTMLVLVNKSPTKEFKGKKGLLAEGLSGFFKRGFKEESFQGSEDSEVQKLAWVKWSSVRKSREEGGLGIRSVGLFNKALVGIWGWRFLTESEYLW

SEQ ID NO: 170417 - protein, 126 aa, Glycine max
  Coding DNA Sequence Number=SeqID_53639
  Subcellular localization annotation: CTP_CleavageSite=20; ConfidenceScore=5.51e-01
SRGIPRYSNKVTTSFKNSTKSSNKSRRVGGACSKGDTNKPHSKYRRKQLRYNRTVYDSALLKYKVLGKDVHLIKDNKEEATNIWDMAKSIRVGNAGTKQGVVARIMELEERDNDVVHLRGGVLEEG

SEQ ID NO: 170418 - protein, 166 aa, Glycine max
  Coding DNA Sequence Number=SeqID_53640
ANVFQEGGNDENPEIGQIQAKGPSGEGRRLKWRRVRIKDDILEASEAIPSYPFIVETSPTIPQEDATTITHSAKVDVSLSELNALSECHPLSEASTRLVDRRNLEGNLSRKHVLSASSARSASRLSPSRLSTSLALSENSLTRAKRDVKELPCYGRLNPQLGILAE

SEQ ID NO: 170419 - protein, 143 aa, Glycine max
  Coding DNA Sequence Number=SeqID_53641
MSIDRDYFSLPSSSRDGKSDNTQRPISSFASFVEDSMSIDRDYFILPSSSKDEKSDDTQRPIWKASPLTRRDQYGHLYPFIEDSTSIDRDYFSLTSSSRDNQVRWHVETNHGHPHPFRYPETIKSNGTRRQIMVIRTLSAIKR

SEQ ID NO: 170420 - protein, 278 aa, Glycine max
  Coding DNA Sequence Number=SeqID_53642
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=3e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRPRLQRTTRPRHQRATLHVLAFRGLHVLIFRETHVLAFKGLRILLFRGLHVVAFRGLHVLIFRGLHVLTFRKLHALTFIGPQSLAFRGLHLHALAFRGLHVLPFKGLHVLAIRGLHDITLRGQHAVIFRGLHVLAFRGLHVLLFRGLHVLAFRGLHVLIFRGLHLHALAFRGLHVLAFRGLLVLTFRGLHALTFRGRHVLVFKGIHVLAFRGLHALSFRGLHILAFRGQHVLTFRVLNVLAFRGLHILPFWRLHVFAIRELHVLTLRGLHVLTFR

SEQ ID NO: 170421 - protein, 88 aa, Glycine max
  Coding DNA Sequence Number=SeqID_53643
MLPLKVAIQLSCHWHWRDSADMESRGTVVQGGFANMDGEFVLRVSHHCCWRERCLRGALACKLNVAAYKKQAFPETFSERVSQVGVVE

SEQ ID NO: 170422 - protein, 166 aa, Glycine max
  Coding DNA Sequence Number=SeqID_53644
MGHPQGPGTESGYGINASEGGCLVLEIEEEETNLCWELVAVLMRLIEGFTWREDMKDGWVWKVGGEENYVVKQPSLPREDTHFFRSLWKALAPSKTLGFTGKIMLDRVLTCNNLLRWNIRILTVIPNEPSTRWCNHWGGLCGTKRRRRRWGVWVSVHGLVVVDVVE

SEQ ID NO: 170423 - protein, 54 aa, Glycine max
  Coding DNA Sequence Number=SeqID_53645
MKVMQSYLLRALDTRLYEDWARDAREGPRVLMSLRVGYPRNVGFCSPCILGHLD

SEQ ID NO: 170424 - protein, 67 aa, Glycine max
  Coding DNA Sequence Number=SeqID_53646
  Subcellular localization annotation: CTP_CleavageSite=19; ConfidenceScore=5.25e-01
MTFHSAPMHSSSFFQILPRAQPRSVAPSGWLAKPVDWLSERMKISASQTFLINLKLFYTQKLVIFID

SEQ ID NO: 170425 - protein, 101 aa, Glycine max
  Coding DNA Sequence Number=SeqID_53647
VLTIVIGQPKHPGRVRAAGDDVTIKLYFGPAPRTSHTSSSMAPKDVEQLRQEIRDQLEESITEKVTRQVLALPPKPEDGRSTTRVSTQENVVIWFGRYSTK

SEQ ID NO: 170426 - protein, 212 aa, Glycine max
  Coding DNA Sequence Number=SeqID_53648
  Gene Ontology: Mol. function=nucleic acid binding
  Homolog annotation: Hit_ID=Q2R442; Match level="QueryCoverage=71%, HitCoverage=52%, E-value=2e-09, Identity=29%"; Hit description=Zinc knuckle family protein
  Pfam annotation: Domain name=zf-CCHC; Domain location=140-157; Score =15.6; E_value=0.0027; Accession=PF00098.13; Description=Zinc knuckle
MVVGNATIEKPRGQWDEEEKRRVQYTLKAKNIITYALGMDEYFRVSNCRNAKEMWDTLQEHKMELMRLNQHEENDKKKKGIALKASYSLQEESDTLNEIKEDDDFSFFIKRFNRFLRNKGNQRRTNFNSKKKREDSSSVPKCYECNHPEHLKVVCPSFKRRMEKSNRKIFKDKKAKKAYITCEDNNMNSSGDSENEVMNLSLIAKNYESEEE

SEQ ID NO: 170427 - protein, 701 aa, Glycine max
  Coding DNA Sequence Number=SeqID_53649
  Gene Ontology: Mol. function=ATPase activity, coupled to transmembrane movement of substances; Cellular component=integral to membrane; Biological process=proteolysis
  Homolog annotation: Hit_ID=Q0BAW8; Match level="QueryCoverage=99%, HitCoverage=89%, E-value=0.0, Identity=55%"; Hit description=ABC transporter related
  Pfam annotation: Domain name=ABC_membrane; Domain location=181-450; Score=38.2; E_value=2.8e-08; Accession=PF00664.13; Description=ABC transporter transmembrane region
  Pfam annotation: Domain name=ABC_tran; Domain location=527-701; Score= 179.0; E_value=1.2e-50; Accession=PF00005.17; Description=ABC transporter
  Pfam module annotation: Pfam domain module=ABC_membrane::ABC_tran; Domain location=181-450::527-701
MRPPFLSDAGSRCASLLDRNHRGDTLLKSVAWIGKHYKREKSEEALVAGLPKATLLSPSQAMTALENAGITGGMVERRLQDLPEQLMPMILLRQNGGGCIVLSRRIHTNEENQRELRFQLIMPEVSDKAVEMSLAELNEIYAGFAVMAKPAAVLDERASEMLPEVKGHWLFSTLWRYRRYYRSAAIAAVLINVLALSSIFFTMNVYDRVVPNQAFVTLWSLAIGVTIAMIFEAITRFVRAHLLDMAGKKADLVLGSMLFRQALSIQMEHKPASSGTFANQIREYESVRDFVASATLAAISDLPFILMFVGVIFFISGPLAIIPLMMIPLIIIVSAAIQWPLARIMKENLRDASLKQGVLIESVEGMETLKAVGGEAHMQRRWENFSALQSANSMKSKRYSTLATGVVTFLQQFQTVMLVVAGVYLINAGTFTMGAMIATVMLASRATGPLGQVIGLAVRYQQAKAALTSLNKLMEMPVDRDSSKTYLTDPPLTGEISLSNVSFSYPAPPMKPNPEILKDISLTIKAGERVAILGRIGSGKSTLLRVMARLYQPVKGQISADGLDVNQIDPADWRKAVGFVSQDARLFYGTLRENVMIGRPDATANELLRVLNLTGLDHVAARHPSGINLSVGEGGEGLSGGQRQLVSLARTLLTRPKVLLMDEPTSAMDSMTESQFLAHLRRASEGHTLIVVTHRPSILAL

SEQ ID NO: 170428 - protein, 83 aa, Glycine max
  Coding DNA Sequence Number=SeqID_53650
MTEPQQPQRPKIEPFSLKGGTQIRDGAVTHLGLHLDGVSGGELREEIKGCGEIHCIVKLRIGFVGVLVHVCDLLFVSLSSLDA

SEQ ID NO: 170429 - protein, 77 aa, Glycine max
  Coding DNA Sequence Number=SeqID_53651
MVELVRIPAINNIETGLAHGTMVLMPYCGEQQGKTKSTFKEPSMEKKVITSPKTLVATSGYPKERLVFDKDREKDIA

SEQ ID NO: 170430 - protein, 101 aa, Glycine max
  Coding DNA Sequence Number=SeqID_53652
  Gene Ontology: Mol. function=DNA binding; Biological process=DNA integration
  Homolog annotation: Hit_ID=Q1SFD6; Match level="QueryCoverage=67%, HitCoverage=4%, E-value=5e-28, Identity=81%"; Hit description =Integrase, catalytic region
MNQHIAAIPSSERRIEGINRHRNCSVKKFELEFGSESASQRPRPRMVVGTIEEWCDLDGGGTVARMNKERTSRISRGIRRWRWCYTRWHSGGSKRNGSLGR

SEQ ID NO: 170431 - protein, 102 aa, Glycine max
  Coding DNA Sequence Number=SeqID_53653
  Gene Ontology: Mol. function=DNA binding; Biological process =regulation of transcription
  Homolog annotation: Hit_ID=Q9LRN5; Match level="QueryCoverage=33%, HitCoverage=11%, E-value=7e-11, Identity=88%"; Hit description =Similarity to transfactor
MYPRLIHPHDGIVTQDELQGGAASNLSHAHKGDPCLVLTADPKPRLRWTQDLHERFVDAVTQLGGASRWVELKFITREHAVVELPALLDALLNDTKGGRDAF

SEQ ID NO: 170432 - protein, 70 aa, Glycine max
  Coding DNA Sequence Number=SeqID_53654
MSPTNQGGEQESSCQTPEQEAPNVGALPHNDRLGSNTIRVSEAVTIVVVAKVVAVNSLTTVPICQSNIKR

SEQ ID NO: 170433 - protein, 288 aa, Glycine max
  Coding DNA Sequence Number=SeqID_53655
  Gene Ontology: Mol. function=DNA binding; Biological process =regulation of transcription
  Homolog annotation: Hit_ID=Q84QT1; Match level="QueryCoverage=49%, HitCoverage=53%, E-value=8e-35, Identity=53%"; Hit description =Transfactor-like
MEGILVTRDRERLRKVIRKIIQKNLAVNEATPKAIMRTMNVKGLTLFHLKSHLQLCNKSETFLSALQKYRLGKQSGKDVGEGCKDGSYLLESPGADNTSPKLPTPDTNEGYEIKEALRAQMEVQSKLHLQVEAEKHLQIRQDAERRYMAMLERACKMLADQFISATVIDTDSQKFQGIGSKAPRGTLVDPLGFYSLPSTEVAGVNVPEEEILPSLPPQRADCSTESCLTSHESSGGLALEGSPGEGKRRMLGMDSMAAPLIWSEAKMRTQAINVAQGNHPQGITRYGM

SEQ ID NO: 170434 - protein, 73 aa, Glycine max
  Coding DNA Sequence Number=SeqID_53656
MTPLPVKMLITFATVVRLRPTIYQNAQNSEENLDKGIWLRRFWMTPDDVNLSRSGSFDTGYGGLDDATSNEGR

SEQ ID NO: 170435 - protein, 97 aa, Glycine max
  Coding DNA Sequence Number=SeqID_53657
MSDDGTMEVMTKTMVVVAIRDENGLGCLCHGDSNDDDGRCDDNDNNNDNSDDNNNSGGCYNENVDDGGNTSDNEGGNNDDDSCDNDNDNSGGDNDAY

SEQ ID NO: 170436 - protein, 341 aa, Glycine max
  Coding DNA Sequence Number=SeqID_53658
  Gene Ontology: Mol. function=DNA binding; Biological process =regulation of transcription
  Homolog annotation: Hit_ID=Q3LHL3; Match level="QueryCoverage=83%, HitCoverage=95%, E-value=4e-92, Identity=64%"; Hit description=MYB -CC type transfactor
  Pfam annotation: Domain name=Myb_DNA-binding; Domain location=51-102; Score=46.2; E_value=1.1e-10; Accession=PF00249.21; Description=Myb -like DNA-binding domain
MYHSKNFPSASLIGVNSLVHGQHIDCGGSTMDPGSGGNSLGNNSNLASKQRLRWTHELHERFVDAVAQLGGPDRATPKGVLRVMGVQGLTIYHVKSHLQKYRLAKYLPDSSSDEGKKADKKETGDMLSNLDGSSGMQITEALKLQMEVQKRLHEQLEVQRQLQLRIEAQGKYLKKIIEEQQRLSGVLSETPGSGVAAVAPGDACQEPDNKTDPSTPDPEKAAKDRAPAKSLSIESFSSHLEPMTPDSGCHVGSPAESPKGERSAKKQRVIMDGVYSKPEMVLPHQILESSMSLYQQPNTVFLGQDQFDPSLGISTRSGEELDKMTCRKLALAVIDCTNHET

SEQ ID NO: 170437 - protein, 181 aa, Glycine max
  Coding DNA Sequence Number=SeqID_53659
  Gene Ontology: Mol. function=calcium ion binding
  Homolog annotation: Hit_ID=UPI00005DC23F; Match level="QueryCoverage =89%, HitCoverage=37%, E-value=7e-59, Identity=62%"; Hit description =catalytic
MIEQFINFIIRPPRAEYDPDQYLWEKEFSLAGRTYQRQDLEASMDMLFGCRADANEAAVILLPSNITVFTLDFSGSGLSDGDHVSLGWHEKDDLKMVVSHLRSNKQVSRIGLWGRSMGAVTSLLYGAEDPSIAGMVLDSAFSNLYDLMMELADVYKIRLPKFTVHCLSFLHSLSVCAYVIL

SEQ ID NO: 170438 - protein, 308 aa, Glycine max
  Coding DNA Sequence Number=SeqID_53660
  Pfam annotation: Domain name=Myb_DNA-binding; Domain location=67-112; Score=28.3; E_value=2.7e-05; Accession=PF00249.21; Description=Myb -like DNA-binding domain
MVCGATVNQRTLSGRLHLWRKSDESERVAVDALIDMCDSLSPEATKRCHANNLQPPDITCWDIDDGTCEWTDEEKAAFLQAVSSFGKDFRMILRHVGTKSKDRCKKIFIKGQKSHRLDLMRHRPENIGSLLNEINIGMSTYTNDAHIVEGDSAADNDKLGTKTNNDQPSSAANSSHDKSKPMEARNHSTNFKESVIGNDKSGTKTNDEQSSSGTNLSHDKSKPVEARNRSADLNESKEINREFDHQDKTIISNTKNGESKLVDIDGCGVVLYNSDKSSSVKDKRSTTMSNIEIVLHKFAPIKNRYCSQ

SEQ ID NO: 170439 - protein, 193 aa, Glycine max
  Coding DNA Sequence Number=SeqID_53661
MVELLRQINDLEMPFAWPFLSKTSTTTLTKERVQEDSTFGGNPMKAVSSFGDDFTMIAQHIGTKSKDQCKKFFIKGHKSHRLDLIHHRLENIGSLLNEVNLSSSTNTNYAHVWEADSVIDNDESGTETNDDQPSSVVNSSCDKSKPMEAMNLSAYFKESVIGNDKSGTKTNDEQPSSTMNSSHDKSKPVEARN

SEQ ID NO: 170440 - protein, 312 aa, Glycine max
  Coding DNA Sequence Number=SeqID_53662
  Homolog annotation: Hit_ID=UPI00005DC23F; Match level="QueryCoverage =30%, HitCoverage=18%, E-value=7e-33, Identity=67%"; Hit description =catalytic
MAVEYMRRVIEKKAKFDIMDLNCLLVAPKTFIPVLFGHGNDDQFIQPHHSDLISESYAGDKNIIKFDGDHNSSRPQFFYDSISIFFYNVLRPPHIPRVRKLEKYFDLGDLKIGSTVNESLLYGILSSLQSATTDAASSSSAPPSTSNSIKASVSELISKVAPVTAAVGWLFPSVQESMIREEPKHGNDEHGHDEPADMKDEKNGLTEDYFSYCSSTRGNWGRCSSLVLSDEESYPDFRDDDNDSEVFATPLGSMREMSPDPKEEGKDQKKKKKAERSSKKLKSERFEKWESLSRRLRLCILKGSAHRRSKPS

SEQ ID NO: 170441 - protein, 175 aa, Glycine max
  Coding DNA Sequence Number=SeqID_53663
MRVIMEMDGSGIDGASHIGKRNEFLEGLCGFEEVATANGDLDEFRVELGVQEVRDHVGDLGDEIRVEGVVGGEGFGGEGLRWNICVLLRGRGRRRQSSESEKEGLEELRDGEGATNECAYKKPSWVKSKKVPTMSFFVKLSSFISFYLQICHCFLFLDGFQKPTLIAHRKILFLQ

SEQ ID NO: 170442 - protein, 35 aa, Glycine max
  Coding DNA Sequence Number=SeqID_53664
MTMRGGGTTIHNGGGWLHNDGVLVWAKFMEVDGGV

SEQ ID NO: 170443 - protein, 385 aa, Glycine max
  Coding DNA Sequence Number=SeqID_53665
DFVSILCLIQISATLIASISSDPCQRSQRKTNGIPLLEDLIISTGGSDQYLALFCAANTVSNKLHSGSLSSNTSSKLAIEPASASSETIKKLKLPSSARLGQGEGKQIESDKNRSKSWHQFPEHIVQSLAQENSSGFEDKHDLSSKGAARSRSFHTLKEYDDMVKKIWLAESLTDQQSEFNDEEDAGSGANTTHHTEDRDCVIKKMQPPCLNKNYSLEEIEERKVVKETDNLSTTSEISTVATTPSPKSHISSSGIKNEGVVPSHKTSTIEKGIKRKAVAKRLESLRIPTGVEYPAIASLREWLPASGIYSPESYVTPKFGSYSIMDIRNANESSEDSVFSPELVSAFEQCMQKLEADEENILKQIVENVEEESEASSPKKEHHA

SEQ ID NO: 170444 - protein, 129 aa, Glycine max
  Coding DNA Sequence Number=SeqID_53666
  Homolog annotation: Hit_ID=Q8HFD0; Match level="QueryCoverage=27%, HitCoverage=8%, E-value=7e-07, Identity=77%"; Hit description=ATPase F1 alpha subunit
MNWHNIIKSSPLLNLTQTLMLRLRHYSIVVQGLQKLFRWDIPILVLVSIVGSIIDGHVDIYIEEASSNESTQAQARSHLGFDGNPFAYVEGVLNEDSLNMWRGWYPVIERFTRKKAKDAAKPACSSSVR

SEQ ID NO: 170445 - protein, 79 aa, Glycine max
  Coding DNA Sequence Number=SeqID_53667
MELSNTIGAALRPLVEWPFAPTPVGTVPFSSCAYWGVVACSFYSNFPHPVASNGRLEVRHKRGRAGRLPNRGKEALTRC

SEQ ID NO: 170446 - protein, 360 aa, Glycine max
  Coding DNA Sequence Number=SeqID_53668
  Gene Ontology: Mol. function=sodium:hydrogen antiporter activity; Cellular component=integral to membrane; Biological process=sodium ion transport
  Homolog annotation: Hit_ID=Q0IJY4; Match level="QueryCoverage=90%, HitCoverage=64%, E-value=5e-78, Identity=48%"; Hit description =Na+/H+ antiporter
MTLIRGLWLVELGTDVNLYALVFGESVLNDAMAISLYRTMSSVRADPSGQNLFMVVVRFLETFVGSMSADLKVTIYCKTLTTRTCLSMQDWILTNEFYGSVQPSELGKLSLCPFPIFLVYACRRPWSVWYCVNPVHRNSHETLYVFQFIAKFSTRSMFSWCSSLTQPLQIFIGIARATNVFSCAYLVNLVRPTHRKIPPKHQKALWYSGLRGAMAFALALQSIHDLPEGHGQTIFTATTAIVVLTVLLIGGSTGSMLEALDVVGGDNDSPLASVGTITNFDGNNGYIAPPYNEESSSGNKIKMKLKEFHKTAASFTALDKNYLTPFFTSQNGDEDDEELMKWIGRLGSMDMTQTWGYNKI

SEQ ID NO: 170447 - protein, 776 aa, Glycine max
  Coding DNA Sequence Number=SeqID_53669
  Gene Ontology: Mol. function=protein binding; Cellular component =membrane; Biological process=protein transport
  Homolog annotation: Hit_ID=UPI000034F47D; Match level="QueryCoverage =99%, HitCoverage=100%, E-value=1e-126, Identity=53%"; Hit description=transporter
  Pfam annotation: Domain name=Vps53_N; Domain location=1-402; Score =724.9; E_value=5.5e-215; Accession=PF04100.3; Description=Vps53-like, N-terminal
MDKSSALEYINQMFPNEASLSGVEPLMQKIQNEIRTVDAGILAAVRQQSNSGTKAKEDLAAATRAVEELMYKIREIKTKAVQSETMVQEICRDIKKLDFAKKHITTTITALHRLTMLVSAVEQLQVMASKRQYKEAAAQLEAVNQLCSHFEAYRDIPKIVELRDNLGTGKETEETNLLQQLSDACLVVDALEPSVREELVNNFCNRELTSYEQIFEGAELAKLDKTERRYAWIKRRMRSNEEIWKIFPSSWHVSYRLCILFCKKTRKQLEDILGNLKEKPDVGTLLLALQRTLEFEDELAEKFGGGTQNREIGNEIEEIGKGTNSSSSAMDIRKKYEKKLAAHQGGDSEEKDGSKDLAVPGAGFNFRGIVSSCFEPHLTVYVELEEKTLMESLEKLVQEETWDIEEGSQSNVLSSSMQVFQRVLKAYATKLFARLPKGGTGIVAAATGMDGQIKTSDRDERVICYIVNSAEYCHKTAGELAESVSKIIDPQYSDGVDMSEVQDEFSAVITKSLVTLVHGLETKFDMEMAAMTRVPWGTLESVGDQSEYVNAINLILTISIPALGSLLSPVYFQFFLDKLASSLGPRFYSNIFKCKQISETGAQQMLLDTQAVKTILLEVPSLGRQTSGAASYSKFVSREMSKAEALLKVILSPVDSVADTYRALLPEGTPMEFQRILELKGLKKADQQSILDDFNKHGPGIKQTQIAPSIVPAAAPVAPVVPSPSAIGLIASREDVLTRAAALGRGAATTGFKRFLALTEAAKDRKDGPFRKLFNP

SEQ ID NO: 170448 - protein, 195 aa, Glycine max
  Coding DNA Sequence Number=SeqID_53670
  Subcellular localization annotation: CTP_CleavageSite=66; ConfidenceScore=5.05e-01
MIHVCKIGENRPIKTFSGHQGIYTIRWSPTGPGTNSPWYKQSQSAVSTSKSRHQVFNPSFMGWWVNAQSLDEDSRPRHVFFPGKKSAIDPNILLRYDVLGSSGNRSSSNFFLARRGMFLNLSFNSKISHIFNCELVLSVAWVEFEFKDGGENHNQEAWAKKKVFYIGSYDFSTSVLTRGCRPMSLNKQHRFKDPM

SEQ ID NO: 170449 - protein, 499 aa, Glycine max
  Coding DNA Sequence Number=SeqID_53671
  Homolog annotation: Hit_ID=Q6EN70; Match level="QueryCoverage=41%, HitCoverage=40%, E-value=4e-37, Identity=38%"; Hit description =Streptococcal hemagglutinin-like protein
  Pfam annotation: Domain name=DUF566; Domain location=75-492; Score =220.0; E_value=5.4e-63; Accession=PF04484.3; Description=Family of unknown function (DUF566)
  Subcellular localization annotation: CTP_CleavageSite=30; ConfidenceScore=5.50e-01
MVQVQIMPEQNSDSAAPPPPPPPPHNRRPRVREVSSRFMSPSVPRRPRSELDPDENSETPFPIISQRKQTQTPQQRSMKIFKENNNNGHEHVAPHPHPSKSCSGRIGTPCVSRPGTPTPSVYVSSRYRQTQQQHHHHHNNHHHHRFVNGMASAAEKLMQASGLNQAKSSNDSGVNCSIQSLPELGEREMLLQSNLSVGEKIGSGNGGGGGGGGDLKFHHPSPLSRSVTLPSSGGENKPPSSVAKQHGSGGNQLTKSGGGLSLPPVPPQCGRPAVDVRKGKKGSSQQEDVHSLRLLYNRYLQWRFANAKAHSTMKAQQTEIQAAIKKALYSQAMRISEMRDSVNKKRIELELLQKSKILSTILEPQIPYLDEWSTMMEEYSVSITEVIQALVNATVRLPVGGNVRLDVRELGEALNSASKMMETMISNIQRFMPKAEETDISISELARVAGGERALVGECGDLLSKRYKSQLEECSLRGQLIQLHSICHKNKNEEQQTSN

SEQ ID NO: 170450 - protein, 237 aa, Glycine max
  Coding DNA Sequence Number=SeqID_53672
LHRLGRPLDIDEVFKETNIRKKDNTWVDKRYEQTYKKLQEGSSGGTQTINTESRVKLWVDVVGGKSQGLLYRAGDMSSHYRLGAYLIVVEFMSLLTCRIVGDQCEMLKEETIEFCSEYIEKVKLVGLPKSQHEERVGEQAKQVFVFKILVMKGGKWFYTEKSLVLILKMMIQPLILVVATYPSAGGRRGARGCIFQGRKMRGVATNVYSRKTSEKPERCGLRTLSVKGSGVVFTHGE

SEQ ID NO: 170451 - protein, 161 aa, Glycine max
  Coding DNA Sequence Number=SeqID_53673
MVRTFNFSPSMSVLRKMHYSISSIARFCLNNAWCRTIGRLLITLDPTCERLGLARPFVPIQPGPGGIIESFRYWIVHTGLCTLNGNYGQNLQLLTINEHVEVDASLHLLHRTVLHRQRLEQNNQLPLDLIGFEVHLLSLQRRKRLRVASMDNVEAIGKRSL

SEQ ID NO: 170452 - protein, 550 aa, Glycine max
  Coding DNA Sequence Number=SeqID_53674
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=99%, HitCoverage=86%, E-value=1e-155, Identity=47%"; Hit description =Subtilisin-like protease C1
  Pfam annotation: Domain name=PA; Domain location=227-325; Score=31.2; E_value=3.6e-06; Accession=PF02225.12; Description=PA domain
  Pfam annotation: Domain name=Peptidase_S8; Domain location=19-444; Score=45.1; E_value=2.4e-10; Accession=PF00082.12; Description =Subtilase family
  Pfam module annotation: Pfam domain module=PA::Peptidase_S8; Domain location=227-325::19-444
MDNVFSVFPNTKYHLHTTRSWDFIGFPQNVNRATTESDIIVGVLDTGIWPESESFSDRGFGPPPSKWKGSYTNGHGSHCASTVAGNSVNSVSLFGLASGTSRGGVPSARIAVYKICWNKGCQVIDMLAAFDEAIDDGVDIISASLESPSIQHFPYFKSVFDVASFYAMRKGILTSQAAGNSGPSLYTMSYHAPWLLSVAATTFDRKIVTKVQLGNGVVYEGVSINTFDLEKKLYPLIYAGDVPNIAGGHNSSTSRYCIEDSLDADSVKGKIVLCERIHGTENVGFLSGAAGVIFGLIYPQDLPEAYALPELLITQWDQRLIHSYITSISEEINDGLIPFVPSFSSRGPNPITVNTLKPDITAPGVEVIAAWSPLNPLSSVKGDKRTIQYNVISGTSMACPHVTAAAVYIKSFYPNWTPAMIKSALMTTDKELEVFSLNHSSCKGQDNKRAVYELNLPSFALFVNGSDFTRAYPRTVTNVGSVTSTYKAKVIAPSLLNIQVKPSTLSFTSIGQKKSFCVTIEGITNVEIVSASLIWDDGSHQVRSPIVVYG

SEQ ID NO: 170453 - protein, 113 aa, Glycine max
  Coding DNA Sequence Number=SeqID_53675
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=96%, HitCoverage=14%, E-value=2e-39, Identity=70%"; Hit description =Subtilisin-like protease C1
MTGERNPTATIFKSYEGKDSFAPYIAPFSSRGPNVITPDILKPDIAAPGVDILAAWSPISSISGVNGDVRVSNYNIISGTSMACPHVTAAAVYVKSFHPNWSPAMIKSALMTT

SEQ ID NO: 170454 - protein, 46 aa, Glycine max
  Coding DNA Sequence Number=SeqID_53676
MARSYGIRNGINEDQQSFTRKGLEQMGSSRPIKLALLPRDIVKRKV

SEQ ID NO: 170455 - protein, 97 aa, Glycine max
  Coding DNA Sequence Number=SeqID_53677
  Homolog annotation: Hit_ID=Q1SJP8; Match level="QueryCoverage=91%, HitCoverage=4%, E-value=8e-18, Identity=51%"; Hit description=D -galactoside/L-rhamnose binding SUEL lectin; Integrase, catalytic region; ...
  Homolog annotation: Hit description=Galactose-binding like; Peptidase aspartic, catalytic
MSYATVCVEANREEAMLDSESTMGTVFVVKKYSKKGICKCTHYNGDNRVMETCFKLHGYPNWHPKGKTTSNTKVNATSKSHISTAARFVTKSRVVSG

SEQ ID NO: 170456 - protein, 204 aa, Glycine max
  Coding DNA Sequence Number=SeqID_53678
  Gene Ontology: Mol. function=nucleic acid binding; Biological process= DNA integration
  Homolog annotation: Hit_ID=Q0KIN0; Match level="QueryCoverage=94%, HitCoverage=40%, E-value=2e-21, Identity=46%"; Hit description =Integrase core domain containing protein
MTMVKVIVIEKNTLKRLSNEFIFTTKDTKRNKVKVLLQVQNRVQGLIVEDERRHVTDHVTCSEKCITPNSEEGHYSEGEGYKLFQLGDDFSILQHHFVVVCDHRKFGGQHSGYHTVEMMNIIGVEFIGFAPNLITCIKCLLHRLKIGINREPNGTTQRGVRLLLMNSVFIKNACSLSGQVIDTSLTMKPKLDSGCPGNILGKSG

SEQ ID NO: 170457 - protein, 127 aa, Glycine max
  Coding DNA Sequence Number=SeqID_53679
  Gene Ontology: Mol. function=DNA binding; Cellular component =mitochondrion; Biological process=DNA integration
MDVLDESSLVLSEISCFKLVLFPDNGVTPLVIVIDMLSLGHELLYEDKGNSKNVCYYDNNWAGLPSGKRSTSGYCVLVGANLISCRSKKHNRVDRSSAKAEYHAMATTTSEITWLQQLLQQLQFEDN

SEQ ID NO: 170458 - protein, 39 aa, Glycine max
  Coding DNA Sequence Number=SeqID_53680
MASPMTCGGTLWFYFRHPETFKPDDAQDSSLLDRDDRAR

SEQ ID NO: 170459 - protein, 75 aa, Glycine max
  Coding DNA Sequence Number=SeqID_53681
MENNDGLWWLMVDMGDGENPNGQIMEKCFVKLQTKFREDPTVNEGWASFLPRQLHVAFSRSFIKRLPLEASSWLL

SEQ ID NO: 170460 - protein, 90 aa, Glycine max
  Coding DNA Sequence Number=SeqID_53682
MESTKIFSTMASEGLFHLPTAIGFTVIKIEKQHINLVWKEQNRRKYKLFAEYSLKVAFVEDKEHMVLSVLSLDSSQIRAYHIALSSIVRQ

SEQ ID NO: 170461 - protein, 109 aa, Glycine max
  Coding DNA Sequence Number=SeqID_53683
  Gene Ontology: Mol. function=kinase activity
  Homolog annotation: Hit_ID=Q1SZU4; Match level="QueryCoverage=69%, HitCoverage=13%, E-value=1e-13, Identity=41%"; Hit description =Protein kinase PKN/PRK1, effector
MESLASALHEVSAEATETKENLLHIQPESESYDAQIEDLKLVLKDTNEKYNSMLDEAEWEQREVQLVSCIKKNEEEKCRNLPFGGRATRDSRDACSTKGIRAESPPTFI

SEQ ID NO: 170462 - protein, 263 aa, Glycine max
  Coding DNA Sequence Number=SeqID_53684
MGTGPKTPGSGGGATHQFPKEPGQGSCSGYGITFRSPRDPRHKFWEITNDASLRLSSKRSVDIVISTPSHACSMNNGEKPYSRAQCHDNNNKKKNYERESSSSKRRIDDVLSTPSHACSMNTRQKLNSREQCHDNKKKNYEREDSLGWKPLNKGNKTSERFYSQSNKKGRDKNKNILETGLKNVIEETRKRPRLNWGEGLTKFEKKKIEGDGVSVVIAATPASGALNNSLTAGVVETHASFYIGCSTVLECHGSKMGLMGYPS

SEQ ID NO: 170463 - protein, 461 aa, Glycine max
  Coding DNA Sequence Number=SeqID_53685
  Gene Ontology: Mol. function=oxidoreductase activity; Cellular component=integral to membrane; Biological process=electron transport
  Homolog annotation: Hit_ID=Q2HST1; Match level="QueryCoverage=96%, HitCoverage=66%, E-value=0.0, Identity=70%"; Hit description=Ferric reductase-like transmembrane component
  Pfam annotation: Domain name=FAD_binding_6; Domain location=112-215; Score=-18.0; E_value=0.033; Accession=PF00970.14; Description =Oxidoreductase FAD-binding domain
  Pfam annotation: Domain name=FAD_binding_8; Domain location=109-213; Score=72.7; E_value=1.2e-18; Accession=PF08022.2; Description=FAD -binding domain
  Pfam annotation: Domain name=Ferric_reduct; Domain location=1-79; Score=1.0; E_value=0.00097; Accession=PF01794.9; Description=Ferric reductase like transmembrane component
  Pfam annotation: Domain name=NAD_binding_6; Domain location=219-439; Score=26.5; E_value=2.3e-07; Accession=PF08030.2; Description=Ferric reductase NAD binding domain
  Pfam module annotation: Pfam domain module=FAD_binding_6::FAD_binding_ 8::Ferric_reduct::NAD_binding_6; Domain location=112-215::109-213::1 -79::219-439
MVLFTVHGLLYVIAWAMEGHLVQELIQWKDIGVANLPGVISLLAGLLMWVTSLPGVRTWNFELFFYTHQLYVVFVVFLALHVGDFVFTMAAGGIFFFVLDRFLRFCQSRRTVNVISSRCLPCGTVELVLSKPQSLRYNALSFIFVQVRELSWLQWHPFSVSSSPLDGKNHLAVLIKVLGKWTEKLRQRITDVDAQKDSCVITTSVEGPYGHEVPYHLMYENLILVAGGIGLSPFLAILSDILHRVREGKPCQPRNILLVWAEEGYSYKPIKSSFCPMASDCGMSVLVGTGDNFWSGLYVISSTVGFVILLALLYVYYVTPFHIETWWYRGLLYVICMVASVVIFGGSVVAMWHIWEKQNSLKDKSNDTKVDKIHQNGSLATKDQSQDSSIAKSTVIHYGSRPNFKEIYDSISEKWGLVDVGVIVCGPSTLQTSVAEEIRSHSMTRQRHHSIFHFHSHSFDL

SEQ ID NO: 170464 - protein, 443 aa, Glycine max
  Coding DNA Sequence Number=SeqID_53686
  Homolog annotation: Hit_ID=Q2INY1; Match level="QueryCoverage=30%, HitCoverage=42%, E-value=3e-07, Identity=27%"; Hit description=HhH -GPD
MEESQKHLQRNKWFDFDMELPSPFQLEQAVCSHGLFMMPPNHWDPLSKTLIRPLRSSPSSFLVSLSQHSQSLAVRVHATHALSPQQQNHITAQVSRMLRFSEAEEKAVREFRSLHVVDHPNRSFSGRVFRSPTLFEDMVKCILLCNCQWPRTLSMAQALCELQLELQNGSPCTIAVSGNSKGESEGFIPKTPASKETRRNKVSTKGMFCKKKLELDGNLQIDHVVASSSTATTLLTTDNGDSEELRSHDSCHEFSNGNEYFSRTGNFPSPSELANLDESFLAKRCGLGYRAGYIIELARAIVEGKIQLGQLEELSKDASLSNYKQLDDQLKQIRGYGPFTRANVLMCLGYYHVIPTDSETVRHLKQVHSRYTTSKTIERELEEIYGKYEPYQFLAFWSEVWDFYETRFGKLNEMHSSDYKLITACNMRSTTNKRKRPSRKCQC

SEQ ID NO: 170465 - protein, 480 aa, Glycine max
  Coding DNA Sequence Number=SeqID_53687
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=98%, HitCoverage=60%, E-value=1e-164, Identity=66%"; Hit description=BY-2 kinesin-like protein 10
  Pfam annotation: Domain name=Kinesin; Domain location=1-240; Score =228.2; E_value=1.8e-65; Accession=PF00225.13; Description=Kinesin motor domain
MELLHYLGSGKTYTMQPLPLKASHDLLRLMHHTYRNQGFQLFVSFFEIYGGKLFDLLNDRKKLCMREDGKQQVCIVGLQEYRVSKVETIKEFIERGNATRSTGTTGANEESSRSHAILQLCIKRSADGTDSKPARLVGKLSFIDLAGSERGADTTDNDKQTRIEGAEINKSLLALKECIRALDNDQGHIPFRGSKLTEVLRDSFVGDSRTVMISCISPSSGSCEHTLNTLRYADRVKSLSKGNSSRRDPLSSSNLRDSTVLPGSSVLSRDETMEDEITYVSSDKNRFGWPKQLEREPSPPNNVDRVPSGRMGGNLAPSMYSDPQNGQRGSQNARTANEYDYLGLAYEQDRRRKTSKRVDNNQLAAVEDNRKIESRVKHVDESDFEANHSDPHDNLNALLKEEEDLVTAHRRQVEETIGIVREEMNLLVEADQPGNQLDDYIYKLNTILSQKAAGIFQLQSQLAQFQRRLNEYNVVVTSGN

SEQ ID NO: 170466 - protein, 931 aa, Glycine max
  Coding DNA Sequence Number=SeqID_53688
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=99%, HitCoverage=100%, E-value=0.0, Identity=70%"; Hit description =Protein kinase
  Pfam annotation: Domain name=LRRNT_2; Domain location=24-61; Score =28.7; E_value=2e-05; Accession=PF08263.3; Description=Leucine rich repeat N-terminal domain
  Pfam annotation: Domain name=LRR_1; Domain location=113-135; Score =8.2; E_value=8.5; Accession=PF00560.23; Description=Leucine Rich Repeat
  Pfam annotation: Domain name=LRR_1; Domain location=137-159; Score =13.7; E_value=0.7; Accession=PF00560.23; Description=Leucine Rich Repeat
  Pfam annotation: Domain name=LRR_1; Domain location=161-184; Score =7.3; E_value=12; Accession=PF00560.23; Description=Leucine Rich Repeat
  Pfam annotation: Domain name=LRR_1; Domain location=191-213; Score =1.8; E_value=1.3e+02; Accession=PF00560.23; Description=Leucine Rich Repeat
  Pfam annotation: Domain name=LRR_1; Domain location=216-235; Score =5.7; E_value=24; Accession=PF00560.23; Description=Leucine Rich Repeat
  Pfam annotation: Domain name=LRR_1; Domain location=240-262; Score =8.8; E_value=6.4; Accession=PF00560.23; Description=Leucine Rich Repeat
  Pfam annotation: Domain name=LRR_1; Domain location=264-287; Score =13.2; E_value=0.96; Accession=PF00560.23; Description=Leucine Rich Repeat
  Pfam annotation: Domain name=LRR_1; Domain location=289-311; Score =6.7; E_value=16; Accession=PF00560.23; Description=Leucine Rich Repeat
  Pfam annotation: Domain name=LRR_1; Domain location=313-336; Score =3.3; E_value=69; Accession=PF00560.23; Description=Leucine Rich Repeat
  Pfam annotation: Domain name=LRR_1; Domain location=337-358; Score =6.6; E_value=17; Accession=PF00560.23; Description=Leucine Rich Repeat
  Pfam annotation: Domain name=LRR_1; Domain location=64-86; Score=3.2; E_value=73; Accession=PF00560.23; Description=Leucine Rich Repeat
  Pfam annotation: Domain name=LRR_1; Domain location=88-111; Score =13.7; E_value=0.65; Accession=PF00560.23; Description=Leucine Rich Repeat
  Pfam annotation: Domain name=Pkinase; Domain location=612-881; Score =120.4; E_value=5.2e-33; Accession=PF00069.15; Description=Protein kinase domain
  Pfam annotation: Domain name=Pkinase_Tyr; Domain location=612-881; Score=132.8; E_value=9.5e-37; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR _1::Pkinase::Pkinase_Tyr; Domain location=24-61::113-135::137 -159::161-184::191-213::...
  Pfam module annotation: Domain location=216-235::240-262::264 -287::289-311::313-336::337-358::64-86::88-111::612-881::612-881
MGERVIVLILLFFTHLLIVFTKTSPQDSAALLALVNEWQNTPPNWDGTDPCGAGWDGIECTNSRITSISLASMDLSGQLTSDIGSLSELLILDLSYNKKLTGPLPNDIGNLRKLRNLLVINCGFTGPIPVTIGNLERLVFLSLNSNGFTGPIPAAIGNLSNIYWLDLAENQLEGPIPISNGTTPGLDMMHHTKHFHFGKNKLSGNIPSQLFSPEMSLIHVLFESNRFTGSIPSTLGLVKTLEVVRFDDNVLSGPVPLNINNLTSVRELDMSNNSFDQSDFPPWLPTLPALTTIMMENTKLQGRIPVSLFSLQQLQTVVLKNNQLNGTLDIGTSISNNLDLLDLQINFIEDFDPQIDVSKVEIILVNNPICQETGVPQTYCSITKSNDSYSTPPDNCVPVPCSLDQTLSPECKCAYPYEGTLVLRAPSFSDLENKTIFVTLESSLMESFQLHKKPVDSISLSNPRKNIYQYLELTLKIFPLGQDRFNRTGISDIGFLLSNQTYKPPPMFGPYYFIADEYENYVDNSEGPVTSNRKSSNTGIIAGAGGGGAALLVLVLLACVYAISQKKKTKKSTGNNNPFEQWDPHDSNSSIPQLKGARRFSFEEIQNCTKNFSQVNNIGSGGYGKVYRGTLPNGQLIAVKRAQKESMQGGLEFKTEIELLSRVHHKNLVSLVGFCFDQGEQMLIYEYVANGTLKDTLSGKSGIRLDWIRRLKIALGAARGLDYLHELANPPIIHRDIKSTNILLDERLIAKVSDFGLSKPLGEGAKGYITTQVKGTMGYLDPEYYMTQQLTEKSDVYSFGVLLLELITARRPIERGKYIVKVVKGAIDKTKGFYGLEEILDPTIDLGTALSGFEKFVDIAMQCVEESSFDRPTMNYVVKEIENMLQLAGSSPIFSASASVSTSSSYNNATKISLHPYNNEYFDSSVVLPRA

SEQ ID NO: 170467 - protein, 210 aa, Glycine max
  Coding DNA Sequence Number=SeqID_53689
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=97%, HitCoverage=34%, E-value=9e-36, Identity=42%"; Hit description=BY-2 kinesin-like protein 10
  Subcellular localization annotation: CTP_CleavageSite=32; ConfidenceScore=5.10e-01
MPRSNSAVHHHRQSSDNFMFDAHGRWLLSSTYAQTRRELIRRRVYGTNRFIQEFGTRSSSLRRNDDDRVLASGLLDLHSFDTELLPEMYGVHNEYLTNHTVRGQSSDDYESILSGNKLVPRSRGLPESHLLKSVSTEKERAKNAAKIKVVVRKRPLNKKEIAKKEEDIISIDSNFLTVHERKLKVDLTEYIEKHEFVFDAVLNEDVSNDE

SEQ ID NO: 170468 - protein, 144 aa, Glycine max
  Coding DNA Sequence Number=SeqID_53690
MGRGQPAGHAGLKSHLDVDSYGWAHLWALCYCSICGQNANAASSVANLTFRAAESNRLLSHFTESDLPACWTASSVEDSPRNAIDICVMLCFVLCFVVFSKSLIKLTKNRIDVIRRKRKATEKFLKKDIADLLANGLDDRAYGR

SEQ ID NO: 170469 - protein, 441 aa, Glycine max
  Coding DNA Sequence Number=SeqID_53691
  Gene Ontology: Mol. function=methyltransferase activity; Biological process=metabolic process
  Homolog annotation: Hit_ID=Q1SW51; Match level="QueryCoverage=99%, HitCoverage=99%, E-value=0.0, Identity=72%"; Hit description=Generic methyltransferase
  Pfam annotation: Domain name=Methyltransf_11; Domain location=292 -387; Score=29.1; E_value=1.5e-05; Accession=PF08241.2; Description =Methyltransferase domain
  Pfam annotation: Domain name=Methyltransf_12; Domain location=292 -385; Score=28.2; E_value=3e-05; Accession=PF08242.2; Description =Methyltransferase domain
  Pfam module annotation: Pfam domain module=Methyltransf _11::Methyltransf_12; Domain location=292-387::292-385
MGNEAHDQQYSKKLQACGHSQKHKLPKSIMLVILTNLVTIYIFTGPISFLYHSSPSPRYSNSISKELNSTKAQIAATHSLLSELHHRLNSSNLLVQALLIDLTRQQEKQSNGADQNQMSLKVGSDDLSFALGPHKLPFGYSPRIGSDEIHTPVGASCMRLHEELNQYMSYEIGGECPMDDVLAQRLMLKGCEPLPRRRCRPKSPTNYVEPTPLPESLWTTPPDTSIVWDAYACKSYQCLIDRKNKPGSYDCKNCFDLQGEEKNKWIFDDGGLDFAIDQVLATKAAGTIRVGLDIGGGTGTFAARMRERNVIIITSTLNLDGPFNNLIASRGLVPMHISISRRFPFFDNTLDIVHSMDVLSNWIPDTMLEFVLYDVYRVLRPGGLFWLDHFFCFGSQLNKTYVPILDRIGFNRLRWHVETKLNRGVHKNVLYISALMEKPMT

SEQ ID NO: 170470 - protein, 947 aa, Glycine max
  Coding DNA Sequence Number=SeqID_53692
  Gene Ontology: Mol. function=protein serine/threonine kinase activity; Cellular component=integral to membrane; Biological process=protein amino acid phosphorylation
  Homolog annotation: Hit_ID=Q1SW54; Match level="QueryCoverage=98%, HitCoverage=96%, E-value=0.0, Identity=53%"; Hit description=Protein kinase
  Pfam annotation: Domain name=LRR_1; Domain location=108-130; Score =14.6; E_value=0.35; Accession=PF00560.23; Description=Leucine Rich Repeat
  Pfam annotation: Domain name=LRR_1; Domain location=132-155; Score =10.5; E_value=3; Accession=PF00560.23; Description=Leucine Rich Repeat
  Pfam annotation: Domain name=LRR_1; Domain location=162-181; Score =3.3; E_value=69; Accession=PF00560.23; Description=Leucine Rich Repeat
  Pfam annotation: Domain name=LRR_1; Domain location=187-206; Score =3.8; E_value=56; Accession=PF00560.23; Description=Leucine Rich Repeat
  Pfam annotation: Domain name=LRR_1; Domain location=211-233; Score =8.4; E_value=7.7; Accession=PF00560.23; Description=Leucine Rich Repeat
  Pfam annotation: Domain name=LRR_1; Domain location=235-256; Score =11.8; E_value=1.7; Accession=PF00560.23; Description=Leucine Rich Repeat
  Pfam annotation: Domain name=LRR_1; Domain location=258-281; Score =16.3; E_value=0.11; Accession=PF00560.23; Description=Leucine Rich Repeat
  Pfam annotation: Domain name=LRR_1; Domain location=283-305; Score =4.7; E_value=38; Accession=PF00560.23; Description=Leucine Rich Repeat
  Pfam annotation: Domain name=LRR_1; Domain location=307-328; Score =1.5; E_value=1.5e+02; Accession=PF00560.23; Description=Leucine Rich Repeat
  Pfam annotation: Domain name=LRR_1; Domain location=331-349; Score =2.1; E_value=1.1e+02; Accession=PF00560.23; Description=Leucine Rich Repeat
  Pfam annotation: Domain name=LRR_1; Domain location=59-82; Score =17.8; E_value=0.039; Accession=PF00560.23; Description=Leucine Rich Repeat
  Pfam annotation: Domain name=LRR_1; Domain location=84-106; Score =9.5; E_value=4.8; Accession=PF00560.23; Description=Leucine Rich Repeat
  Pfam annotation: Domain name=Pkinase; Domain location=590-889; Score =94.0; E_value=4.6e-25; Accession=PF00069.15; Description=Protein kinase domain
  Pfam annotation: Domain name=Pkinase_Tyr; Domain location=634-889; Score=91.7; E_value=2.3e-24; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=108-130::132-155::162 -181::187-206::211-233::235-256::...
  Pfam module annotation: Domain location=258-281::283-305::307 -328::331-349::59-82::84-106::590-889::634-889
LVLKSLRGSWLSPTPNWEGSDPCKDWEGIKCKNSRVISISLPDIGLTGHLSGDIGSLSELEILDLSYNRGLTGSLPQEIGNLKKLLKLVLVGCGFTGRIPDEIGFLEQLVFLSLNSNNFVGPIPPSIGNLSNLTWLDLADNQLDGSIPVSSGTTSGLDMLQKTLHFHLGKNRLSGEIPPKLFSSKMTLIHVIFYSNKLVGSIPETLGLVKSLTLVRFENNSLNGYVPQTLSNLTNVTDLLLSNNKLQGALPNLTGMNSLKYLDLSNNSFDKSDFPLWLSNLKNLTTLQMESVDLNGNIPVNLFSLAYLQNVVLNNNNLGGTLDIGTNNRKHLKLVNLKSNSIQDFEQQNDLPENITIILESNPICTETGAMERSYCKKHNILDTEPQNKCPPDSCSRDQILSPKCICGYPITGTLTFRAPSYFEWRDTTSLEKHLLQEFQSHDLPVDSVSLIISDPFHSFVYTIQIFPRGQDRFDRQDKSTISSILGNLSATSPYDFITGNQGDGPKESTNSSSKVLIIRVAVGGSSVMLVLLVLAGVYAFCQKRRAERAISRSNPFGNWDPNKSNCGTPQLKAARQFSFKEIKKYTNNFSQDNDIGSGGYGKCALKASHAILFFIIAYKYDLETPGRNTDVLVYRGTLPSGQVVAIKRAQRESKQGGLEFKAEIELLSRVHHKNLVSLVGFCFEREEQMLVYEFVPNGTLKDALTGESGIVLSWSRRLKVALGAARGLAYLHEHADPPIIHRDIKSNNILLNENYTAKVSDFGLSKSILDDEKDYVSTQVKGTMGYLDPDYYTSQKLTEKSDVYSFGVLILELITARKPIERGKYIVKVVRSTIDKTKDLYGLHKIIDPAICSGSTLEGFEKFVDLAMECVEDSGADRPAMSDVVKEIEDMLQSVGMHLTSESVTSTTSSHRYQEVSIVSFHLDQPYSNESFGSSAEHIQKLNLVS

SEQ ID NO: 170471 - protein, 217 aa, Glycine max
  Coding DNA Sequence Number=SeqID_53693
  Homolog annotation: Hit_ID=Q1SW45; Match level="QueryCoverage=56%, HitCoverage=81%, E-value=7e-31, Identity=55%"; Hit description=Sec20
MDKVVEEVEKVKKEWDETYKKTQEHIEAIADYGKSARAKEENNSLARLNGIAQDGLALLSSFLFTLDLLAPQLPSEPEVQSTRALLQSSKTLTQKTKAGMTSAAESITESLRRTRQLMVQEVERNTSTLMTLGRAPLVVDENTKSPLHNATSRCHRQRIGLLTLQRKVTEAIKAGMVGQAELRPQAVADDVNLHQVRGNRVPNNAEAPLEQRIHDEL

SEQ ID NO: 170472 - protein, 680 aa, Glycine max
  Coding DNA Sequence Number=SeqID_53694
  Gene Ontology: Mol. function=protein binding
  Homolog annotation: Hit_ID=Q1SJW0; Match level="QueryCoverage=98%, HitCoverage=79%, E-value=0.0, Identity=60%"; Hit description =Ubiquitin-associated
  Subcellular localization annotation: CTP_CleavageSite=71; ConfidenceScore=5.33e-01
DSVVTEKTYAFSIGDGPSSSSQRAGVQSAWAGNTGQVSMADIVKMGRPQARPSMHNSSIQSGNHQNVFMPPAASDNNLHSSQGYASKVSETNTNQGHAISDNVPQNDEWPCIENQHDVRVYADVDAHANSECYANSSSFAEADWQQKTHLDEHGAEDGSVENADNAESASISAKSTSEDNTGAEDDVSSVAANIEQLNIQRDDQGTAQEDDNPSVVIPNHLQLHTPECMNLSFGSFGSANPLSGSGSFTSRPLKSNLEDTSGAADASTIENSDTRNPDYYGDEHLTTTTSDGNLVQGTGVSAGTYEHTSISQEALKPEPPEIAQENQYSFPSHSHGFNYENAQQPEVTFPVSQTSSQNQNLAPFSGVMAHTNSLPSALLSSPVQTAREDIPYLPFPATQSMPTKYSDIASSIGGSTITMSEALRASGISAPQPNAQTLSGAGVATGPTHPQHLAMHPYSQPSLPLGHFANMISYPFLPQSYTYMPSAFQQTFAGNNTYPQSLAAVLPQYKNNVSASSLPQSAAIPPGYGFGSSTSIPGGNFSLNPPAAPTGTTIGYEDVINSQFKDNNHMMSLQQNENSPMWVQGPGSRTMSAVPPSNYYNLQGQNQQQPGGFRQRHQQQQQQQQQPPLQHFGPLGYPNFYQSQTGISLEQQPQNPREASLGGPQSQPSKQSQQIWQNSY

SEQ ID NO: 170473 - protein, 136 aa, Glycine max
  Coding DNA Sequence Number=SeqID_53695
  Pfam annotation: Domain name=Arm; Domain location=42-86; Score=1.4; E_ value=8.1; Accession=PF00514.13; Description=Armadillobeta-catenin -like repeat
  Pfam annotation: Domain name=Arm; Domain location=89-130; Score=40.9; E_value=4.4e-09; Accession=PF00514.13; Description=Armadillobeta -catenin-like repeat
  Pfam module annotation: Pfam domain module=Arm::Arm; Domain location =42-86::89-130
METYISAEILQQLSLLNSPYHTLVKSTVLALVKNVWCRSWVQEDLRDTMVNWGVIPTLAMTLLPAAPDLDVQKGCAYTSLIGFLADDDKPEHRQLIVDAGALPCLIDLLRRHKSSKVQGAAVMTLRILAFNDDENK

SEQ ID NO: 170474 - protein, 456 aa, Glycine max
  Coding DNA Sequence Number=SeqID_53696
  Homolog annotation: Hit_ID=Q1SW35; Match level="QueryCoverage=99%, HitCoverage=100%, E-value=8e-82, Identity=63%"; Hit description=IMP dehydrogenase/GMP reductase
MSDTEGQSHSSGITKKLDSHKTYHGRDPNNGNDLWKDGLICAFEYIRGQNRSAKLSSSSSKITDGMHGQHSKMHHVPSDDKKKLSDPSSVNVSRESLFGGSDDDKESQTPKAGQSKKYEGGHWVPIGWARISELVQAVQVDAEWSSHQFEFEYSKDDFTVADLAAPYWEHPTGPIWWCHASAGHPTWLSNAQWLHPAVSLALRDESRLISERMKHLFYEIDIFMNGKHSIKSLPPSTRLFRKSIFGAADEIELKFMNRRNHEDLNLFILILNLEIRKLSTQVIRVKWSLHARNEIVFELLQHLKGNGARNLLEGIKKSTREMIEEQEADRSLRVTHNLAVFGGVGVVLTIITGLFGINVDGIPGAEHTPYAFGVFTAILVFLGVVLIAVGMVYLGLKNPVAEGQVEVRKLELQELVKMFQHEAETHAQVRKNISPKNLPPTAGDGFRSDADYLVIQ

SEQ ID NO: 170475 - protein, 141 aa, Glycine max
  Coding DNA Sequence Number=SeqID_53697
MSRLCTVEPKNNFGKCMEVVRSKLGVSVLSSKPRLNITQLAISLAESNTHHSDHTPSPSSSVDSPPAAPDGIVMVSPPDTQDIFHTPPKVSLLPSSDDSLDRCVVSHAINVDAESQVFVNFCDGLEFVDLGKDSDLGFSEV

SEQ ID NO: 170476 - protein, 117 aa, Glycine max
  Coding DNA Sequence Number=SeqID_53698
  Homolog annotation: Hit_ID=Q1SE07; Match level="QueryCoverage=62%, HitCoverage=7%, E-value=1e-14, Identity=52%"; Hit description =Armadillo-like helical
MATTLVSSVGGMLAMLNEPHLSVKLHALSNLNNLVETFWPPLVDSLNYAVSAARNTKYAENPHKLANFLIVCIFQGNPETQGLKATSANINNDQFGHKFEISCKAPMKKGGEINKNK

SEQ ID NO: 170477 - protein, 127 aa, Glycine max
  Coding DNA Sequence Number=SeqID_53699
MWIRKMLNWVLLKSISPDGVILKDIPAGGTFAHKVHAWPKQTVSGTGRFAVGEGLATANGDMHMQGEGLTTGNGDMHMQGEGLTTLTGEFPPRRLRARRQAMQDSASFFLLRDFSSCYYVVSPPPIT

SEQ ID NO: 170478 - protein, 789 aa, Glycine max
  Coding DNA Sequence Number=SeqID_53700
  Gene Ontology: Mol. function=protein binding; Cellular component =membrane; Biological process=defense response
  Homolog annotation: Hit_ID=Q2L360; Match level="QueryCoverage=74%, HitCoverage=93%, E-value=1e-114, Identity=38%"; Hit description =Putative CC-NBS-LRR resistance protein
  Pfam annotation: Domain name=LRR_1; Domain location=511-532; Score =10.3; E_value=3.4; Accession=PF00560.23; Description=Leucine Rich Repeat
  Pfam annotation: Domain name=LRR_1; Domain location=534-556; Score =15.1; E_value=0.26; Accession=PF00560.23; Description=Leucine Rich Repeat
  Pfam annotation: Domain name=LRR_1; Domain location=558-580; Score =14.8; E_value=0.32; Accession=PF00560.23; Description=Leucine Rich Repeat
  Pfam annotation: Domain name=LRR_1; Domain location=605-627; Score =5.2; E_value=31; Accession=PF00560.23; Description=Leucine Rich Repeat
  Pfam annotation: Domain name=LRR_1; Domain location=628-651; Score =11.2; E_value=2.3; Accession=PF00560.23; Description=Leucine Rich Repeat
  Pfam annotation: Domain name=LRR_1; Domain location=676-698; Score =2.6; E_value=94; Accession=PF00560.23; Description=Leucine Rich Repeat
  Pfam annotation: Domain name=LRR_1; Domain location=701-723; Score =12.1; E_value=1.6; Accession=PF00560.23; Description=Leucine Rich Repeat
  Pfam annotation: Domain name=LRR_1; Domain location=725-747; Score =7.2; E_value=13; Accession=PF00560.23; Description=Leucine Rich Repeat
  Pfam annotation: Domain name=LRR_1; Domain location=749-779; Score =7.2; E_value=13; Accession=PF00560.23; Description=Leucine Rich Repeat
  Pfam annotation: Domain name=NACHT; Domain location=191-347; Score= -21.7; E_value=0.0028; Accession=PF05729.3; Description=NACHT domain
  Pfam annotation: Domain name=NB-ARC; Domain location=150-459; Score =237.4; E_value=3.1e-68; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::NACHT::NB-ARC; Domain location= 511-532::534-556::558-580::605-627::628-651::676-698::701-723::725 -747::749-779::191-347::150-459
MAESLLFSVAESLLGKLASRAVEKASLAMGVYHDLQQMRVTMALVKALLLDAEQKKQQNNALSEWLRQIKRVFSDAEDIVDNFECEALRKHVVNTHGSVSRKVRRLFSTSNPLVYRLRMAREIKGIKNRLEKVAADRHMFGLQINDMDTRVVHRREMTHSHVNASNVIGREDDKKKIIELLLQDGNDTSPSVISIEGFGGMGKTTLAKLVFNDLIIDECFPLKMWVCVSNDFELRNVLIKILNSTPNPRNENFKNFEMEQLQNRLRNTLHRQKFLLVLDDVWNENRVKWNELKDIIDIGVEGSKILVTTRSHAIAVMMRTKSSNYYRLEGLSEEHSLSLFLKSAFDDGEERKHPQLVEIGKEILKKCGGIPLAVRTLGSSLVSRVNRQEWESLRDNEIWNLPQNEQDILPALELSYDQLPSYLKRCFACFSLAPEDFDISSFYVTLLWEALGFLPQPKEDFLDMGSTCRFKLHDLVRDLAVYVAKGLRTIIFPVEATNEAFLYTLVSRCKYLRVLDLSYSKYESLPRSIGKLKHLRYLDLSGNQKLEELPHSMYKLQNLQTLDLRGCIKLHELPKGIRKLISLRQLLVTTRQPEFPDKEIANLTSIETLELHSCNNLESLFEEIQISTLRFLNFSGCGSLKSFSFHAIKNLESLVIFNCSKLELSMGLGNEIPASRLKLLVLQSLSQLVTLPRWLRGSASTLHSLLIVGCNNLEELPEWLSNLNCLKLLMIEHCPKLLSLPDSMHHLTNLEHLEINDCPELCKRCQPGVGLDWHKISHIKQVIIGEPEE

SEQ ID NO: 170479 - protein, 488 aa, Glycine max
  Coding DNA Sequence Number=SeqID_53701
  Gene Ontology: Mol. function=nucleic acid binding; Cellular component= intracellular; Biological process=DNA integration
  Homolog annotation: Hit_ID=Q1RWN2; Match level="QueryCoverage=87%, HitCoverage=38%, E-value=1e-110, Identity=44%"; Hit description =Peptidase S8 and S53, subtilisin, kexin, sedolisin; Integrase, catalytic region; Zinc finger, CCHC-type
  Pfam annotation: Domain name=rve; Domain location=98-252; Score=92.9; E_value=1e-24; Accession=PF00665.16; Description=Integrase core domain
  Pfam module annotation: Pfam domain module=RVT_2::rve; Domain location=405-488::98-252
MFGHCHSECYTKLSSNKENEVISKFVEENEAEMLLMAVQNSKEPKPDVWYVDTGCSNLMSGMVGIKDPSWLWHFRYGHLSFGELKTLNQKNMVTGLPPIVAPSQVCEDCVVSKQHCSQFPKNKSWRAKDALELEKSKAFIAFKFLKARVENEAGKNIKTLHTDRGSEYCSKVFENFCAEHGIRRELTTTYTPQQNGVSKRMNRKILNMVRSLMTRGRVPKNFWPEAVNWSVHILNRSPTFDVQNMTPEETWSGRKLDVNHFKKFGCIAFVHVLDQKRKKLDDKAGKCVYCTKNIVTSKDVVFDEENTRDWNRQQPTQVFLDENDEKGQTLASSTFEKIAPIVTENSPTNNDNEEELSPRIRKRPAWMDDFLVTRIPNSITHFALFSDCDPTTFESAVKEEKWRKTMNDEIDAIERNDTWELCDLPKEHKTIGVKWVFKTKLKENGEVDKYKARLVAKGYKQQYGIDYTEVFSQVARHDTIRLMIALVA

SEQ ID NO: 170480 - protein, 336 aa, Glycine max
  Coding DNA Sequence Number=SeqID_53702
  Gene Ontology: Mol. function=electron carrier activity; Biological process=electron transport
  Homolog annotation: Hit_ID=O22943; Match level="QueryCoverage=99%, HitCoverage=43%, E-value=1e-143, Identity=71%"; Hit description =Expressed protein
MAEEGFWTEKDVKLTAAWLQDLLAVGYQQPRLMSLELGRPRANIGHGDQKEFVPQKLPSVHLGVEETGTVNYEISNLIRWRKTFGNVVLIMHCNGPVERTALEWRLLYGRIFRSVVILSEKKDVDLVVGEGHLDYAYRYLPKIFDQFSSAEGFLFVQDNTILNYWNLLQADKTKLWITNKVSESWSSILTNGEDSDWLSQQARMVQKVVSMMPAHFQVSYKETSDNDKNLLICSSELFYVPQRLISDFVELVNLVGDLEIHQKVAIPMFFVSLDSPQNFDPVLDRMIYKQNPPANSTTLYSAKVPAVHPLSVSSEQDFIKLIRIMAEGDPLLMELV

SEQ ID NO: 170481 - protein, 115 aa, Glycine max
  Coding DNA Sequence Number=SeqID_53703
  Gene Ontology: Mol. function=transferase activity, transferring glycosyl groups; Biological process=metabolic process
  Homolog annotation: Hit_ID=Q8S3B5; Match level="QueryCoverage=96%, HitCoverage=27%, E-value=7e-37, Identity=68%"; Hit description =Putative glucosyltransferase
MGLVEGLGIPTGNSEPLFNRGFMSQCEWNSCLESITMGEPIAALPMHSDQPRNTHRNPLVSASVVENTVRRLMETNEGDEMRERAVRLKNAIHRSMDEDGVSRMEMDSFIAHITK

SEQ ID NO: 170482 - protein, 50 aa, Glycine max
  Coding DNA Sequence Number=SeqID_53704
  Gene Ontology: Mol. function=nucleic acid binding
MAWNNIRCFNTTFNNMPILFRPQEILHQHAPMVIVIIKAWNNRLHKVLFR

SEQ ID NO: 170483 - protein, 85 aa, Glycine max
  Coding DNA Sequence Number=SeqID_53705
MEWRVEVPDVSLTQTCRSSLYSSTSLSHDITSLTSLLELEPNNIFFVTTHNLNLIVNNLALDHTIVASEHAIRLAPALTPSSHSH

SEQ ID NO: 170484 - protein, 101 aa, Glycine max
  Coding DNA Sequence Number=SeqID_53706
MTSKRSMFQSLSPMSSGVVTFGGNQKGLITDVVKAHRYDMSNEYWVKAMQEELDQYQKNDVWKLVELRTSKEVQDGQYKVNEDPYASNHCTWIGQSFKAGE

SEQ ID NO: 170485 - protein, 82 aa, Glycine max
  Coding DNA Sequence Number=SeqID_53707
MIKQKHLLQECTLANIELDKLKKKNSDLWMECQHYKKMPSDLNYKHREHMVFRELLLEIVKLYEEIEILRGKQGKFVGGHEV

SEQ ID NO: 170486 - protein, 169 aa, Glycine max
  Coding DNA Sequence Number=SeqID_53708
  Homolog annotation: Hit_ID=P09468; Match level="QueryCoverage=42%, HitCoverage=53%, E-value=7e-28, Identity=88%"; Hit description=ATP synthase epsilon chain
  Pfam annotation: Domain name=ATP-synt_DE; Domain location=26-73; Score=58.5; E_value=2.1e-14; Accession=PF00401.10; Description=ATP synthase, DeltaEpsilon chain, long alpha-helix domain
MALMGGFARINNNEIIVLVNDAEKDSDIDPQDAQQTLEIAKANLNKAEGKRQTIEANLALRRARTRVEAINRWRGGLQCHRKAHSCVLRALVFGVVCLVRGIPYAPQRRSGSKRFREISVSYGSYKSSSSSLTEDDDDDDDDGDSSEKDIKSGSVSSSAVTRYDQMKLK

SEQ ID NO: 170487 - protein, 148 aa, Glycine max
  Coding DNA Sequence Number=SeqID_53709
MQQVEHSNIFASKESLSKAFVVNDASKEESNDDDFDEEDDELCLIIRKIRKVCRNKNPSKFNGSSKRSFHKKEKKHLKLECPDLENPKDKNKKFFKPKKNSLMSTWEDLDYYSSDEDSEEEANLCLMADVSTSKAESTLDVSLDNEES

SEQ ID NO: 170488 - protein, 150 aa, Glycine max
  Coding DNA Sequence Number=SeqID_53710
  Gene Ontology: Mol. function=structural constituent of ribosome; Cellular component=intracellular; Biological process=protein modification process
  Homolog annotation: Hit_ID=A0DBT3; Match level="QueryCoverage=91%, HitCoverage=79%, E-value=2e-41, Identity=63%"; Hit description =Chromosome undetermined scaffold_445, whole genome shotgun sequence
  Pfam annotation: Domain name=ubiquitin; Domain location=1-53; Score =60.4; E_value=6.1e-15; Accession=PF00240.13; Description=Ubiquitin family
  Pfam annotation: Domain name=ubiquitin; Domain location=61-129; Score= 117.4; E_value=4e-32; Accession=PF00240.13; Description=Ubiquitin family
  Pfam module annotation: Pfam domain module=ubiquitin::ubiquitin; Domain location=1-53::61-129
MARLAELKLDDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKEYNIEGGSVLHLVLALRGEGKGRLMFVEVLSDFGMEWS

SEQ ID NO: 170489 - protein, 147 aa, Glycine max
  Coding DNA Sequence Number=SeqID_53711
  Subcellular localization annotation: CTP_CleavageSite=77; ConfidenceScore=5.27e-01
IARKIRTKVAWTTSCSGDRKPNVGEAEKVLSPASVSGEASSCLSSSSSGISSERSLRYAKRCRGAIVSVAGINRETAAAAKRRGAGSPHLHRRGEAILKLLSCCGGSSEVKIRQMLGDSPDTSKALRMVDAVKRSGSGGRYDPYVYM

SEQ ID NO: 170490 - protein, 111 aa, Glycine max
  Coding DNA Sequence Number=SeqID_53712
  Subcellular localization annotation: CTP_CleavageSite=28; ConfidenceScore=5.33e-01
MVPTLVDTFAFCSIGMLSSIKGKSLFMSLSMVKGWAMSVPMTGKCNEEETSSKVMVISSTALAHVVADRSIHVQLCGPYRIKVVSNQLGLLQMAFQRSSQQTVPLPPRCHL

SEQ ID NO: 170491 - protein, 58 aa, Glycine max
  Coding DNA Sequence Number=SeqID_53713
  Homolog annotation: Hit_ID=Q40495; Match level="QueryCoverage=93%, HitCoverage=7%, E-value=7e-13, Identity=73%"; Hit description=N -ethylmaleimide sensitive fusion protein
MTLLSINVRLPLATFSSRKNLTLSHWVLVGISGLSAKFEDIYQRAFASRVIPPHVTLK

SEQ ID NO: 170492 - protein, 138 aa, Glycine max
  Coding DNA Sequence Number=SeqID_53714
MDKENPAYPTWEYQDQSLLVWLQSSLSEAIMLKVVGCVHSQAGKVKRKCCSSCTKYNSRAQTTKAEDTDSKSTPQVQLTQCNILDFLLLDDSHTTILHTVTLHLTALLVSEKLSTDGSDLGRVLANVELSEVSPCEMS

SEQ ID NO: 170493 - protein, 155 aa, Glycine max
  Coding DNA Sequence Number=SeqID_53715
  Subcellular localization annotation: CTP_CleavageSite=12; ConfidenceScore=5.03e-01
MRFQPRAMSMLSLAMVKVNGSILLRGTLSQDGLYVFSNLLHPSVKSIVGGVFAAIHMSSFSILSSNCNNVNTSNRLGHPRSVVFVPTEQTASLVSTNIESSQFNSSLSTPPPQPQNTHPMQTRSKSGIVQPQLHPTLLLTTAKSTSVKHVLSSPE

SEQ ID NO: 170494 - protein, 96 aa, Glycine max
  Coding DNA Sequence Number=SeqID_53716
MKFSRIVASSFWSTRSLMRIHAYTCLHENLGDEEMSLCLDDECSNNKGVESMDDLLSEEQFYDVFDVVEGGLIDDIYDILNINLMTISDEELKNRL

SEQ ID NO: 170495 - protein, 151 aa, Glycine max
  Coding DNA Sequence Number=SeqID_53717
MVSLETFESYVQPPREKPRDHALGDFEPYPMFIVEGPVCSGMPQPNAAGAPQQRLLQPLHFSVGRLPQTVEGREKLDLIEERLRAIEGIGDYPSADMAELCLVLEVIIPPKFKVPYFDKYKGAACPKNHLKMYYQKMGAYSRDEKLLLHFF

SEQ ID NO: 170496 - protein, 114 aa, Glycine max
  Coding DNA Sequence Number=SeqID_53718
LPAPFINQGANEPVDAKRLTSSSAPFAIQGQRVKWQREIPYGYSRLSSTEGNKFDGFYSRRPETFKNDDARDSSLLGKDGQMQWHREVSWLSNFVSFKTLKFVDASDAFSFLSE

SEQ ID NO: 170497 - protein, 270 aa, Glycine max
  Coding DNA Sequence Number=SeqID_53719
  Gene Ontology: Biological process=response to biotic stimulus
  Homolog annotation: Hit_ID=Q45W75; Match level="QueryCoverage=60%, HitCoverage=83%, E-value=3e-44, Identity=55%"; Hit description =Disease resistance-responsive family protein
  Pfam annotation: Domain name=Dirigent; Domain location=98-269; Score =214.4; E_value=2.6e-61; Accession=PF03018.5; Description=Dirigent -like protein
  Subcellular localization annotation: CTP_CleavageSite=48; ConfidenceScore=5.19e-01
MASSDNELGTQSVGCDAKDVVKFSISVPTTSRPHNGRSGFGSSVPMCNCGIMVEIWEFSGSRWMPMEISLFTLELYFAFLVPNNMAKSTFFVCLNLSLLFSLVTATYYSSLTPTLLGFREEQFTHLHFFFHDVVTGPKPSMVFIAEPNGKAKDALPFGTVVAMDDPLTVGPEQDSKLVGKAQGIYTSISQEEMGLMMVMTMAFTDGDFNGSTISVLGRNMIMSEPVREMAIVGGTGAFRFARGYAQARFYSVDFTKGDAIVEYDVFVNHY

SEQ ID NO: 170498 - protein, 202 aa, Glycine max
  Coding DNA Sequence Number=SeqID_53720
  Homolog annotation: Hit_ID=Q45W75; Match level="QueryCoverage=63%, HitCoverage=61%, E-value=4e-32, Identity=52%"; Hit description =Disease resistance-responsive family protein
  Pfam annotation: Domain name=Dirigent; Domain location=22-194; Score =194.5; E_value=2.5e-55; Accession=PF03018.5; Description=Dirigent -like protein
MANSKTLSSTFFTFLTLTFLFSFLVTANYYQNIPPTYLGFREEKLTHFHFYFHEVVTSQKPSLVIATEPLKGKSNCPLPFGSIVVMEDPLTIGPELDSKLVGKAQGFYISSAQTEGLELELVMGMTLAFIEGEYNGSTLSVLGRNAIFSQVREMPIIGGTGAFRFARGFVQARSVKVDYQKGDATVEYNVYVLHYSSHEDFN

SEQ ID NO: 170499 - protein, 318 aa, Glycine max
  Coding DNA Sequence Number=SeqID_53721
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=87%, E-value=8e-87, Identity=31%"; Hit description =Leucine-rich repeat
  Pfam annotation: Domain name=LRR_1; Domain location=105-127; Score =10.7; E_value=2.8; Accession=PF00560.23; Description=Leucine Rich Repeat
  Pfam annotation: Domain name=LRR_1; Domain location=129-152; Score =11.8; E_value=1.8; Accession=PF00560.23; Description=Leucine Rich Repeat
  Pfam annotation: Domain name=LRR_1; Domain location=154-177; Score =6.0; E_value=22; Accession=PF00560.23; Description=Leucine Rich Repeat
  Pfam annotation: Domain name=LRR_1; Domain location=18-40; Score =16.7; E_value=0.086; Accession=PF00560.23; Description=Leucine Rich Repeat
  Pfam annotation: Domain name=LRR_1; Domain location=202-221; Score =5.0; E_value=33; Accession=PF00560.23; Description=Leucine Rich Repeat
  Pfam annotation: Domain name=LRR_1; Domain location=251-270; Score =0.9; E_value=2e+02; Accession=PF00560.23; Description=Leucine Rich Repeat
  Pfam annotation: Domain name=LRR_1; Domain location=272-294; Score =1.7; E_value=1.4e+02; Accession=PF00560.23; Description=Leucine Rich Repeat
  Pfam annotation: Domain name=LRR_1; Domain location=300-318; Score =9.1; E_value=5.5; Accession=PF00560.23; Description=Leucine Rich Repeat
  Pfam annotation: Domain name=LRR_1; Domain location=47-68; Score=2.3; E_value=1.1e+02; Accession=PF00560.23; Description=Leucine Rich Repeat
  Pfam annotation: Domain name=LRR_1; Domain location=81-103; Score =10.9; E_value=2.6; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=105 -127::129-152::154-177::18-40::202-221::251-270::272-294::300-318::47- 68::81-103
MDNNLHGTISDALGNLTSLVELDLSYNLLEGTISTSLANLCNLREIGLSYLKLNQQGITTLAVRSSQLSGNLIDQIGAFKNIDMLDFSNNLIGGALPRSFGKLSSLRYLNLSINKFSGNPFESIGSLSKLSSLRIDGNNFQGVVKEDDLANLTSLKEFHASGNNFTLKVGSNWLPSFQLTYLDVGSWQLGPSFPSWIQSQKKLKYLGMSNTGIIDSIPTQMWEAQSQVLYLNHSHNHIHGELVTTLKNPISILTVDLSTNHLCGKLPYLSNDVYGLDLSSNSFSESMQDFLCNNQDKPMQLEILNLASNNLSGEIPDC

SEQ ID NO: 170500 - protein, 104 aa, Glycine max
  Coding DNA Sequence Number=SeqID_53722
MGNLKKGKIIDDTTSFECISCNSRARCYEWYGDERVLPADYFNHFWQHRGNINGKKTILAWGAVWASVIWALWKHRNDIKFNGGELAVYFVEGILSGTFVHANC

SEQ ID NO: 170501 - protein, 116 aa, Glycine max
  Coding DNA Sequence Number=SeqID_53723
MASRLIQDCFNKQSLASRLTQRSSLALKHSAFKTCKALERDYFMKIKPFEKQTSDSNTTFVIRDPMKKIHMVKNKSLKKVHMAEWRRKKDDWRCHYFKEKMSQEEAHHHRKPWIGV

SEQ ID NO: 170502 - protein, 216 aa, Glycine max
  Coding DNA Sequence Number=SeqID_53724
MGDFNVVRRLEERIGRLNGSQHGGRDIEEINAFIDSMELLDVLLVGRSFTWVRAEKLKILKLEIKNWSKEKFEGSKENMIVDNINNLGLKEEIEGLSLEDSDSNTKYFHTIVNWRKRCNFIKGVKVDGNGVRFKTISEENNSILVHVFSKEEIKSTVVKVDIVRVLNELYAHGKLPKGTNALFRTLIPKKGLSGLMREVEEKELISKVVISDGNLK

SEQ ID NO: 170503 - protein, 184 aa, Glycine max
  Coding DNA Sequence Number=SeqID_53725
MQSEELTLPSEAKVGPSDARASTKESCVDPSGQDPKTSDLDKFGLYVDDSPPCLVALRRVYEGSTIVHNVPLGNDQLKVGVEEVRDDHACVPVLTQEDKQVAEGPTKHVPWDANMFGVYNDNFPLYIKHEDLSKIAHGGQCLSISIIQLWILHMTKTIMRAGNVDVYGFLEPQSIQRFRKSQFE

SEQ ID NO: 170504 - protein, 323 aa, Glycine max
  Coding DNA Sequence Number=SeqID_53726
  Subcellular localization annotation: CTP_CleavageSite=35; ConfidenceScore=5.04e-01
MAESSKKRKGSSSTSTATDHRRHGTSGDPPAPALRANAPLSYPHLVTFFLHHFNVPLVDEPYVKVKRSFSIDVSVVTSFGYRKDVDGQWVHKQDLPPPIPDECTPSPPPQRDASSSLLTEVLTELHDLRAFVGEHFDEIDTHFDGMNTRITRLEDDMSFIRTSKSQSAQNEMSSSLRLGAMASSTSFMTRRNAGPILEINRCTPYKQKHNSNCDGGKREGECYLGGSVSKEEPTVVENKIYVLDKETHHFGIVAFHACQRQKQRLRMRGEKSREEDDGVPVGGQNGATIVEHGLNLLSCWGKREEKQHLAGCEREGDFAHTDI

SEQ ID NO: 170505 - protein, 77 aa, Glycine max
  Coding DNA Sequence Number=SeqID_53727
MVAVGDGESAWDIRNGFGRKKGEEIAFFLSYTKAKGVTSRNHFHRHLSILSSLFTSVSDHEALREHLPKIGPYRPCL

SEQ ID NO: 170506 - protein, 116 aa, Glycine max
  Coding DNA Sequence Number=SeqID_53728
  Homolog annotation: Hit_ID=Q1SDA8; Match level="QueryCoverage=36%, HitCoverage=12%, E-value=3e-15, Identity=86%"; Hit description=Heat shock protein DnaJ, N-terminal
  Pfam annotation: Domain name=DnaJ; Domain location=70-115; Score =57.9; E_value=3.3e-14; Accession=PF00226.21; Description=DnaJ domain
  Subcellular localization annotation: CTP_CleavageSite=18; ConfidenceScore=5.19e-01
MLSTSLKSLLLLPSCRASAFLLSSAIPLAIRRTSIIPLSSPWSAAWVFWWFEFAWFICRTSGFFICCRKSYYDILKLSKGASDEQIKRAYRKLAMKYHPDKNPGNKEATKKSRSLV

SEQ ID NO: 170507 - protein, 136 aa, Glycine max
  Coding DNA Sequence Number=SeqID_53729
  Homolog annotation: Hit_ID=UPI000034F0B9; Match level="QueryCoverage =47%, HitCoverage=8%, E-value=1e-15, Identity=64%"; Hit description =electron carrier
MGNYGSLNEVECSGRGVVAAVLANVGYKVLVLEKGSYSTRNNVSLLEGPSMDQMYLSNGLVATNDMSVLILAASTVGDEGNNQCCYKWRVCSNGDEIRSAHARNLLVGGLLNKVGKDNAKADIQLETCTYSSRCDL

SEQ ID NO: 170508 - protein, 153 aa, Glycine max
  Coding DNA Sequence Number=SeqID_53730
  Subcellular localization annotation: CTP_CleavageSite=63; ConfidenceScore=5.70e-01
MGSPPASPTPPSPPPPSSSPSPPRPPPTSDASASTSAVKRTRAKPHVYDRCGHHLRELEGGPYCSEGPDLGGYSADQDGVEDTVYDKYGISKEKWAQFCQTRRDPSWEDVRIKAQAIQKQNTVPHVLSRGGYDYLEQKLLAEKTKKKLQEAAQ

SEQ ID NO: 170509 - protein, 155 aa, Glycine max
  Coding DNA Sequence Number=SeqID_53731
EEPTEDLALHNWKASFTTKRREKGMIEEIQAVFAQQNGLSVRINGFRLSAYFPRSANGLKRYLAPFVAQYVKFCDMPEIKRKHCYTICEIPMFLQKAVASGGSNLARLGELGGKLLPYFPINRGRSEGERGSALLIFNRSSSFIVRSSSLFGLQS

SEQ ID NO: 170510 - protein, 111 aa, Glycine max
  Coding DNA Sequence Number=SeqID_53732
MPISPCESIGITPARHPVDPKKSNRVLGFPALIAGFCQFYGVPVIPSNVIRPPTNRAFIKKYCAPRKAEDETLQQPGDGQQQASNASPPPPEPLSSSTKRLEYCLRHMADK

SEQ ID NO: 170511 - protein, 137 aa, Glycine max
  Coding DNA Sequence Number=SeqID_53733
MLHSLLQSIHKGKSIIMQSLQGLGLPSIMSMEEFDAQVAYPGDQPSSSRGDGASVAHEPMTEEPRAFAKRDTQWLSARKNPEEDELSGSLSAPLQVIKRTTSAHPLSERSALRQNSLMRAKRFRFALSARAQTNPPI

SEQ ID NO: 170512 - protein, 1068 aa, Glycine max
  Coding DNA Sequence Number=SeqID_53734
  Gene Ontology: Mol. function=RNA-directed DNA polymerase activity; Biological process=RNA-dependent DNA replication
MYLVDPGQQIISPSSEPACGQKRLSSVKGICPMSKEAASCLGSSLDKLVRLVKPPSLDKCCLGCFCQVVQGGHAFGFAGQAFLVGDQASPLGDRFWLHFGLAIRGRRVERLVVEPLYCIFLMLGACLLVDGSPTSTGIMVFMSYVSHKGVSLVVVWGEQWQAQSILGSSSFHRPLYLSSLEVFISLSLELGVVVGDNGIREAISAHELISTSRYLTALGAFGSGPNMFIPHMEKGQGELILWRLLGGGVSPECWLVVVSVHHFGGKGASPGVKTTDPFMKFSHDVVCLLVIQSFEQGSGVELRSHLVEISLELGNSCRGVYGGSLERLLDDSLEVLNIFGADYLREQVCSGVVLPGDIVKAFEDDSCSVPLHVGRTTNVEAPLVWGDLVVSSKLCHKVFMNCVFMGPQGSYWRSKSKSSTDQGTILLASSGFPKTCLMGVMEYAFSEVDGKTGGVAMVFLKARKACSQVSSQRNDSVFLSSLLNNFTFSPIDDRQRICILGTRPVQISIVGAHSPFVVGLFDHDNIGEPGGILDFSDEVGFKELDINYASVLMSGEVPVELRALPDCQGSNWRPFVHADDFSGTIRCGVRLDRLPGHKLHTSALRVPLTGGGIDKIKDSDTQVAYDHRVEGFDGTRAVLSLVDNSRLIDNSRELRDNHVSDAPMLMMREVLIELHALLQFGSKFQLDKLFDGFQAFVGGVVSRIYVKFSAYVGLALCIALACLLLVILNDYNLPSLGEHALIEGGHQVHVAFDLDSFACKVEEWNCVMVDNIGTLDTMKFTMMMEKTTVFLVDGVDTLEVPVVAHAIVDVVFVCFGLLLFSYLLPGSYATPLDVLRVSVITWLRLTSTSEVSSSVAGWVPPERLALVWLVPLVQLVQVGLGVCFVLVVLLSSMLLGAFLHRLPMNLPGRKARSMECNATLGLRIRIWMTGHAMRPDGGILSTESFDEGVETVYDLGGSPPYQEGIQMLIWIGCPIVPFEVEWLPPQGDLGRLQCCPCIKSVIPLRCVQASLMPDLVLIMDRCERIDERPWVGSQTSHASIEGAFDRRGDMQNEGLRCLSENVYKEIKA

SEQ ID NO: 170513 - protein, 118 aa, Glycine max
  Coding DNA Sequence Number=SeqID_53735
PTKGVGRLRQQDGGHGSRNPLRRRGGRCKTQGASPGGAVVGADLGGTGEARLIALCARTPKGNRPAHPGNGSAGGRVQRLEEHRTSRGVREVGKWIRNLGKGLALRAGHGGPSPEARR

SEQ ID NO: 170514 - protein, 51 aa, Glycine max
  Coding DNA Sequence Number=SeqID_53736
MVKILESVADVVSESQAVIITRRKGTKEQQRRKVWGAQERTPSIENAVESV

SEQ ID NO: 170515 - protein, 38 aa, Glycine max
  Coding DNA Sequence Number=SeqID_53737
MGSQPNVLIQKVTAMMNRVGAVQGLSYFDSWSWGSSIA

SEQ ID NO: 170516 - protein, 37 aa, Glycine max
  Coding DNA Sequence Number=SeqID_53738
MFDERHYLSIGANMVAASGVGAAAVVATNPLWVVKTR

SEQ ID NO: 170517 - protein, 106 aa, Glycine max
  Coding DNA Sequence Number=SeqID_53739
  Subcellular localization annotation: CTP_CleavageSite=7; ConfidenceScore=5.12e-01
MTALSTRSNLRKRNIRLNNMDFSSIMPSPRRNVRTLSFLVPDSINLGHLVIAEQVWFINQEVDVESLRNSITVRAWFWISCKAKLNHLSFYDWSTNLLECLNRSAK

SEQ ID NO: 170518 - protein, 146 aa, Glycine max
  Coding DNA Sequence Number=SeqID_53740
  Homolog annotation: Hit_ID=Q9FIQ3; Match level="QueryCoverage=84%, HitCoverage=85%, E-value=2e-14, Identity=34%"; Hit description =Arabidopsis thaliana genomic DNA, chromosome 5, P1 clone:MZA15
  Pfam annotation: Domain name=UPF0131; Domain location=20-119; Score= -13.7; E_value=0.049; Accession=PF03674.5; Description=Uncharacterised protein family (UPF0131)
MERESEKAKPHLIFAYGTLKRGFPNHYLMEELRSKDDAVLLGSYVTNEPYPLGEVYAVSEEAVVVLDEFEGVSAGYYERLAVTAAEEEGGGKVEAEAYWGHRRFGEVLWKMKGEVGLREYGEKEAREYVRKEDRSGGRNTILDLVP

SEQ ID NO: 170519 - protein, 196 aa, Glycine max
  Coding DNA Sequence Number=SeqID_53741
MPMTRLTGDERRAVRELSVAHPLSMYGWSLTFFIMKVDPSVPCMVIARVLRKGKQIGRNSWQAWDAVQRKDNELKGSSNVGKRLKWEWGRIQFLRALWGSNNELKLQRAKRNESRVESMILEDKLMACCHTLISSGDHLFGGMRPSFDRFEYFREENPSRGASAMLPRRFRERIREGFPLFFTVLHPFFVHSSFFN

SEQ ID NO: 170520 - protein, 704 aa, Glycine max
  Coding DNA Sequence Number=SeqID_53742
  Gene Ontology: Mol. function=protein binding
  Homolog annotation: Hit_ID=Q93YP4; Match level="QueryCoverage=59%, HitCoverage=43%, E-value=4e-39, Identity=31%"; Hit description=Epsin- like protein
MASEAMLKLKTNLWKQGIFKVDNVQYKWAGLSGNFLSKIWVLLLAMKKLLVNLAALDAETSAPSAPRDSSPHVNDNPSQISAPTGSFPVNNNPTEATTAASGAQETETTDDFFDPRGPSSAAPAAPATTNSVEMDLLGSLSDSFSSNALSLVPAASATAAPDANSGSTASFAAAPSGSNNFDQSFEDPFGDSPFKAFTSTETAPSQPQTYQSIEPSQSNGLNAETNSNYGFGDSFSVVPYSAPVSSDAQPFSANSQFPSQDMSSSQPETDILADILPPAPLPEMHSQQNISAPAFDHPSSPSFPASSGQMASQPFSEPTGQFPQQGFSAATSQPAQTFPVPTDQFSQQHFSAPNGQPGQVQSSFSSPSSQYAQQPFSSHAGQPGLHAFSSPTGQHMQSPFASQGGQPAQSGSMYGGLHSQGGSPTMSPQSQNGYNGHMNSGNFGSMAAFPSHMAPQAPTGQLSQGTNFPHHGGSIAHTAPHLSSHSPTHQPSQFNSQSFTGQQGNATPHSSPITNQSLASQSNSLVSQPSKDKFETKSTVWADTLSRGLVNLNISGPKTNPLADIGVDFEAINRREKRMEKPTTTAVTSTVTMGKAMGSGSGMGRSGAGSLRPPPNPMMGSGMGMGMGMGMGNGPSVGMGMGGYGGMNTSMGMGMGGMGGMGMGQGYHNQMQPPTRLPPGSNIPGSYGQQPYGSYGQQPYGGYR

SEQ ID NO: 170521 - protein, 93 aa, Glycine max
  Coding DNA Sequence Number=SeqID_53743
MEIVKKHDSGGLVWKRIKLTTTRKANAKKRLLRVWQNEAVLKACSATPNEPQPTPVATPVWRLEQMLNCCVLKERPPQVKVKRPPQGKVKVEE

SEQ ID NO: 170522 - protein, 707 aa, Glycine max
  Coding DNA Sequence Number=SeqID_53744
  Gene Ontology: Mol. function=catalytic activity; Biological process =metabolic process
  Homolog annotation: Hit_ID=Q9ZW77; Match level="QueryCoverage=64%, HitCoverage=76%, E-value=1e-108, Identity=51%"; Hit description =Putative carboxyphosphonoenolpyruvate mutase
  Pfam annotation: Domain name=DUF6; Domain location=69-196; Score=7.1; E_value=0.026; Accession=PF00892.11; Description=Integral membrane protein DUF6
  Pfam annotation: Domain name=DUF914; Domain location=1-224; Score =300.4; E_value=3.4e-87; Accession=PF06027.3; Description=Eukaryotic protein of unknown function (DUF914)
  Pfam annotation: Domain name=ICL; Domain location=233-542; Score= -302.6; E_value=0.0025; Accession=PF00463.11; Description=Isocitrate lyase family
  Pfam annotation: Domain name=TPT; Domain location=60-196; Score= -38.8; E_value=0.1; Accession=PF03151.7; Description=Triose-phosphate Transporter family
  Pfam module annotation: Pfam domain module=DUF6::DUF914::ICL::TPT; Domain location=69-196::1-224::233-542::60-196
MLLDCWSIPSVMLLTWLFLKTKYRFKKITGVVVCVAGLVLVVFSDVHSGDRAGGSNPRKGDLLVIAGATLYAISNVSEEFLVKNADRVELMAMLGLSGGIISAIQISILERNELKSIHWSAEAALPFVGFAVAMFMFYSLVPVLLKINGSTMLNLSLLTSDMWAVLIRIFAYHEKVDWMYFVSFGAVTIGLIIYSGGDIDEDQHPPNAAIVDLGPAVKQDEEANSGNHSKGTAAGSSKTWGIGIGIGMEKVKVLRRLLETPGVHQGPACFDALGAKLIESAGFPYCITSGFSIAASRLALPDTGFISYGEMLEQGQLITQAVSIPVIGDADNGYGNAMNLKRTVKGFIAAGFAGIILEDQIAPKACGHTRGRKVIPREEGVMKIRAAVDARRESGSDIVIVARTDARQAVSLEEALTRCKAYGDAGADVLFIDALASVQEMKALCQLSPHLPKLANMLEGGGKTPILSPQELEDVGYKLAIYPISLIGVCIRAMQDALTAIKGGAVPPPGSMPSFEEIKDIVGCMFVDADVDGVNEVEGDFFAHGGEAEGGGLFRYESAANMLEGGGKTPILNPMELEEIGWGFYTSNAGGRIPPPGSMSSFEKIKDILGFNAYYEEEKRYATSTNQQLSNRESNSLYSIQRRDQVDKEQTSQSFKDPIVEVITPDDVYNKYGADSSRNPFSGIWSRTLRVKITGRDGFEKLDLRIP

SEQ ID NO: 170523 - protein, 535 aa, Glycine max
  Coding DNA Sequence Number=SeqID_53745
  Gene Ontology: Mol. function=methyltransferase activity; Cellular component=cellulose and pectin-containing cell wall
  Homolog annotation: Hit_ID=Q1S1Q1; Match level="QueryCoverage=98%, HitCoverage=76%, E-value=1e-129, Identity=43%"; Hit description =Generic methyltransferase
  Pfam annotation: Domain name=DUF248; Domain location=1-533; Score =765.3; E_value=3.8e-227; Accession=PF03141.7; Description=Putative methyltransferase
  Pfam annotation: Domain name=Methyltransf_11; Domain location=103 -198; Score=41.1; E_value=3.8e-09; Accession=PF08241.2; Description =Methyltransferase domain
  Pfam module annotation: Pfam domain module=DUF248::Methyltransf_11; Domain location=1-533::103-198
MFRKERHCPQSTTERLRCLIPIPPGYQTPFPWPKSKDTAWFSNVPFPKLVEYKKSQNWVRLEGDHFVFPGGGTSFPEGVKAYVNALKRLLPVPLESGDVRTVLDVGCGVASFGASLMDYGILTMSLAPSDEHQSQVQFALERGLPAILGVLSIHRLTFPSRSFDMVHCSRCLVPWTDYDGLYLREIDRILRPGGFWVLSGPPINWRVNYKAWETEPHELKKEQNTLEDLAMQLCWEKVAERDQIAVWQKHIDHISCMQKLKTRRSPKFCNSSESDPDAGCPIERLRTILEKVIKKGLMVNNIYDDLVFKTLEDGNLYIAKVSLFLNPFKNFEFTTVLLRYTKMTACIFPLPDVKDVHEVSGGVLEKWPMRLETVPPRVRNENDDGFTLKTYIEDNQTWKRRVSNYGVLLKSLSSGKYRNVMDMNAGFGGFAAAIVKYPVWVMNVVPFDVKSNNLGIIYERGLIGTYMDWCDITDILLEMHRILRPKGAVIVRDHGDVILKVKEITDRIRWKGIVVAGDQDGPFHPEMIMVINNDD

SEQ ID NO: 170524 - protein, 42 aa, Glycine max
  Coding DNA Sequence Number=SeqID_53746
MEGHREKLKMNPVISDVVIRRIVMVEVSMKMPIWMFKLTTWA

SEQ ID NO: 170525 - protein, 216 aa, Glycine max
  Coding DNA Sequence Number=SeqID_53747
  Gene Ontology: Mol. function=nucleoside-triphosphatase activity; Cellular component=chloroplast
  Homolog annotation: Hit_ID=Q2PMM5; Match level="QueryCoverage=99%, HitCoverage=16%, E-value=2e-93, Identity=89%"; Hit description =Protein ycf2
MSHTNGFGSTTMGSNVRDLVALTNEALSISIIQKKSIIDTNIIRSVLHRQTWDFRSQRFLYEKYESEFEEGGGVLDPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKH

SEQ ID NO: 170526 - protein, 286 aa, Glycine max
  Coding DNA Sequence Number=SeqID_53748
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=99%, HitCoverage=23%, E-value=1e-150, Identity=83%"; Hit description=DNA -directed RNA polymerase beta'' chain
  Pfam annotation: Domain name=RNA_pol_Rpb1_5; Domain location=32-277; Score=-59.5; E_value=5.2e-07; Accession=PF04998.8; Description=RNA polymerase Rpb1, domain 5
  Subcellular localization annotation: CTP_CleavageSite=38; ConfidenceScore=5.09e-01
MNPNFRMTDPFNPVHIMSFSGARGNASQVHQLVDTAVRTSDAGYLTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQVRAPYNGKIQFNEDLVHPTRTRHGHPAFLCYIDLYVTIESGDIIHNVTIPPKSFLLVQNNQYVKSEQVIAEIRAGTYTFNLKEKVRKHVYSD

SEQ ID NO: 170527 - protein, 129 aa, Glycine max
  Coding DNA Sequence Number=SeqID_53749
MIMRGQDIYSSQYEATTSPSSSESEEAKGEESSKELYPEEKGQPLMEECKEVSVSSKRLAKKESHFAIKTNIKETSPLRQPPYFLLCQKTLVSTATPLRLEVIPQVKELLDECFVRKSLNLCALLVPKI

SEQ ID NO: 170528 - protein, 124 aa, Glycine max
  Coding DNA Sequence Number=SeqID_53750
MRGLNLTERFKSIEVHALNSSSSETNRGNSSKASVAAATKPHNYLDRNKTMLPSWSKTKSRTTNNNSTSSVADLAPSVVCVVELMMTASVKNSQIRKPAFLVCVCQIRKVMFCSVLEVKKSVGT

SEQ ID NO: 170529 - protein, 193 aa, Glycine max
  Coding DNA Sequence Number=SeqID_53751
VFRKCASSGILPDEPLLPESSRKRFSGSLPEEVFFRKTFGYFRKNTSSRNFPEKVLPELPEEPLTGLPEDSVVSLLRHFFRRPLVFSPLVFYPKVTILRFHCYANNAAYYKQRVGRETNLFAEKKKKTLPWARLAEKKEVHEEDKKNQVHGRGREDEAVRTNSVFREHFPLGDYNLVCFGPQANLQASPKDSA

SEQ ID NO: 170530 - protein, 281 aa, Glycine max
  Coding DNA Sequence Number=SeqID_53752
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=94%, HitCoverage=11%, E-value=1e-105, Identity=73%"; Hit description=IMP dehydrogenase/GMP reductase
MIIVAWNGSGDPSAIFNGDVFKKALSVFITAAILKFGQGRFYIRTCAVLQFEELILCVSQTGTVTLKWSIVLSIHYVLSSVLDVILSWKAQQSMSLYVKLRYILKVVSAAAWVIVLSVTYAYTWDNPPGFAQTIKSWFGSGGSSSPSLFILAVVVYLSPNMLAAIFFLIPFIRRHLERSNYRIVMLMMWWSQIKPLVGPTKAIMSVKITIFQWHEFFPHGTRNNIGVVIALWAPIILVYFMDTQIWYAIFSTLFGGVYGAFRRLGEVVENAILLYFTFLCL

SEQ ID NO: 170531 - protein, 135 aa, Glycine max
  Coding DNA Sequence Number=SeqID_53753
  Homolog annotation: Hit_ID=Q1T4L4; Match level="QueryCoverage=75%, HitCoverage=5%, E-value=4e-53, Identity=91%"; Hit description=IMP dehydrogenase/GMP reductase
MAFELYGMLAGNVSPMTGENVKPAYGGEEEAFLRKVVTPIYNVIAKEAARSKKGRSKHSQWRNYDDLNEYFWSADCFRVGWPMRADADFFCLPAEKLVFDKSNPYPCIEAVSGFEPMTNKSPRHNFTAAPGLALL

SEQ ID NO: 170532 - protein, 461 aa, Glycine max
  Coding DNA Sequence Number=SeqID_53754
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q1T4L4; Match level="QueryCoverage=94%, HitCoverage=21%, E-value=0.0, Identity=82%"; Hit description=IMP dehydrogenase/GMP reductase
IRTLGMLRSRFQSLPGAFNASLIPEETNEPKKKGLKATLSRRFPEISSNKGKEAARFAQLWNQIITSFRDEDLIDDREMNLLLVPYWADTQLDLIQWPPFLLASKIPIALDMAKDSNGKDRELKKRIAADNYMSCAVRECYASFKSIIKHLVQGEREIPVIEYMFNEVDKHIESDKLISEFKMSALPILYGQFVELIQYLLTNDPKDRDRVVLLFQDMLEVVTRDIMMEDQDQIFSLVDSSHGGTGHEGMLHLEPEPHHQLFASEGAIKFPIEPLTAAWTEKIKRLHLLLTTKESAMDVPSNLEARRRISFFSNSLFMDMPMAPKVRNMLSFSILFSSIEVCGLGLIQPQKLAHRLRVLTPYYTEEVLFSLNDLDSQNEDGVSILFYLQKIFPDEWNNFLERVNSTEEDIKGSESDELVEELRLWASYKGQTLTRTGYFSFTPPPPKKIKKYAHMISSANC

SEQ ID NO: 170533 - protein, 1051 aa, Glycine max
  Coding DNA Sequence Number=SeqID_53755
  Gene Ontology: Mol. function=ubiquitin-protein ligase activity; Cellular component=ubiquitin ligase complex; Biological process =protein ubiquitination
  Homolog annotation: Hit_ID=Q1T4L3; Match level="QueryCoverage=99%, HitCoverage=100%, E-value=0.0, Identity=55%"; Hit description=U box
  Pfam annotation: Domain name=U-box; Domain location=612-687; Score =42.5; E_value=1.5e-09; Accession=PF04564.6; Description=U-box domain
MASSLEELLAKEGFKGIRRVTRSRSSFHYGASSEPLHSLDGRFSVSSERIRTQRTKSDASRYQISSGQLKTDNDTAMNRRSRDNLFLRDKMDQRLKNSSIDTDSGRGVDTNSSEYMPRNEITEVTEQEANIVKDNCSTEVSSKRGKEKNFNELVEEENPVKDAKARSRSSSIHMLGHSSETRNNIKPQKDSYTRSNSSRNKDSNHAIQAASSLALDEVAVQAVVSILNGYIKSFPKDADFRSTLRHKCFSSLNFIELEEENITGTKVIRSLEQAIEAIEQTAEEPISTMYLKRTMMQLSIITGLSLNDLKYECTCGIPNFKLSACAHLYLSVVYMMQKKNKVSAKHLLQVFCDSPFQARTVLLPELWEHLFSSQFSHLKAWYSKQAEFLVDAPSKTRKLKLLQKVYNEHLDSGTHIFAVYYKDWLTEGVESPPTPSIGIPSASVMGSQEGSSLGYSFESASSIDPLSPQPMVSKKLYDSMFGSLSKPRVYQVKDIKDDDNIDNCMKDSYGSTIVRQTLTYESETVKFTDQDIENFSQGVAIDTIKPQKGNSMTASEEWQKRNLSNDINNSFSMETNLNSHSIDALSHEKASEPVLIKPNKTCSSLEGPYFPSIPHEFICPLTGNLFEEPVTLETGQTFEREAIKAWFEKGNRTCPVTGNTLECVTMPFTNLILKRLIDTWKSELFDYLIDLPSQTVENPEELKLKKRDEAAVFKRFEQGNVEEKSHVMSLLLNCIQVDSGCIYQIATSVNKKCLLELLHSKKATPTTNAILFLTEILSMKRENSLLQSEMLDVGWDINWGNGHRVEPQKFSIYREVAVNAIAEALDASLNDEKGREKCCRALVILCSHFSSTGKIPTKTSILKQAGYNNDSLEVKPPGHEEEGQRLYVAISSEGEEKRGEELLKKLLESLIGDGESPFLKNISRCLDSKHLDLVRACLITVTWLSSSLSMLFSAGLHLPAFLSIISQLKGILENGELELKTLASLSLLNFSKISGSPSSALLFFDAKNLAIFECKTLLKTMAEDIGPLLHELDDVTWTAKQLHAIVSRENL

SEQ ID NO: 170534 - protein, 592 aa, Glycine max
  Coding DNA Sequence Number=SeqID_53756
  Gene Ontology: Mol. function=transporter activity; Cellular component= membrane; Biological process=oligopeptide transport
  Homolog annotation: Hit_ID=Q1T4L2; Match level="QueryCoverage=97%, HitCoverage=90%, E-value=0.0, Identity=75%"; Hit description=TGF -beta receptor, type I/II extracellular region
  Pfam annotation: Domain name=MFS_1; Domain location=49-521; Score =3.9; E_value=0.00021; Accession=PF07690.6; Description=Major Facilitator Superfamily
  Pfam annotation: Domain name=PTR2; Domain location=111-509; Score =337.5; E_value=2.2e-98; Accession=PF00854.12; Description=POT family
  Pfam module annotation: Pfam domain module=MFS_1::PTR2; Domain location=49-521::111-509
MEPGICNSVNSVNVEATEKKVTGGNGSYTEQSDTSYKKIKGGWKTAIILLANQALATLAFFGVGVNLVLFLTRVLRQDSAEAANNVSKWTGTVYIFSLIGAFLSDSYWGRYLTCAIFQFIFVVGLGMLSLSSWRFLIKPVGCGNEETTCLEPSSVGVGIFYLSIYLVAFGYGGHQPTLATFGADQFDEKNEKQKNAREAFFSYFYFALNVGSLFSNTILVYYEDSGMWTMGFLVSLASAVIALVSYLAGYRKYRYVKGYGNPVIRVVQVFVATVRKWKVGPAKEHQLYEVDGPESAIKGSRKIHHSNDFRFMDKAATITEKDAVNLKNHWRLCTVTQVEEAKCVLRMLPVWLCTIIYSVVFTQMASLFVEQGDVMNNKIGNFHLPAASMSVFDICSVLLCTGIYRQILVPLAGRFSGNPRGLTELQRMGVGLIIGMLAILAAGATEFERLKHITPGEKASSLSIFWQIPQYVLVGASEVFMYVGQLEFFNGQAPDGIKSFGSSLCMASISLGNYVSSLLVYMVMGITARGENPGWIPNNLNVGHMDRFFFLVAVLTALDFVLYLLCARWYKSINLGDGDMGSQEDEEVISKV

SEQ ID NO: 170535 - protein, 346 aa, Glycine max
  Coding DNA Sequence Number=SeqID_53757
  Homolog annotation: Hit_ID=Q39860; Match level="QueryCoverage=28%, HitCoverage=45%, E-value=1e-49, Identity=100%"; Hit description =GTPase
  Pfam annotation: Domain name=DUF1723; Domain location=285-334; Score =76.1; E_value=1.1e-19; Accession=PF08330.1; Description=Protein of unknown function (DUF1723)
LVEPAADAIEGGAAGDVVDNEGADSAAVVGGGDGAESLLAGGVPNLSLDFLGVDFQALSLELDTYGGLGVHVELVPGVAGEKVGFAHRRVSDYDDLEEVEAQFNKELTCGIELLCQQLCVMGCYSCSDTTTFGQHRVGTGCRAQMLHRAHWRKYPREDVAPTPLRNTPYSFVSFFAYKLKNTCCSLTHNTPPPFQQLPSSSVFDMTSSSSSSSSFDVVCGPRENDVLWMQKQHVSQHIWNEDADRKLRMRRAIPTYQGIEQPPTEIIPLLQQSGLYTTIKLRRIKINGGIVNVFVERWRPETHTFHLTCGEATITLQDVSVLLGLPVDDNPLIGSTNIDEIDMCEQ

SEQ ID NO: 170536 - protein, 62 aa, Glycine max
  Coding DNA Sequence Number=SeqID_53758
MTCETKSGTSNNLKVVHSGTKEFKIASNKRDLFLGFSEHQERLRKKLALEEGRIFAANEQLS

SEQ ID NO: 170537 - protein, 132 aa, Glycine max
  Coding DNA Sequence Number=SeqID_53759
  Gene Ontology: Mol. function=D-alanyl-D-alanine endopeptidase activity; Cellular component=integral to membrane
  Homolog annotation: Hit_ID=UPI0000162C76; Match level="QueryCoverage =77%, HitCoverage=23%, E-value=8e-26, Identity=52%"; Hit description =D-alanyl-D-alanine endopeptidase/ peptidase
MTFRVLLLLVVLLFVIGAGADDAKRDDDRAPKSESCNNPFQLVKVESWVDGEEGHVHNGVSARFGSVLPDKPDKSVRTPAIFANPIDCCSNSTSKLSGSVALCVRGGCDFTVKAYFAQSGAATAILVINDSQ

SEQ ID NO: 170538 - protein, 145 aa, Glycine max
  Coding DNA Sequence Number=SeqID_53760
  Homolog annotation: Hit_ID=Q1RXS1; Match level="QueryCoverage=77%, HitCoverage=27%, E-value=2e-07, Identity=29%"; Hit description=Zinc finger, CCHC-type; Peptidase aspartic, catalytic
  Pfam annotation: Domain name=zf-CCHC; Domain location=93-110; Score =23.4; E_value=0.00014; Accession=PF00098.13; Description=Zinc knuckle
MREKERKPQEANINLRYFHGKDNIEANLDWEIRVEQKIKRKSTLKSYGSHSYPKKDQGLGILGAAPSKPKDDKAKTIEKQPPKASMQEKTISIKCFKCLGRGHITSQCPSKKTMILRGPDIYSSQDEATTSPSSSEREDAKWDES

SEQ ID NO: 170539 - protein, 79 aa, Glycine max
  Coding DNA Sequence Number=SeqID_53761
MAKGAEFVYARLSLIERADNRMSSGPPPLDDKRCRRRHSKKVWTDNHLGISACHMTQGQYDRDCGAANKSEALAPTYPQ

SEQ ID NO: 170540 - protein, 38 aa, Glycine max
  Coding DNA Sequence Number=SeqID_53762
MGRVNLGLNVRMVVMTCGKAWAEQMRKTSDQSESKSHF

SEQ ID NO: 170541 - protein, 416 aa, Glycine max
  Coding DNA Sequence Number=SeqID_53763
  Gene Ontology: Mol. function=D-alanyl-D-alanine endopeptidase activity; Cellular component=integral to membrane; Biological process=cytochrome complex assembly
  Homolog annotation: Hit_ID=Q53P98; Match level="QueryCoverage=96%, HitCoverage=70%, E-value=1e-144, Identity=61%"; Hit description =Signal peptide peptidase, putative
  Pfam annotation: Domain name=Peptidase_A22B; Domain location=99-403; Score=407.4; E_value=2e-119; Accession=PF04258.4; Description=Signal peptide peptidase
  Subcellular localization annotation: CTP_CleavageSite=59; ConfidenceScore=5.17e-01
MVCSNSSEANISIPVVMIAKSAGQSLNKSFTSGSKVEILLYAPPRPLVDFSVAFLWLMSVGTIVCASLWSDLTTPEKSDERYNKLCPKESSNAETEKDDLDKEIVNIDSKGAVIFVIAASTFLVLLFFFMSTWFVWVLIVLFCIGGIEGMHNCIVSLTLRYNRCLFVFWPENVLGVLSACHRKCQNCGQKTVSLPLFGEISIFSLAVLLFCVAFAIFWAATRQESYSWTGQDILGICLMITVLQLARLPNIKVATVLLCCAFVYDIFWVFISPVIFHESVMIAVARGDKAGGEAIPMLLRFPRLFDPWGGYDMIGFGDILFPGLLISFAHRFDKDNGRGASNGYFLWLVVGYGIGLVLTYLGLYLMNGNGQPALLYLVPCTLGVTVILGCIRGELESLWNYGTDSSLSTEPPGSEV

SEQ ID NO: 170542 - protein, 82 aa, Glycine max
  Coding DNA Sequence Number=SeqID_53764
IIRHRIPMIGGMMNVLSRATLFCKITHASNILMIHTHRDSLDQGVLTGPKRWNDAILPPQGHWLEDSKKIGSEMQEKIIGFS

SEQ ID NO: 170543 - protein, 172 aa, Glycine max
  Coding DNA Sequence Number=SeqID_53765
  Homolog annotation: Hit_ID=Q1S393; Match level="QueryCoverage=38%, HitCoverage=48%, E-value=2e-12, Identity=50%"; Hit description=Auxin responsive SAUR protein
  Pfam annotation: Domain name=Auxin_inducible; Domain location=48-140; Score=92.0; E_value=1.9e-24; Accession=PF02519.5; Description=Auxin responsive protein
  Subcellular localization annotation: CTP_CleavageSite=62; ConfidenceScore=5.21e-01
MDDVDEMKSTKKGKGNKKGGGLITKTWERCKSIGRSRKEASSNSLNTNTNTMRSKSWPNRNRAENKNKNKNSTIVAPEGCFSVYVGPQMQRFVIKTEYANHPLFKMLLEEAESEYGYNSQGPLALPCHVDVFYKVLMEMDSDETHGSCACVKRSPSAYQLLRTSPMLSINHF

SEQ ID NO: 170544 - protein, 147 aa, Glycine max
  Coding DNA Sequence Number=SeqID_53766
  Gene Ontology: Mol. function=protein serine/threonine kinase activity; Cellular component=membrane; Biological process=protein amino acid phosphorylation
  Homolog annotation: Hit_ID=Q9FE20; Match level="QueryCoverage=79%, HitCoverage=25%, E-value=2e-26, Identity=71%"; Hit description =Serine/threonine-protein kinase PBS1
MDMEGVADKLRSRSNSNGGSKRDCLLPASKLLLKTFTFRELAAATKNFRPESLVGEGGFGRVYKGRLETTARGLKCLTFHTTKLKCCQLSFSIKRFSCSVFYITLTLSISLDTVPMGINASLFMNLYAFGTLGRSPSCYASSNALPI

SEQ ID NO: 170545 - protein, 81 aa, Glycine max
  Coding DNA Sequence Number=SeqID_53767
MYIVVVKQGQDHLGLPSEVETKRERQKPIKVGYLRTDASRDGVMTDRSLPLLCARQAENVAARQPRILCILQLSFTICKNK

SEQ ID NO: 170546 - protein, 310 aa, Glycine max
  Coding DNA Sequence Number=SeqID_53768
  Gene Ontology: Mol. function=zinc ion binding; Cellular component =integral to membrane; Biological process=defense response to bacterium
  Homolog annotation: Hit_ID=P93332; Match level="QueryCoverage=77%, HitCoverage=89%, E-value=1e-104, Identity=81%"; Hit description=MtN3 protein precursor
  Pfam annotation: Domain name=MtN3_slv; Domain location=173-259; Score= 136.2; E_value=8.7e-38; Accession=PF03083.6; Description=MtN3saliva family
  Pfam annotation: Domain name=MtN3_slv; Domain location=52-139; Score =132.7; E_value=1e-36; Accession=PF03083.6; Description=MtN3saliva family
  Pfam module annotation: Pfam domain module=MtN3_slv::MtN3_slv; Domain location=173-259::52-139
MTKARISQVYTVSYGIEYCGKNGDPTFPYLLVVAQSQKKLENMAISHSTLAFAFGMLGNVISFLVFLAPITTFYRIFKKKSTEGFQSLPYLVALFSSMLWLYYALLKKDAMLLLTINSFGCVIEVIYIILYITYATRDARNLTLKLFFAMNVGAFALILLVTHFAVHGSLRVQVLGWICVSLSISVFAAPLSIVAQVVRTKSVEFMPFNLSFTLTLSAIMWFGYGLFLKDICIALPNVLGFALGLLQMLLYAIYRNGNKKVDKIMEKKAPLEPLKTVVIETGLEEKQQGKKSKENSEEKEKSDEPNDCAV

SEQ ID NO: 170547 - protein, 261 aa, Glycine max
  Coding DNA Sequence Number=SeqID_53769
  Gene Ontology: Mol. function=zinc ion binding; Cellular component =integral to membrane; Biological process=defense response to bacterium
  Homolog annotation: Hit_ID=P93332; Match level="QueryCoverage=85%, HitCoverage=83%, E-value=2e-91, Identity=76%"; Hit description=MtN3 protein precursor
  Pfam annotation: Domain name=MtN3_slv; Domain location=121-207; Score= 135.7; E_value=1.2e-37; Accession=PF03083.6; Description=MtN3saliva family
  Pfam annotation: Domain name=MtN3_slv; Domain location=5-87; Score =122.9; E_value=8.8e-34; Accession=PF03083.6; Description=MtN3saliva family
  Pfam module annotation: Pfam domain module=MtN3_slv::MtN3_slv; Domain location=121-207::5-87
MHVRACNLISFLVFLAPVPTFYRIYKKKSTESFQSLPYLVALFSSMLWLYYAMLKRDAVLLITINSFGCVIEIIYIVLYITYATRDARNLTIKLFSAMNMSSFALILLVTHFAVHGPLRVQVLGWICVSISVSVFAAPLSIVAQVVRTKSVEFMPFNLSFTLTLSAIMWFGYGLFLKDICIALPNVLGFVLGLLQMLLYTIYRKGNKKTKTNEKSPVEPLKSIAVVNPLGTGEVFPVEEDEQAAKKSQGDGDDKKGQDCLV

SEQ ID NO: 170548 - protein, 58 aa, Glycine max
  Coding DNA Sequence Number=SeqID_53770
MKAPSCYDPGVIARIRGSSSSKKKRRKVPLTVEDFGRFCADKAVADRIAYSFCHVIPQ

SEQ ID NO: 170549 - protein, 142 aa, Glycine max
  Coding DNA Sequence Number=SeqID_53771
  Gene Ontology: Mol. function=protein serine/threonine kinase activity; Cellular component=membrane; Biological process=protein amino acid phosphorylation
  Homolog annotation: Hit_ID=Q9FE20; Match level="QueryCoverage=96%, HitCoverage=49%, E-value=6e-34, Identity=89%"; Hit description =Serine/threonine-protein kinase PBS1
MKIAVGAAKGLEYLHDKENPPVIYRDFKSSNILLDEGYHPKLSDFGLAKLGPVGDKSHVSTRVKGTYGYCAPEHWTADCEALAVASLCIQESAATRPLIGDVVTALSYLANQAYDEGGRILKNEGTWKDPRKMTPHEKLRSR

SEQ ID NO: 170550 - protein, 1194 aa, Glycine max
  Coding DNA Sequence Number=SeqID_53772
  Gene Ontology: Mol. function=RNA-directed DNA polymerase activity; Cellular component=chromatin; Biological process=chromatin assembly or disassembly
  Pfam annotation: Domain name=RVP_2; Domain location=340-473; Score= -16.6; E_value=2e-05; Accession=PF08284.2; Description=Retroviral aspartyl protease
  Pfam annotation: Domain name=rve; Domain location=1067-1193; Score =47.2; E_value=5.5e-11; Accession=PF00665.16; Description=Integrase core domain
  Pfam annotation: Domain name=zf-H2C2; Domain location=1008-1049; Score=12.2; E_value=0.0085; Accession=PF09337.1; Description=His(2) -Cys(2) zinc finger
  Pfam module annotation: Pfam domain module=RVP_2::RVT_1::Retrotrans _gag::rve::zf-H2C2; Domain location=340-473::593-878::102-192::1067 -1193::1008-1049
MAESTRSKSFDRLEEAIAKLATRHLHVSDKLENLINRVTALESHPPSPSSASTNPSHHGQTPSPHILKLDVPRFDGSDPFGWVFKISQFFEYHGIPDSERLTVASFYMEGPALAWFQWMARNHQLPSWSGFLQAIEARFALSPYEDPTGQLFKLVQKGTVREYLAQFESLANRITGLSPSSLLSCFISGLEPDIRREVQALQPLTLTHAAGLARLQEEKFSDSRRSFRSRPSFPPYPATPPPLSVVPPSPLPLLPSPPKPPPLPVRRLSPEELANRRERGLCFYCDEKYNRSHRCASRFFLLVANEDPEDDLLNPNISPPLSPKPTRPDNSNNPTHSQPDLPQAQISLHALSGHTAPETLRMTGRISTQSVVILIDGGSTHNFVQARLVKTFGLTPQSTPTLRVLVGNGNEVVCSQVCLAVTIHLQGHSFTVDLHVLPLCGADIVLGVQWLKSLRPVLTYYNDLTMKFLHQGQLIELKGTTDMHPLAVSPPQLRRMLQTQSVSEFFHIRVCPSTSPSPTTHPAITSILEQFGPLFQPPTTLPPSRSTNHSIHLLPNSPPVNTRPYRYPHFQKQEIESQVSAMLRNGIIRPSTSPFSSPVLLVKKRDGSWRFCVDYRALNALTVKDRFPIPTVDELLDELGEARWFSKLDLLQGYHQILMAPEDINKTAFRTHHGHYEFLVMPFGLCSAPASFQATMNQTLGLFVLKLSKCSFATQQVEYLGHLVSEKGVEPVPAKVTAVQQWPTPRTTRALRGFLGLSGFYRRFIKGYASLATPLTALLVKDQFHWNEEADRAFSQLKLALCQAPVLGLPDFNSSFVVETDASGIGMGAILSQNHHPLAFFSKPFCSKLLRASTYVRELAAITVAVKKWRQYLLGHHFVILTDHRSLKELMSQAVQTPEQQIYLARLMGFDYTIQYRAGKANLGADALSRLPPPTQGEFYVLTIPNCLFLQELRAALAANPDFLSRRQLLQDDPQPDWVLRGDFIVHQGRIWLPPKFPLIPAILTELHSTPTGGHMGVMKTLARVRENFVWTSMKQDVHHFVTTCLTCQQIKSDNRRPSGLLCPLPVPAKPWEDLSLDFIVGLPLHRGHSVILVIVDRFSKGLHLGSLPQHHTAAGVAKLFMVISGKLHGMPKSLVSDRDPLFLSHFWQELFKLSGTKLCMSSAYHPQSDGQTEAMNKVVEQYLRAFVHQNPSS

SEQ ID NO: 170551 - protein, 75 aa, Glycine max
  Coding DNA Sequence Number=SeqID_53773
MEKAPRIDPLYNPNSSSLGLFSRKKSVIEAYPFQPRDQPIKQTKIVGMVYPADGLSSVSDVLVFVGEYLSGVQVS

SEQ ID NO: 170552 - protein, 45 aa, Glycine max
  Coding DNA Sequence Number=SeqID_53774
MGLRKRWGGISPVENDLEWQSEGKRHQKWVFLCRQSLTLLKIYLV

SEQ ID NO: 170553 - protein, 234 aa, Glycine max
  Coding DNA Sequence Number=SeqID_53775
  Gene Ontology: Mol. function=receptor activity; Biological process =protein amino acid phosphorylation
  Homolog annotation: Hit_ID=Q9ZU94; Match level="QueryCoverage=89%, HitCoverage=80%, E-value=3e-53, Identity=47%"; Hit description =Expressed protein
  Pfam annotation: Domain name=DUF26; Domain location=161-213; Score =30.3; E_value=9.5e-07; Accession=PF01657.8; Description=Domain of unknown function DUF26
  Pfam annotation: Domain name=DUF26; Domain location=79-133; Score =64.4; E_value=3.6e-16; Accession=PF01657.8; Description=Domain of unknown function DUF26
  Pfam module annotation: Pfam domain module=DUF26::DUF26; Domain location=161-213::79-133
  Subcellular localization annotation: CTP_CleavageSite=58; ConfidenceScore=5.47e-01
MAKTKLTLLIISFFTTFSVVCLSSPADFFLYGGCTQQRYTSNSPYESNLNSLLTSLVNSATYSSYNNLTVVGSSQSDAVYGLYQCRGDLAMPDCAACVSRAVSRAGQLCPATCGGAVQLDGCFIKYDNVTFLGVEDKTVVLKRCGPSVGFGPVGSGERDAGVAQCCGDLSFAECQDCVGDAIRRLRSECAAADYGDVFLGKCYARFSTNGAHAYNYNKAHGKPSLLKLLTITLK

SEQ ID NO: 170554 - protein, 195 aa, Glycine max
  Coding DNA Sequence Number=SeqID_53776
MTLIVMGVVATYSRNMLPHIQLRHWRKGSQWFELNCALAAYGALREKKLVVGQDQRATGTPGATEHSGGVGARAARHGSSQLNLTSAISWVRDMSGNPQTRTRSTRIFPVKIGTGLGRYPQVRVSLSCLVELAWWSWEKFDILPLREANIDRQDYKGALWKEDLAKEETVAAKVTATMIAKGRKGKFQRVSKMVV

SEQ ID NO: 170555 - protein, 115 aa, Glycine max
  Coding DNA Sequence Number=SeqID_53777
  Homolog annotation: Hit_ID=P22177; Match level="QueryCoverage=32%, HitCoverage=15%, E-value=3e-07, Identity=90%"; Hit description =Proliferating cell nuclear antigen
MDEAEEGYGESNNECLLGEEEDHDYNDLYNDVNFNEGFIQLLRKNDNSGFMLQLFGSRFLNFKILGVAFIEEAFVYSQDKIYDFEMKLMDIDSEHLGIPEAYHAISLLRCHPLSC

SEQ ID NO: 170556 - protein, 73 aa, Glycine max
  Coding DNA Sequence Number=SeqID_53778
MGISGLEEHSNRATPKAYTLKSLSGSLPPDSGPTPKFFLHANTANELYNTHDLTLVFYTRLTQLRYNLTLVPE

SEQ ID NO: 170557 - protein, 321 aa, Glycine max
  Coding DNA Sequence Number=SeqID_53779
  Gene Ontology: Mol. function=transferase activity, transferring phosphorus-containing groups; Cellular component=integral to membrane; Biological process=two-component signal transduction system (phosphorelay)
  Homolog annotation: Hit_ID=P14376; Match level="QueryCoverage=99%, HitCoverage=33%, E-value=6e-79, Identity=47%"; Hit description =Sensor kinase protein rcsC
MRELKYITENRLSSSVNGLDMLNGMPGGKSTLPQFTPLFTDGDCTSMSNTWRNSLDSLSYFINYWKSNFASAYELNRVFFIGGENQCLADFTIGNNNPVDRERSLKALRENVLHYRSGNEEERRNPMYWITNSSQPGIGNFYMVVPVYVANKLQALLGVEQNIRLDEFIQPGGLPLVATITDENYRPLISSRRGGPGYSLDDLPDNSTWFGYLDGYRQLVLKKPLPPSSLNVVWSLSTDVLMDQLKLMLINALLLNILSALILFTLAWVFERRMFLPAEDNAHRLEEHEQFNRKIVASAPVGICILRTSDGTNILSNEIGA

SEQ ID NO: 170558 - protein, 171 aa, Glycine max
  Coding DNA Sequence Number=SeqID_53780
MLQSIHQGQILLLQSLQVVAPPGSILSVEQFLERVAWPGAQPSLDREGEGTTAQVPQQVQDASSETTIPKPFTLHLEVGEEQARPEIATTPERSLEGTSELLTPMADLSSPQPTVDPSTPLLDILEDQTAPVLALNTSPPTTPVLHLTDEECIDTPRRYDITILNRDKFYF

SEQ ID NO: 170559 - protein, 168 aa, Glycine max
  Coding DNA Sequence Number=SeqID_53781
DVQKKAQAIQKQNTAPYVLSRGGYEYLEQKLMAAQSGSTEGVIDPPSLIRRHVKWKLARTKKTGQMTSEAAKEIAEKIGSFVPHRRQDVLTIAIGRLEHHGCVRAAGASVTIKQYFGSAPRTSYSSSSMPPEDLQQLTQQIRDQLEELITKKVTRQLMASFNQMQSQF

SEQ ID NO: 170560 - protein, 95 aa, Glycine max
  Coding DNA Sequence Number=SeqID_53782
  Homolog annotation: Hit_ID=Q2PMM5; Match level="QueryCoverage=95%, HitCoverage=4%, E-value=1e-48, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKERF

SEQ ID NO: 170561 - protein, 59 aa, Glycine max
  Coding DNA Sequence Number=SeqID_53783
  Subcellular localization annotation: CTP_CleavageSite=42; ConfidenceScore=5.02e-01
MENEQFLIKQIWMSNSGAQGHTMLNRMPQNSSMTSTCCIRVVSSEKWRLRNLGWGYGYH

SEQ ID NO: 170562 - protein, 95 aa, Glycine max
  Coding DNA Sequence Number=SeqID_53784
MASRKRKAPSTPTQVRFDRSRFTSQEAWERYTNIIVPRKLLPERNVVVYLSQRALLRASEGEAHGCAFQRRKDARSCHQRLFVENVGKTEGNRSK

SEQ ID NO: 170563 - protein, 190 aa, Glycine max
  Coding DNA Sequence Number=SeqID_53785
  Subcellular localization annotation: CTP_CleavageSite=32; ConfidenceScore=5.06e-01
MNTLSAPASLSLFITTVKILDFQMNTLSGPCRAKRAKHALCAKPECHFREVELSAPCCAKLRLSSAKRQSAMASKKRKAPSTPAQARYDRSRFTSQEAWERYTDIVVPKKLLSERNAVVYYTEFDEFKEELDRRHWDEKFTLLRPNPQELAAKLYIPGRGFELNADGQPLKILRKNMTTFRHGVFFPMLN

SEQ ID NO: 170564 - protein, 177 aa, Glycine max
  Coding DNA Sequence Number=SeqID_53786
MTSRKRKRTASRPQAQYDTRRFQSLEAWNRYTNNILNRRILLERNVKIYHTEFDEFKAELERRNLHKRLANLQDGSIDVAMVKEFYANLYSSEDQSPKQVRVRGHSIKIDADSLNTFLETPIVLEEGETLPTYSRFTRMRIDPQEFAAHLCIPGRGFVLNAEDHPWKLLRKDLTTLA

SEQ ID NO: 170565 - protein, 87 aa, Glycine max
  Coding DNA Sequence Number=SeqID_53787
  Pfam annotation: Domain name=zf-CCHC; Domain location=62-79; Score =10.9; E_value=0.016; Accession=PF00098.13; Description=Zinc knuckle
MDKAKEIWHDLKSRYSQGDLFRISDLQQEASSMKQENVCYKKYDLPSNYDGRSKGSSIKSGNTCTHCGKNGHTVDVCYRKHGFPQDT

SEQ ID NO: 170566 - protein, 52 aa, Glycine max
  Coding DNA Sequence Number=SeqID_53788
MQKGINNRGGDDGHGGLKGPSGDGEMDRYISDGCHLYCHMGDPIMGLIINLI

SEQ ID NO: 170567 - protein, 156 aa, Glycine max
  Coding DNA Sequence Number=SeqID_53789
  Homolog annotation: Hit_ID=Q1SJW0; Match level="QueryCoverage=99%, HitCoverage=19%, E-value=3e-30, Identity=49%"; Hit description =Ubiquitin-associated
  Pfam annotation: Domain name=DUF1296; Domain location=14-73; Score =140.6; E_value=4.1e-39; Accession=PF06972.2; Description=Protein of unknown function (DUF1296)
  Pfam annotation: Domain name=UBA; Domain location=17-58; Score=21.8; E_value=0.0025; Accession=PF00627.21; Description=UBATS-N domain
  Pfam module annotation: Pfam domain module=DUF1296::UBA; Domain location=14-73::17-58
MSGKGGGKALSATIPASSRKMVQSLKEIVSNFPDHEIYATLKDCNMDPNEAVSRLLSQDPFHEVKSKREKKKEIKDPTESRSRGSGTNNTSSRGGGRAGTDRNGGRGGANQFGSSDDGLQGKPVYKKEKGAPTYGGSTSSAPSVLGNNANMRPASY

SEQ ID NO: 170568 - protein, 137 aa, Glycine max
  Coding DNA Sequence Number=SeqID_53790
  Homolog annotation: Hit_ID=Q1SUI8; Match level="QueryCoverage=57%, HitCoverage=30%, E-value=3e-08, Identity=35%"; Hit description=Beta tubulin
MEVGGTWMRQEEIIKILSGSRIYVLFAFNGGGKLVQKSTTTLYSADGIASSGVWEWQLEWRRMLMEGEMDLAANFMEDIEGMVVQVQHQDSWSWEGDLAGEYTAGSAYRALNQFIIEDDERAFSILWKLKFPARCLM

SEQ ID NO: 170569 - protein, 270 aa, Glycine max
  Coding DNA Sequence Number=SeqID_53791
  Gene Ontology: Mol. function=RNA-directed DNA polymerase activity; Biological process=RNA-dependent DNA replication
  Homolog annotation: Hit_ID=Q1SP50; Match level="QueryCoverage=46%, HitCoverage=15%, E-value=2e-26, Identity=48%"; Hit description=RNA -directed DNA polymerase
MVNGGSHKSFIQQRGIRPGDPLSPYLFILCAKALFALLNKVVASGDLHGIKVSRSAPMISHLFFVDDSIIFSRATKEEVTHISVILKDYETAFGQRINFDKSELPCSQNVSSTKQDELIQLMGVKAVENQEKGDVEQRSIHWMSRKRLTRHKNEDDVGGRLQPLKFTTNGIYTVNFGYHVARMKYNSIESSLRKPRNEWRKIWEGEALPKYAGEKEWGGGGGRARRGFRFLVANCRAKSVRVVSERGFLSSFRLLSRRNPSYSGGARKGV

SEQ ID NO: 170570 - protein, 199 aa, Glycine max
  Coding DNA Sequence Number=SeqID_53792
  Gene Ontology: Cellular component=integral to membrane; Biological process=vesicle-mediated transport
  Homolog annotation: Hit_ID=Q1SW30; Match level="QueryCoverage=74%, HitCoverage=55%, E-value=2e-75, Identity=90%"; Hit description =Synaptobrevin
MGQKSLIYAFVSRGTVILAEYTEFSGNFNSIAFQCLQKLPATNNKFTYNCDAHTFNYLVDNGYTYCVVADESIGRQLPMAFLERVKDEFVSKYGGGKAATAPANSLNKEFGPKLREHMQYCVDHPEEISKLAKVKAQVSEVKGVMMENIEKAEPSYNKRRFTRTHITECCHVITRKQITGTVLIENEVVDDVRRKENAV

SEQ ID NO: 170571 - protein, 129 aa, Glycine max
  Coding DNA Sequence Number=SeqID_53793
  Gene Ontology: Cellular component=integral to membrane; Biological process=vesicle-mediated transport
  Homolog annotation: Hit_ID=Q1SW30; Match level="QueryCoverage=51%, HitCoverage=28%, E-value=4e-21, Identity=65%"; Hit description =Synaptobrevin
MAVSRFEPVTKLVTKGNFSIALGLQSQSHVQSMRMKMFNMSKVLDRGDKIELLVDKTENLHNQDFWNQNPSKNVAAKHEDKADCIGNIDSTYPDNSPICVSWVQLWKIAPFSEAFYHVISTLRLSEKRY

SEQ ID NO: 170572 - protein, 138 aa, Glycine max
  Coding DNA Sequence Number=SeqID_53794
  Homolog annotation: Hit_ID=Q10EQ8; Match level="QueryCoverage=84%, HitCoverage=51%, E-value=5e-16, Identity=37%"; Hit description =Expressed protein
  Pfam annotation: Domain name=Hin1; Domain location=5-119; Score= -11.5; E_value=0.014; Accession=PF07320.4; Description=Harpin-induced protein 1 (Hin1)
RLNRIGIRTNPRPILDLSFSITVKVHNRDFFSLTYDTLAVSVGYRGRQLGFVTGGGGGRIRARGSSYVDATLTIDGFEVIYDAFYLLEDIAKGVIPFDTDTRVEGKLGLFFFTVPLKTCSQIHSLAQTLSLVKEKSKY

SEQ ID NO: 170573 - protein, 60 aa, Glycine max
  Coding DNA Sequence Number=SeqID_53795
MFEARKWWKNLTNEKEAEKILEKNFNETKSEFEHASPGFDSVGDSLTTQIIIKVFIFSKT

SEQ ID NO: 170574 - protein, 162 aa, Glycine max
  Coding DNA Sequence Number=SeqID_53796
  Homolog annotation: Hit_ID=Q10EQ8; Match level="QueryCoverage=58%, HitCoverage=41%, E-value=1e-09, Identity=35%"; Hit description =Expressed protein
MCHPGVPFVNREGLMVHRRWLVSPLARHAPRQVHDGGGSGESGSVKHCVCSPSQHPGSFRCRLHHGDIEWNDALSDIFEQVERVVDNLKSVNGERGVDVGGATRPDAAAAAAGDEAELAAAVADGDGEGVIGEGEEVSIVDFNGDGEGEVENGPRVGSDPDA

SEQ ID NO: 170575 - protein, 173 aa, Glycine max
  Coding DNA Sequence Number=SeqID_53797
  Subcellular localization annotation: CTP_CleavageSite=74; ConfidenceScore=5.09e-01
MHTAQLISDAIYCLQGSPPQDTQWTRRSPTGSWGFQLWLQASISPTGCPFPPARDRARKTPNGPEEVQQGLGVSSSGYGPLLVLQGARSPQQGIAPVRHPVDPKKSNRILGFPTLITGLYQFHRVPVTPNKVIRPPLTGLSSRSTAPLGRRRARHHSSLGMAGSGQQTHRRHL

SEQ ID NO: 170576 - protein, 289 aa, Glycine max
  Coding DNA Sequence Number=SeqID_53798
  Homolog annotation: Hit_ID=Q1SDS1; Match level="QueryCoverage=44%, HitCoverage=25%, E-value=5e-13, Identity=34%"; Hit description=IMP dehydrogenase/GMP reductase
MVGFTPFSSRGETCLPARRPPLMHREKEASWDRLLASKEGASVNWFPRWKEGRTGILISCGGFPNVPLMGTRGCINYNPILAIRQLGYPMRGAPLEEDLTPIIARGFNSTNVEALQKVHKAWEMVQKKDKKLRGSSNGPIGDYHRWLKAYTQGLDWLPNLRTTKGVEVEAPEEGEEENAELRDVNIATTEALEQETKRARREEHGRNKFRGALWGSNSELKLRKEESNQSRVDSLILKDELRICLRSKRSLSQRLCETETNMLAILTNPSLVDVVVEETSLLHPTLPPP

SEQ ID NO: 170577 - protein, 236 aa, Glycine max
  Coding DNA Sequence Number=SeqID_53799
  Gene Ontology: Mol. function=transition metal ion binding; Cellular component=nucleus; Biological process=cytoskeleton organization and biogenesis
  Pfam annotation: Domain name=Transposase_21; Domain location=157-236; Score=-70.9; E_value=1.5e-08; Accession=PF02992.5; Description =Transposase family tnp2
MQKRSQTEPVDVEMGDRLEDMIHDLGQESFQQAHAPMHDTLENDSKKPLYPGCKKSLTLLSMVLSLDMLQEENTLPKSYCEVKKILCPMGIKYQKIHACPNDCILYRHDYEEMHKCPRCGASWYKVNDDDECSSVESTKKDPQQRCCGIFRSFQDAKDLTWHADARNYDGMIYHPTDSSQWKKIKPFYPDFGKKARNLRLELATDGMNCDDNLSTQHISWPILLVIDNLPPWLCMK

SEQ ID NO: 170578 - protein, 59 aa, Glycine max
  Coding DNA Sequence Number=SeqID_53800
MALINGMDAKVSKRDPPAMRRYPINSSNRSRKVANENLWFLAKREGMVQNLLDIFLQEI

SEQ ID NO: 170579 - protein, 92 aa, Glycine max
  Coding DNA Sequence Number=SeqID_53801
MINIISIPSTRSPWLMKGADNRKVFPACHRTRCLWMTKGAEDDVSLCASTCSLAPDLRKMMTLVSAYYLTLSLTDSERVFIRITTWVSPPAT

SEQ ID NO: 170580 - protein, 264 aa, Glycine max
  Coding DNA Sequence Number=SeqID_53802
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=79%, HitCoverage=12%, E-value=7e-99, Identity=82%"; Hit description=D -galactoside/L-rhamnose binding SUEL lectin; Integrase, catalytic region; ...
  Homolog annotation: Hit description=Galactose-binding like; Peptidase aspartic, catalytic
MEKMDVDIIIRGTPKANGHFGAIAACLGELKLSVEAIRSPRRAGFFTMKPFGGPSKPEEALTDSRWIQEMKTKMKALEKNATWELVTLPNGNNTVGCRWVFTVKHKADGSVERYKARLVAKGYIQSFEVDYQETFALVAKLNTMRVLLSLAANQDWPLLQFDVKNDFLHGDLMEEVYMDPPPDIPKYSNIPLVCNLKKALYGLKQSPRAWFGRFTKSMKFFDYTQSNSDRTLFLKHNQGKVTALIIYVDDMIMTGNDPDEILSL

SEQ ID NO: 170581 - protein, 205 aa, Glycine max
  Coding DNA Sequence Number=SeqID_53803
  Homolog annotation: Hit_ID=Q1SS72; Match level="QueryCoverage=35%, HitCoverage=4%, E-value=6e-16, Identity=50%"; Hit description =Integrase, catalytic region
MADNAVINNTTFANLLNPYYTHPNENPGVAIVAQVLNGANHHSWSRAMLLALKTKKKVQFIDGSLPRPTLNDPNFTIWDHCNTLVKEVATDTSSTTFTPEQHKALLSLLQQTSQASSSHTTNQLISSNKNDNSGIFCATLHASSSNINSWVLDSGATDHDPSSLRMIEAAELRAGLYILSSSTTKFSYTCNINTIPSTKCNVWHN

SEQ ID NO: 170582 - protein, 49 aa, Glycine max
  Coding DNA Sequence Number=SeqID_53804
  Subcellular localization annotation: CTP_CleavageSite=40; ConfidenceScore=5.09e-01
MVSPTANVATSPSLCSSTNQCWDSSNGSSEKSHFTFGMIEATVARNEEN

SEQ ID NO: 170583 - protein, 88 aa, Glycine max
  Coding DNA Sequence Number=SeqID_53805
MDKVDIFVPHPLTNACLLIQLSPECGCKPLVCLLKQPALLSVDFQDRSIRDYSSCTRESSTTRDPQSLNPFSEIRRREEEVSRKRGRL

SEQ ID NO: 170584 - protein, 794 aa, Glycine max
  Coding DNA Sequence Number=SeqID_53806
  Gene Ontology: Mol. function=transferase activity
  Homolog annotation: Hit_ID=Q2RBE2; Match level="QueryCoverage=94%, HitCoverage=95%, E-value=1e-113, Identity=36%"; Hit description =Nucleotidyltransferase family protein, putative, expressed
  Pfam annotation: Domain name=NTP_transf_2; Domain location=100-171; Score=7.2; E_value=0.034; Accession=PF01909.13; Description =Nucleotidyltransferase domain
  Pfam annotation: Domain name=PAP_assoc; Domain location=255-344; Score=5.7; E_value=0.014; Accession=PF03828.9; Description=PAP25A associated domain
  Pfam module annotation: Pfam domain module=NTP_transf_2::PAP_assoc; Domain location=100-171::255-344
MGDLHVNGVVFGEDRPCASSPPSPPLPPWNPDPSSVAADAWAAAERNTAEILRRIRPTLAADRRRREVVDYVQRLIRELILNDSGVLVRCLGFCFVMVLMTVKVFPYGSVPLKTYLPDGDIDLTALSCENIEDGLVSDVRAVLHGEEINEAAEYEVKDVRFIDAEVKLVKCIVQDIVVDISFNQLGGLSTLCFLEKVDRLVAKDHLFKRSIILIKAWCYYESRVLGAHHGLISTYALETLVLYIFHQFHVSLDGPLAVLYRFLDYFSKFDWDNYCVSLKGPVSKTSLPNIVAEVPENGGNTLLTEEFIRSCVESFSVPSRGADLNLRAFPQKHLNIIDPLKENNNLGRSVNKGIAFKYGARKLGWILRLPEDRIAEELIRFFANTLERHGSTQGNVDKSFLSLSTASGKDRKPGNQHNFESRDERERYVVQDAGEFFDSSRDGNAVTSFKLGEDSKDIATSGVLDRTSTNGWSYCSNEQFENNISDSEPALNSVINDEKEKQVMAGNSPRSHTDEKHMAVSEASKSLLDLTGDYDSHIGNLQYGHMCNGYPVSLVVPSPPRSPKFPNRNPWETVHQCVPINHSIRSQANSNCVMGQQVYVINHPTLPMTSFGSEEKRKVRGTGAYFPNMTSRPYRDNRPIPGRGRGQAPGTHGHLQRHSRNNGFALAPQETNLSVDGTFEHALEGYSGFGSTKTRSSETYFPQPSTWGSHYANGFLHSSEKPESGPASPQLRVVPRNEMSNYPESGISTPRDTVPNTEEVTEEKSDSLSAVDSKRIEEQAYRLKNDDDFPPLSH

SEQ ID NO: 170585 - protein, 105 aa, Glycine max
  Coding DNA Sequence Number=SeqID_53807
MHAQGLQSGFCSLTSLFGHYEFVGLVGRPSNENVENYMPGTLNCEEGAQECHDSSEIYQKIVTDPSITVDTIIVTALNLHQPGIEPGSVPWQGTILPLDHWCFVA

SEQ ID NO: 170586 - protein, 198 aa, Glycine max
  Coding DNA Sequence Number=SeqID_53808
VSQECPLRHGLGLRGSKCGEDGGNKDNDVDDGDNEMMTLEDFLAKANVVNDASHNHDHNHDLDYDNDSKGVLNFDFEGNLNATPSSSFTTTHFGPLVSHNSSVVTYVVSNRGPVTPALSVEDPVGSDNVLEQRSFRVTRAGFCISTTRQGCWYVVSSGSVENTKNMMEVETQRDSSADGVCNKQEEEKAITGLLDGSE

SEQ ID NO: 170587 - protein, 52 aa, Glycine max
  Coding DNA Sequence Number=SeqID_53809
MGLNPAYEVEVKRVSQILVAFVNDIEEVFDAMGLENGLLGNDLINGKWEVEK

SEQ ID NO: 170588 - protein, 231 aa, Glycine max
  Coding DNA Sequence Number=SeqID_53810
  Homolog annotation: Hit_ID=Q6CQE3; Match level="QueryCoverage=25%, HitCoverage=73%, E-value=1e-11, Identity=47%"; Hit description =Kluyveromyces lactis strain NRRL Y-1140 chromosome D of strain NRRL Y- 1140 of Kluyveromyces lactis
MKFQRLPGPVGQGYRLVEYISVARVRPRTSKGITDLLRSRSLTELTRQIAPPTKNGHAPPPIESRKSSQSVNPYYVWTCCSSFIIQDFTSDYEIRWPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 170589 - protein, 89 aa, Glycine max
  Coding DNA Sequence Number=SeqID_53811
MDMSEFPSAREKKRIVASILLSTCETNFSMPKHYFSNTNHWNVPKWVPKVVSKFHDDPTIDEFGIIVLLEQVLGLYGKKAMMRREFLPP

SEQ ID NO: 170590 - protein, 472 aa, Glycine max
  Coding DNA Sequence Number=SeqID_53812
  Gene Ontology: Mol. function=monooxygenase activity; Cellular component=membrane; Biological process=electron transport
  Homolog annotation: Hit_ID=Q1SKI2; Match level="QueryCoverage=96%, HitCoverage=91%, E-value=1e-132, Identity=51%"; Hit description =Arthropod hemocyanin/insect LSP; E-class P450, group I
  Pfam annotation: Domain name=p450; Domain location=4-458; Score =336.4; E_value=4.9e-98; Accession=PF00067.12; Description=Cytochrome P450
MNLPPGPWKLPIIGSIHHMIGFLPHHRLRELALKHGPLMHLKLGEVPAIVVSSPEVAKEVMKTYDSIFAQRPHQVGADIMCYGSTDIATAPLGGYWKQLRRICSQELLSNKRVRSYQSIREEEVLNLMRLVDANTRSCVNLSEKVSCMTSAITARATFGEKCKDQEDFISLVKKLLKLVERLFVFDIFPSHKWLHVISGEISKLEELQREYDMIIGNIIRKAEKKTGEVEVDSLLSVLLNIKNHDVLEYPLTIDNIKAVMLNMFGAGTDTSSAVIEWTMSEMLKNPRVMTKAQEEVRRVFGSKGYTNEAALEDLKFLKAVIKETLRLHPPFPLLLPRECRETCEVKGYTIPAGTKVIVNAWAIARDPKYWSEAEKFYPERFMDSPIDYKGSNHELIPFGAGRRICPGISFGVSSVELCLAQLLYYFNWELPNGNKENDLEMTEALGASSRRKTDLVLVPISYNHVPVSYIRP

SEQ ID NO: 170591 - protein, 617 aa, Glycine max
  Coding DNA Sequence Number=SeqID_53813
  Gene Ontology: Mol. function=protein serine/threonine kinase activity; Cellular component=cytoplasm; Biological process=protein amino acid phosphorylation
  Homolog annotation: Hit_ID=Q6EIX6; Match level="QueryCoverage=93%, HitCoverage=92%, E-value=0.0, Identity=58%"; Hit description=Mitogen- activated protein kinase
  Pfam annotation: Domain name=Pkinase; Domain location=3-248; Score =144.5; E_value=2.8e-40; Accession=PF00069.15; Description=Protein kinase domain
  Pfam annotation: Domain name=Pkinase_Tyr; Domain location=3-248; Score=-3.3; E_value=2.9e-12; Accession=PF07714.7; Description =Protein tyrosine kinase
  Pfam module annotation: Pfam domain module=Pkinase::Pkinase_Tyr; Domain location=3-248::3-248
MKTVYKAIDEVLGIEVAWNQVRLNEALRTPDDLQRLYSEVHLLSTLKHQSIIRFYTSWIDIDNRAFNFITELFTSGSLREYRKNYKRVNIQAIKNWACQILQGLVYLHCHDPPVIHRDLKCDNIFVNGHLGQVKIGDLGLAAILRGSQLAHSVIGTPEFMAPELYEEEYNELADVYSFGMCVLEMLTSEYPYSECSNPAQIYKKVTSGKLPMAFFRIEDMEAQRFIGRCLVPAEKRPSAKELLLDPFLVSDDPSSTKKFAIQKPFLNVNEMEKLQLSDDLPRTGMKVIGKLNPEDDTIFLKVQISDKDGSARNVFFPFDILSDTPIDVATEMVKELEIADWEPFEIANMIDREISALLPHRRQSSCSDAFHTFNYLDDDCDDDEPHHHFRSFSSSSSFQESMSDLVSKAEEISSGYYWLHDDLHDDTSSRCSSQGTYSNLNYYSLDDHHQEYNVPSLRKDKLPITKSHNKGKKVSSGEDLSNFNQYKLMVGSQVPLTSKSKMMMNNHHRLTRNRSLIDIRSQLLHRSLVEEVNKRRLFKTVGAVENIGFQAPCDVSTKRSQHIMECAEQKMILGDGELFPRCWTNKLYYFCRCMEMKGDAAGRQARIKIHYASGLFY

SEQ ID NO: 170592 - protein, 85 aa, Glycine max
  Coding DNA Sequence Number=SeqID_53814
YKGEGEKVVHGVIGWENKQILFNKESDRVLAGDLWQIRESTKARNLKNLWTLFDVIIGGKQRKKMQKNRVRRCRGGNNYRGEMKL

SEQ ID NO: 170593 - protein, 59 aa, Glycine max
  Coding DNA Sequence Number=SeqID_53815
MDKGKGAKALATSLQNLDLNPPSNIKSKSSITIAHPQFPEMGCYVYVWFLVKLSPFSAP

SEQ ID NO: 170594 - protein, 129 aa, Glycine max
  Coding DNA Sequence Number=SeqID_53816
MVIKSTSTTSHTKIRKYNMRLNPKKCIFEKHKGINLKDECKVHFEKLKEFNPSPPILTRPQLVCTKGVNESSMPSRLFCQIDNRYRNGSYYVIEGGGDLYKRGFTTPLLKGLTRDQVKYMMNEMHRGIF

SEQ ID NO: 170595 - protein, 182 aa, Glycine max
  Coding DNA Sequence Number=SeqID_53817
LLPKKTKPLSLVSLCVGVLGRHLEDIIADLSEIAINLPADIKITVAAIARRRKLLNDDVLIALADTSWEIFDVSGSDVSDFGLIKAAEVCRFIKALDIRAMICSENGSIWLSVSNLYLNYHHGIIVTLLYPSKSSPMKAIGAKFQVGYSHPNVVLLLPHESYCVLDFYLVLFHGPDHMLCLS

SEQ ID NO: 170596 - protein, 104 aa, Glycine max
  Coding DNA Sequence Number=SeqID_53818
MEFLNNQVYQWSVAPFNIIGNTRHMIALSFMDRLIHLCDECVDMLFWVRESIVMMDGQHLPSRWELSLHNLVSERMKLSVNICCSLDWLCDKGVPSHHIASVTS

SEQ ID NO: 170597 - protein, 159 aa, Glycine max
  Coding DNA Sequence Number=SeqID_53819
  Gene Ontology: Mol. function=RNA-directed DNA polymerase activity; Biological process=RNA-dependent DNA replication
MIRGLHVREVWEDDLKKVKEEVAKLFLNRFLEGEDGGISLDGVYFNLICHENNLLLSSKFEELELKEAIWDCRVSKSLGSDGFNFNFIKKFWSVLKVDTMRSTNVSLISLIPKVEEPQGLREYIPISLKLLYDPGDCGGCGTASLRQNCCIEVVVMQRS

SEQ ID NO: 170598 - protein, 41 aa, Glycine max
  Coding DNA Sequence Number=SeqID_53820
MCSGKGIGTREKTIWLVGAVLEGTKRESTAGIIFEVSLIAI

SEQ ID NO: 170599 - protein, 527 aa, Glycine max
  Coding DNA Sequence Number=SeqID_53821
  Gene Ontology: Mol. function=protein serine/threonine kinase activity; Cellular component=integral to membrane; Biological process=protein amino acid phosphorylation
  Homolog annotation: Hit_ID=A0AAR7; Match level="QueryCoverage=96%, HitCoverage=96%, E-value=0.0, Identity=85%"; Hit description=Calcium calmodulin-dependent protein kinase
  Pfam annotation: Domain name=Pkinase; Domain location=12-309; Score =283.0; E_value=5.9e-82; Accession=PF00069.15; Description=Protein kinase domain
  Pfam annotation: Domain name=Pkinase_Tyr; Domain location=12-307; Score=34.4; E_value=1.4e-14; Accession=PF07714.7; Description =Protein tyrosine kinase
  Pfam annotation: Domain name=efhand; Domain location=407-435; Score =18.8; E_value=0.02; Accession=PF00036.22; Description=EF hand
  Pfam annotation: Domain name=efhand; Domain location=443-471; Score =30.0; E_value=8.5e-06; Accession=PF00036.22; Description=EF hand
  Pfam annotation: Domain name=efhand; Domain location=485-513; Score =38.0; E_value=3.2e-08; Accession=PF00036.22; Description=EF hand
  Pfam module annotation: Pfam domain module=Pkinase::Pkinase _Tyr::efhand::efhand::efhand; Domain location=12-309::12-307::407 -435::443-471::485-513
MGNETRKLSDEYEVSEVLGRGGFSVVRKGTKKSSSDTKTHVAIKTLRRVGTASNSNNPSGFPRPKGGEKKSTAAMMGFPTWRQVSVSDALLTNEILVMRRIVENVSPHPNVIDLYDVYEDSNGVHLVLELCSGGELFDRIVAQDRYSETEAAGVVRQIASGLEAIHRANIVHRDLKPENCLFLDVRRDSPLKIMDFGLSSVEEFTDPVVGLFGSIDYVSPEALSQGKITTKSDMWSLGVILYILLSGYPPFIAQNNRQKQQMIMNGNFSFYEKTWKGITRSAKQLISDLLIVDPSRRPSAQDLLSHPWVVGDKAKDDAMDPEIVSRLQSFNARRKLRAVAIASIWSTTIFLRTKKLKSLVGTHDLTEEEIENLRMSFKKICVSGDNATLSEFEEVLKAMNMPSLIPLAPRIFDLFDDNRDGTVDMREILCGFSSFKNSKGDDALRLCFQMYDTDRSGCITKEEVASMLRALPEDCLPTDITEPGKLDEIFDLMDANSDGKVTFDEFKAAMQRDSSLQDVVLSSLRPQ

SEQ ID NO: 170600 - protein, 165 aa, Glycine max
  Coding DNA Sequence Number=SeqID_53822
  Subcellular localization annotation: CTP_CleavageSite=59; ConfidenceScore=5.59e-01
MRFAAHLHLCHSSGVAHVILSVTAPPFTVHNIRLSRLRVFLSVANSPHRAPMSFLLPLAASLIATSLSVSSEIKHYSKLVEWFEWLLLYYFFIEKSDVSLKDSTLFGFLLSKPIKANFSSLALRCKAKGHFGVVAARPSELKLSAEAMSSPRQAGARPGKLASSP

SEQ ID NO: 170601 - protein, 155 aa, Glycine max
  Coding DNA Sequence Number=SeqID_53823
MVLVMGPLLGRIASQYLYTYLDHQAIAAKLCMLERAKVGPNNSHSGCTTTTNHPSSSHLIFRQLALLFPAGATNSDDAKPPPRQVPHHPEPPLAFHPTLPSASTNDARGLPTIGSLARSPALFCRGEGGDTSPVSNDDTANTGADEDYVADIIIA

SEQ ID NO: 170602 - protein, 645 aa, Glycine max
  Coding DNA Sequence Number=SeqID_53824
  Gene Ontology: Mol. function=RNA-directed DNA polymerase activity; Cellular component=chromatin; Biological process=RNA-dependent DNA replication
  Homolog annotation: Hit_ID=Q0ZCD0; Match level="QueryCoverage=60%, HitCoverage=42%, E-value=2e-68, Identity=36%"; Hit description =Integrase
MKLASTIFKKLEITIPFGETLQQMPLYTKFLKDLLTKGKYINNESIVKFKDPGSVTISCYIGDVSVGRALIDLGASINLMPPSMCWRIRNLRIASTRMTLQLVDNSITRPYGVVEDVLVKEGIVLGHKISARGIEVDKAKIDVIEKLPPLVNVKGIRSFFGHAGFYQRIIKDFSKITRPLSNLLNKDAMLKLDEELKNLSSCATPMLCSWCSSWAIPRQGDAGHSLRIREVQIIFGGVQSGYLYDHATIKYLLTKVDSKPRLIRWVLLIQEYDIVIKDKKGSENVGVNHLSRLANEEITQEEQEIRDEFPDESLLHVNERPWFANMANYRAAVGIGQLLRCYKLDSSSLLSSRMLMIMCFIVINAREQGTFLGGMRCHCNTSWKHKVASPSHPQRNGQAEAYRTAFKTSTGLSPFQMVYGKVYHLPEMRLNVYEFSKIYKQKIKVYHDRKLIKNNFHPRQQVLLFNSQLKLFPGKLKSKWSGPFIIKEVKPYGAVELVNPASSELERSWIVNDDLEEAPNRIQSAALEGFLPLCFRDSLGISGTKDLPALPEKQIDVVLVKEFYSNIYDPDDGSPKQCQERGWTIRFNAQMLNDFLGTPVILPELEQLTTYSQYNVAPCRACRPWIFFINGILFFLKINGSGMEK

SEQ ID NO: 170603 - protein, 122 aa, Glycine max
  Coding DNA Sequence Number=SeqID_53825
MPFKPLETGKCEFLVKLKEEASYEGSAKLVLSSEFKEYNDGLIDHRSCIGSTKMLPLSHTCITFFTASSIHRCPTSGFPQSLFSVERVSFAVFCNRVKLNGNAWVSLRFKGSNWKPYLSNNN

SEQ ID NO: 170604 - protein, 118 aa, Glycine max
  Coding DNA Sequence Number=SeqID_53826
MTTLTQIWMTLLLSNILPSDHNADHDIGKYACGSTEVSVGLSRHDIGIAPTRHPVDLEEPNKVLGFLALITGLCQFYGVFVAPNKVIRPPTNRAFIKKYCAPRQAQGETPQQPGDDRQ

SEQ ID NO: 170605 - protein, 75 aa, Glycine max
  Coding DNA Sequence Number=SeqID_53827
MKLTSTPTVTVAARLAASGSENEESRRGEFVTERNTYAEVRHLNVMKREWRSCDKEDDVGDTKATAETKIHNRHE

SEQ ID NO: 170606 - protein, 78 aa, Glycine max
  Coding DNA Sequence Number=SeqID_53828
MSNLSLKLKILKLELGDDLLKHLVMISLPAHLGQFKRNDAILPSKGPVTRAMSKRLQEDWARAAEEDPRVLMNLRVDF

SEQ ID NO: 170607 - protein, 133 aa, Glycine max
  Coding DNA Sequence Number=SeqID_53829
  Homolog annotation: Hit_ID=Q1SVP2; Match level="QueryCoverage=74%, HitCoverage=9%, E-value=1e-08, Identity=46%"; Hit description=HMG-I and HMG-Y, DNA-binding; Transcriptional factor B3
MNINYDYKVVKIAYMVVSVYPKDLTLSKLKSYAKSLQSWGSPLASGRWYGTFGMRLTQEYWRPRILIEIATTVSTLIALDESTRSRNFGHFARLLVDIDLSEIRGSIRDILCTIAHDLDFVILLCKQVVCPNA

SEQ ID NO: 170608 - protein, 492 aa, Glycine max
  Coding DNA Sequence Number=SeqID_53830
  Gene Ontology: Mol. function=RNA-directed DNA polymerase activity; Cellular component=chromatin; Biological process=chromatin assembly or disassembly
  Pfam annotation: Domain name=rve; Domain location=258-414; Score =117.6; E_value=3.6e-32; Accession=PF00665.16; Description=Integrase core domain
MGVADVHKTAFRTHGGHFEYLVMPFGLTNAPATFQGLMNSVFQHYLRRFLLVFFDDILIYSKSMEDHLSHLHHVLLTMRTHSLYAKKSKCYFGVDKVEYLGHFITKEGFSTNPSKIVAVQDWTLPQNLKQLRSCLGVAGYYKRFVSRYGAIAKPLTDMLKKDNFSWSSAAKEAFQELKQRLVATPVLALPDFSKEFVVEADASGLGLGRDATLQEMKNVVYWRGMSKAVMFFVYQCATCQRIKYNTAASPGLLQPLPIPEHVWQNITMDFIEGLPLSFGKQVIFVVVDRLSKAAHFMALSPPYTVANVAQCFLDHVFKLHGFPDTITNDKDPIFVSHFWKEFMSLQGIQVQLSIAYHPQTDGKSEVVNRFLETYLRCMSSDSLAQWSKWLPLAEWWYNSTYHSTIKASPYEIVYGQDPLVYLPYLLGESKIALVDRSLQKREEMLKLLKFHMKRSQDKMKQLADKGKYDRSFHIGDLVYVKLHAYRQVLVQA

SEQ ID NO: 170609 - protein, 127 aa, Glycine max
  Coding DNA Sequence Number=SeqID_53831
  Gene Ontology: Mol. function=RNA-directed DNA polymerase activity; Cellular component=nucleus; Biological process=RNA-dependent DNA replication
  Homolog annotation: Hit_ID=Q1RXD8; Match level="QueryCoverage=91%, HitCoverage=13%, E-value=2e-29, Identity=51%"; Hit description=RNA -directed DNA polymerase
MGTNARVWTEDVLRVLSKFHRNCVLPKGTNATFVVLIPKNDNPHGLKEHHPVTLVGCLYKIIAKVLSNRLRRVLHKVVDESQSAFLSGQNMLDNVVVANEMIQDAKKRPSPCVIFVVDFDKAYNSLR

SEQ ID NO: 170610 - protein, 173 aa, Glycine max
  Coding DNA Sequence Number=SeqID_53832
MWRSFIRRTLLAKWLWWFLKEKDALWVEVIKARVGPSVDMLHTLGRMLVGFRRTYGSKMKLSRINFQQVILCFSAIEFLNKWDVVLGGGGVEVDVRMECIFYGIDIVTTDYLGELNGIVYKDVPRDINNVVELIQGRSWHMFQGNAKSKDPLGLILGLVLYVEGGDHQPNNWG

SEQ ID NO: 170611 - protein, 104 aa, Glycine max
  Coding DNA Sequence Number=SeqID_53833
MVDFAKIQPHGQIDQYSIGYRPISEVYSWKGKRVKGTKNETKDEGSGVYERRREHIPQGKFVGMRRKRDNRIGMVNRLSIFVRTHSLDLLINNYLHWTLEKHNP

SEQ ID NO: 170612 - protein, 233 aa, Glycine max
  Coding DNA Sequence Number=SeqID_53834
  Gene Ontology: Mol. function=RNA-directed DNA polymerase activity; Cellular component=nucleus; Biological process=RNA-dependent DNA replication
MRHLYEFYVNGVLPRSCNSSFITLIPVVEDMQELDEFRSTSLIGCIYKIVAKILSSRSNKVLEWIIDRRPMAFIRVRNMLDGGVGWIKSCLESNSISILVNRSPLNEFQPKRGLRQGDPPVPFLFLIVVERLSSLIKQVVERNMFESYKRLVKIQGNNRDRFLDKVKKKLSRWKGKCLPFGGRICLIKSILTSLPIYMLSFFKMPLKVVKAFRKLQKEFLWGGFEEMKKIPWV

SEQ ID NO: 170613 - protein, 186 aa, Glycine max
  Coding DNA Sequence Number=SeqID_53835
  Subcellular localization annotation: CTP_CleavageSite=51; ConfidenceScore=5.06e-01
MAGKEMVGVGMAAIGLSMKAPNVRPVSSFYNSFFLSKYLGWEFLGVERAVNRGLVRGLIWTRWAKCVEITILEDGSTTTAKWRIGVGKGIKIWGDGKLIDGFGISNGSDNGSNGKQRVWGLLRDDLERVRFVRGALDKRVWNLKNEGEGGRDEVPEGRRGTRGEVERGGGHNCSGGEGGSDEGINE

SEQ ID NO: 170614 - protein, 83 aa, Glycine max
  Coding DNA Sequence Number=SeqID_53836
MDEDQWIYDNIMSEEVNMNEENREQPGVFENIDCSNAFNTYKVFATHDDVLYWVRFIAYDISFGEVIMRSDTYTGNRGRTSYV

SEQ ID NO: 170615 - protein, 242 aa, Glycine max
  Coding DNA Sequence Number=SeqID_53837
  Homolog annotation: Hit_ID=Q1SAS4; Match level="QueryCoverage=36%, HitCoverage=4%, E-value=4e-10, Identity=40%"; Hit description=RNase H, putative
MGEVDEVQERIKADIEALKGKMTTMMEAMMSMNNGGQEGKELGSTDGPHFVRVQNEHAFPPYGLPPNYTPPNVVHPLDENANNSTPILIESQQTQADHAHVSQPMREAHEIPHHYLADSSLTSDTPLWGKIKAIEGGEDYAFANIEDLCLVPDVVIPPKFKVPNFDKYKGTTCPKNYLKVVGYTPLSFADFVFVGERIEVRLRRGKFDYPALVNEEAAANEENEKEEGIHVVIAVPTWLNFS

SEQ ID NO: 170616 - protein, 39 aa, Glycine max
  Coding DNA Sequence Number=SeqID_53838
MVLGSNILDWNTMTVLQKCPMQSTSFVLAELHIIHDHGS

SEQ ID NO: 170617 - protein, 170 aa, Glycine max
  Coding DNA Sequence Number=SeqID_53839
MKMKANKTRNELKASDSNTYQLKIEERRRTMKNLHEITHGNVSEALQRHLGLDFLHENMGQAPFGTTLLYQFLEKRGGVCHPGGFLRKLPEAPPFLLSSSLFFRNLRKHIGVKYTYLGLRVSYPNFVRGLLFDGMQPLVDRFEVLGTLCCTIREVPRHAESQKEALLRNP

SEQ ID NO: 170618 - protein, 76 aa, Glycine max
  Coding DNA Sequence Number=SeqID_53840
MEAKSKQFKELDEIAYPNLNSMRVPLEKVKTKGAQKKQMTKHQRSTKRDPSYWEYVDALHYVQNSNSSMKQPTSSS

SEQ ID NO: 170619 - protein, 71 aa, Glycine max
  Coding DNA Sequence Number=SeqID_53841
MVSNSNASASGQLFNLQKSEVAYSKNVEKVIKGLVTSTLGFRDEHVNEANRWRVWFSPSSFPEKDGLSSSR

SEQ ID NO: 170620 - protein, 76 aa, Glycine max
  Coding DNA Sequence Number=SeqID_53842
ALKGLDDTPQPKSKAAARWIVVKCNRQKRSTECGYYVMHWMSTIILGIFRNNWKMYFNDVRPLEAERFKALRIQWA

SEQ ID NO: 170621 - protein, 74 aa, Glycine max
  Coding DNA Sequence Number=SeqID_53843
MTGMHDGMEKCMLITTDGRNGLTAQHRGEGDVNGVWCRGTTRRGRRCKWSGEGWKQQPSEGVRIVIWALVLWGS

SEQ ID NO: 170622 - protein, 301 aa, Glycine max
  Coding DNA Sequence Number=SeqID_53844
  Homolog annotation: Hit_ID=Q67UP1; Match level="QueryCoverage=84%, HitCoverage=40%, E-value=5e-59, Identity=47%"; Hit description =Hydroxyproline-rich glycoprotein-like
MSPPSPFGLWASLTSSPGQPRHFYFSKKISYHTIPYHASFRDMQDMRDCYDTLLSAAAATASSAYEFSESLRDMGSCLLQKTALNDHGDETGKLLLMLGKIQFKLHKLIDHYRSHIFQTITIPSESLLNELRIVEEMKRQCDEKRDLYDYMVTRYREGGRSKGGKGETFSLQQLQTAHDEYDEEATLFVFRLKSLKQGQSRSLLTQAARHHAAQLCFFKKAVKSLETVEPHVKSVTEQQHIDYHFSGLEEEDGDEGDYGDDVGGGYDENDDGELSFDYGQIEQDQDVSTSRNSMEVTTLRN

SEQ ID NO: 170623 - protein, 371 aa, Glycine max
  Coding DNA Sequence Number=SeqID_53845
  Homolog annotation: Hit_ID=Q67UP1; Match level="QueryCoverage=84%, HitCoverage=47%, E-value=1e-14, Identity=27%"; Hit description =Hydroxyproline-rich glycoprotein-like
MSIRVVDKDVLQSCAQKLCILVCLNVTICSMHLDQVELTLPRDSTAEAAKENLDNLVRNLFSFKVRAGSQSAPLFADNKPDASEKLRQMRPSLSRKFSSYVLPTPVDAKSSTSSGSNNPKPSKMQANLNEPTKNLWHSSPLEQKKQEKDIGDEFSGSIVRSAQSVLKESNSNTASMRLPPPLIDSLLSSNRDYISAYSKKIKRHAFSGPLTSNPGPTKPVSIESVQLFSGPLLPAPIPQPPSSSPKASPSASPTLMTSPKISELHELPRPPTSFPSNSRLLGLVGHSGPLVSRGQKVTANNLVASSAASPLPMPPQAMARSFSIPSSGARVAALHMPRTLESSHRSSISENIASPPLMPISLSSSRPSLDG

SEQ ID NO: 170624 - protein, 112 aa, Glycine max
  Coding DNA Sequence Number=SeqID_53846
MCREVIQLQLLDLGVEVSPVLPPGDQGSSQLSRASQLSSKDAFLSKAEAKTIFEINGISEDIVCVMVGTISKIVMDNHSWCYLACVQCHGKIDIQTGPFTCGCDKDNDQPVL

SEQ ID NO: 170625 - protein, 150 aa, Glycine max
  Coding DNA Sequence Number=SeqID_53847
  Gene Ontology: Mol. function=oxidoreductase activity; Cellular component=intracellular; Biological process=electron transport
  Homolog annotation: Hit_ID=Q9SHS2; Match level="QueryCoverage=89%, HitCoverage=18%, E-value=1e-39, Identity=63%"; Hit description =Similar to glucose inhibited division protein A from prokaryotes
  Pfam annotation: Domain name=GIDA; Domain location=24-149; Score= -217.6; E_value=0.00088; Accession=PF01134.12; Description=Glucose inhibited division protein A
MFITIQWETLASNLEDFSKVAENFAISKSTVEVVVSMKLQDDAIPALEKLQKIWTSFSLVTPNLSIREAMVTNILLGKNDNVEGVCTFFGMKFYAPSVILTTGTFMSGKIWVGRTSMPAGRVGESASLGLTKNLQRLGFETDRLKNGTPA

SEQ ID NO: 170626 - protein, 64 aa, Glycine max
  Coding DNA Sequence Number=SeqID_53848
MKMDFPMGAALHASLATSYLANYQQDIARVWYNLKKLTYEDRKAKFISRVAALNSTIDNDEDDE

SEQ ID NO: 170627 - protein, 89 aa, Glycine max
  Coding DNA Sequence Number=SeqID_53849
  Gene Ontology: Mol. function=transferase activity, transferring phosphorus-containing groups; Cellular component=membrane; Biological process=two-component signal transduction system (phosphorelay)
  Homolog annotation: Hit_ID=Q0K3V3; Match level="QueryCoverage=99%, HitCoverage=14%, E-value=1e-16, Identity=49%"; Hit description =Signal transduction histidine kinase containing a receiver domain
  Subcellular localization annotation: CTP_CleavageSite=28; ConfidenceScore=5.67e-01
MASPHARRSACWTTPSCGWCSASPPCLSSASRSPSGFICWGMNSAQPLPGSWFTCYAPWRSEYGIGATNARPKKMMKTPCCAAGCRALI

SEQ ID NO: 170628 - protein, 97 aa, Glycine max
  Coding DNA Sequence Number=SeqID_53850
  Homolog annotation: Hit_ID=Q0B3K7; Match level="QueryCoverage=54%, HitCoverage=49%, E-value=2e-11, Identity=64%"; Hit description =Hypothetical protein precursor
MDGHQRPTHNPAPKDSPFAFTVQIGGNRQNAGPGLIGRNYRDQCQWRTAGCAGRAKTFLSRHHGKRPHFRLLVADDAGNFRFVAVAERADLYAGGHA

SEQ ID NO: 170629 - protein, 40 aa, Glycine max
  Coding DNA Sequence Number=SeqID_53851
MTTMADMADMAVTIFSGREACAHRYKRWIPLISPSKDGNM

SEQ ID NO: 170630 - protein, 171 aa, Glycine max
  Coding DNA Sequence Number=SeqID_53852
  Gene Ontology: Mol. function=CDP-diacylglycerol-glycerol-3-phosphate 3-phosphatidyltransferase activity; Cellular component=integral to membrane; Biological process=phospholipid biosynthetic process
  Homolog annotation: Hit_ID=Q07A04; Match level="QueryCoverage=65%, HitCoverage=37%, E-value=5e-51, Identity=87%"; Hit description =Phosphatidylglycerolphosphate synthase
  Pfam annotation: Domain name=CDP-OH_P_transf; Domain location=91-171; Score=9.8; E_value=0.003; Accession=PF01066.11; Description=CDP -alcohol phosphatidyltransferase
MLGSYLSKRNHKGLVLGANNTTCVCVIVGAKHMVAEMNVREFSISKNDRTSNSNSKFLTLPTILTLGRVAAVPLLVATFYMDGWRGTVVTTSIFTAAAVTDWLDGYIARKMKMKSTFGAFLDPVADKLMVSATLVLLCTRPLEVAVFRQVPWLLIIPSITIIGRELQTRFY

SEQ ID NO: 170631 - protein, 76 aa, Glycine max
  Coding DNA Sequence Number=SeqID_53853
MPDLSFQVRDLVESRCFQGGCRGAWFRCKLSTADMTAVKSCTNKRKVNPSEKVYSITPQAHEGLAERFSSILSLSL

SEQ ID NO: 170632 - protein, 102 aa, Glycine max
  Coding DNA Sequence Number=SeqID_53854
  Pfam annotation: Domain name=GRP; Domain location=1-91; Score=30.3; E_ value=4.7e-08; Accession=PF07172.2; Description=Glycine rich protein family
MGSKVLLVLVMFMATILLISAAPNEYQNFDKKDGKPAPNGEYDSKWGYGGWGGPWYRGWGGPYYGGGWGGPWHGGGWGWHGGWGGWRPNEHVEAGINGNLNN

SEQ ID NO: 170633 - protein, 185 aa, Glycine max
  Coding DNA Sequence Number=SeqID_53855
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=46%, E-value=2e-28, Identity=40%"; Hit description =Integrase, catalytic region
  Pfam annotation: Domain name=Chromo; Domain location=102-153; Score =26.4; E_value=0.0001; Accession=PF00385.14; Description='chromo' (CHRromatin Organisation MOdifier
MEAVDTLLSDRECGFIALRKKLHKAQEIMKLTADKKRREVQFHVGDMVMIGPVAYKLKLPEDARIHPVFHCSMLKPFHSPVLANTSPTLALPSLIVNNEPVISPTAIVGTRYTSNSETPKLQVLVQWEGLLPEDTTWEDWEQHQDNCHLKGKVILEGPGDDRNREDASARPKRKSSARSYLKDYI

SEQ ID NO: 170634 - protein, 59 aa, Glycine max
  Coding DNA Sequence Number=SeqID_53856
MVEASMAETNNVAIKFIEKEDLTIVESFAIEGVNALRQSDRSHNLITTTNEEEKPHDLI

SEQ ID NO: 170635 - protein, 87 aa, Glycine max
  Coding DNA Sequence Number=SeqID_53857
MAIDGFNFQNTLHRHPPMVHDNAFVEPPPAAANVDMSRHAMDACQQITKSLENMINMRMITIGTEAYTLTKHCLRLARGVTEQWNVY

SEQ ID NO: 170636 - protein, 51 aa, Glycine max
  Coding DNA Sequence Number=SeqID_53858
MYDNLNDASKSSTKHLGGYITMLPRWIYEHFLKIASIVADEDYHERKPRAC

SEQ ID NO: 170637 - protein, 186 aa, Glycine max
  Coding DNA Sequence Number=SeqID_53859
  Gene Ontology: Mol. function=RNA-directed DNA polymerase activity; Cellular component=chromatin; Biological process=RNA-dependent DNA replication
MTVPVLATPNFSQPFILETDTSDIAMGTTASIYVRELHAITVAMRKWRHCLLGNHFTILTDHRSLKDLMSQIILILEQQHYLSKLLGYDYSIQYRPGSGNVAVKYENRKSTGLLQPLPIPTTIWEDLALDFIIDLPLSHGFLAILVVNEKFAKRALSSALPAKYSAHKVALLFLDTVCKLHGFLHV

SEQ ID NO: 170638 - protein, 288 aa, Glycine max
  Coding DNA Sequence Number=SeqID_53860
MVIVENPTITHHDLKWVNGGGGKVQKACDSWLDEIMGTPTVYEDSHLGNRRVDCHRQMRLQFFVWDKEDGSSREGGRAGCGSHEQIDGDPVAYPPIILLAPPLVVMTGVVMLVPRNGVVARHPLVLAKGWALHVKRGHREAFVVRYALVLEELGGFGVGGEGGEGGTKRATRRSTRKSILLLIYWAWEREVWLWTREFWPWVSRLTASSRRSVVAKRVLWSSMTRMAEQGKGARNKDEAKSNGRNSLLNAHLHKSFNVSKYSLLRIVSPLFPAVEKLLSLFKDSCKEL

SEQ ID NO: 170639 - protein, 156 aa, Glycine max
  Coding DNA Sequence Number=SeqID_53861
  Gene Ontology: Mol. function=DNA binding; Biological process=DNA integration
  Subcellular localization annotation: CTP_CleavageSite=61; ConfidenceScore=5.29e-01
MALTFSGSGASPAAETMYPRTLKTSSKWDRCSVREVLYTRISLKNTATNLRKNGFSNSFMEAWKVAGILLKVWVPIWMDVDWVDLWKEGRASRGRDEGSLGWAGSDNQARWSMVVILCVCASLLSWWVDAMVGSNDTSTQRCTCWPKYENTIVLVV

SEQ ID NO: 170640 - protein, 136 aa, Glycine max
  Coding DNA Sequence Number=SeqID_53862
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=36%, E-value=6e-33, Identity=56%"; Hit description =Integrase, catalytic region
MKKLVDTHRWDVSYSTGDWVFVHLRPYRQVSVRPSYTKLSKRFYGPFLILERIGPMAYQLQLLASSKIHPIFHVSLLKPYHGNPPSTFGQPSSGRTTLNIGLEDRYIQYPSHLKGLSVMARAGSRRHHLGGLGFPT

SEQ ID NO: 170641 - protein, 231 aa, Glycine max
  Coding DNA Sequence Number=SeqID_53863
  Gene Ontology: Mol. function=zinc ion binding
  Homolog annotation: Hit_ID=Q69L44; Match level="QueryCoverage=80%, HitCoverage=52%, E-value=9e-36, Identity=38%"; Hit description=SWIM zinc finger family protein-like
MDLSNFGTGRFSAHKNIPNTRDTSESDPFVLGIQTEWQLQQMIRYGHRNVVAADSTFGAKRLKYPLFTLLVFDSRQHALPVAWVITRSFAKPDVSKWLKALIDQTRSVEPGWKLNGFLIDDAIAEIDLLRNMAFNNEKLSTSKPGSFWIIRSLSCNLCKHVVKVNVIYENLKGYQQSMSFRSFEEVLMDLWKKPVDDSFALKGRTYIGKPSSLPLPHGSSNTKSVGVHKKN

SEQ ID NO: 170642 - protein, 225 aa, Glycine max
  Coding DNA Sequence Number=SeqID_53864
  Homolog annotation: Hit_ID=Q1S4V6; Match level="QueryCoverage=76%, HitCoverage=25%, E-value=1e-07, Identity=26%"; Hit description =Ribonuclease H
MDWSLCTKRDDLWEKNGSNLWKGVCSSWRNFQENLGLNIGDGTKVEFWDDRWGPGSDESCQRFDVDTENLDRIFRRCPISRAIWYMLLPQTMHSEFLVQDFNLWMLSYLKNGESVNGRQWYHIFALAVDNIWQCRNKLIFEIYQVQPTVIVSQIWRQVDAILDSIQYIDSLHSISLSVKESTINSSMKKVAVGGVFRDSNGQVIFAYALRGGSYCEGICWEKEIK

SEQ ID NO: 170643 - protein, 175 aa, Glycine max
  Coding DNA Sequence Number=SeqID_53865
MVFESASRSTSMADSYIGSLISLTSKSEIKYEGSDESMMAKAAMMGGVLSGKSTVVGAQLVSLTVALAVSLTINLIVSLVVTLTLVVVVVLDFGVNDEREQKDTAQKVITFADSLILSISQTWDRKEASFINEDRIQTFAFGTRIPTSCQDGGFPGFTAQLSLVIHGFLMATLWL

SEQ ID NO: 170644 - protein, 88 aa, Glycine max
  Coding DNA Sequence Number=SeqID_53866
MDSEDFQSILESVDVWAFMDAAIAVASVNHADELKRRRDRIVELVTPRNSDFANLDAHQMAGIADPDDGIFKSVPVDEVLKHKNSSTM

SEQ ID NO: 170645 - protein, 125 aa, Glycine max
  Coding DNA Sequence Number=SeqID_53867
  Homolog annotation: Hit_ID=Q8H6Q8; Match level="QueryCoverage=58%, HitCoverage=2%, E-value=5e-07, Identity=35%"; Hit description=CTV.20
MSNPWRFTVGNWLCDSDLVSPTRIERVLAEKDLLADSYSDLETSILDEKEFLLLKVISTFPELSCLICSMVGAGRGIDGVALSITHLSGRVTSSHFIFLGRETLAFVISVINKAAGIDPSFMSRP

SEQ ID NO: 170646 - protein, 90 aa, Glycine max
  Coding DNA Sequence Number=SeqID_53868
  Gene Ontology: Mol. function=ubiquitin-protein ligase activity; Cellular component=ubiquitin ligase complex; Biological process =protein ubiquitination
  Homolog annotation: Hit_ID=Q8VZ40; Match level="QueryCoverage=87%, HitCoverage=11%, E-value=8e-19, Identity=62%"; Hit description=E3 ubiquitin ligase PUB14
VIRTGSPRNRENVAAVLWSLCIGDPLQLKLAKEHGAEAALQELSENGTDRAKIKAGSILELLQRMEGGPAIKSAATTEPGSQNGKKLEGG

SEQ ID NO: 170647 - protein, 75 aa, Glycine max
  Coding DNA Sequence Number=SeqID_53869
YLEEELSTNVMNCNSLDEKAQALCKDADDLLAASSGVEDEGKVAEVKQNILNSTWSTDLRSQLRKIKNTILGLSD

SEQ ID NO: 170648 - protein, 159 aa, Glycine max
  Coding DNA Sequence Number=SeqID_53870
MASQGVIQVSISLVTLKPMPYLLVKWHNYLTKGKKVLGDVEELSWQVVRTYIRVQGENSTTKDNNDRETDVESDVARREFDLIEETVLVVKKESRPKLLIQVSKNRSEANKAKIPGIPLSERPQAESESTEAEVKGKLIWIDSKQQTTRGKVIKLRLNL

SEQ ID NO: 170649 - protein, 302 aa, Glycine max
  Coding DNA Sequence Number=SeqID_53871
  Pfam annotation: Domain name=zf-C2HC_plant; Domain location=18-72; Score=5.0; E_value=0.011; Accession=PF07567.3; Description=Protein of unknown function, DUF1544
MGTSYLAKNQDDDIKSLWNYVTKIKRARGSGHEIKCNLCGLNFTGCYTRVRAHLLKVRRKGVRVCENVTPSRLIEFKNIDNEATALRVQKSKAKSISSRPFLMKTKRKTLVLIQEKRKRSRETLDYEIAKDEVHPTIVQNDPPIIERCEGDDIKLESVSTSELQSVDFSSSITGSDSDDPFDQVDKKFSVCGKETMSSGACSGDASLKSIRDAIGALELLMIRDLSEVSSDPVMQSQLSHFLDLLTTSSHPKVTVELGTLFVFKRMAFASFQEFQATVESVNKLKNFEKQKARIQKETSAGK

SEQ ID NO: 170650 - protein, 88 aa, Glycine max
  Coding DNA Sequence Number=SeqID_53872
  Homolog annotation: Hit_ID=Q1S4E1; Match level="QueryCoverage=82%, HitCoverage=7%, E-value=3e-26, Identity=75%"; Hit description=Citron- like; WD40-like
MVVSNESLSYSFGLSNGFAKKPMLSMTVVESRDFLIPLSESIAFHRLPFFETIAVITKAKGANLFCWNHRRGFLCLARQKHICIFRHD

SEQ ID NO: 170651 - protein, 205 aa, Glycine max
  Coding DNA Sequence Number=SeqID_53873
  Gene Ontology: Mol. function=sequence-specific DNA binding; Cellular component=intracellular; Biological process=regulation of transcription, DNA-dependent
  Homolog annotation: Hit_ID=Q76FX2; Match level="QueryCoverage=99%, HitCoverage=90%, E-value=1e-43, Identity=47%"; Hit description=CCAAT- box binding factor HAP5 homolog
  Pfam annotation: Domain name=CBFD_NFYB_HMF; Domain location=79-143; Score=81.0; E_value=3.7e-21; Accession=PF00808.13; Description =Histone-like transcription factor (CBFNF-Y) and archaeal histone
  Pfam annotation: Domain name=Histone; Domain location=73-146; Score =38.5; E_value=2.3e-08; Accession=PF00125.14; Description=Core histone H2AH2BH3H4
  Pfam module annotation: Pfam domain module=CBFD_NFYB_HMF::Histone; Domain location=79-143::73-146
MDQNQHGQPTQEAVGKNQYQSNPMMAPTNPPSETIGPYVTSSFPREKQHAPQDIYQEQLNNFWAKQCQEIEETTDLRTHSLPYARIKKIMKADRDVRMVSAEAPVLFAKACEMFIMELTMKAWANAEDHRRRILQKSDIASAISKTDVFDFLEDIVPRDVGIPRSSIAQNFDLSMPPHQNVTYPPYYVPAMVTGRPIPDQNHHGP

SEQ ID NO: 170652 - protein, 291 aa, Glycine max
  Coding DNA Sequence Number=SeqID_53874
  Gene Ontology: Mol. function=microtubule binding; Cellular component =cortical microtubule, transverse to long axis; Biological process =positive regulation of microtubule polymerization
  Homolog annotation: Hit_ID=Q10PE0; Match level="QueryCoverage=72%, HitCoverage=40%, E-value=5e-59, Identity=50%"; Hit description =Microtubule associated protein family protein, putative, expressed
MLAIGGHGTSIRTSSTCTALLRELAVFLCLWCFRILGFEEFVGCKNKDMGTTVEDEQDLSLGRLNEYKKEKTVGYVHRSLHGTQVEQSTNISNSTLEGLEQAILKLKIERKTGISEESEITERGVLSTEMIEKGSAEVDRLAKLKASRMKELVFKKRSELEEICRLTHIEPDPSTVAEKASALIDSGLVDPSELLAKIEEQIIKAKDEVLSRKEVTDRIDKWVAACEEENWLDKYNQDNNRYSAGQCAHINLKRAEHARITIGKIPAFFKKVYAGVNAMQQKEEDKRDDKG

SEQ ID NO: 170653 - protein, 62 aa, Glycine max
  Coding DNA Sequence Number=SeqID_53875
MPDLPFQVGDLAESRCFEKVVIVVHGLDASDRKRYGGENSTYSFFLTQQILIVQTSVTIPLH

SEQ ID NO: 170654 - protein, 103 aa, Glycine max
  Coding DNA Sequence Number=SeqID_53876
MTIICLCVPSNSIVSGWRKGVWMTIICLRMSSGSPPLDDKWYRMTIICLCVPSDSIVSRWQKGVRMTIICLRMSSGSPPLDDKRCRMTIICLCVPSDSIVSGW

SEQ ID NO: 170655 - protein, 168 aa, Glycine max
  Coding DNA Sequence Number=SeqID_53877
MTTGGGKISALITATYRLKEVKTCLNVRIQPNPVALIILRHQVKEKIPIASPPFKPLRRIRPALLLAGSPAALADNGATATGPEQTLNLSNQTLQATGKDHYGLLVESGAKASATDVTVLTDGADGYGVFSTLASSDIQMTRCSVQTTGDGGYGVVASLTGAFKLDGT

SEQ ID NO: 170656 - protein, 207 aa, Glycine max
  Coding DNA Sequence Number=SeqID_53878
  Gene Ontology: Mol. function=two-component response regulator activity; Cellular component=intracellular; Biological process=two -component signal transduction system (phosphorelay)
  Homolog annotation: Hit_ID=Q9HZG3; Match level="QueryCoverage=99%, HitCoverage=99%, E-value=4e-31, Identity=35%"; Hit description =Probable two-component response regulator
  Pfam annotation: Domain name=GerE; Domain location=144-201; Score =46.8; E_value=7.3e-11; Accession=PF00196.10; Description=Bacterial regulatory proteins, luxR family
  Pfam annotation: Domain name=Response_reg; Domain location=2-115; Score=109.2; E_value=1.2e-29; Accession=PF00072.14; Description =Response regulator receiver domain
  Pfam module annotation: Pfam domain module=GerE::Response_reg; Domain location=144-201::2-115
MANFVIVDDHPIVRVAIRLVLENAGHRVSAEAVDGDNIFSLIKENGADAAIIDIDLPGIDGIEAVRNLRTAGSLIPVIVMSGKNAEFYAYKSKKAGANGFISKKNNLNDLAQAVDAVLSGYGFFPLRLSHQAEGDQLVQDSDKLLLLSHREYEVLRYLGEGTEIVKIANRMKLSNKTVSTYKARLMEKLSLKNQKDLLDFTRRNQIN

SEQ ID NO: 170657 - protein, 166 aa, Glycine max
  Coding DNA Sequence Number=SeqID_53879
  Subcellular localization annotation: CTP_CleavageSite=43; ConfidenceScore=5.75e-01
MSNHSSVSSVHPSAGLNSSLPSSSGIGLSNNLTSSGPLAAPARDSRYGVSRTPPLSVDEQKRIQQYNQMISSRNMPQSTMSVPGSLSGSDLGGVRMLPGGNGMGMLGSGGMPSSSMVGIPSPVNMHAGVGAGQGNSMLRPRETAKVGSYMEVIKTSINGWKLHGSY

SEQ ID NO: 170658 - protein, 102 aa, Glycine max
  Coding DNA Sequence Number=SeqID_53880
  Gene Ontology: Mol. function=solute:hydrogen antiporter activity; Cellular component=integral to membrane; Biological process =regulation of pH
  Homolog annotation: Hit_ID=Q75L14; Match level="QueryCoverage=85%, HitCoverage=12%, E-value=3e-20, Identity=56%"; Hit description =Putative Na+/H+ antiporter
  Subcellular localization annotation: CTP_CleavageSite=91; ConfidenceScore=5.71e-01
MRTTARASRIHAATSWNVVATMVVSPTHMVKSLSFARMRASTGNAVMERETPMKMRNCGNSALSTPSTILQRMTATSMPHMKGREISTAVMQNAFRPLWGME

SEQ ID NO: 170659 - protein, 101 aa, Glycine max
  Coding DNA Sequence Number=SeqID_53881
  Gene Ontology: Mol. function=pyruvate decarboxylase activity
  Homolog annotation: Hit_ID=P51850; Match level="QueryCoverage=53%, HitCoverage=9%, E-value=1e-24, Identity=90%"; Hit description =Pyruvate decarboxylase isozyme 1
MIRCGQKIIIFLINNGGYTIEVEIHDGPYNVIKNWDYTHFVDTIHNGQGKCWTAKNLKTNYEGVDYKTQLSPKIMPTSSRRLDDSSPESYSLHPAAFILLP

SEQ ID NO: 170660 - protein, 136 aa, Glycine max
  Coding DNA Sequence Number=SeqID_53882
  Gene Ontology: Mol. function=pyruvate decarboxylase activity
  Homolog annotation: Hit_ID=P51850; Match level="QueryCoverage=54%, HitCoverage=13%, E-value=9e-22, Identity=67%"; Hit description =Pyruvate decarboxylase isozyme 1
MADFLTALAIKVMTSTTTVDNYQRVYVPLGIPLRPKIECVEQELLSGDTVVIAETGDSWFNCQKLHLPENCGDEDMFKSKGKDPLDGLGGPMTRARARKAKESLQQVLSILFEYKPKFQGEKSKVVSCIMAQMEED

SEQ ID NO: 170661 - protein, 89 aa, Glycine max
  Coding DNA Sequence Number=SeqID_53883
MKKIQGLQAPMELHQFISDEVTMSLGWGNMNDGSQGFFNQPSLLCGAEPNDTGMGNDNDENMGGGDTDMHSQPAILTFLVFKDYDDFLN

SEQ ID NO: 170662 - protein, 127 aa, Glycine max
  Coding DNA Sequence Number=SeqID_53884
METAKGTTERTPSNRKKQSRRKRKAVKRSKESESAVERIKFRKKVLPETSGRRFFRKLSDDVLPDVVCGYFRNSQILLPEEVFFRKLFGKAFSEKFTEILLPEEELLKGNFATSLFAGCPSNNAGCT

SEQ ID NO: 170663 - protein, 293 aa, Glycine max
  Coding DNA Sequence Number=SeqID_53885
  Gene Ontology: Mol. function=galactosylgalactosylxylosylprotein 3 -beta-glucuronosyltransferase activity; Cellular component=membrane; Biological process=protein amino acid glycosylation
  Homolog annotation: Hit_ID=Q4VZ79; Match level="QueryCoverage=99%, HitCoverage=59%, E-value=1e-123, Identity=76%"; Hit description =Glycosyltransferase
  Pfam annotation: Domain name=Glyco_transf_43; Domain location=45-292; Score=198.9; E_value=1.2e-56; Accession=PF03360.6; Description =Glycosyltransferase family 43
MKAHRIIERVQREQRTLFGVKMPKTVIAVTPTHVRTFQKLHLSGVMHSLMLAPYEVVWIVVEAGQVTNKTASIIAKSGLRTIHVGFNHRMPISWNDRHKLEARMRLHALRIVRKERLDGIVMFADDSNMHSMELFDEIQSVKWIGAVSVGILVHSGGADESSTLQGEEEAPPMPVQGPACNATNNLVGWHTFNKLRYAGKSAVYIDDLAPVLPRKLEWAGFVLNSRLLWKDLDDKPDWIKDLKELDGIDEDIESPLSLLRETYVVEPLGSCGHQVLLWWLRVEARTDSKFPAQ

SEQ ID NO: 170664 - protein, 425 aa, Glycine max
  Coding DNA Sequence Number=SeqID_53886
  Gene Ontology: Cellular component=nuclear envelope
  Homolog annotation: Hit_ID=Q5NBL8; Match level="QueryCoverage=92%, HitCoverage=88%, E-value=5e-67, Identity=39%"; Hit description=Unc -84 homolog B-like
  Pfam annotation: Domain name=Sad1_UNC; Domain location=311-423; Score= 88.7; E_value=1.8e-23; Accession=PF07738.3; Description=Sad1  UNC -like C-terminal
MSASTVSITAANPGARRRPVIATEKKTATNLELLANDVAVSPAVATSGDGATGRDLSHHSVRGEALLDRTPRDLAPAKKVAGGNSSSVPPRRARKLSAKAEKPRWLTLVSIFGKNMVLLVVLAGLVQLIWRMSLKSGDGMAGGYVGFSEFEGRISDVEGLLKKTAKMIQVQVDVVDKKIEDEVRGLRRELNEKIEEKGEILENGLKKMEAKNEELERYLSELKGEDWLSKEEFEKFVDEVRSVKGSGYEGGGLDEIREFARGVIVKEIEKHAADGLGRVDYALASSGGAVVKHSEVFDLVRGNWFLKSARNGVHPNAEKMLKPSFGEPGQCFPLKDSRGFVQIRLRTAIIPEAVTLEHVAKSVAYDRSSAPKDCRVSGWLQEHNADSAINTEKMHLLAEFTYDLEKSNAQTFNVLNSAASGVINT

SEQ ID NO: 170665 - protein, 108 aa, Glycine max
  Coding DNA Sequence Number=SeqID_53887
MCKWRKHLGEWENAREVTPPPQPGYLKCNIDADQNCIGIGLCITNEWSQCVKANSSLHQGCMDYVEAETWALLHALSWIKFQNLSNNVFEIDVQTVMDGINTKAVGKS

SEQ ID NO: 170666 - protein, 108 aa, Glycine max
  Coding DNA Sequence Number=SeqID_53888
MEITIRDGVTESLNQPGGYMLVMWLGLDMLVMWYSYWCLGVRDWGIKRWFELGLGSGVSFGFRGVLGFEGELAIVEPLGSARSSGPHFRVPSSATMVNNFLQTSAKAG

SEQ ID NO: 170667 - protein, 140 aa, Glycine max
  Coding DNA Sequence Number=SeqID_53889
  Gene Ontology: Mol. function=DNA binding; Cellular component =mitochondrion; Biological process=DNA integration
  Pfam annotation: Domain name=rve; Domain location=3-136; Score=14.6; E_value=0.00036; Accession=PF00665.16; Description=Integrase core domain
MGNGLGTFLIAKSQIKFLLVIVDYFTKWIEAEPLAKIITQKVQKFTWKSIICSYGLPQAIITDKGRQFIEKGYEEFLKQLRINSLTSLVEHPQTNGQAKIANDLVWRLRGDARKDNSEGKLVFDWEGPFRVVESLQNDAY

SEQ ID NO: 170668 - protein, 152 aa, Glycine max
  Coding DNA Sequence Number=SeqID_53890
  Homolog annotation: Hit_ID=UPI000034F09D; Match level="QueryCoverage =62%, HitCoverage=5%, E-value=1e-39, Identity=83%"; Hit description =SPK1 (SPIKE1)
MHLVIEAINSLKNVDSTALLQFLHPILNMLLHLIGNGGETLQVAAFRAMVNIVTRVQQESVDDAERNHFLVNYVDCAFDDFGGRQPPVYPGLSTVWGSLARSKGFNSKFSSFQILFLCTKHLILFGYRGYCQFITAVTEDLDCSHNQEKEEI

SEQ ID NO: 170669 - protein, 88 aa, Glycine max
  Coding DNA Sequence Number=SeqID_53891
MTKGIEIYACDWRNKSKRQCLEKPSIINSVVPSNFVTLLICATERHCNTIEVVRRGSSSTIGHLCLKRKLGILQRTLFGFHSRPLFVP

SEQ ID NO: 170670 - protein, 88 aa, Glycine max
  Coding DNA Sequence Number=SeqID_53892
MAILEAIHWGLEMNINVQVCNIETGYQRQRKKRSSGRGGPTVGVEVEVNASEGSAMDGVGCGGVAFVVVVEIHHGEWWMKAEGEKGLE

SEQ ID NO: 170671 - protein, 49 aa, Glycine max
  Coding DNA Sequence Number=SeqID_53893
MEPHTSHVSATTILKIHFLIHPLTIEAQNLLCLLVKQFKISEFLQQHGM

SEQ ID NO: 170672 - protein, 139 aa, Glycine max
  Coding DNA Sequence Number=SeqID_53894
MGAGSAAFHSIKLRDFTAQSNAYAIMLIQIGFFFFVLLVASLALYVLVLGVNRVLVQLLLVATQVMLVSTQSITNYIFKKNLTEEACQEIGSFFLQCHAIPFNVTRRDEFYDILELVARHGSDGTGFKPPSYPEIRVKY

SEQ ID NO: 170673 - protein, 402 aa, Glycine max
  Coding DNA Sequence Number=SeqID_53895
  Gene Ontology: Mol. function=protein binding; Cellular component =integral to membrane; Biological process=defense response to fungus
  Homolog annotation: Hit_ID=Q1ST34; Match level="QueryCoverage=87%, HitCoverage=84%, E-value=4e-76, Identity=38%"; Hit description =Leucine-rich repeat
  Pfam annotation: Domain name=LRR_1; Domain location=116-138; Score =7.6; E_value=11; Accession=PF00560.23; Description=Leucine Rich Repeat
  Pfam annotation: Domain name=LRR_1; Domain location=12-35; Score=6.7; E_value=16; Accession=PF00560.23; Description=Leucine Rich Repeat
  Pfam annotation: Domain name=LRR_1; Domain location=140-163; Score =12.9; E_value=1.1; Accession=PF00560.23; Description=Leucine Rich Repeat
  Pfam annotation: Domain name=LRR_1; Domain location=165-188; Score =8.4; E_value=7.5; Accession=PF00560.23; Description=Leucine Rich Repeat
  Pfam annotation: Domain name=LRR_1; Domain location=189-211; Score =6.7; E_value=16; Accession=PF00560.23; Description=Leucine Rich Repeat
  Pfam annotation: Domain name=LRR_1; Domain location=213-236; Score =15.4; E_value=0.2; Accession=PF00560.23; Description=Leucine Rich Repeat
  Pfam annotation: Domain name=LRR_1; Domain location=238-261; Score =3.6; E_value=60; Accession=PF00560.23; Description=Leucine Rich Repeat
  Pfam annotation: Domain name=LRR_1; Domain location=309-330; Score =11.6; E_value=1.9; Accession=PF00560.23; Description=Leucine Rich Repeat
  Pfam annotation: Domain name=LRR_1; Domain location=333-355; Score =14.0; E_value=0.53; Accession=PF00560.23; Description=Leucine Rich Repeat
  Pfam annotation: Domain name=LRR_1; Domain location=357-379; Score =11.2; E_value=2.3; Accession=PF00560.23; Description=Leucine Rich Repeat
  Pfam annotation: Domain name=LRR_1; Domain location=38-60; Score =15.7; E_value=0.17; Accession=PF00560.23; Description=Leucine Rich Repeat
  Pfam annotation: Domain name=LRR_1; Domain location=381-402; Score =8.6; E_value=6.9; Accession=PF00560.23; Description=Leucine Rich Repeat
  Pfam annotation: Domain name=LRR_1; Domain location=63-85; Score =17.4; E_value=0.053; Accession=PF00560.23; Description=Leucine Rich Repeat
  Pfam annotation: Domain name=LRR_1; Domain location=87-109; Score =10.7; E_value=2.8; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=116-138::12-35::140-163::165-188::189 -211::213-236::238-261::...
  Pfam module annotation: Domain location=309-330::333-355::357-379::38- 60::381-402::63-85::87-109
  Subcellular localization annotation: CTP_CleavageSite=19; ConfidenceScore=5.17e-01
MSSSFIMSSSSSLVSLDLSSNLLKSSTIFYWLINSTTNLHNLLLYNNTLEGPIPDGFGKLMNSLEVLHLTGNKLQGEIPSFFGNMCTLQGLHLSNNKLNGEISSFFQNSSWCNRHIFKRLYLSYNRLTGKLPKSIGLLSELEVLTLVGNSLEGDVTESHLSNFSKLKRLYLSENSLSLKLVPSWVPPFQLKYLRIRSCKLGPTFPSWLKTQSSLYELDISDNGINDSVPDWFWNNLQYMTDLNMSFNYLIGAIPDISLKLPNRPSIILNSNQFEGKIPSFLLQAPTLMLSENNFSDLFPFLCDQSTAANLATLDVSHNQIKGQLPDCWKSVKQLVFLDLSSNKLSGKIPMSMGALVNMEALVLRNNGLMGELPSSLKNCSSLIMLDLSKNMLSGPIPSWIGE

SEQ ID NO: 170674 - protein, 381 aa, Glycine max
  Coding DNA Sequence Number=SeqID_53896
  Gene Ontology: Mol. function=inositol or phosphatidylinositol phosphatase activity; Cellular component=intracellular; Biological process=abscisic acid mediated signaling
  Homolog annotation: Hit_ID=Q6AVN0; Match level="QueryCoverage=95%, HitCoverage=74%, E-value=1e-107, Identity=51%"; Hit description ='putative inositol-1, 4, 5-trisphosphate 5-phosphatase'
  Pfam annotation: Domain name=Exo_endo_phos; Domain location=25-346; Score=43.0; E_value=1e-09; Accession=PF03372.13; Description =EndonucleaseExonucleasephosphatase family
FQEIVPLNAGNVLVLEDNEPAAKWLALINQSLNGSSDLASKGLKLTASFGGPLFSQKPSLKKIKKTFKKLNGKRLKSCNCVLEMERKAAKDFCFRCQESNFNSDDSSTEEEDENFTIPVALATSQMKYSLVACKQMVGIFVSVWMRRELVQYVGHLRICCTSRGIMGCLGNKGCISVSMSFYQTSFCFICSHLASGEKEGDELRRNLDVIEILKNTQFPRICKTPHSRMPDKILDHEISLSHDDAKRLVEKRDWPALFNKDQLKMEREAGRVFKGWKEGKIYFAPTYKYAFNSDTYYVEGVKVSKNKRRTPAWCDRILWHGRGIQQLLYVRREFKFSDHRPVCATFNVEVEVMFRGQKKKVSTCNFQNIDDLVSTRSPYFS

SEQ ID NO: 170675 - protein, 77 aa, Glycine max
  Coding DNA Sequence Number=SeqID_53897
MVEWVISKPILVWCCGEQMLKAQGMAEKKSSSRVGGGSMVFGRVDLVKGRLVVWMSKTAKRDNEDVWVVKRRKEQPT

SEQ ID NO: 170676 - protein, 108 aa, Glycine max
  Coding DNA Sequence Number=SeqID_53898
  Homolog annotation: Hit_ID=UPI000034F09D; Match level="QueryCoverage =86%, HitCoverage=4%, E-value=5e-18, Identity=53%"; Hit description =SPK1 (SPIKE1)
MRLAGARQTKGDEVNDDDIPSTSGRQFTEGVDGDLLPSDVPKHIGQSPLPAYEPAFDWENERTLIFGQRIPETPLSHGMKISVKVQSLQFQAGLAGECYVVDIGGIMW

SEQ ID NO: 170677 - protein, 145 aa, Glycine max
  Coding DNA Sequence Number=SeqID_53899
  Homolog annotation: Hit_ID=Q1SHY8; Match level="QueryCoverage=64%, HitCoverage=12%, E-value=1e-08, Identity=41%"; Hit description=WD40 -like
MLGYDDDDIDVFFDSVDSLSAQDSVLGKEGFDSERCGYDEIWVKEPVSVKERRERFLQGLGLADAASKVCSQEKMSFDDSSISLGLERIRECSGAISNACILHTDPVVSEKLILSGGKAASEEKVYLDEVKGCSQDEADANFQGK

SEQ ID NO: 170678 - protein, 144 aa, Glycine max
  Coding DNA Sequence Number=SeqID_53900
  Subcellular localization annotation: CTP_CleavageSite=42; ConfidenceScore=5.02e-01
MVESSKKCKGLTSTSIAAGQRCHDTSGDSTAPPNPSISSPCSLNLFSSDDQRQSYCYCLLWLSEGYGWPMGVKQDLQSIVPDEHTPSPPPQMDSSSSLLHDVLSEIRDLRAFVGDHFEVMDSHIMRLKDDMSFIRRCFDPPAYP

SEQ ID NO: 170679 - protein, 273 aa, Glycine max
  Coding DNA Sequence Number=SeqID_53901
  Gene Ontology: Mol. function=protein phosphatase type 2A regulator activity; Cellular component=protein phosphatase type 2A complex; Biological process=signal transduction
  Homolog annotation: Hit_ID=Q1SHY8; Match level="QueryCoverage=68%, HitCoverage=29%, E-value=4e-53, Identity=56%"; Hit description=WD40 -like
MPIPQIYYVGRGGEAFLRLLKGLPKSGSQMSGSFTSSGKNIISVGEDSHVYIWNFDDMGNASSKQTKSERSCEYFFSKGVTVAIPWSGMKADQRDSSGNYSHRSSEMPTQQLEVAPETRDHELFSLGNWFTTDGSCRGSMTWPEEKLPSWDLPIAEEDQQLSHKDNCHDRSVSETWGLSIVAAGCDGTIKTFHNFGLPPRCLPCMRTLATYPLRLCLLKVENLQRCFMALESNISGSKCGKTEFEAHGILAIASAYMMIIAKSMLNLKALDMF

SEQ ID NO: 170680 - protein, 77 aa, Glycine max
  Coding DNA Sequence Number=SeqID_53902
MSEWVDSKDILKLKSIRILPKILAEVGDGLDSLRQGLRLLEDNDNFPLDECIIYSVRIYLKHLHSNIDFNQRATHVD

SEQ ID NO: 170681 - protein, 278 aa, Glycine max
  Coding DNA Sequence Number=SeqID_53903
MEEPSKKRKGTSSRSQRHSGAQETSMPSSIPSGSLFSSKEQRIREGVPFEGALIDDWKFDFSIHDDRRLVCTNQADMTGRLLAGSLAFESRILHYLIVRILLPRSSNLAQVSEEDLIVMWAFHKGLQIDWAHLVRYRMHKALRLNAPLPYLHLVTLFLQHFNIPLDSEAYVPIKRSFLIGASVIAFFGYIKEHDGSWVKKGARNVGEEGHEREDSSFLSKNMDRFDGLQTFVGERFDTLELQVDMHFNEMESRITKVEEDVSYIRSSFDLPPLPPPSS

SEQ ID NO: 170682 - protein, 96 aa, Glycine max
  Coding DNA Sequence Number=SeqID_53904
MDNNQEEINYIGLERDVDCLVVRGRKRKSLSRSSWRGTQSLQRDDDCSQMQSHVDRPCRRIGQRRSTKKGLPQHRAGKVLEGESSGCECGEGKVEV

SEQ ID NO: 170683 - protein, 106 aa, Glycine max
  Coding DNA Sequence Number=SeqID_53905
  Subcellular localization annotation: CTP_CleavageSite=57; ConfidenceScore=5.05e-01
EPVEDDFGGFKGSSASTRPLSLWTADSSAESHLTRSRRREGTRESAWLVQQLAATTRVAELGPRDEVQRERGGVSVGGDVREGRVGALLMEACLWGFYGGWIFELQ

SEQ ID NO: 170684 - protein, 140 aa, Glycine max
  Coding DNA Sequence Number=SeqID_53906
MEERIEERMGKKKYKMKNKRIAYKLKRYGNQVKKRLSHEVQKVTVELSSVIGLCAHPQLSAASARRRIWQSISIKAVSSARLSARLALSSNPLTCAKREGGAKHNIVNSEPIQSLSCAELGYTLLQTFRQIVGRRKGTDS

SEQ ID NO: 170685 - protein, 158 aa, Glycine max
  Coding DNA Sequence Number=SeqID_53907
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=1e-21, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHALAIRGLHVLAFRGLHALAFRGLHVLVFRGLHILAVRGLHDHTLRELHVPAVKWLHALAFKGLHALTFRGLHVLAIRGLHVLAFRGLHILAFRGMHALAFRGLHALAFRGLHILAFRGLHVLSFRGLCCVKIYRDQSLKRKSF

SEQ ID NO: 170686 - protein, 207 aa, Glycine max
  Coding DNA Sequence Number=SeqID_53908
  Homolog annotation: Hit_ID=Q2HRX8; Match level="QueryCoverage=86%, HitCoverage=23%, E-value=1e-09, Identity=29%"; Hit description=IMP dehydrogenase/GMP reductase
  Pfam annotation: Domain name=DUF1723; Domain location=74-124; Score =7.9; E_value=0.059; Accession=PF08330.1; Description=Protein of unknown function (DUF1723)
MNIGPPFGGGPIDLSLIRSYRDQYVGHVWIRQSRPKMKLVIHDGQVLPLLTESTVKAYVLRSGLSTLVTMWYPATNKGFVNTHVERCHQEISSFHLPVGNITITLDYAYSLIMSPPPLVEVVKILFMTHLGINLEEEAIATTTIGARGVAALAYLYGHLSYVSQYTSKQVGGYMMLVMLADGSQHETPDKLIRPGRSWMKLQMDVVV

SEQ ID NO: 170687 - protein, 129 aa, Glycine max
  Coding DNA Sequence Number=SeqID_53909
MVDSLLFFLNVNGPILQEIEVVPKVKHFRNPQKSAPQPQCHGPLSQAPTHSVPAMNPEISSPPSDSTQAPEVPTGNVPLSHVSTSEVPQEDETTRRHVGRESTQCWTVEAIGIQVLYFIFIFVITLYFI

SEQ ID NO: 170688 - protein, 204 aa, Glycine max
  Coding DNA Sequence Number=SeqID_53910
  Gene Ontology: Mol. function=RNA-directed DNA polymerase activity; Cellular component=chromatin; Biological process=chromatin assembly or disassembly
  Pfam annotation: Domain name=zf-H2C2; Domain location=126-167; Score =5.6; E_value=0.065; Accession=PF09337.1; Description=His(2)-Cys(2) zinc finger
MVEIQLLLWECNNEKDVQQMRGTYCFDYEIHYHSSKMNVVADALPRILEPTLSSLLLLSVPCLVFLGELKQHLVNDLTFLKLRQAISNDPATYSDYFIAQDLILKWGRIWLTPGSHFILTLLMEYHSSPTGGHMGVAKTLARRSENFTWHGIRKDVELFITTSIDCQHTKYETQKAVGLLCPVLVPFLPWEDLSLDFIIGLSAY

SEQ ID NO: 170689 - protein, 302 aa, Glycine max
  Coding DNA Sequence Number=SeqID_53911
  Gene Ontology: Mol. function=actin binding
  Homolog annotation: Hit_ID=Q1RYE3; Match level="QueryCoverage=93%, HitCoverage=31%, E-value=8e-68, Identity=52%"; Hit description=IMP dehydrogenase/GMP reductase
  Pfam annotation: Domain name=DUF827; Domain location=1-302; Score =176.3; E_value=7.5e-50; Accession=PF05701.2; Description=Plant protein of unknown function (DUF827)
  Pfam annotation: Domain name=Prefoldin_2; Domain location=24-124; Score=-4.0; E_value=0.035; Accession=PF01920.10; Description =Prefoldin subunit
  Pfam module annotation: Pfam domain module=DUF827::Prefoldin_2; Domain location=1-302::24-124
MNKEAKAQLEVAKARYTAYVSDLIVVKEELEALHNEYASLVTDIDVAIMKAEEVVTTSKEVEKSVEDLIVELIAAKESLETTHDAHLEEEEQIIGIVMARDQDSLNWEKELKLAEEELQRLNQRISSAKELKSKLETASALLIDLKAELTAYMKSKLKQQRGPEEPEIKTHTNIREVVASAGKELEEVNLNIEKATAEINILKVVATSLKLELEQQKTTLASIRQREGMASVAVASLEAELEKTRSKIGLVQMKEKEAKEKMTKLPKKLQLTVEETNQGKSIATESKGRSRASQGWSKYLGK

SEQ ID NO: 170690 - protein, 58 aa, Glycine max
  Coding DNA Sequence Number=SeqID_53912
MISCGREEEGIEVTEPEAFLWHDNETRTRGVRPELAPILTGKPELTGVGVRFSPIAKV

SEQ ID NO: 170691 - protein, 144 aa, Glycine max
  Coding DNA Sequence Number=SeqID_53913
  Subcellular localization annotation: CTP_CleavageSite=72; ConfidenceScore=5.56e-01
MMSFSSIHHHLSLFILSPFNPHRRHRSTPSSTHTSLAPTPPRCQRSSHLIPCQTLASGYDSIRESVDSHWPRVDLAWSVAAIDHGGGRSSTILSSYGGGASILILSVSIFGIEFLENWRVDFVGACHVLKGEAVVDEGDEEEEA

SEQ ID NO: 170692 - protein, 81 aa, Glycine max
  Coding DNA Sequence Number=SeqID_53914
MAGYLIDDSTVQGHADTYPNPPSLLQIGKTQTHSVKAYFIKIRALDMSSHGLDETYLGKVAKEKRKRVLMMLELRRNNAQM

SEQ ID NO: 170693 - protein, 180 aa, Glycine max
  Coding DNA Sequence Number=SeqID_53915
MKCKIEDPILNIYREDKAQQNIEWTKFKPQRKTKLPHQHYNMQRFFFFNITNHIEHILTYLRTQNCKHDKDLFFTLPAVKMLPWKSITAIENREKTSSSQSPKIQRKGTIPRFKKKNTHFPKAQFFSRKNYKNRRKSRQDSKCRTVTSKKNKGGKRVKLTKWKETQNKEDEKERVLRQQW

SEQ ID NO: 170694 - protein, 772 aa, Glycine max
  Coding DNA Sequence Number=SeqID_53916
  Gene Ontology: Mol. function=transporter activity; Cellular component= integral to membrane; Biological process=oligopeptide transport
  Homolog annotation: Hit_ID=Q9ZTX4; Match level="QueryCoverage=99%, HitCoverage=96%, E-value=0.0, Identity=71%"; Hit description=LeOPT1
  Pfam annotation: Domain name=MFS_1; Domain location=243-721; Score= -9.6; E_value=0.00087; Accession=PF07690.6; Description=Major Facilitator Superfamily
  Pfam annotation: Domain name=PTR2; Domain location=305-705; Score =489.0; E_value=5.5e-144; Accession=PF00854.12; Description=POT family
  Pfam module annotation: Pfam domain module=MFS_1::PTR2; Domain location=243-721::305-705
METLHRDPGGGIENLDLRVSNLGHQDHFCCSLCPDVNIVYGARNNDEHMHWIIVPIIRKFTGKERGLSMLQRMGIGLFISVLCMLSAAVVEIMHLQLAKELDLVDKHVAVPLSVLWQIPLYFFLGAAEVFTFVGQLEFLYDQSPNTMKTLGTAMTLLNFSLGNYLSSFILTMVTSPHKVESLNQKRFLTRDMSSIEGATQLLEEALLQDDEESKQYTRDGSVDYRGRPAIKKDTGNWRACPFILGNECCERLAFFGIATNLVTYLTTKLHEGNVSAARNVSIWLGTSYLTPLIGAVLGDGYWGRYWTIAVFSVGMCTLTLSASLPALKPAECLGSVCPSATPAQYAVFYFGLYVIALGIGGIKSCVPSFGAGQFDDTDPKERVKKGSFFNWYYFSINLGAIVSSSIVVWIQDNAGWGLGFGIPTLFMVLSVISFFIGTPLYRFQKPGGSPVTRMCQVLCASVRKWNLVVPEDSSLLYEMSDKRSAIKGSRKLLHSDDLRCLDRAATVSDYESKSGDYSNPWRLCPVTQVEELKILIRMFPMWATGAVFSAVYTQMSTLFVEQGTVMNTNIGSFEIPPASLATCDVLSVVLWAPVYDRIIVPITRKFTGNERGISVLQRVSIGYFISVLSMLAAVVVEIMRLRLARDLDLVDEPVAVPLSILWQIPQYFLLGAAEVFAFVGLLEFFYDQSPDTMKTLGTALSPLYFALGNYLSSFILTMVTYFTTQGGKLGWIPDNLNKGHLDYFFLLLAGLSFLNMLVYIVAAKRYKQTKTS

SEQ ID NO: 170695 - protein, 668 aa, Glycine max
  Coding DNA Sequence Number=SeqID_53917
  Gene Ontology: Mol. function=UDP-glucose 4,6-dehydratase activity; Cellular component=integral to membrane; Biological process=UDP -rhamnose biosynthetic process
  Homolog annotation: Hit_ID=Q9SYM5; Match level="QueryCoverage=99%, HitCoverage=100%, E-value=0.0, Identity=86%"; Hit description =Probable rhamnose biosynthetic enzyme 1
  Pfam annotation: Domain name=3Beta_HSD; Domain location=10-280; Score= -23.7; E_value=2.7e-11; Accession=PF01073.9; Description=3-beta hydroxysteroid dehydrogenaseisomerase family
  Pfam annotation: Domain name=Epimerase; Domain location=386-582; Score=0.0; E_value=3.3e-06; Accession=PF01370.11; Description=NAD dependent epimerasedehydratase family
  Pfam annotation: Domain name=Epimerase; Domain location=9-251; Score =219.7; E_value=6.7e-63; Accession=PF01370.11; Description=NAD dependent epimerasedehydratase family
  Pfam annotation: Domain name=NAD_binding_4; Domain location=11-235; Score=31.7; E_value=1e-10; Accession=PF07993.2; Description=Male sterility protein
  Pfam annotation: Domain name=Polysacc_synt_2; Domain location=9-294; Score=-93.9; E_value=1.3e-07; Accession=PF02719.6; Description =Polysaccharide biosynthesis protein
  Pfam annotation: Domain name=RmlD_sub_bind; Domain location=385-662; Score=-116.1; E_value=3.2e-06; Accession=PF04321.7; Description=RmlD substrate binding domain
  Pfam annotation: Domain name=adh_short; Domain location=7-178; Score=- 63.1; E_value=0.079; Accession=PF00106.15; Description=short chain dehydrogenase
  Pfam module annotation: Pfam domain module=3Beta_HSD::Epimerase::Epime rase::NAD_binding_4::Polysacc_synt_2::RmlD_sub_bind::adh_short; Domain location=10-280::386-582::9-251::11-235::9-294::385-662::7-178
MASYTPKNILITGAAGFIASHVANRLVRSYPDYKIVVLDKLDYCSSLKNLLPSKSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVVLHKGEVGHVYNIGTKKERRVVDVAKDICRLFSMDPETCIKFVENRPFNDQRYFLDDQKLKDLGWSERTTWEEGLKKTMDWYINNPDWWGDVTGALLPHPRMLMMPGGLERHFEGSEEGKPASFGSSNTRIVVPSSKNTSSQQKHPFMFLIYGRTGWIGGLLGKLCEKQGIPYEYGKGRLEDRSSLLADLQNVKPTHVFNAAGVTGRPNVDWCESHKTETIRTNVAGTLTMADVCREHGILMINYATGCIFEYNATHPEGSGIGFKEEDKPNFIGSFYSKTKAMVEELLRDYDNVCTLRVRMPISSDLSNPRNFITKISRYNKVVNIPNSMTILDELLPISIEMAKRNLKGIWNFTNPGVVSHNEILEMYRDYIDPNFKWSNFTLEEQAKVIVAPRSNNEMDASKLKTEFPELLSIKESLIKYVFEPNKKT

SEQ ID NO: 170696 - protein, 554 aa, Glycine max
  Coding DNA Sequence Number=SeqID_53918
  Gene Ontology: Mol. function=enzyme inhibitor activity; Cellular component=cell wall; Biological process=cell wall modification
  Homolog annotation: Hit_ID=Q9FXW9; Match level="QueryCoverage=90%, HitCoverage=87%, E-value=1e-175, Identity=60%"; Hit description =Pectin methylesterase-like protein
  Pfam annotation: Domain name=PMEI; Domain location=40-192; Score =76.5; E_value=8.5e-20; Accession=PF04043.6; Description=Plant invertasepectin methylesterase inhibitor
  Pfam annotation: Domain name=Pectinesterase; Domain location=238-542; Score=608.2; E_value=7.1e-180; Accession=PF01095.10; Description =Pectinesterase
  Pfam module annotation: Pfam domain module=PMEI::Pectinesterase; Domain location=40-192::238-542
  Subcellular localization annotation: CTP_CleavageSite=50; ConfidenceScore=5.53e-01
MASSSLFYLSLSLILTLTSAARHKPHPSPAKPPAKPAVTTATSPAIQQACAATRFPQQCEASLSQSQNLPPNPNPTPLQLLQSAIALSSDNLATAQTMVKSLHDASADSRNRTVAAATCIEILANSHYRISLASDALPRGRTKDARAWLGAALAYQYDCWNSLKYANDTEMVGKTMLFIDNLETLSSNALSMAFSFDAFGNDTASWKPPVTERDGFWEAVGSGGPASAGGVPPNLTPDVTVCNNGGDGCYKTVQEAVNAAPANGTKRFVIYIKEGVYEETVRIPLEKRNVVFLGDGIGKTVITGNGNVGQQGMTTYNSATVAVLGDGFMAKELTVENTAGPDAHQAVAFRLDSDLSVIENCEFLGNQDTLYAHSLRQFYKSCRIEGSVDFIFGNAAAVFQDCQILVRPRQVKPEKGENNAITAHGRTDPAEPTGFVFQNCLINGTEEYIALYLSKPQVHKNYLGRPWKEYSRTVFINSILEALVTPQGWMPWSGDFALKTLYYGEFENKGTGSDLSQRVPWSSKIPAEHVLTYSVQNFIQGNDWIPSSVGSPSS

SEQ ID NO: 170697 - protein, 267 aa, Glycine max
  Coding DNA Sequence Number=SeqID_53919
  Gene Ontology: Mol. function=transferase activity, transferring hexosyl groups; Biological process=carbohydrate biosynthetic process
  Homolog annotation: Hit_ID=Q5BMA3; Match level="QueryCoverage=93%, HitCoverage=76%, E-value=9e-36, Identity=70%"; Hit description =Secondary cell wall-related glycosyltransferase family 8
MELRIESIHCVKFISCRPNFVNRWIWGGLDRGYISNVDINWGDILQITAKLTGKKEFQEVGLLNFNNNELDHWEQLIPNVTHVVLELEYAAKNVTWESLYPEWIDEEEETEVLVCPSLPKNLWDMKGMFLGEKLHLPPGSCELAFPLRGKELSYVGNVRREAYATILHSAHVYVCGAIAAAQSIHMSGSTRDLVILVDETISEYHRSGLEAVGWKFRTIQRIRKSVKFPYVVKSDAAHERWRKVHDAMPELLQQFCMLKSKQKAQLE

SEQ ID NO: 170698 - protein, 581 aa, Glycine max
  Coding DNA Sequence Number=SeqID_53920
  Gene Ontology: Mol. function=transporter activity; Cellular component= integral to membrane; Biological process=transport
  Homolog annotation: Hit_ID=Q2RSZ3; Match level="QueryCoverage=99%, HitCoverage=83%, E-value=1e-153, Identity=50%"; Hit description =Fusaric acid resistance protein conserved region precursor
  Pfam annotation: Domain name=DUF939; Domain location=22-315; Score= -150.9; E_value=0.0049; Accession=PF06081.2; Description=Bacterial protein of unknown function (DUF939)
  Pfam annotation: Domain name=FUSC; Domain location=350-468; Score =177.4; E_value=3.7e-50; Accession=PF04632.3; Description=Fusaric acid resistance protein conserved region
  Pfam annotation: Domain name=MFS_1; Domain location=7-510; Score= -51.5; E_value=0.072; Accession=PF07690.6; Description=Major Facilitator Superfamily
  Pfam module annotation: Pfam domain module=DUF939::FUSC::MFS_1; Domain location=22-315::350-468::7-510
MASPSLLNDANALLYSAKSFTAAMLAYYIALSIGLERPSWAIITVYIVSQTSVGASLSRSLYRLVGTVIGAGMTVLIVPTFVNSPVFCSVILAGWITFCLYLSLLERTPRAYGFVLAGYTASLIGFPAVSDPGAIFDIAITRVQEIMIGIFCAALIHRYVLPARISGQFNSKLSQTLLAARQRIAETLTGKPDPVSSPLHMALALQFLQGISHHIPYDFAFSVPVRQARKRLHDRLARLVIVNCELRDRLALIAKIPFDVQILMDDVEVWLACKDEGKFKSEGEALKKRSEKLLQRYVVHELTFVEALHVSFMRYLTEAIVLVQQCYRLSDAIHHANQMPAHSEMNNVKGYVFHRDPLTAARTALGAFTIILSGCMVWIFSAWPDGGTAVSILGVCCTLFGSFDTPAPHIVKYIIGSLWGVVISLIYSFVLLPQVSDFIVLVVVLAPVYLLAGSLQARPPTTFMAMGITLTLPILCELGAHYSGDFAVAVNTSIALFSATGFAVFSMGFLQTVQADAAIKRLLKLCQRDINRSVKGVLNTDETLWINLMIDRAALILPRLPRSGQSSEQALNHLLHTLRIG

SEQ ID NO: 170699 - protein, 268 aa, Glycine max
  Coding DNA Sequence Number=SeqID_53921
  Gene Ontology: Mol. function=sequence-specific DNA binding; Cellular component=intracellular; Biological process=regulation of transcription, DNA-dependent
  Homolog annotation: Hit_ID=Q2RSZ4; Match level="QueryCoverage=94%, HitCoverage=93%, E-value=2e-91, Identity=63%"; Hit description =Transcriptional Regulator, AraC family
  Pfam annotation: Domain name=AraC_binding; Domain location=23-141; Score=-2.6; E_value=0.06; Accession=PF02311.9; Description=AraC-like ligand binding domain
  Pfam annotation: Domain name=Cupin_2; Domain location=25-92; Score =12.9; E_value=0.014; Accession=PF07883.2; Description=Cupin domain
  Pfam annotation: Domain name=HTH_AraC; Domain location=165-208; Score= 9.4; E_value=0.25; Accession=PF00165.13; Description=Bacterial regulatory helix-turn-helix proteins, araC family
  Pfam annotation: Domain name=HTH_AraC; Domain location=214-257; Score= 28.8; E_value=1.9e-05; Accession=PF00165.13; Description=Bacterial regulatory helix-turn-helix proteins, araC family
  Pfam module annotation: Pfam domain module=AraC_binding::Cupin_2::HTH_ AraC::HTH_AraC; Domain location=23-141::25-92::165-208::214-257
MLPPLANTLFDPDTTSCPAVARHLDFVDYAAEVPVHTHRKGQLIIALYGAVICRAENDIWIVPPDCAVWIPGGVPHSAKATWNAHLNYLFIEPGAAELPERCCTLAISGLIKELIARLTHEGVGYPPESHLARLTRVTLDELATMPQQKLSLPVSSHPKIRAMADALVSQPDDRSTFKTWAKRLALSERSLARLMLRETGLTFGRWRQQLQLIIALRELASGVSVQNVAANLGYESVNAFITMFKKTMGSTPAHYFAERKTSAHLTDN

SEQ ID NO: 170700 - protein, 690 aa, Glycine max
  Coding DNA Sequence Number=SeqID_53922
  Gene Ontology: Mol. function=enzyme inhibitor activity; Cellular component=cell wall; Biological process=cell wall modification
  Homolog annotation: Hit_ID=Q7XAF8; Match level="QueryCoverage=73%, HitCoverage=89%, E-value=1e-126, Identity=46%"; Hit description =Papillar cell-specific pectin methylesterase-like protein
  Pfam annotation: Domain name=Extensin_2; Domain location=6-274; Score= -119.4; E_value=0.012; Accession=PF04554.4; Description=Extensin-like region
  Pfam annotation: Domain name=PMEI; Domain location=149-307; Score =96.3; E_value=9.3e-26; Accession=PF04043.6; Description=Plant invertasepectin methylesterase inhibitor
  Pfam annotation: Domain name=Pectinesterase; Domain location=378-676; Score=694.3; E_value=8.6e-206; Accession=PF01095.10; Description =Pectinesterase
  Pfam module annotation: Pfam domain module=Extensin_2::PMEI::Pectinest erase; Domain location=6-274::149-307::378-676
  Subcellular localization annotation: CTP_CleavageSite=22; ConfidenceScore=5.16e-01
MSTPPMPFLFLFLFSLIVPLLLAQAPSPSPTHSPPPPSPSPSPKHTPPPPPSTTTPPSPKHVPPPPPSSPSPSPKHAPPPPHSSPLPSPKHAPSSPPPSQAHAPPLPSSQSPPPTHSPPPSSPSPPSPTHAPPPSPTPPPARAPSPPPPPPPSSPSSACKSTLYPKLCRSIVSSIRSSPSDPYNLGKFSIKQSLKQAKKLVLVFKDFLTKYKSSSSLNAAEIAALEDCSELNQLNVNYLESVSEELKSADSSNDTELVEKIETYLSAVATNHYTCYDGLVVIKSNIANAIAVPLKNVTQLYSVSLGLVTQALKKNLKTHKTRKHGLPTKDYKVRQPLKKLIKLLHTKYSCTASSNCSTRSERILKESENQGVLLKEFAIVSLDGTENFTSIGDAIAAAPDNLRAEDGYFLIYVREGNYEEYVTVPIQKKNILLIGDGINKTCITGNHSVVDGWTTYNSSTFAVSGERFVAVDVTFRNTAGPQKHQAVALRNNADLSTFYRCSFEGYQDTLYVHSLRQFYRECDIYGTVDFIFGNAAVVFQSCNIYARKPMPNQKNAVTAQGRTDPNQNTGISIQNCKIDAAPDLAEDLKSTNSYLGRPWKVYSRTVFMQSYIGELIQSAGWLEWNGTDGLNTLFYGEFKNFGPGSDTSKRVQWSGYNLLSATQARNFTVHNFTLGYTWLPDTDIPYSEGL

SEQ ID NO: 170701 - protein, 188 aa, Glycine max
  Coding DNA Sequence Number=SeqID_53923
  Homolog annotation: Hit_ID=Q6I666; Match level="QueryCoverage=33%, HitCoverage=97%, E-value=2e-25, Identity=78%"; Hit description =Cytochrome P450 like_TBP
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 170702 - protein, 326 aa, Glycine max
  Coding DNA Sequence Number=SeqID_53924
  Gene Ontology: Mol. function=ATP binding; Cellular component =membrane; Biological process=pathogenesis
  Homolog annotation: Hit_ID=Q6D6R0; Match level="QueryCoverage=100%, HitCoverage=35%, E-value=1e-159, Identity=81%"; Hit description =Putative conjugal transfer protein
  Pfam annotation: Domain name=VirB3; Domain location=3-88; Score=66.7; E_value=7.7e-17; Accession=PF05101.4; Description=Type IV secretory pathway, VirB3-like protein
MATLNKALTRPAAIMGIPLVPFVLVSGAIVLLAVYVSYYLAVLLIPAWAEMKNKTRKDIHYFSLLWLAFKTRGRLFTNTHFGANALLANQYDNVDISEFIQKMKLSERITLDKYIPYSSHIHLYVIRNRHRDLVATWELGGTVFECEDEHHLTLMATHLNNVIRSYEGLPVTFYIHRLREKYHDAFEACSGIPFSDDVTRRYYQPVKEKPFWRHRLFFTVCYAPFSQIEKKTMKAQSYGKRQAALDDALKIMLEYREALESSLSRYMATPLGIYEENGRVYSSQLAFFHRLLTGQWQKVAVTRSPFYETLSTPDVFFTTDTGECQT

SEQ ID NO: 170703 - protein, 136 aa, Glycine max
  Coding DNA Sequence Number=SeqID_53925
MLRISVPLQESPPSTTEELTLLLTPRTYYHQLRNVAIERRIARLGEVEGQQIRNTNLTSNRLVSEPSEPASASAVKSSKSVGVKLRTPFVSKTEEYNIWKRQLAEGIGIVSIEECVKSIKSKKEWDLGGGSLEVLA

SEQ ID NO: 170704 - protein, 185 aa, Glycine max
  Coding DNA Sequence Number=SeqID_53926
  Gene Ontology: Mol. function=nucleoside transporter activity; Cellular component=membrane; Biological process=transport
  Homolog annotation: Hit_ID=Q69S29; Match level="QueryCoverage=56%, HitCoverage=29%, E-value=3e-30, Identity=59%"; Hit description =Putative equilibrative nucleoside transporter ENT8 splice variant
MTGYLLAGSIIEPRASTTGMVNNEVSTCLEYVDYRRLLHLLVSRLGTFIGICALSGDFGVANAYVQGGMVGDLSYMKLEFIQSFLAGVAASDALTSALRLITKTTFENSKDVLCKGAIIFPKIPIVKYYHSKAASEGSKTVSADLATRGIRTLPGAIMLFTFFFHSNKSQNFHCSRFNLEFIYEV

SEQ ID NO: 170705 - protein, 92 aa, Glycine max
  Coding DNA Sequence Number=SeqID_53927
  Homolog annotation: Hit_ID=Q6ZD39; Match level="QueryCoverage=37%, HitCoverage=4%, E-value=2e-10, Identity=85%"; Hit description =Putative ARF GTPase-activating domain-containing protein
MKKVDEETGKYYGRKAVSFVLKRQPWALFVFTFVLSSEGLGEAYDGNIVFASDLETFGGGHNDPISVALGGMLPFYINIMMVDERFYVPPGS

SEQ ID NO: 170706 - protein, 76 aa, Glycine max
  Coding DNA Sequence Number=SeqID_53928
MENSQKGGQNGHLVTFSGPWLIQASLWLAWATRKLKAKVTGSPGQAEVTWASKVTSGESNQLALVSCCATSTPHML

SEQ ID NO: 170707 - protein, 78 aa, Glycine max
  Coding DNA Sequence Number=SeqID_53929
  Gene Ontology: Mol. function=nucleic acid binding; Biological process= DNA integration
  Homolog annotation: Hit_ID=Q1RWP6; Match level="QueryCoverage=95%, HitCoverage=7%, E-value=4e-15, Identity=56%"; Hit description=Zinc finger, CCHC-type; Polynucleotidyl transferase, Ribonuclease H fold
MDLGATHHITNHLDNLHLTQTYHGNDHLFVGDGYALPITYNGSEDKGFNTQRAAKGWPLPHAPSNQCTNNIHHDLTTS

SEQ ID NO: 170708 - protein, 249 aa, Glycine max
  Coding DNA Sequence Number=SeqID_53930
  Gene Ontology: Mol. function=manganese ion binding; Cellular component=mitochondrion
  Homolog annotation: Hit_ID=Q9ZU95; Match level="QueryCoverage=65%, HitCoverage=71%, E-value=4e-31, Identity=45%"; Hit description=Nudix hydrolase 17, mitochondrial precursor
  Pfam annotation: Domain name=NUDIX; Domain location=53-185; Score =29.7; E_value=1e-05; Accession=PF00293.18; Description=NUDIX domain
MACLMSRTGREMQRYNSSGGRQVVGGTRAFSMAALSDKLAFCLVSACLVTVAPKLFQWCIPYRYKEDNDGNVSNELEVLVVSSQKGQALMFPKGGWELDESVEEAASRESLEEAGVTGIVQHELGQWSFISKRLGTYYEGHMFPLLVKEQLDLWPEKDLRRRIWAQHGGRRNMQQRGGIHREGWRMSRGGGSDLLAGVWPRSRKRSGVEELEMCNGVRVREGDARQSEGLKGKTLKSKVSTLNSNIQSV

SEQ ID NO: 170709 - protein, 197 aa, Glycine max
  Coding DNA Sequence Number=SeqID_53931
  Gene Ontology: Mol. function=tricarboxylate carrier activity; Cellular component=integral to membrane; Biological process=transport
  Homolog annotation: Hit_ID=P16482; Match level="QueryCoverage=91%, HitCoverage=40%, E-value=2e-66, Identity=69%"; Hit description =Citrate-proton symporter
MTTTAFYLITVYAPTFGKNVLLLSASDSLLVTLLVAISNFIWLPIGGMLSDKFGRKPVLVSMTLLAIFTSWPALSLLARMPDFAMMLSVLLWLSFIYGIYNGAMIPALTEIMPRSVRVAGFSLAYSLATALFGGFTPAMSTALIKVTGDKAAPGYWMSFAAICALLATLGIHLRLCACCRRAGDHGDDFRRLLCGVG

SEQ ID NO: 170710 - protein, 151 aa, Glycine max
  Coding DNA Sequence Number=SeqID_53932
  Homolog annotation: Hit_ID=Q3KDT0; Match level="QueryCoverage=78%, HitCoverage=93%, E-value=4e-21, Identity=46%"; Hit description =Hypothetical protein precursor
MKKNILTGMIAATLGLFNTANAEGMDPAALKNVYDITRNTAGLMSYCVDKGFLKADSIDNAKKMVAYVAAIPGGVDTRDGDKREAMGREGNVLNDDGKVVALEKEAPQGLQACKSSSRALTGPMGSVATPADPLPGSHSRLVLPPEYPHPV

SEQ ID NO: 170711 - protein, 271 aa, Glycine max
  Coding DNA Sequence Number=SeqID_53933
MLGSCFGKLDLGDSFAGTEKEAANTKEVTCYNTLQDDRRQRNHIEGYYSNGGAKVAVDQTFIGEEEGHVTQSLSPSISGQIQQGLGPGCITGPISTQGGCNKEDILPVELLGVQVVQIQKEGGPSNNLGPTLKTEGCYKEESLPVTQPLKENPDKYSKVYFRQKNSLFKARLSQIEENHPQLQDGEKVPEDQLVNQDKAKNQSYVESERRLKSIIECSDEVLEEAQHLWHLGENLGMETATDNLDFLHSYASMECRDRKEATELGNRKPLK

SEQ ID NO: 170712 - protein, 86 aa, Glycine max
  Coding DNA Sequence Number=SeqID_53934
  Gene Ontology: Mol. function=nucleic acid binding; Cellular component= spliceosome; Biological process=mRNA processing
  Homolog annotation: Hit_ID=Q2I310; Match level="QueryCoverage=81%, HitCoverage=36%, E-value=4e-30, Identity=87%"; Hit description=RNA recognition motif-containing protein
  Pfam annotation: Domain name=RRM_1; Domain location=14-82; Score =51.2; E_value=3.5e-12; Accession=PF00076.12; Description=RNA recognition motif. (a.k.a. RRM, R
MKFQVERKEGKYCNLDERVTDRVLYDILIQAGRVVDLHIPKDKESEKPKGFAFAEYETEEIADYAVRLFSGLITLYNRTLKFAVRS

SEQ ID NO: 170713 - protein, 73 aa, Glycine max
  Coding DNA Sequence Number=SeqID_53935
MASSKYQSQSLCFYDLPLFDDDNSIPEIKIQAMLMQSYPARALDRKLQVDWARDAREGPRVLMSLRVDFGPMG

SEQ ID NO: 170714 - protein, 99 aa, Glycine max
  Coding DNA Sequence Number=SeqID_53936
  Homolog annotation: Hit_ID=Q1SLA4; Match level="QueryCoverage=45%, HitCoverage=8%, E-value=4e-09, Identity=51%"; Hit description=Zinc finger, CCHC-type; Lipocalin
MACRQDKSKEYVVSESSIVLEIDLSVPMVDKFYLNNRWYNIEYEALHLLCAFDGCYGHTARASPNNSEDEKMASVEKEVVMAPIMIVFGVKVRVDENIP

SEQ ID NO: 170715 - protein, 57 aa, Glycine max
  Coding DNA Sequence Number=SeqID_53937
MGDVAEAEDRGGMEGVPVLTKKTMRRLRVIVVEWLWDQCVFQFEKGRVEAPILIDTP

SEQ ID NO: 170716 - protein, 110 aa, Glycine max
  Coding DNA Sequence Number=SeqID_53938
MDRCCCMPRLLLRRGPQTLLLSNVLPLQALYTHVVVVSLNENGEAEALSKVDDRKISELKHEWWIVWIWKNKERKSVGNILSRWPVVIKEKKNEKGRKKRINNKTNKLIH

SEQ ID NO: 170717 - protein, 469 aa, Glycine max
  Coding DNA Sequence Number=SeqID_53939
  Gene Ontology: Mol. function=ATP binding; Cellular component =membrane; Biological process=transport
  Homolog annotation: Hit_ID=Q6D6R0; Match level="QueryCoverage=99%, HitCoverage=51%, E-value=0.0, Identity=88%"; Hit description =Putative conjugal transfer protein
MTTLSTLSLPAAYLAQLPGVYTLRPRLVAVSSQNFADMACLHNFHPHIRSGNPKREAIAILTSPVGGGYYLNLHDSQAGRDDTGEKTPGNTAIIGKTGSGKTLLMTVVQQLMQKYRNPATFAPSATLKRLTTVYFDKDRAAEMAIRQAGGRYFRIRTGEPTGFNPFALEPTRRNISFIKRLVRMLCRRNGKPLDPRDEERISAAVDTIMLDYPPEYRRFGITRLLEVLPEPPTTDARTNGLRIRLKQWAQGGEFGWVFDNEADTFTISDVDNFGIDGTEFLDDDDIRGPVTFYLLYRVTSLLDGRRLVMFMDEFWRWLSDVEFSRFSLNMLKVIRKLNGIFVPATQSPDEIVRHPIAPAIIEQCGTQIFLANPKASHADYVEKMKVPDSVYDTVRNLDPGEHYMVILKTPLRAGETRPFVAMAKMDLSGLGKLTRLLSGSEDNLKIFDAIYQDGMRPDEWKETFLERAI

SEQ ID NO: 170718 - protein, 157 aa, Glycine max
  Coding DNA Sequence Number=SeqID_53940
  Homolog annotation: Hit_ID=Q6D6R2; Match level="QueryCoverage=44%, HitCoverage=76%, E-value=6e-28, Identity=80%"; Hit description =Putative plasmid protein
MAIENTTDVEKRINNTLSDISDLSDRISNAQDSKESQDLANAIAAKSVQLNALTNQWEMSVRQAEQRTTLLEQQRQKAFEQQQLTAPETKSEAWYKQHPDETYVVYTQCLKDGEASDNCEFAHRAALMFAQEGQPGVKEKFEAIFQQEAEKRNAVTQ

SEQ ID NO: 170719 - protein, 343 aa, Glycine max
  Coding DNA Sequence Number=SeqID_53941
  Gene Ontology: Biological process=conjugation with cellular fusion
  Homolog annotation: Hit_ID=Q6D6R3; Match level="QueryCoverage=99%, HitCoverage=100%, E-value=1e-134, Identity=73%"; Hit description =Putative conjugal transfer protein
  Pfam annotation: Domain name=TrbL; Domain location=34-268; Score =139.1; E_value=1.2e-38; Accession=PF04610.4; Description=TrbLVirB6 plasmid conjugal transfer protein
MSGGIFVGMDKNIMDGLNAVLEGQSSTYGTMISVIIVSSFTLFILFRGYQTLAGKLRTPVEDVAWDVGRMLLITTFALNLDGWLDMAVAAIQGLKDGISGDDNVWALLDTVWEKAQALGQKLFNMDTSTYVKLNGGLAEVLVWGGSIVLLMAATFVNLLAEITILLMTTTAPLFIFCLLYGFLKPMFDNWLRTIFAAMLTIMFSALSIRIAINYLHKILDAATKTSAETNMVTLAAQCLLAGIAAGVVVWFSAKLASALSGAAVQAVLQGAAMSGLSGLANKSADLAGPGVKGGARLAAKGGMAAAAAAGRLAGAGAGKTVSAWQKRAAAIESMKRLNRQRHR

SEQ ID NO: 170720 - protein, 296 aa, Glycine max
  Coding DNA Sequence Number=SeqID_53942
  Gene Ontology: Cellular component=outer membrane; Biological process =transport
  Homolog annotation: Hit_ID=Q6D6R6; Match level="QueryCoverage=99%, HitCoverage=100%, E-value=1e-117, Identity=71%"; Hit description =Putative conjugal transfer protein
  Pfam annotation: Domain name=CagX; Domain location=30-275; Score =92.8; E_value=1e-24; Accession=PF03524.5; Description=Conjugal transfer protein
  Subcellular localization annotation: CTP_CleavageSite=25; ConfidenceScore=5.11e-01
MMLKYILLLTGLLVSCVAWSSATPRGSAYDSRMQNVTYNSQNATVVSTRPGYVTMLVFDDDETVIDAQAGFPRGWTVTKSDNRVGVSPNPITQPVTDASGNTVSQVFLPTAKDWKTNLFVVTSKRDYSLELNVLDKDSPVQAFVIRYRYPDEQRKKSAAASATRQQRQQETLDRKRIAAAFGKATTPRNWRYTKRVAAGSAFIAPDFTWDDGRFAYIGFSPTKTLPSVFRVVNGQEQAVTPGTVKRGSYTVVVVPASTQLVLRYGTSVVGVENDGSGRIPLTNSDTVSPSVTLEAK

SEQ ID NO: 170721 - protein, 75 aa, Glycine max
  Coding DNA Sequence Number=SeqID_53943
  Gene Ontology: Biological process=unidirectional conjugation
  Homolog annotation: Hit_ID=Q6D6R7; Match level="QueryCoverage=99%, HitCoverage=17%, E-value=5e-12, Identity=50%"; Hit description =Putative conjugal transfer protein
MAYQESEQKTPPGQPEVTRFRKTSGRRTLIVSLLSLVLVIALASGGDRLLSALKRGDEKESDTAPPPSSGAVQQE

SEQ ID NO: 170722 - protein, 643 aa, Glycine max
  Coding DNA Sequence Number=SeqID_53944
  Gene Ontology: Mol. function=nucleoside-triphosphatase activity; Cellular component=intracellular; Biological process=unidirectional conjugation
  Homolog annotation: Hit_ID=Q6D6R8; Match level="QueryCoverage=49%, HitCoverage=94%, E-value=1e-161, Identity=85%"; Hit description =Putative conjugal transfer protein
  Pfam annotation: Domain name=GSPII_E; Domain location=308-619; Score =117.9; E_value=2.9e-32; Accession=PF00437.11; Description=Type IIIV secretion system protein
  Pfam annotation: Domain name=TrbI; Domain location=151-334; Score =153.2; E_value=6.9e-43; Accession=PF03743.4; Description=Bacterial conjugation TrbI-like protein
  Pfam module annotation: Pfam domain module=GSPII_E::TrbI; Domain location=308-619::151-334
YRYRPPPSSGAVQQERKNLGMDSNPFGLFGPGRQKSADPARQTVTTGPALPAEPPALNKAAALADGLNSSTTAGGNAYTSRSEPRNSAGTSDSLSASTAYTSCQSVLVSGEDGRLRCSDTTAPAGSNNNDNPGVARVTGVRRLGLDPDLYIPVDHYIPCSMMRRFVSDVGGHISCLIGENVWSASNHVKLIPAGTVARGVYRTGALHMGAAGCLWLWTELRTPEPGSLQIPLTDTQATGPLGEAGIAGWIDSHFWERFGNALMLSTVQDVAAAASEAAPGKDRNTDYTENTRAATAEMAKTTLENSISIPPTMYLNQGDVIGIMTVEGLTEIAINRPGELHTKIKGAWQRDESPVTLRQCHAFARALASWQDDNIDDTSPILSATLESGERIQTIIPPACERNTVSITLRKPSFEQKTHQSWIDAGFYQRVAGQEKTESQDDALVQLYQSGNIPRFMEKAVEYGKTIFIVGETGSGKTTYMKTLLHYIPLHLRLITIEDNPEIRFHHHANYVHLFYPADAGDNAIVTPGRLIRANYRMNPDRILLAEIRGREAWDALKIIGSGHEGLITSLHAGSPEECIEGIIDRCYENPDCRNIPFDVLLRKVLKSIDVIVSIDIHGDIRRMHDIYFKPVHLNGMKETFRK

SEQ ID NO: 170723 - protein, 113 aa, Glycine max
  Coding DNA Sequence Number=SeqID_53945
  Subcellular localization annotation: CTP_CleavageSite=28; ConfidenceScore=5.01e-01
MKVSAPFTIGDSETASLFKITMPPSSAVAAVRPCAGKHASLHDTACASTCGLDALIACRMGVMSQLHAAPKPPISTAAHRRPLRATTPFKTVAFAFFFPLLVPRSGNKREADL

SEQ ID NO: 170724 - protein, 456 aa, Glycine max
  Coding DNA Sequence Number=SeqID_53946
  Gene Ontology: Biological process=conjugation
  Homolog annotation: Hit_ID=Q6D6S2; Match level="QueryCoverage=100%, HitCoverage=72%, E-value=0.0, Identity=89%"; Hit description =Mobilization protein
  Pfam annotation: Domain name=TraG; Domain location=75-456; Score= -218.6; E_value=0.1; Accession=PF02534.5; Description=TraGTraD family
MGPVLIWIFQWLYRGLVIGSVPVLTWPVLISFTIAGIIFHILLRRVLTPELDKIKKRLVRKTTLERELRTDVRTVKSLLPETLHYDPLDYIDLNKGLFIGMDRDIQPMYLPVKDWQKQHADIIGTTGAGKGVATGILLYQSILAGEGVFVMDPKDDEWAPHLYRKACEDAGKPFALIDLRKPQYQLNLIEAITADELEELFVAGFSLAEKGQESDFYRIDDRKAARIAAQFVTRNTAATIRDVYNGDYVQGIADKIKAFFGKIEELALLNAINAPTGFSLNKIFKEGGCCYVIGSMRNSKIITAQRMLLVRLYQLAEKRERVKKVPRPIAIYLSELKYHLSRTALEGLGAARDKGVHIIMDHQSIADLKDCPADLKGDAVVGAVVENAKFKLVYRVMDPDTAEWVARMSGTILVDDEVRKAKTDAVLTETIDSERTIRQAERFFTDSNMILNLPDF

SEQ ID NO: 170725 - protein, 317 aa, Glycine max
  Coding DNA Sequence Number=SeqID_53947
  Gene Ontology: Mol. function=sequence-specific DNA binding; Cellular component=intracellular; Biological process=regulation of transcription, DNA-dependent
  Homolog annotation: Hit_ID=Q3P902; Match level="QueryCoverage=91%, HitCoverage=94%, E-value=6e-80, Identity=54%"; Hit description=Helix- turn-helix, AraC type:AraC-type transcriptional regulator, N- terminal
  Pfam annotation: Domain name=AraC_N; Domain location=44-195; Score =126.7; E_value=6.7e-35; Accession=PF06719.3; Description=AraC-type transcriptional regulator N
  Pfam annotation: Domain name=HTH_AraC; Domain location=210-256; Score= 38.0; E_value=3.3e-08; Accession=PF00165.13; Description=Bacterial regulatory helix-turn-helix proteins, araC family
  Pfam annotation: Domain name=HTH_AraC; Domain location=262-306; Score= 19.5; E_value=0.012; Accession=PF00165.13; Description=Bacterial regulatory helix-turn-helix proteins, araC family
  Pfam module annotation: Pfam domain module=AraC_N::HTH_AraC::HTH _AraC; Domain location=44-195::210-256::262-306
RDHSYEERTARDDEFNSAGRMASLLQAARHYADEHHNGAGVAVTPVDGVFILRETAPTALQFAITKPLIAMVLQGSKRVTMGSDRFDFGAGESLLITMDVPTVSQVISASADTPYYSLVVELDAAVISELMANMVGLEAATDLPVSIDQIEEDVAEAALRLLNMLSRPRALAVLGSQLVRELHYWLLSGRHGSALRALGSTDSHARRIARAVAIIRANYAQPLRMKTLADAAGMSLSVFHTHFRHITTLTPLQFQKQLRLLEARRLMLTEGTAIGIAANAVGYESVTQFTREYSRLFGSPPARNIRETRALERSALS

SEQ ID NO: 170726 - protein, 167 aa, Glycine max
  Coding DNA Sequence Number=SeqID_53948
MRVFRVSLLVGVLGFCFLIWVREKRVKDDLAPRIMSILSWNCHEIGHWRAILVLKDDAKIGNLFFLRTPMQRLMEYETKLVLMECLVLIEKEWEVEFGEILLNEKWCLMGYYGYSKRPRRRETWTLIRSLTEDMSLPWCIDAHNIDTVSNIKIGPVWKIKEYRPLHP

SEQ ID NO: 170727 - protein, 103 aa, Glycine max
  Coding DNA Sequence Number=SeqID_53949
MDQTWMNASCMSFVYEEGVEQFLEFVYDRSQSDEEGKYFCPYDVEMGDRLEDMIRNLGQEYFQQVHAPMYGTLENDSKKAFVSEVQEVIDTIVNGVKSGQCQG

SEQ ID NO: 170728 - protein, 53 aa, Glycine max
  Coding DNA Sequence Number=SeqID_53950
MEIYIVFCADYLCQALTRETNVVFCTLCQPEASEPTDTWRFTSSSTQTTSIKH

SEQ ID NO: 170729 - protein, 160 aa, Glycine max
  Coding DNA Sequence Number=SeqID_53951
  Gene Ontology: Mol. function=RNA-directed DNA polymerase activity; Biological process=RNA-dependent DNA replication
  Homolog annotation: Hit_ID=Q1SP50; Match level="QueryCoverage=77%, HitCoverage=15%, E-value=3e-12, Identity=29%"; Hit description=RNA -directed DNA polymerase
MREWNSMGMQRHNEQHGGGTVDTQRHKELSDSERAQFLDVVRASWQGHRSLQLVDKNKNYFKKVDVFRSGKRVKFKEDIQGCRREMENVRIRDDRDTGVRYIKLQKIMETFMIQGDIFWLQKAKMFWYRERDKNTSYFDATVLVRKMRNRVKCLLCEDGV

SEQ ID NO: 170730 - protein, 69 aa, Glycine max
  Coding DNA Sequence Number=SeqID_53952
MVEKRRNKKEWIWWKDLCAACGAIEEGRWFNNAVRWKLRSDKKKVLGRWLGQRRGLGMEFQMEKERVEK

SEQ ID NO: 170731 - protein, 214 aa, Glycine max
  Coding DNA Sequence Number=SeqID_53953
  Gene Ontology: Mol. function=sequence-specific DNA binding; Cellular component=nucleus; Biological process=regulation of transcription, DNA-dependent
  Homolog annotation: Hit_ID=Q56NI6; Match level="QueryCoverage=84%, HitCoverage=74%, E-value=2e-38, Identity=48%"; Hit description=MADS box protein M3
  Pfam annotation: Domain name=K-box; Domain location=45-151; Score =82.3; E_value=1.5e-21; Accession=PF01486.8; Description=K-box region
MRAQPVTCLRCLFLGVRESSTHHIRPCSVVRDINKIIERYRQCRYSKSQTDDSLEHDSQSSYHEFLKLRAKYESLELTQRHFQGEELEPLSFKDLQSLEKQLDITLALTRQHQTKKLLARADELREKEKITTCKVHKLEDLNKQLESKEKDEFSSFILDNNNYIQVHATQGDQFESGTTLNTCRFQRQDSKEKAIDTKTDGSQSSHNKNKGWLL

SEQ ID NO: 170732 - protein, 161 aa, Glycine max
  Coding DNA Sequence Number=SeqID_53954
  Gene Ontology: Mol. function=RNA-directed DNA polymerase activity; Biological process=RNA-dependent DNA replication
  Homolog annotation: Hit_ID=Q1SQN7; Match level="QueryCoverage=99%, HitCoverage=31%, E-value=3e-17, Identity=40%"; Hit description=RNA -directed DNA polymerase
MVMMDSWVLEIIIYISAGQWVSHLRVLPTMKSQTGEPIGNIPVHYCSRRLKSFDSRSSEEEDVWGLIRWKEEDEWVNNVADFLNYRLLSMPFTYLGIPIGANLRQSETWGTIIAKVPKKVVGRLEKLQWWFLWGGEDDQNKISWVNWEDIYTSREKGGLGI

SEQ ID NO: 170733 - protein, 86 aa, Glycine max
  Coding DNA Sequence Number=SeqID_53955
MGLKSTLRLMRTLGSSLVSLAQFSWSLLSNALGGVGLHHQHPCWTFLTNLVLDFPCQPPVGLSTSLHHSAIIVLGLEIICSTVTPT

SEQ ID NO: 170734 - protein, 116 aa, Glycine max
  Coding DNA Sequence Number=SeqID_53956
MALHACHVDTLLKIPIIWYGLLDICSVPPGSPIEHFCQISHRLQGHVLNSWWKAGWCVIIWNIWYNRNKILSGGGEGQDPSSHGRGYRDPSLFIPWPGASKLVELLAFFLCNSFAP

SEQ ID NO: 170735 - protein, 162 aa, Glycine max
  Coding DNA Sequence Number=SeqID_53957
  Gene Ontology: Mol. function=RNA-directed DNA polymerase activity; Biological process=RNA-dependent DNA replication
  Homolog annotation: Hit_ID=Q1T5Q8; Match level="QueryCoverage=81%, HitCoverage=27%, E-value=2e-15, Identity=27%"; Hit description=RNA -directed DNA polymerase
IPIGANPRRLETWEPIISKFDRKLAFWKHKHLSFAGRICLINLGKEKISWVGWKNICSPKDDGGALWERVLDSKCANWQGMCENKESGERHSKSIWWRDIKQVEVEVMGGLRIYMMEWKIGDGTPTRFWKHRWLGRCQDGWIVDGNETFGGGDSGLNGKRNW

SEQ ID NO: 170736 - protein, 83 aa, Glycine max
  Coding DNA Sequence Number=SeqID_53958
  Pfam annotation: Domain name=zf-CCHC; Domain location=11-28; Score =12.4; E_value=0.0089; Accession=PF00098.13; Description=Zinc knuckle
MKKGEDSSLAPKCNECDQPEHLRFDCLVPKRRIEKSDKRNFKEKEEKKAYITWEDNGLDSSSDSENEIINLDLMAKDYESGEE

SEQ ID NO: 170737 - protein, 192 aa, Glycine max
  Coding DNA Sequence Number=SeqID_53959
  Gene Ontology: Mol. function=ATP-dependent DNA helicase activity; Cellular component=intracellular; Biological process=DNA recombination
  Homolog annotation: Hit_ID=Q1H2C2; Match level="QueryCoverage=98%, HitCoverage=31%, E-value=5e-73, Identity=69%"; Hit description=ATP -dependent DNA helicase RecQ
  Pfam annotation: Domain name=HRDC; Domain location=118-191; Score =73.5; E_value=6.5e-19; Accession=PF00570.13; Description=HRDC domain
MALSCVYRTGQRFGVGHLIDVLMGKVTPQVERFGHEKVSTFGIGKTLNQAQWSGVYRQLIAAGLLETDLSGYGGLHLTEAARPVLKGEQEVWLRRDAEPEKRMSKAERSARAKEAFEGASDDPLWQALKAKRLELAREQGVPPYVIFHDSTLLEIHNRKPQTLDEMGQISGIGQAKLQKYGDAFLQTIEETI

SEQ ID NO: 170738 - protein, 160 aa, Glycine max
  Coding DNA Sequence Number=SeqID_53960
  Gene Ontology: Mol. function=ATP-dependent DNA helicase activity; Cellular component=intracellular; Biological process=DNA recombination
  Homolog annotation: Hit_ID=A0A671; Match level="QueryCoverage=98%, HitCoverage=25%, E-value=2e-75, Identity=83%"; Hit description=ATP -dependent DNA helicase RecQ
MTDTESLTSAINTGKCHLRDLGGLPGFDRMQAVIALLAGAGMAFAKVAQNGLVAAGGGFAVAEQGIKLQAFQPFAFFGGFAAIEHLPHGDDIAHAVDHPGICGQTITPSAAGFLVIAFHTFWQVQMCDKTHVGFINAHAKRNRRHHDDAFFTQEAALVMF

SEQ ID NO: 170739 - protein, 46 aa, Glycine max
  Coding DNA Sequence Number=SeqID_53961
  Homolog annotation: Hit_ID=Q1SWP9; Match level="QueryCoverage=96%, HitCoverage=8%, E-value=1e-12, Identity=75%"; Hit description =Chalcone and stilbene synthases, N-terminal
MAAKVMFGALDDVFANTKVKPKDIKIALVNCSLFDPTPSLTAMIVN

SEQ ID NO: 170740 - protein, 101 aa, Glycine max
  Coding DNA Sequence Number=SeqID_53962
  Subcellular localization annotation: CTP_CleavageSite=82; ConfidenceScore=5.77e-01
MPFVRISDSTASRFKPTLDPFSTFPSPSPSRSTIETSSPLPMTPSPTAAASGPQLPHWCHSVQYWRGCKAGLMESTIVTATRAMKGVKRANDVVEFEEVRV

SEQ ID NO: 170741 - protein, 43 aa, Glycine max
  Coding DNA Sequence Number=SeqID_53963
VDGSMMGSPPRAGFGGLCRVHHGSFLVGLYGHVGGQEILYAEI

SEQ ID NO: 170742 - protein, 62 aa, Glycine max
  Coding DNA Sequence Number=SeqID_53964
MTPSQQYHDPIPTPNAPLTKKKRGGIGAEEILIAKHEDGIDHVAHPHDIMDTKMNDLHVFVY

SEQ ID NO: 170743 - protein, 125 aa, Glycine max
  Coding DNA Sequence Number=SeqID_53965
  Pfam annotation: Domain name=zf-CCHC; Domain location=97-114; Score =26.5; E_value=4.2e-05; Accession=PF00098.13; Description=Zinc knuckle
MSLVTLFGKLLEHEMELMRIHQHEENDKKNKGITLKASSSSIHEENNKEDLNENNLEEDDDFRLFVKKFNKFMRNKGNQKRSNFNPKKKGEDSSLAPKCYECDQPGHLRFDCPVFKRRMKNPTRK

SEQ ID NO: 170744 - protein, 516 aa, Glycine max
  Coding DNA Sequence Number=SeqID_53966
  Gene Ontology: Mol. function=binding; Cellular component =mitochondrion; Biological process=positive regulation of transcription, DNA-dependent
  Homolog annotation: Hit_ID=Q2QPI7; Match level="QueryCoverage=91%, HitCoverage=91%, E-value=1e-144, Identity=52%"; Hit description =Pentatricopeptide, putative, expressed
  Pfam annotation: Domain name=PPR; Domain location=147-181; Score =25.3; E_value=0.00021; Accession=PF01535.11; Description=PPR repeat
  Pfam annotation: Domain name=PPR; Domain location=182-215; Score =16.7; E_value=0.078; Accession=PF01535.11; Description=PPR repeat
  Pfam annotation: Domain name=PPR; Domain location=216-250; Score =26.1; E_value=0.00012; Accession=PF01535.11; Description=PPR repeat
  Pfam annotation: Domain name=PPR; Domain location=251-285; Score =11.5; E_value=0.33; Accession=PF01535.11; Description=PPR repeat
  Pfam annotation: Domain name=PPR; Domain location=286-320; Score =15.5; E_value=0.11; Accession=PF01535.11; Description=PPR repeat
  Pfam annotation: Domain name=PPR; Domain location=356-390; Score =13.4; E_value=0.19; Accession=PF01535.11; Description=PPR repeat
  Pfam module annotation: Pfam domain module=PPR::PPR::PPR::PPR::PPR::PP R; Domain location=147-181::182-215::216-250::251-285::286-320::356 -390
MMQLRKTDTLLRSVGTYLAVVRHFSASAEARVGSAAASSSGGGDTLGRRLLSLVYPKRSAVVAINKWKEEGHEPPRKYQLNRIVRELRKDKRYKHALEVCEWMTLQKDMKLVQGDYAVHLDLITKVRGLNSAEKFFEDLPDRMRGKQTCSALLHAYVQNNLVDKAEALMLKMSECDLLINPLPYNHMISLYISNGKLEKVPKIIQELKMNTSPDIVTFNLWLAACASQNDVETAERVLLELKKAKIDPDWVTYSTLTNLYIKNASLEKAGATVKEMENRTSRKTRVAYSSLLSLHTNMGNKDDVNRIWEKMKASFRKMNDNEYICMISSLLKLGDFAGAEDLYREWESVSGTNDVRVSNILLGSYINQDQMEMAEDFCNQIVQKGVIPCYTTWELFTWGYLKRKDVEKFLDYFSKAISSVTKWSPDQRLVQEAFKIIEEQAHTKGAEQLLVILRNAGHVNTNIYNLFLKTYATAGKMPMIVAERMRKDNVKLDEETRRLLDLTSKMCVSDVSRILS

SEQ ID NO: 170745 - protein, 167 aa, Glycine max
  Coding DNA Sequence Number=SeqID_53967
  Gene Ontology: Mol. function=RNA-directed DNA polymerase activity; Biological process=RNA-dependent DNA replication
  Pfam annotation: Domain name=AT_hook; Domain location=132-144; Score =14.9; E_value=0.061; Accession=PF02178.9; Description=AT hook motif
DDGEIEGDVNHRIQAGWMKWRKTSGVLCDAKVPIKLKGKFYRTAVRPAILYGTECWAVKSQHETKVGVVEMWMCGKTRQDKIRNGAIRERVRVAPIVEKMVKNRLRWFGHVERRPVDSVVRRVDQMERRQTIRGRGRPKKTIREVIKKDLELNDLDRSMGLKTHYLN

SEQ ID NO: 170746 - protein, 555 aa, Glycine max
  Coding DNA Sequence Number=SeqID_53968
  Gene Ontology: Mol. function=transcription regulator activity; Cellular component=nucleus; Biological process=regulation of transcription
  Homolog annotation: Hit_ID=Q9FEA1; Match level="QueryCoverage=99%, HitCoverage=82%, E-value=1e-113, Identity=47%"; Hit description =Anthocyanin 1
  Pfam annotation: Domain name=HLH; Domain location=351-400; Score =56.3; E_value=9.8e-14; Accession=PF00010.16; Description=Helix-loop -helix DNA-binding domain
LPGKAYARRQHLWLTGANEVDSKTFSRAILAKTVVCIPLLDGVVEFGTMDKVTNQPSLDYLVMLRSNVQEDLSFIQHVETFFIDHLNPLPPKPALSEHSTSNPASSSEHIPAVMYTVVDPLAANPNLNDDMDEDIEEEEEEEEEDEEPESGSEDKAGYGIARQTPTPAMAAEPSELIQLEMPEDIRLGSPNDGSNNLDSDFHLLAVSQGVNTAGQAESTRRWGLSQNPMQVQLPTSALHPLEDLTQEDTHYSQTVSNILQNQFTRWPASPSSVGYVSYSTQSAFAKWSSRASHHHFHPAAAAAADGTSQCILKYILFTVPYLHAKNPGESSPQTTAADTKLRGKGAPQEELSANHVLAERRRREKLNERFIILRSLVPFVTKMDKASILGDTIEYVKQLRRKIQELEARNRQMTEAEQRSKLPEIAVQRTSSSSSKEQQRSGVTMTEKRKVRIVEGVVAKAKAVEAEATTSVQVSIIESDALLEIECRHKEGLLLDVMQMLREVRIEVIGVQSSLNNGVFVAELRAKVKEHANGKKVSIVEVKRALNQIIPHAVD

SEQ ID NO: 170747 - protein, 215 aa, Glycine max
  Coding DNA Sequence Number=SeqID_53969
  Homolog annotation: Hit_ID=Q2HS22; Match level="QueryCoverage=63%, HitCoverage=42%, E-value=1e-07, Identity=34%"; Hit description=IMP dehydrogenase/GMP reductase
MAAIHVHDDGEVGFEEGMLWLPSHVLNEACGTKVCLRNRHQKFQNHQQMHQQRHHKSPGEPKSQDRCTCSVWYGIWRFREYSKSGSRSSYQRPKLANGGPGMRAIFLGSTHRSCGTGVFLPQRAGTNFQPSKRPACAPILVPAGVIQALNLNVRALGLQISPPQVQSYDPRCREVYNNNSEEKKSDQKDSSKQCRFISQNQCSTPEIFLPKEWTY

SEQ ID NO: 170748 - protein, 445 aa, Glycine max
  Coding DNA Sequence Number=SeqID_53970
  Gene Ontology: Mol. function=calcium ion binding; Cellular component =intracellular; Biological process=small GTPase mediated signal transduction
  Homolog annotation: Hit_ID=Q6ATR5; Match level="QueryCoverage=76%, HitCoverage=53%, E-value=1e-111, Identity=56%"; Hit description =Expressed protein
  Pfam annotation: Domain name=EF_assoc_2; Domain location=226-315; Score=127.7; E_value=3.3e-35; Accession=PF08356.2; Description=EF hand associated
  Pfam annotation: Domain name=GTP_EFTU; Domain location=10-186; Score=- 72.8; E_value=0.056; Accession=PF00009.17; Description=Elongation factor Tu GTP binding domain
  Pfam annotation: Domain name=MMR_HSR1; Domain location=13-126; Score=- 4.2; E_value=0.0024; Accession=PF01926.13; Description=GTPase of unknown function
  Pfam annotation: Domain name=Miro; Domain location=14-126; Score =112.6; E_value=1.2e-30; Accession=PF08477.3; Description=Miro-like protein
  Pfam annotation: Domain name=Ras; Domain location=14-177; Score= -24.7; E_value=2e-07; Accession=PF00071.12; Description=Ras family
  Pfam annotation: Domain name=efhand; Domain location=197-225; Score =11.1; E_value=0.8; Accession=PF00036.22; Description=EF hand
  Pfam annotation: Domain name=efhand; Domain location=317-345; Score =7.4; E_value=2.2; Accession=PF00036.22; Description=EF hand
  Pfam module annotation: Pfam domain module=EF_assoc_2::GTP_EFTU::MMR _HSR1::Miro::Ras::efhand::efhand; Domain location=226-315::10-186::13- 126::14-126::14-177::197-225::317-345
MVGPSSASGRREVRIAVVGDGATGKSTLIAAMASESFPKSVPPVLPPTRLPRNLFPDSVPLTLIDTPSSLAKQGTRNEELKLADTVVLTYACDEPVSFERVTTYWLPELHKLEVKAPVIVVGCKLDLRDENQLVSLESLTTHIMKQFTEVVTCVECSAATLYQVPQVFYFAQKAVLHPVDPLFDYERHALTDRCVRALRRIFVLCDHDMDGALNDEELNEFQVRCFNAPLQQFEVANIKTIVEQKVPEGVNSIGLTFPGFIYVHNLFLKKGRTETLWAVLRKFEYDNDLKLRDDFLPVPSKQASDQSVELTSEAVEFLNGIFRLLDTDKDRYLRPAEVDKLFDIAPERCGSGIGENTELDLMKFWMKLPLFLRMSLHTAVASTFLSYPSFLIVTYLHKCCSSNEVYGVWDLHERIQIFVQIFQHLMEALHPAILDRARFGFGVAR

SEQ ID NO: 170749 - protein, 337 aa, Glycine max
  Coding DNA Sequence Number=SeqID_53971
  Gene Ontology: Mol. function=structural constituent of ribosome; Cellular component=intracellular; Biological process=translation
  Homolog annotation: Hit_ID=Q9LT09; Match level="QueryCoverage=52%, HitCoverage=100%, E-value=1e-41, Identity=55%"; Hit description=50S ribosomal protein L24
  Pfam annotation: Domain name=KOW; Domain location=175-208; Score =41.3; E_value=3.4e-09; Accession=PF00467.19; Description=KOW motif
  Pfam annotation: Domain name=Tryp_alpha_amyl; Domain location=1-79; Score=17.9; E_value=0.0014; Accession=PF00234.12; Description =Protease inhibitorseed storageLTP f
  Pfam module annotation: Pfam domain module=KOW::Tryp_alpha_amyl; Domain location=175-208::1-79
  Subcellular localization annotation: CTP_CleavageSite=49; ConfidenceScore=5.28e-01
MTSMINTITPCANFITGSINNGLTPSATCCDSFLSLITTSVDCACLLVSANVPLQIPVNRVLALFLPQACNVGQMPALCKASASPLPAPGPALLGSNDQTPPPIAFSPLSPQVSNTIFEVEAPKSEILQPALAPASVESTPMKQKHPRKVQELDNAETSCMGWKAAEKLIRRWKILRGDNVMITRGKDKGETGIIKRVICSQNRVIVEGKNLVKKHIKQGQGHKGGIFTVEDPLHASNVQVLNPVTGLARLELKYLEDGTKVSVQRNRSIRVHSPSSQDLKDKNYPKTYSPANRELRKGERQKMNLNYEKVGPKDTPMNLVLEKTYDAKTGRGMPEL

SEQ ID NO: 170750 - protein, 120 aa, Glycine max
  Coding DNA Sequence Number=SeqID_53972
  Gene Ontology: Mol. function=transcription regulator activity; Cellular component=nucleus; Biological process=regulation of transcription
  Homolog annotation: Hit_ID=Q9FEA1; Match level="QueryCoverage=92%, HitCoverage=16%, E-value=2e-53, Identity=89%"; Hit description =Anthocyanin 1
MAAPLGTSLQSMLQAAVQSVQWTYSLFWQLCPQQGILVWGDGYYNGAIKTRKTVQPMEVSAEEASLQRSQQLRELYESLSAGETNPPCRRPCAALSPEDLTESEWFYLMCVSFSFPPGVG

SEQ ID NO: 170751 - protein, 138 aa, Glycine max
  Coding DNA Sequence Number=SeqID_53973
  Gene Ontology: Mol. function=transcription factor activity; Biological process=regulation of transcription, DNA-dependent
  Homolog annotation: Hit_ID=Q1BJ74; Match level="QueryCoverage=97%, HitCoverage=44%, E-value=1e-26, Identity=42%"; Hit description =Transcriptional regulator, LysR family
MEWRALGAIEMDFYASKALFPSAEQPLSLLELSLTPQVIMHPDSDEPVARRLQISGHTIFTNELEMLRALLEQGCGWGFLPTHMHAEQWKNVNTLRTEVGSQGISQTMVTIWKPGNDRRALIDETLGLLPGLWRGAEG

SEQ ID NO: 170752 - protein, 51 aa, Glycine max
  Coding DNA Sequence Number=SeqID_53974
MARLADAQIGLAVCQQAFSFVARGVNQAQPCVALGHGGNQCLQQRAGREGI

SEQ ID NO: 170753 - protein, 228 aa, Glycine max
  Coding DNA Sequence Number=SeqID_53975
  Gene Ontology: Mol. function=hydrolase activity; Cellular component =chromosome; Biological process=DNA metabolic process
  Homolog annotation: Hit_ID=Q5L1L0; Match level="QueryCoverage=97%, HitCoverage=29%, E-value=6e-42, Identity=47%"; Hit description =Hypothetical conserved protein
MQSDCFLLLHSQAGRARQQSLIESLIAKPIKNADGTNNYRYKQLFISTHNLDFLKYLKKISLPNEKNHGGCQHFIVERNGGASQISLMPSYLRDYITEFNYLFHQIYKCRNQGGANESHEPFYGFGNNLRKFLEAFLFFKFPHQDDKNDAFERIKKFFGEEDPTAIALVNRLNNEFSHLESIPDRGFKPVEIPEISKVANYVLDKIYTADPHQYNALLKSIGEPPRTH

SEQ ID NO: 170754 - protein, 270 aa, Glycine max
  Coding DNA Sequence Number=SeqID_53976
  Homolog annotation: Hit_ID=Q6V8P1; Match level="QueryCoverage=31%, HitCoverage=77%, E-value=4e-29, Identity=69%"; Hit description =Putative senescence-associated protein SAG102
  Pfam annotation: Domain name=DUF581; Domain location=210-264; Score =79.3; E_value=1.2e-20; Accession=PF04570.5; Description=Protein of unknown function (DUF581)
  Subcellular localization annotation: CTP_CleavageSite=54; ConfidenceScore=5.38e-01
MLLRNRSRAVTKPSLMGDHSSSQPCPNQSYKRTIIPSLFSPKFRDFTAKCLSAGAEALRSPTSILDTRALSSPFGSPLSHEAAASENTTSWDSKCIGLALVGALKDETFPQNSTKPSSGTVLFGTKHRVKIPPLPLSLPPPSFESKTCASAAAADCAAKTKDSPLSVATGVLSLSEMELSEEYTCVIAHGPNPRTTHIFDNCIVESYCSLPNTPNSPSLNFLSFCHTCKKHLEQTKDIFIYRGEKAFCSKECRHQEMVLDGARNSEFDRY

SEQ ID NO: 170755 - protein, 373 aa, Glycine max
  Coding DNA Sequence Number=SeqID_53977
  Gene Ontology: Mol. function=protein binding; Cellular component =transcription factor complex; Biological process=red or far red light signaling pathway
  Homolog annotation: Hit_ID=Q338Q9; Match level="QueryCoverage=89%, HitCoverage=96%, E-value=1e-121, Identity=62%"; Hit description =Kelch motif family protein, expressed
  Pfam annotation: Domain name=F-box; Domain location=3-50; Score=24.4; E_value=0.0004; Accession=PF00646.23; Description=F-box domain
  Pfam annotation: Domain name=Kelch_1; Domain location=149-195; Score =55.6; E_value=1.6e-13; Accession=PF01344.15; Description=Kelch motif
  Pfam annotation: Domain name=Kelch_1; Domain location=276-330; Score =32.6; E_value=1.4e-06; Accession=PF01344.15; Description=Kelch motif
  Pfam annotation: Domain name=Kelch_1; Domain location=91-147; Score =36.4; E_value=1e-07; Accession=PF01344.15; Description=Kelch motif
  Pfam annotation: Domain name=Kelch_2; Domain location=149-195; Score =34.9; E_value=2.8e-07; Accession=PF07646.5; Description=Kelch motif
  Pfam annotation: Domain name=Kelch_2; Domain location=276-330; Score =18.4; E_value=0.027; Accession=PF07646.5; Description=Kelch motif
  Pfam annotation: Domain name=Kelch_2; Domain location=87-147; Score =10.5; E_value=1.6; Accession=PF07646.5; Description=Kelch motif
  Pfam module annotation: Pfam domain module=F-box::Kelch_1::Kelch _1::Kelch_1::Kelch_2::Kelch_2::Kelch_2; Domain location=3-50::149 -195::276-330::91-147::149-195::276-330::87-147
MSGLIEGLPDAVAIRCLAWVPFYLHPKLELVSRAWRAVVRGPELFKARQELGSSEDLLCVCAFEPENLWQLYDPQRDLWITLPVLPSRIRHLSHFGAVSTAGKLFVIGGGSDAVDPLTGDQDGCFATNEVWSYDPVVRQWSPRAAMLVPRSMFACCVMNGKIVVAGGFTSCRKSISQAEIYDPEKDVWIPMPDLHRTHNSACSGVVIGGKVHVLHKDMSTVQVLDNAGQWTVEEYGWLHGQMAVIRDALYVISHGLIIKQDKKMRKVVGSASEFRRRIGFAMIGLGDELYVIGGVIGPDRWNWDIKPLSDVDVLTLASERPTWRQAAPMTRRRRIRLFNGFFELLYGYNGWGARRVEKDALKSHVGEIQGSKR

SEQ ID NO: 170756 - protein, 279 aa, Glycine max
  Coding DNA Sequence Number=SeqID_53978
  Homolog annotation: Hit_ID=P09444; Match level="QueryCoverage=91%, HitCoverage=98%, E-value=6e-69, Identity=57%"; Hit description=Late embryogenesis abundant protein D-34
  Pfam annotation: Domain name=SMP; Domain location=131-193; Score =89.0; E_value=1.5e-23; Accession=PF04927.3; Description=Seed maturation protein
  Pfam annotation: Domain name=SMP; Domain location=15-73; Score=97.2; E_value=5e-26; Accession=PF04927.3; Description=Seed maturation protein
  Pfam annotation: Domain name=SMP; Domain location=197-259; Score =70.3; E_value=6e-18; Accession=PF04927.3; Description=Seed maturation protein
  Pfam module annotation: Pfam domain module=SMP::SMP::SMP; Domain location=131-193::15-73::197-259
MSQEQLKKPQGEQDPIKYGDVFKVSDELAFKPIAPRDAALMQATENQALGQTQKGGPASVMQSAATENLRAGVVGRQDISDVARNEGVSVTETKVGCHRVITEFVGRHVVGQFVEPDVPMNTPGTALERDAITIGEALEASAIAGASDKPVDESDAAAIQAAEMRATGKNETEPGGLGARAQSAATRNTRTVSHSHKTTLSDVLTDAKEKLPADKAVTREDAEGVIGAELRNKLDMRTTPGGVAASMAAAATLNQNSYDFFLSSLLIISTKTMQILLTF

SEQ ID NO: 170757 - protein, 258 aa, Glycine max
  Coding DNA Sequence Number=SeqID_53979
  Homolog annotation: Hit_ID=Q7XEG8; Match level="QueryCoverage=73%, HitCoverage=94%, E-value=6e-09, Identity=31%"; Hit description =Expressed protein
METLFVVEQHNKNQYYNRSKSQGHARFGGSPSRGFRDINCRTFESGRTGILPTPLKSHHGSPKTPPNSDNKMVGKVKVTPKSTPIPINGKAYRKEESEDVPNGGGLLLSELWAGPTYSNSPPPSSLPIPKFSVWPKRTVSLDLPGSSSPEIEMHPVAKSAPSSPSRELLDLPFTRDFFDDNADSAATKTLLSWFMLPLVVVLPLTIWAVMVGQQSPDFGIWIKLLAVERVTGCILEESIESRLCYGLYNLMEASMKMF

SEQ ID NO: 170758 - protein, 157 aa, Glycine max
  Coding DNA Sequence Number=SeqID_53980
  Homolog annotation: Hit_ID=Q9LUW1; Match level="QueryCoverage=90%, HitCoverage=14%, E-value=5e-11, Identity=30%"; Hit description =Arabidopsis thaliana genomic DNA, chromosome 3, P1 clone: MCB17
SHTQSTEESVGNEQDVDIVDVGVSKFHSPNYTTSSFASDHNHRRSFTPAKPLPFKITDEMIGMTVPRKAPSAKRFHESWISASSGGEELNFRQRSNSPGGQSVEPASPSSSNVSLRKKMKEIKPVSKTSKSSSSDLEIEIAELLYGLKTSKSHESSK

SEQ ID NO: 170759 - protein, 92 aa, Glycine max; identical to SEQ ID NO: 151243
  Coding DNA Sequence Number=SeqID_53981

SEQ ID NO: 170760 - protein, 119 aa, Glycine max
  Coding DNA Sequence Number=SeqID_53982
WKDVPDTLKELVWNDILAKLDIPEALHAKKKVMYTVATRWRQFKSSLTSKFVYSNFEDSLEEQMTNGEFVPQGREDILNTAIGRTYHRGHVRAAGSGVTISQYYGRTSRASSTSSISFT

SEQ ID NO: 170761 - protein, 219 aa, Glycine max
  Coding DNA Sequence Number=SeqID_53983
  Gene Ontology: Mol. function=protein histidine kinase activity; Cellular component=membrane; Biological process=peptidyl-histidine phosphorylation
  Homolog annotation: Hit_ID=Q6W5B6; Match level="QueryCoverage=67%, HitCoverage=27%, E-value=7e-26, Identity=47%"; Hit description =Ethylene receptor
  Pfam annotation: Domain name=DUF623; Domain location=155-219; Score =102.5; E_value=1.3e-27; Accession=PF04844.4; Description=Protein of unknown function, DUF623
MASTRNLKHLNLNLNLNMCCSNSATHECESPPLSPITSSSNHNNTTQCPSPSSIMIKNFNSIYDPTLTSHDHSFSSTFFEPEPADFATAFASQRFFFSSPGLSNSLVEYNNTNKSTTRHPALLREHGEKMKEEEEEEEKKKKVLFKGSVAVATYSPDPYVDFRRSMQEMVEARPELMDVKSNWNVLHELLLCYLALNPKSTHKFILGAFADLLVSLMSF

SEQ ID NO: 170762 - protein, 114 aa, Glycine max
  Coding DNA Sequence Number=SeqID_53984
  Pfam annotation: Domain name=AT_hook; Domain location=2-14; Score =17.0; E_value=0.026; Accession=PF02178.9; Description=AT hook motif
MKRKRGRPPKMDLKEEDQLDDQFPRKRGGVNEAHRVFQIGDEKPPEEPVLGSYGLGISRLGNALVGRAIHAQIVKHDVGEADQVVNNVFLGLYVEIGCFDEVLKVFEAMPQRNV

SEQ ID NO: 170763 - protein, 1180 aa, Glycine max
  Coding DNA Sequence Number=SeqID_53985
  Homolog annotation: Hit_ID=Q9LUW1; Match level="QueryCoverage=71%, HitCoverage=61%, E-value=2e-69, Identity=28%"; Hit description =Arabidopsis thaliana genomic DNA, chromosome 3, P1 clone: MCB17
MDRTRESRRSSMTTSTNGFPKRRHRTIALRDSSEEGAVELREGTSKRGRNRDRDRDSANRSKRRIGSHSQSTEESVGNEQDDDVLDVGVSKIRSLNNTTTSFASDQIHRRSFTSAKPPPFKITEEMIGVSVPRKARSASAKRSYESWISASSGGEELNFRQRSNSPGGQSVEPTSPSSSNVSLRKKMKEIEPVSKTSKSSSSDIEIEIAELLYGLKTSKNHESSIKLEASVSPSDDAEKKKMEDNNNSSTLFSNNSTEELSRIQIEQPADVDYHVGPSIEAPKENIGDASADGRSVSPTRESPSCSELDTEKPYSASNRVVAFQQAPPPMGLSPEGDDLSRGDFILETKALALDVEMKKENSVKVERPVKKEKIPEEIEEAKMVTFMEKLDVLKHDLEKKNNVHDIKTNNKLEEQDRNKELASISSNPKEEKTANNVTLLRSITMIGRYKPHLQPVAKTDKTTGSLTLKHANFVLSQRKPKRCATHYYIACNILHQQFTKMNPSLPAAIGSGSLCSTKPNNVNCVPSAESMAIGKQSQKHLPIVNQNASQEKGWAVTSNPSLTAAKCSNNSNPMDSAHRVQLVLQQGPNPGPTGNLVHGPAFLYPPGQHQASVTATTNQAGAVNSPNSTSSYNKFHSSVGGSPGTSSTLPVVAPGISFSYPNFSANGSSPYMTIVHNNGYSFPFSTSLGATTAIRGPSPPQATHVLSGPFYSSQMFHPQQHPQSQALVQPSYLNASTSSSSSSHKQSPGAQVNGSNILTSTTMEQQSQKRQTSLSHLCKHETEMGGGNAPSVANRTSYSQKNVHGQNCTIPVQPVNFSFKPSATSDIVGNGGSFGDKQQKQQALKGGVENIPSQAFAISFAAYNGTSVPSNLNFSSMAQNPVILQSLPDMAWQGYQAASTPQTTQQKTYSITEAKSGGNSSHQDDEKKISRAQSSSNGPTTLVFDNSSKNLNFMLSTANGNWSNHTIASTAITSVPLSSNALSSQQPPHLLQLPKQHAMQQQQAAMATRYKAPPANNTPAAKFGNNAPVFSQTPSQCKSSNQASHTKASSRTADSHIHHSSVITSNAPTLKSFSQEQGRVLPGHMQISFGGNYITPLPPQGQPLLNNNHPLCATAQGTPYSGGNAKSNSEGSKVSSSVNASQLQQTENSAGSGQKSSPVCGRNVPSILSSCPSHLSELKY

SEQ ID NO: 170764 - protein, 263 aa, Glycine max
  Coding DNA Sequence Number=SeqID_53986
  Gene Ontology: Mol. function=signal transducer activity; Cellular component=intracellular; Biological process=signal transduction
  Homolog annotation: Hit_ID=Q9SY00; Match level="QueryCoverage=60%, HitCoverage=78%, E-value=8e-61, Identity=47%"; Hit description =Putative WD-repeat protein
MEKNIKLVKQTEKEDETHKSVVESGGENELAIGGEFGEGDSRGLIFDEGLQEIAGFGVPNLAGAVVAGGDDEVSVAVVVDGGDGHGVALYGVDAFPGLHIPNLDGLVEGTGHDVARLGVEVDAENGVVVAAEDLDAAAADGGVPDAEGAVVGGGADVVGAEARRVPSFENFTHDTAFSWSPATPPPSAFDNDSHTTTIGEGTTITIVEATSQLKASVLFTIELYFNDLGGGIDEKGEVERATIDPSDGGATPWWRQVKWEYKK

SEQ ID NO: 170765 - protein, 300 aa, Glycine max
  Coding DNA Sequence Number=SeqID_53987
  Homolog annotation: Hit_ID=Q9LUA7; Match level="QueryCoverage=90%, HitCoverage=87%, E-value=4e-45, Identity=38%"; Hit description =Arabidopsis thaliana genomic DNA, chromosome 5, P1 clone:MIF21
  Pfam annotation: Domain name=DUF868; Domain location=24-299; Score =421.2; E_value=1.5e-123; Accession=PF05910.3; Description=Plant protein of unknown function (DUF868)
  Subcellular localization annotation: CTP_CleavageSite=26; ConfidenceScore=5.03e-01
MREFPSCFGENGVQVADSSSSSTTRAAQNVVTCVYQCKLRGHSSLITVSWTKTLIGQGLSVEIDDLGKHCLCKVEIKPWLFSKRKGSKNLEVQSGKVDIFWDLSSAKFGSGPEPMEGFYLAVVFNKETVLLLGDLKKEACKKIESDCACFSHSGAIFIAKREHIFGKKFYGAKAQFCDKGQVHDVTIECDTLGLNDPSLVIRIDSKTVMKVKRLKWKFRGNHTILVDGVPVEVFWDVHSWLFGNAMGNNAVFMFQTCISNDKMWEGQSVSDPSWASSQQFRDSQLQGLGFSLILYAWKHE

SEQ ID NO: 170766 - protein, 264 aa, Glycine max
  Coding DNA Sequence Number=SeqID_53988
  Gene Ontology: Mol. function=signal transducer activity; Cellular component=intracellular; Biological process=signal transduction
  Homolog annotation: Hit_ID=Q9SY00; Match level="QueryCoverage=87%, HitCoverage=80%, E-value=1e-87, Identity=52%"; Hit description =Putative WD-repeat protein
  Pfam annotation: Domain name=WD40; Domain location=126-164; Score =52.5; E_value=1.4e-12; Accession=PF00400.22; Description=WD domain, G-beta repeat
  Pfam annotation: Domain name=WD40; Domain location=168-206; Score =51.3; E_value=3.3e-12; Accession=PF00400.22; Description=WD domain, G-beta repeat
  Pfam annotation: Domain name=WD40; Domain location=41-79; Score=47.5; E_value=4.5e-11; Accession=PF00400.22; Description=WD domain, G-beta repeat
  Pfam annotation: Domain name=WD40; Domain location=83-121; Score =44.7; E_value=3.1e-10; Accession=PF00400.22; Description=WD domain, G-beta repeat
  Pfam annotation: Domain name=eIF2A; Domain location=52-224; Score= -73.1; E_value=0.002; Accession=PF08662.1; Description=Eukaryotic translation initiation fact
  Pfam module annotation: Pfam domain module=WD40::WD40::WD40::WD40::eIF 2A; Domain location=126-164::168-206::41-79::83-121::52-224
MAEVWRAAFMNEVSKVSEFRWMATSATRSGGVTQTLGFKPYRHLKTLTDHENAVSCVKFSNDGTLLASASLDKTLIIWSSATLTLCHRLVGHSEGISDLAWSSDSHYICSASDDRTLRIWDATVGGGCIKILRGHDDAVFCVNFNPQSSYIVSGSFDETIKVWDVKTGKCVHTIKGHTMPVTSVHYNRDGNLIISASHDGSCKIWDTETGNLLKTLIEDKAPAVSFAKFSPNGKLILAATLNDTLVCFIFFFCLLHKSCYLHLK

SEQ ID NO: 170767 - protein, 105 aa, Glycine max
  Coding DNA Sequence Number=SeqID_53989
MVVGHDVCTHSHFSGALALLPMKTVPYNAIHKGMFDVLEAAKFIWFLLVMRELEGLRQLSSKGHLLGIAGERGDGGCCWCFHWCRSRLGSLSGGRGGEVSEKISL

SEQ ID NO: 170768 - protein, 323 aa, Glycine max
  Coding DNA Sequence Number=SeqID_53990
  Gene Ontology: Mol. function=carbohydrate binding; Cellular component= chloroplast; Biological process=translation
  Homolog annotation: Hit_ID=Q9M1X0; Match level="QueryCoverage=52%, HitCoverage=61%, E-value=4e-68, Identity=77%"; Hit description =Ribosome recycling factor, chloroplast precursor
  Pfam annotation: Domain name=RRF; Domain location=126-289; Score =248.5; E_value=1.4e-71; Accession=PF01765.9; Description=Ribosome recycling factor
MVMALWSGIANWQRKKKEWRKLLSTTQHHQRYTSLSDGNLDLFLSDSLCPLHHLPKAKPSQSPSSSLPAALLRLFRKLCNSQAPSQTPPFQGRTPLVRAATIEEIEAEKAAIEKDAKSRMDRTIDNVRTNFSSIRTGRANPAMLDKIEVEYYGSPVSLKSIAQISTPDASSLLVQPYDKSSLKAIEKTIVSSDLGMTPNNDGESIQLRIPQLTSDRRKELSKIVAKQAEEGKVALRNIRRDALKAYDKLEKEKKLSEDNVKDLSSDLQKLTDEYMKKVDTIFKQKEKLMTDGKLMRYLDTDYMPKARPHALPFTMSTTLVNMF

SEQ ID NO: 170769 - protein, 34 aa, Glycine max
  Coding DNA Sequence Number=SeqID_53991
MDSTLISPDSGKGVASLHRARRAAWGSFAGAVVD

SEQ ID NO: 170770 - protein, 429 aa, Glycine max
  Coding DNA Sequence Number=SeqID_53992
  Homolog annotation: Hit_ID=Q8UA79; Match level="QueryCoverage=62%, HitCoverage=41%, E-value=9e-40, Identity=36%"; Hit description=GGDEF family protein
  Pfam annotation: Domain name=GGDEF; Domain location=340-429; Score =13.4; E_value=4.8e-08; Accession=PF00990.12; Description=GGDEF domain
  Pfam annotation: Domain name=Oxidored_molyb; Domain location=20-163; Score=-42.3; E_value=5e-05; Accession=PF00174.9; Description =Oxidoreductase molybdopterin binding d
  Pfam module annotation: Pfam domain module=GGDEF::Oxidored_molyb; Domain location=340-429::20-163
MVGDMRLIFAVLFYVLVLPNAFAEKLPAPTGKPVLTISGKITNTNEGDTAVFDIAALEKLGNETVITTTPWYSGKVRFDGISLSKLMDLVGAQGKTAKVMALNDYTTEVPVEDFHKFPVILALKMNGEYMRIRDKGPLFIVYPYDSSAELQNQIYYSRSAWQMVSEYMRLEARLSALALNVKGTDRDEVRLRLEIMMSQIELLQQGDLGQFIRKSEQRQATVTSLIQILDQLDRQLDTMTPEQMVILLHTMSKLDGPMTSLASMTLAQDFDVVNLTHDKIQHLYYIYSVISILLITMCITLGLLMLRQNNNLRRAHVRMKLLANDLQLSKEKLQVQNRRLQYDAYHDSLTGMPNRLSFWQRLQEVVNHVKPYNGCAVVMLFDLDNFNDVNDTLGHDAGDKLLQELASRLSFFRKTSETLYRLGGDEFAL

SEQ ID NO: 170771 - protein, 75 aa, Glycine max
  Coding DNA Sequence Number=SeqID_53993
MDSIAQVIGCIREGNTYQEDWEKKYESYVLKDLYRNNFKEAIGKKKVRYNLMCDMAMKVDIKRNMTVTPVDEEDI

SEQ ID NO: 170772 - protein, 99 aa, Glycine max
  Coding DNA Sequence Number=SeqID_53994
  Gene Ontology: Mol. function=zinc ion binding
  Pfam annotation: Domain name=SWIM; Domain location=33-72; Score=20.9; E_value=0.0018; Accession=PF04434.8; Description=SWIM zinc finger
MAKVEEGEIFLDTEEEVNNLIEAIRKEKGLLHYTRIVLDPLTMKITKASCDCEGYTFRHNCWHIKTLEQMIKEDRELRERIEKARQEMMQIEEDIASWG

SEQ ID NO: 170773 - protein, 33 aa, Glycine max
  Coding DNA Sequence Number=SeqID_53995
HLDVTLTSTVGPECVELISIVCGVDLYCSESNL

SEQ ID NO: 170774 - protein, 83 aa, Glycine max
  Coding DNA Sequence Number=SeqID_53996
MTLLCLVSDQDIWMKGQRLHDGNGLRAMKKICSNLQGKDNAPPPPPQWIKAKYFSDGTALDTDTMTTIRKKWAAYFLEVGKWM

SEQ ID NO: 170775 - protein, 183 aa, Glycine max
  Coding DNA Sequence Number=SeqID_53997
MIQFHEIESFLKGGMNILTAHSQEWEQELSSNYQYEEERTPNLEKLLNRKLSRGTKVTTFLSKCSKRGSNMDKLLMQFMETTKSTQQALQSVEIQVGELAEAVTQFMSRREKSFVEAEAQEKSPIKEHESREKDEEKDDEQTQQQWEKYSTVENQQGNILQSNNLPHQLIDKKGRQGEHEETL

SEQ ID NO: 170776 - protein, 146 aa, Glycine max
  Coding DNA Sequence Number=SeqID_53998
  Subcellular localization annotation: CTP_CleavageSite=14; ConfidenceScore=5.28e-01
MNVGALISGQITSMAQSNSSRLGFPALITALCKSRGVASNSLVFEHLSPVINLAYIRKNCWNPDDLIVTIRGAKRVRIRPVEASSTSTTPPPTRTLAAPSAPDPADFQHLEAMLQSINQGQIILLQSLQMVTPPDSIPLVEQFNEW

SEQ ID NO: 170777 - protein, 291 aa, Glycine max
  Coding DNA Sequence Number=SeqID_53999
  Gene Ontology: Mol. function=catalytic activity
  Homolog annotation: Hit_ID=Q4JCJ1; Match level="QueryCoverage=98%, HitCoverage=54%, E-value=8e-96, Identity=59%"; Hit description =Conserved Archaeal protein
  Pfam annotation: Domain name=DUF557; Domain location=2-291; Score =441.8; E_value=9.2e-130; Accession=PF04477.3; Description=Protein of unknown function (DUF557)
MEFMRLPNPKVEGADRKVFAETMESIPITYDLAEKFYGNGITVPVFEVILPMTTSNLEIISVARYYEKAVANEDELELYDGVKVKDLVGEIYPKVIEVIPLVEDRDSLQNIDNIVEGYYKVIKPKYMRVFLARSDPAMNYGMITAVLSVKIALSELYKLSESLNFEIYPIIGVGSLPFRGHLSPENYEKVLEEYKGVYTYTIQSAFKYDYDYDKVKSAISSINNSRIGPAKILEKYEEDVLRKITILYTERYQPIIENLANAINDVSVLLPRRRARKLHIGLFGYSRSAGK

SEQ ID NO: 170778 - protein, 188 aa, Glycine max
  Coding DNA Sequence Number=SeqID_54000
MKVDMESMKEHMTTMMEAMMSMRKMMEDNTAIVVVVSTATEMDPIHPAGFIQVNRPISNVVGQKGEATKNACGPYHVQVQSKHSFAPYGLPPNYTPPTVVYASSENISNSAPVFIENQQPQSDHAHVSQPMGETHEVPQDHTLARFGVYPGYTTEGQTFSSIPMLNAPRISQCRPLSQPLHLVRGEMM

SEQ ID NO: 170779 - protein, 111 aa, Glycine max
  Coding DNA Sequence Number=SeqID_54001
  Subcellular localization annotation: CTP_CleavageSite=2; ConfidenceScore=5.02e-01
MMAHQLPPRKRFFNVISLTLLPQWANSRFGSYFQNLLTHFHYLFFLPISTMQLIVNMNGLPNITGMSLSSQMMQSYPTRALDRRLQEDWAKDAREGPRVLMSLRVDFRLMG

SEQ ID NO: 170780 - protein, 325 aa, Glycine max
  Coding DNA Sequence Number=SeqID_54002
  Gene Ontology: Mol. function=pyridoxamine-phosphate oxidase activity; Biological process=pyridoxine biosynthetic process
  Homolog annotation: Hit_ID=UPI00006DBDF9; Match level="QueryCoverage =50%, HitCoverage=83%, E-value=4e-18, Identity=32%"; Hit description =COG5135: Uncharacterized conserved protein
  Pfam annotation: Domain name=Pyridox_oxidase; Domain location=164 -262; Score=50.8; E_value=4.5e-12; Accession=PF01243.10; Description =Pyridoxamine 5'-phosphate oxidase
MTGNVSSLSDHLAKANLHIGLFFLLIVLLFIAGSSVSTLIINSGRRRQIRGIYAINILLEGIALLRGRRVADSQPELSDGPAKCGGNAHLQCPRAHDAPAKTALLHRAGISRWRRAGHSAAAVAKLRAADRHWVTAQCAGAVGAETCGQQSASRPLRKGIMISLEDRLQAIWQLLSTATTSRSAFTLMQLATVTADGQPSLRTVVIRQFLPALPALRFTADRRSAKMQDIAAQPQVALLAYDAASRVQLRLAGTAQRVDDAQQRAAAWQALRPHSHALFQSPVRPGSVIAHPDDAQPASAQKAGTGPDEHFALVQITLHSVEWLD

SEQ ID NO: 170781 - protein, 328 aa, Glycine max
  Coding DNA Sequence Number=SeqID_54003
  Gene Ontology: Mol. function=helicase activity; Biological process =viral genome replication
  Homolog annotation: Hit_ID=Q1S3G1; Match level="QueryCoverage=99%, HitCoverage=90%, E-value=2e-61, Identity=38%"; Hit description=AAA ATPase
  Pfam annotation: Domain name=DUF889; Domain location=65-244; Score= -11.5; E_value=1e-10; Accession=PF05970.5; Description=Eukaryotic protein of unknown function (DUF889)
MAYDKEILAEQYNTTYQLLTDEQKTIVDTIMCVVNTQSAAVYFLYGYGGTGKTFVWTTLSSSIRSNGGIVCTVASSGIASLLLPGCRTAHSKFSIPVPATQNSTCNIHQGSDLAELLKVTKLIVCDEAPMCHKFAFEALDKSLKDIMQNNLLVGGKIIVFGGDFRQILPIVPKGIPNHKLKLKVRTPIMLIRNLDQTDGLCNGTRLIITKLGSNVIEAEVITGPNTGNRTYIPRINMSPSESPWSFKLIRRQFPFIVSYAMTINKSQGQSLHHIGLYLPHPVFSHGQLYVALSRVKNKDELHILIHENDGNPKNIITNGFYDEVFANL

SEQ ID NO: 170782 - protein, 113 aa, Glycine max
  Coding DNA Sequence Number=SeqID_54004
  Homolog annotation: Hit_ID=Q8H6Q8; Match level="QueryCoverage=65%, HitCoverage=2%, E-value=5e-07, Identity=35%"; Hit description=CTV.20
MSNPWRFTVGNWLCDSDLVSPTRIERVLAEKDLLADSYSDLETSILDEKEFLLLKVISTFPELSCLICSMVGAGRGIDGVALSITHLSGRVTSSHFIFLGRETLAFVISVINK

SEQ ID NO: 170783 - protein, 142 aa, Glycine max
  Coding DNA Sequence Number=SeqID_54005
  Homolog annotation: Hit_ID=Q8H6Q8; Match level="QueryCoverage=95%, HitCoverage=4%, E-value=6e-08, Identity=26%"; Hit description=CTV.20
MTKANVSLPRKIKWDEVTLPERWVMDKATPSIPRPAPTIEHIKQDNSGKVEITFNRRNSFSSRIEVSRSEYESARRSFSARTRSILVGLTRSESHNQFPTVNLQGLDITSSIPRTTYNQEQEDDQNSIQSLTYSSMEPYDVI

SEQ ID NO: 170784 - protein, 85 aa, Glycine max
  Coding DNA Sequence Number=SeqID_54006
MTQPPILRTYQMNTRVVGSKTMVVILTPFPGPKEVTCLHPMKQYSNEIVKNFQFIHFYCNRWHGNITIKIHNTLQFTLDVCYIRY

SEQ ID NO: 170785 - protein, 265 aa, Glycine max
  Coding DNA Sequence Number=SeqID_54007
  Homolog annotation: Hit_ID=Q1T493; Match level="QueryCoverage=98%, HitCoverage=55%, E-value=4e-25, Identity=26%"; Hit description =Nucleic acid-binding, OB-fold, subgroup
MAQKKLLKLSVRISDLWFISTPNKSEQAEMVFVDSDYRVCDHQFKLVFIGVTVVRECVLGDIPFRKYRFAGFADVVAGQFERGLLVDVIGVVEEVVFRQVLGKGRRVVFKLKDLSQQLLSCTLWDDYCLQFVKFLDDYEGDGPITVLLSHCRIKEAQGSYPASINNSFKASKLIINQPVMEIQEFNERLAELGIEARSGFKSHGEGSTQLLGSIQLSSKESFFGNAEAKTIVEINTISEEIVCVTVDTITRIQLDNHSWCYTACI

SEQ ID NO: 170786 - protein, 61 aa, Glycine max
  Coding DNA Sequence Number=SeqID_54008
WAKRATTAKRSFNALSVIEESGRASISRLCAKREISALSATGVFSQAQRTTGAKPESTYPR

SEQ ID NO: 170787 - protein, 86 aa, Glycine max
  Coding DNA Sequence Number=SeqID_54009
MALQIGHQIDWAHLVRYRMHKALRVNAPLPYPHPVTLILQHFSIPLANEPFVKVKCSFAIGATAVESFGYRKDLDGQWVRKHDLPI

SEQ ID NO: 170788 - protein, 62 aa, Glycine max
  Coding DNA Sequence Number=SeqID_54010
MTMAVMADNSKVHTDKSGDNHGDGDRAIGGGTLEGIGNTTIANGEHLNDYLEIKDELLKLGN

SEQ ID NO: 170789 - protein, 99 aa, Glycine max
  Coding DNA Sequence Number=SeqID_54011
MSSRRSRSRQTSSSRNITDDQINDLVSKLQQLLPEIRDRRSDKIWVQFATDSLSTLKNKRIGVTMLLVLILFSLWFQIVNAVVVVSIRAVAVLIAVIAV

SEQ ID NO: 170790 - protein, 221 aa, Glycine max
  Coding DNA Sequence Number=SeqID_54012
  Gene Ontology: Mol. function=RNA-directed DNA polymerase activity; Biological process=RNA-dependent DNA replication
  Pfam annotation: Domain name=AT_hook; Domain location=190-202; Score =14.9; E_value=0.061; Accession=PF02178.9; Description=AT hook motif
MLCASIGHSSQKLWQFEYLKAFFFNFERVDILWFAIEHPSQKLLSFEFVRSFHLHDGEIEGDVNHRIQAGWMKWRKASGVLCDAKVPIKLKGKFYRTAVRPAILYGTECWAVKSQHETKVGVAEMRMLRWMCGKTRQDKIRNRAIRERVGVAPIVEKMVENRLRWFGHVERRPVDSVVRRVDQMERRQTIRGRGRPKKTIREVIKKDLELNDLDRSMGLPS

SEQ ID NO: 170791 - protein, 91 aa, Glycine max
  Coding DNA Sequence Number=SeqID_54013
MVVKWRLQSSFFLLHSAVIDLQEAKDSIDEEDPRPTSSTWSYIIASQGASYPWHSLGGEAPPSMAYSLMDGSSSHLLSFIFCYISMVENHH

SEQ ID NO: 170792 - protein, 83 aa, Glycine max
  Coding DNA Sequence Number=SeqID_54014
MKERIESLFSTESLRWIMRISLQLKCSSPCGGPATSNGGLWWPPMIVGGGGEGISLSELVSLSGNLLLALSMASRVACIASLG

SEQ ID NO: 170793 - protein, 318 aa, Glycine max
  Coding DNA Sequence Number=SeqID_54015
MPKKTNTPPKADHSKHCRYHRNRDHSIEERSALKDKIEELIKLDHLKDFSIGHSHTSPREEIDPNLVEEETKSMSDGQEGKGAEADLGREKREPLTNRGSVISVNMISQHQVPNMLPITFTTKDFKAIDPVKDDPMVISVEIANSIVKKTLATPPGEGRTPEAVHHVEARIKAEEVEELELDPKTSDNSRVIQLGNQLHEDDSSSIQRVNREYANLFAWSMTDILGINPSFHCHGLTICEDTVCGYIYLGLTENKRGYISCGSVLVEGTSTRFKENKGGYIPCGSLLVRDTKPATKKKRKMGEERCRAVQQEVDKLTT

SEQ ID NO: 170794 - protein, 96 aa, Glycine max
  Coding DNA Sequence Number=SeqID_54016
MKLADDDKNLQDQVLALSNDAKGWETRALNAEALKAYDDVCNAHKAGFSHCLRQVLHMCDVSDPSIFDINKDVHEGELVLINDIPKDEVAPSPSIC

SEQ ID NO: 170795 - protein, 88 aa, Glycine max
  Coding DNA Sequence Number=SeqID_54017
  Subcellular localization annotation: CTP_CleavageSite=69; ConfidenceScore=5.24e-01
MATFGGATPMLTPPGHRDLVRFQLMWCLLSARTQRRSISIRSKAIKTIEVARGNTPGTGKAPLRRRGSSSQHLSSNLSLPPLWATMRL

SEQ ID NO: 170796 - protein, 87 aa, Glycine max
  Coding DNA Sequence Number=SeqID_54018
MVSVEGSPLRESIKGGFEGSSDLSTFLSQLPANIVKKVGESIVAPVMVATTKVGTFERVASQPKKRLVLMENCLPPPITLLEYTWID

SEQ ID NO: 170797 - protein, 201 aa, Glycine max
  Coding DNA Sequence Number=SeqID_54019
MVAQSGGNDRLELKCWLLEPLLLRGAFPVPGVFPRATSMVLMALLLMLILLLWVLADKRHHINWNLTRSRCPGPLMVIFHHGNAAEDKGEEDASMKEKKEGEKERGGEHEIEGIKEGEKWNFEPNLLGVFYPMPLRSRIASPGLEESVHDPVTKEATQGAKQVVVEGVIRDNQGLDIRQQSAVPLGTHCTAEYTTASRREK

SEQ ID NO: 170798 - protein, 63 aa, Glycine max
  Coding DNA Sequence Number=SeqID_54020
MALGKPMAVDLASPPSAINSWVEIYVTQPHGGRQNVPVTNGTGTHPLVKGSSMPKDRLLVVPH

SEQ ID NO: 170799 - protein, 180 aa, Glycine max
  Coding DNA Sequence Number=SeqID_54021
MGGYVGAKASLLSTAPLSVTMTEELVARGDTLRLSAPLCHPEAAGPMIRGDTLRLSAPLSHPEAAGPMIRGDTLRLSAPFCHPEAAGPMTSRDKIWSFCTLESSRGGGPDDTRRYLTVIRTLVSSRGGGPDDTRRYLTVIRTLVSSRGGGPDDTRKYPSGYPYKHSFAICKTERLIACRD

SEQ ID NO: 170800 - protein, 354 aa, Glycine max
  Coding DNA Sequence Number=SeqID_54022
  Homolog annotation: Hit_ID=UPI0000680584; Match level="QueryCoverage =93%, HitCoverage=90%, E-value=1e-47, Identity=34%"; Hit description =conserved hypothetical protein
  Pfam annotation: Domain name=Peptidase_M14; Domain location=25-307; Score=-74.2; E_value=0.02; Accession=PF00246.14; Description=Zinc carboxypeptidase
MSLLPDYTQQRARFLATVTRQHGALTAYRHPLTAPDGAALYTDVAVIGDPAAPKRMLILSGTHGVEGYYGSDSQIAWLDSFDVAALPPDCALVLVHLLNPWGAAHLRRVNEDNIDLNRNFIDFSQPAPANPHYALWHDLYHGDRAHADRLLAETLQQSGWPALKRVVEAGQYQAADGLFYGGQQPAWSHRTLHAIVEQHLRQAQVILSFDLHTGAGAWGHPMLLAIAEQRYPAHDWGKSLYDEWLTLLFTGAGRDSDTGVTATATGYVSQFLLTSLPDTQLLPLVVECGTYPGEEMHRRVRDDHWLHLQGDPASHAGRALKQQLVEGFWPADEDWRALTAFRTRADFPARLARA

SEQ ID NO: 170801 - protein, 73 aa, Glycine max
  Coding DNA Sequence Number=SeqID_54023
MNEVGNLLGSKMLIEDWMQNARLKLEDAMCEFHKGEVAGKPLKYMEYVAKKHAKRVLKITKPATLAKSGSRTA

SEQ ID NO: 170802 - protein, 193 aa, Glycine max
  Coding DNA Sequence Number=SeqID_54024
MSEIEEVQEQMKVDMEAMKDQMTSMMEAMLSMRRLMEDNTAVVATTSVTAEADPTHPSGINQTSRPILDMVGQGVEVLGNTGGPHMVQKKNSFPPYDLPPNYTPPNAVHVPNENTNHSVPIPLEGQQPQLRHAPFVQPVGKAREEPWDHALAQCHESSSTPAAATSALLGGETTTGHGRRREVGSHKRKVEGH

SEQ ID NO: 170803 - protein, 179 aa, Glycine max
  Coding DNA Sequence Number=SeqID_54025
  Homolog annotation: Hit_ID=Q6CQF3; Match level="QueryCoverage=31%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MAARALGVPRHLRAPGVGLWAPHSARLETRTKESDMCASQRASKPVRRKEADWWDPLWVAPPTDPDLLKLWWRPAAILTIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLG

SEQ ID NO: 170804 - protein, 251 aa, Glycine max
  Coding DNA Sequence Number=SeqID_54026
  Homolog annotation: Hit_ID=Q8TGM6; Match level="QueryCoverage=47%, HitCoverage=97%, E-value=1e-09, Identity=43%"; Hit description =Protein TAR1
MLSLEPFTEDQGRSAVQPTGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 170805 - protein, 216 aa, Glycine max
  Coding DNA Sequence Number=SeqID_54027
  Homolog annotation: Hit_ID=Q21KY2; Match level="QueryCoverage=40%, HitCoverage=80%, E-value=5e-10, Identity=42%"; Hit description =HesB/YadR/YfhF
MAAGQEQAAGNTGPGADVGDQRLAADAHRAVQPFQQRGWVIGPVADVIGDAAAEAFSAVGGGHGSQFDIAASQARPPKNRMKTRMAAITAPTITQPSTRPVTARPSPSSSCGRRRISARAMWPVMMATMLATKGRTVQLAMPMTRLTTARALVCRGATLIGVLLGSVHMIVRLPRQSHARRIQWQASTLVDERHANQGWQLQGAGVSPSTPGHHPR

SEQ ID NO: 170806 - protein, 176 aa, Glycine max
  Coding DNA Sequence Number=SeqID_54028
MTSIAQSNSSRLGFPALITALCRAKEVVSDSLTFERLSVVINLAYIRKNYWNPDDLTVSIRGARRVREDEGPTAQVPQHVEDASSEATVPKPFIVKKEAGETQVRQEVAAIPERSREVTSDPPTPVVDLSSPQHEANPSTLILEIPKDPTTPVLTLNTSPPATPVLHLTDEEDVQT

SEQ ID NO: 170807 - protein, 67 aa, Glycine max
  Coding DNA Sequence Number=SeqID_54029
MRAHMFMSIRETRPKISLTLSIVRSEVCDVGARLEYERTLHTWAKVVKSFLRILPGWPSAFKMNPRP

SEQ ID NO: 170808 - protein, 104 aa, Glycine max
  Coding DNA Sequence Number=SeqID_54030
  Gene Ontology: Mol. function=protein serine/threonine kinase activity; Biological process=protein amino acid phosphorylation
  Homolog annotation: Hit_ID=Q7XIB4; Match level="QueryCoverage=100%, HitCoverage=18%, E-value=3e-17, Identity=40%"; Hit description =Putative cyclin-dependent kinase CDC2C
MGCVVVKQAVSVTPAIEHSVESEKNNRKKKTESVGASRSELGESGRASSNGGSESLSFRLGNLSKYVEGEQAAAGWPAWLSAVACEAIHGWVPLRADAFEKLDK

SEQ ID NO: 170809 - protein, 235 aa, Glycine max
  Coding DNA Sequence Number=SeqID_54031
  Homolog annotation: Hit_ID=Q47522; Match level="QueryCoverage=21%, HitCoverage=69%, E-value=4e-14, Identity=71%"; Hit description=LacZ protein
VPPVQLLTGWCVTAKAPPDISAGKCSGHAARRVPFAIQAAQLLGRAIGAGLFAITPAGERGMCCKAIKLGHGNTEIPQDGISIEKYTQELAEYCKQQKLNDVYIFGHSMGGYVGLCYSLQLPENVNSVLTLGTKFNWTEEQALKESTMLDPEIILLKIPKYAEQLELQIKLIDTVDLEGGPVGKPVVPAALMNRPTRGERRFAYWALAECILAYYVGTDEGVSEVLHVAGEKRLH

SEQ ID NO: 170810 - protein, 76 aa, Glycine max
  Coding DNA Sequence Number=SeqID_54032
MMVDDDIDEGPAKSSPSMMGGNVSLLAKKKRDVGCFGCRWKLTPATLIGHELCCGGRSDEEGWSEREKGKEEEKII

SEQ ID NO: 170811 - protein, 1271 aa, Glycine max
  Coding DNA Sequence Number=SeqID_54033
  Homolog annotation: Hit_ID=Q6F3A8; Match level="QueryCoverage=91%, HitCoverage=99%, E-value=1e-15, Identity=28%"; Hit description =Putative cell wall protein
MEQGDEWARESGKHINLLWMLGWSTRLFYIKGKWETHKFTLDVRMEHETWLGLTSEAVQEVRDHHQETALIEEQIANESSGKQVVGETSVQINCSDGDGLTELEKLLKQKTFTRSEIEHLTELMRSRTVGSSVAEEGMSTEVVPSDPVFPCEQKGEYPKTPGPENGIENQLVSTPYVTKTTSTVSVDDVASPAELAKAYMGSRPSKLSPSMLGLRSSPREDPFLLKNQHVAQKSPIKSIVPKATTLTRVHENGLVTPRSHGRSAIYSMARTPYARVYPGSMLKGAGVAVEGEPSSSACHAIDHDMLSGSKQGVLKRGSSLLGNDIGSFGPIRRIRHKSNLLSAKSLTLPHSGNALAIDRSRVGIDAAQQPSSSMQKPNLLVEAKHRHTNLSAENVDDTMPSSNIPPLPSKSSEMASKILLHLDKLVSPKEKSPTKMSSSMLRGQALRSMETVDSSKFLDNIRDNGLDGSHGNLSAGAQKLKSKIDETESGPSKFVAPTDVLVSVDANTTAPKKQDISIFKSGDSSGTKPVSHPPQKKRAFHMSAPEDYLELDDDAHPNGAVSPFSTSGKETTVSTAVADKTTSGIGTAVLEKPPCSSVLMPSKSFTIDGKPQVRTADGSKVEKKVDVPTSITSSVSDPIFKPISEASNTSLGFNKSTTPNGSVANPPLFNFGNKVVPSMELTAADAPSKYSTKSGPLFGLEKVPLSKEPGADAPLVNSGFNKNGGNVLQVPVTFSSSVGESAVFKFGSSDSKPISSISSTTVPGAVDSMPKALDSDNAGAKTNIIAGFSARLSEPAVSSVASMPSLTSPANLFTFGNNSNQNNGPAASSPTFSSPFPPLTNNFTGQNIFSSSSLAASNSSVSAYVASTSMGMTTSTPAVVAASNSSSSTQVSSSSPTTSFFKFGSTPSAPTSLPVSSSGSEPLENKSGTGIGMFGSSSAAIGSTGSGIFGFSTPAMTTGSSQSLGSVFGTTSGSGTSGFATSSESQSVAFGSSASAPLSGLTGSAAFSSGSSLFSSSSSATNIFNAGTTSGKSTPAASSEANPVSSSGGTSSSVFGLSSWQPSKSPLGSSFSSSSSPSSGFSFGSSFSSLSSSTPGFSFGGTSTSSVTSSSSPMMFGSSAVASTPQFSFTSATATTNTQPAFGSSSPSPGFTFGGSAPAPVNNDQMSMEDSMAEDTVQATPPATPPATPIFGQQPAPLQSNFAFGASASTGASPFQFAGQQNIAPPQNPSPFQASGSLEFNAGGSFSLGTGGDDKSGRKYIKVRHNRSRKK

SEQ ID NO: 170812 - protein, 110 aa, Glycine max
  Coding DNA Sequence Number=SeqID_54034
MKLWLFTDHLIRKQIQVSLLRHQWWKMIEMLTSTTDADDARRWTLEEEEDDSARKKNGCKENARKKNGFVGEIRRIRGRRGCKEEDEREEEEECWVREEERESQMFFFLK

SEQ ID NO: 170813 - protein, 252 aa, Glycine max
  Coding DNA Sequence Number=SeqID_54035
YDEFLEELEPQGRITSLCHLKKILPEKNMELAYTYPREAHHVRHPDVERFPRDTGHHSGGGVPDHIVPMDMDLGSMISSQITYSNSLKLGVPTLITAFYDIKGVILDTLTFESLSPMINLPYIRKNYWNPIDPSTVISGPRRARAHAAPDAPPVIPPSVSSPWPVFSYAKSPSALPLSTSHVARGLPRACSLAWSPAFLYWGVTPLELDLMQDQLVILILQRLVMMMTKLQMSQLPRELGTLGPLGIETTFD

SEQ ID NO: 170814 - protein, 503 aa, Glycine max
  Coding DNA Sequence Number=SeqID_54036
  Homolog annotation: Hit_ID=Q2HRX8; Match level="QueryCoverage=57%, HitCoverage=51%, E-value=1e-28, Identity=31%"; Hit description=IMP dehydrogenase/GMP reductase
  Pfam annotation: Domain name=DUF1723; Domain location=164-213; Score =45.4; E_value=1.9e-10; Accession=PF08330.1; Description=Protein of unknown function (DUF1723)
MSDGFCGTHLQIMVTGRGVGRGDRHDSNDAPQRRQPTAFARRQRVAVTADHVDEPVIPVPDVQDDPMEAPAAVEDIPADIPANAGAEAAEDQPQGFPGGPSDPSVLTAYADHVACSVWTGEERPELKLSSHGRKVHSLGRPVPAIEGLIAGTGLSPLIAYSVDTGDWGFLSAFVERWHRETSSFHLPVGELTITLDNISSLLHLPVIGDFHAFEPLHVDDAVQMLVDLLMVSPEFARAETVQCCGPATNVHVVYLEALRDLSMTERYAWGVAALVHMYDQLNDASMSHSQQLGGYITLLQVDCDKEDREEHLHAVIQGAPGPTPDSGCLLDPVWGASGGPGLPRQIMLFRSLALEACCCLLPTGEDHIVPAGEVCVVLGACSSDYIDWFFRISHPFMTPGHALDPLPHGHAPQPRVVPQAPQTNILSVPEPGASSTFAEESRHAVEVCDDIAERLERHLSLGVVTPDSSTYEVIEKCLRLARSVTQDHLVYVRCRRRWRTDQT

SEQ ID NO: 170815 - protein, 88 aa, Glycine max
  Coding DNA Sequence Number=SeqID_54037
MGNGNLEMSVEDQKVTFNLFEAIKHPSDSKTCFKVEAVEQEADLVVQRFTIHSPFEKALMNAIDFLTNEEDQDLRACLEDLDRLKEFP

SEQ ID NO: 170816 - protein, 41 aa, Glycine max
  Coding DNA Sequence Number=SeqID_54038
MRECGYEILATLTSSRAILRCFSYKLLPSPDLMEQGHPMKF

SEQ ID NO: 170817 - protein, 108 aa, Glycine max
  Coding DNA Sequence Number=SeqID_54039
MMTMIVDTLPVFYYEKMVGYTPSSFDDMVFTDKRIKVGLKRGKSDHHALINAKKKKTGANEEGENEGEAHAVTAIPIQPVSHQPNNVITQLITTLLITHHPVIDKGNP

SEQ ID NO: 170818 - protein, 469 aa, Glycine max
  Coding DNA Sequence Number=SeqID_54040
  Gene Ontology: Mol. function=protein binding; Cellular component =membrane; Biological process=defense response
  Homolog annotation: Hit_ID=Q1SPY2; Match level="QueryCoverage=98%, HitCoverage=22%, E-value=3e-67, Identity=38%"; Hit description =Disease resistance protein; AAA ATPase; Zinc finger, C2H2-type
  Pfam annotation: Domain name=NB-ARC; Domain location=1-157; Score= -121.1; E_value=0.014; Accession=PF00931.13; Description=NB-ARC domain
GCGVILTTRSREVCISLQCQTIIELNLLAGDEAWDLFKLNANITDDSPYASKGVAPKIVDECRGLPIAIVTVGSTLKGKTVKEWELALSRLKDSEPLDIPKGLRSPYACLGLSYDNLTNELAKSLFLLCSIFPEDHEIDLEDLFRFGKGMGLPGTSGTMEKARREMQIAVSILIDCYLLLEASKKERVKMHDMVRDVALWIASKTGQAILASTGMDPRMLIEDESIKDKRAISLWDLKNGQLLDNDQLNCPSLEILLFHSPKVAFVVSNACFERLKMIKILAFLTSSYTWWPWGTDGILSLPQSMESLQNLHTLCLRGYKLGDISILESLQALEVLDLRCSSFIELPNGIASLKKLKLLDLFHCSIQENNAYEVIGRCMQLNELYLYIPSYANEEFPHNISFSRLERYVLIFKMDPSYWRSWSWMEILEEHRPCRALCIDGFNASVQSFISLPIKDFFQKAEYLHLKNP

SEQ ID NO: 170819 - protein, 118 aa, Glycine max
  Coding DNA Sequence Number=SeqID_54041
  Homolog annotation: Hit_ID=Q2HTB8; Match level="QueryCoverage=81%, HitCoverage=42%, E-value=2e-28, Identity=64%"; Hit description =Harpin-induced 1
MYDVAPHSSPPNLPYHTPSHVLLPPLHQEKRSSVSMSPLIEGMPLSVLVEVSHWLALDEAYGVVGLRLIFQGRVRLKAGAIKTAHYRFYVKWDVLIGLKKGLVVQVPLLGVTPCDVDQ

SEQ ID NO: 170820 - protein, 338 aa, Glycine max
  Coding DNA Sequence Number=SeqID_54042
  Homolog annotation: Hit_ID=Q84WU6; Match level="QueryCoverage=28%, HitCoverage=16%, E-value=3e-32, Identity=66%"; Hit description=Auxin response factor 17
MTTTKLGFIHKNDIHATNQIGIIIFSQKTKVYRQCYEEEETLSTVNARKKKLSTLEDDTGEGFAGATNLGDVRDGGEVSSVLQREGVLDENDGVANDKLLVVEELAPAGGEEVATWRAAVDVVEAPLNAVDVGDREELDRWIGIKVEWREAQVGAKARHGEATAVVGVGGSEDLHKRNDAVVLARGVRRNLAGDKGERADKRVVVMRGRGMLHVTLGLGEAIAREVLDAAAPIIQSSVTTDEIDRVVHAATITAEATPSVTFENVVKEHKFAATHTHSLKSVVEKTITLGKLEVCLELRYSVLCIQAVRTTLRMLEDGHNIRDAEAVCVPDVLNQIFK

SEQ ID NO: 170821 - protein, 293 aa, Glycine max
  Coding DNA Sequence Number=SeqID_54043
MATSTPSFASPGVEAATKPKALLQRVVVVEREPHDEQVPEIEATIENEMNENKLGVLWPSLPLTEDVMESLTKHIAVNMVQSPNASHGVMGLEQEPTNIVKVVKMVEEDAAINSNNGNTEIPTTNVGNMEGNIVAHQSQGRGVGGSGTRPSQIEGDDAMENESEVASQLGELGPIEGVLFFFCLFARKSRLWEESNQVNKRLGLNGYFIEEAQGHMGEFGAFGTLVKWKTGDDRLLKVVYGRPRYQHHQSLWDTLVDIATDVEGVSQPTLWQKGDMRLTGASSKERKRTESPP

SEQ ID NO: 170822 - protein, 115 aa, Glycine max
  Coding DNA Sequence Number=SeqID_54044
MKTIGVVIVIITMLGFTQADHYNPSYVQVEPNSESNGISCKTICKLECAPLVIIAQLYLKCVKDCSAKCLTKSIVAANDCMTSCGLVKSINVNNDVRDRTTYVVNSCMQECLNKK

SEQ ID NO: 170823 - protein, 97 aa, Glycine max
  Coding DNA Sequence Number=SeqID_54045
MNLGIPRSCGSACHRSLGTRISFLNDHLEEALGSTKIEENHSKCINLTQGKDYGELGFWLKACRTVGHDTCQDLASGLGIKGMSPHYSHDTHATNDY

SEQ ID NO: 170824 - protein, 112 aa, Glycine max
  Coding DNA Sequence Number=SeqID_54046
MGAKHLARTKEKSHVIKQRSPDEIRNAKLAVYYPDEHQTPTDTTQHDQFVGYDSSDSSDDDVNMTQENIDIEYSLNDPTIDDLDDYDEQTFLSASSAYQNTGGTYIDIGDPI

SEQ ID NO: 170825 - protein, 60 aa, Glycine max
  Coding DNA Sequence Number=SeqID_54047
MHVAFNEEALWCATAIVTSVCGIAGEGDASNTKTCSEKNINECLMSTPTLPSWPQDAGIL

SEQ ID NO: 170826 - protein, 57 aa, Glycine max
  Coding DNA Sequence Number=SeqID_54048
RDGELRKGFQGSEGEEIERREKEEEERRGNEVEALPNRDCDQSLRCSLFGVLRATID

SEQ ID NO: 170827 - protein, 159 aa, Glycine max
  Coding DNA Sequence Number=SeqID_54049
  Gene Ontology: Mol. function=DNA binding
  Homolog annotation: Hit_ID=Q1S0F5; Match level="QueryCoverage=97%, HitCoverage=37%, E-value=2e-12, Identity=36%"; Hit description=IMP dehydrogenase/GMP reductase
MGLSQVPSLKKRFYQVKVKSLGIASLKELGQLMGQLQRQAFRKAYGNIWDLTMVEVSTEAIASLAQYYDQPLRCFTFGDFQLAPTVEEFEEILGCPLGIRPREASQKWGSWGTKEMFGSKGESLGKSRRRGPVHGHLGTFDLRGGPLSKYGWVSGPGSD

SEQ ID NO: 170828 - protein, 119 aa, Glycine max
  Coding DNA Sequence Number=SeqID_54050
MSQRKDKELRGSSNGPIGGYHRWLKAYAQDLDWLPSLRTTKGMEIETPEKDEETVKEKFKSVAVRIRKENAKLRDNIATTKALEQKTKRARKEEHGRNKFRGALWGSNSELKLQRKGRD

SEQ ID NO: 170829 - protein, 164 aa, Glycine max
  Coding DNA Sequence Number=SeqID_54051
MGDLEEVQKQMKLDMLAFKEQMASMMDAMLGMKQLMESYMAIAAAVSSAAEADPTLSTTAHHPIPNMVGREGSTSRHINNPHSWYNRGTYPYGLPPNYTPPAIHEDVGHVPTLILEGEPPRHPDGVHENPQEHAQGDINSYCRSKASWKQPGSPGRAELAQASQ

SEQ ID NO: 170830 - protein, 110 aa, Glycine max
  Coding DNA Sequence Number=SeqID_54052
MSRNFTDCAIMLPFDFQHVTELHELPNDGCQGAMGPVKLSDRPDHEVMWDATMFGVFNQDFPLYIKHEDLLKIAHGGQCLSISVIQLWILHLTETSMRAGNSDLYGFLEP

SEQ ID NO: 170831 - protein, 84 aa, Glycine max
  Coding DNA Sequence Number=SeqID_54053
MDGQAPTMFILEGALTNRPLGLDGKDFNYWKEECGIAQEFWNTLRTTQEGTNQIHEHKSIEEMSNKFTTIVNEWNALGEKYPTH

SEQ ID NO: 170832 - protein, 188 aa, Glycine max
  Coding DNA Sequence Number=SeqID_54054
  Gene Ontology: Mol. function=alcohol dehydrogenase activity; Cellular component=membrane; Biological process=electron transport
  Homolog annotation: Hit_ID=Q9RH53; Match level="QueryCoverage=97%, HitCoverage=44%, E-value=2e-24, Identity=35%"; Hit description =Cytochrome c subunit II
  Pfam annotation: Domain name=Cytochrom_C; Domain location=49-135; Score=25.2; E_value=0.00024; Accession=PF00034.11; Description =Cytochrome c
MAEAVEHSLRFLSDDDLDAIADWLKQTPPIATAQGTKAAYAYQGGGEGRAAGQALYAAACASCHRLGGEGAYDGHFPSLTHNSTVGSEQANNLIMVMLHGVQRQGETLQTWMPGFADSLDDRQLAELGNYVLQQFGNPAVRITPEQVAQLRAGGEKPWLIASLPYVFWGGVLLALIVIGAWVKRRVKR

SEQ ID NO: 170833 - protein, 126 aa, Glycine max
  Coding DNA Sequence Number=SeqID_54055
MKEEQEKEKEKNQKNEKEKEKVDEEKKKRKSEVSREKKREITSAEGKEVPYPLVPSKKDKERHLARFLDIFKKLEITLPFGEALQQMPLYAKFLKDMLSYPNFVGGPSVVRMRPSFDHFEVFDTHR

SEQ ID NO: 170834 - protein, 252 aa, Glycine max
  Coding DNA Sequence Number=SeqID_54056
  Homolog annotation: Hit_ID=Q1SKD7; Match level="QueryCoverage=88%, HitCoverage=56%, E-value=1e-07, Identity=22%"; Hit description =Ankyrin
MASKKRKAPATPSQVRYEQSRFTSPEAWESYTDILVPRKLLPERNVVIYHTEFDEFKEELERRKWDEELTSFDESPKQVMVRGHLVIFWKEFYANIYDPEDKSPKQVMVRGHLVKFDVDTLNTFLKTPVIIEEGEELTAYSRFALLRLDPQELAAKLSIPGRGFELNVDGLPLKILRKNITIHAQTWSVLSYSNLVPTYHTFDITLDWAKLIYGIIMKMDMNMGYLISHQISIIAQHDSSRLGFPSLNHNFV

SEQ ID NO: 170835 - protein, 75 aa, Glycine max
  Coding DNA Sequence Number=SeqID_54057
  Subcellular localization annotation: CTP_CleavageSite=65; ConfidenceScore=5.45e-01
MWDRHRLKGALKPGVFTPKAYTPKSLSGSLPPHSVIPSQYSSRINSSPSKGLSINSSPLKDLSINSSSLKGFIVV

SEQ ID NO: 170836 - protein, 92 aa, Glycine max
  Coding DNA Sequence Number=SeqID_54058
MTRGNPDDLQPFDPEIDRTFQRLVRHSEDPHKHLKEFHIVCSTMKPPDVQEDHIFLKAFPHSLEGVAKDWLCYLAPRSPPKSMSFFAAIWSQ

SEQ ID NO: 170837 - protein, 45 aa, Glycine max
  Coding DNA Sequence Number=SeqID_54059
ESSRASASRPRTKREISTLSAVGVFSQAQCKTGAKCEGGAKGCFP

SEQ ID NO: 170838 - protein, 69 aa, Glycine max
  Coding DNA Sequence Number=SeqID_54060
  Subcellular localization annotation: CTP_CleavageSite=38; ConfidenceScore=5.02e-01
MSYPNFIWGPLFGGMQPLLDRFEQPGPLGPFGGSNRRRCLLVEATQLAWASWVATTSLFFPINRGNRAE

SEQ ID NO: 170839 - protein, 96 aa, Glycine max
  Coding DNA Sequence Number=SeqID_54061
MIQEKKMKKKNKEKAQQWEKCSQVEIQQESILQVNTPPHQLIAKEERHGKHEKVISVILSLITSTSLAMIWKVFPKYMSFMESLLRGENARKMCSL

SEQ ID NO: 170840 - protein, 190 aa, Glycine max
  Coding DNA Sequence Number=SeqID_54062
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=14%, E-value=2e-57, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNGNGGFNTHLPVFDGKNWNRWSIQMRVLFGAQDVLEFVNDGVPDLAENATEAQRNLHREKKKKDQKALFYIHQCVDAKIFEKIAESTTAKAAWDTLVRCYGGDATVKKVKLQSLRKQYENLNMKHNEKVADYVSRIITVTNEMKTCGETISEQMIVEKVLRSLTAQFDHIVVAIEQSKDTSTMKIDELQ

SEQ ID NO: 170841 - protein, 116 aa, Glycine max
  Coding DNA Sequence Number=SeqID_54063
  Homolog annotation: Hit_ID=Q111J0; Match level="QueryCoverage=58%, HitCoverage=23%, E-value=2e-08, Identity=42%"; Hit description =Glutathione S-transferase-like
  Subcellular localization annotation: CTP_CleavageSite=10; ConfidenceScore=5.04e-01
MAMKRQKFRRSSSGGYSCPASKFHFSSTIPSPGSFHLYVGLACPWAHYTLIIHTLKGLEDAMPVSIASSDLNGSWEFKRPLRVSRVDRGDMVERKEVRLIVYWCVGMNPDKMKCFN

SEQ ID NO: 170842 - protein, 233 aa, Glycine max
  Coding DNA Sequence Number=SeqID_54064
  Gene Ontology: Mol. function=metal ion binding; Cellular component =integral to membrane
  Homolog annotation: Hit_ID=Q8L8R1; Match level="QueryCoverage=93%, HitCoverage=88%, E-value=2e-76, Identity=62%"; Hit description=RNA -binding protein-like protein
MAMASDCPRESDGASIQMRLSYSPAAQFFLFLVQWTDCHLAGVLGLLRILIYKVYEDGKTTMSIYEKKASLKEFYGVIFPSLLQLHRGISDVEERKQKDLCATKYKPRDIIRRGKSSEIDIEREEECGICMEMNNKILIDAQDHVVVGYKYNRRRHARSQSCPFCRDTLQRVNSGDLWIYMNSNEIDDLASINKENLKGLFMYIDKLPLIVPDPIFMSYPQRFRFFPNQFGSA

SEQ ID NO: 170843 - protein, 77 aa, Glycine max
  Coding DNA Sequence Number=SeqID_54065
MKLQKKGKIKWLSCYEAYGGGGMTRYEKTRMSQVSLWLGGGGVTRSFPRGGFVIDRINCKRKEISNDYLAMKHMEEE

SEQ ID NO: 170844 - protein, 82 aa, Glycine max
  Coding DNA Sequence Number=SeqID_54066
  Gene Ontology: Mol. function=transferase activity; Cellular component= cytosol; Biological process=glutamine metabolic process
  Homolog annotation: Hit_ID=Q1SPM3; Match level="QueryCoverage=84%, HitCoverage=20%, E-value=1e-14, Identity=67%"; Hit description=SNO glutamine amidotransferase; CobB/CobQ-like glutamine amidotransferase
MVVLSPPGIMRELIVLSCSGFRISTPCTPNLLRAAIKNKRVVEKRKKGKMNVPAMCSLKDPCSARTPTTAMLGRVEKEIAAF

SEQ ID NO: 170845 - protein, 58 aa, Glycine max
  Coding DNA Sequence Number=SeqID_54067
MSFYGKGKCYNARGISLSSAIISQFPTVRWPAGKREGFGRRGKIEIVRQRKLRSQSKN

SEQ ID NO: 170846 - protein, 74 aa, Glycine max
  Coding DNA Sequence Number=SeqID_54068
MAAPDLPYTWLSGPLKNDLYSLRIDESKEHHLDEDALIPHNVAPCRACRPWIFFINEVLFFLKINDNGMEKEGR

SEQ ID NO: 170847 - protein, 201 aa, Glycine max
  Coding DNA Sequence Number=SeqID_54069
  Homolog annotation: Hit_ID=Q84VH5; Match level="QueryCoverage=85%, HitCoverage=29%, E-value=8e-74, Identity=73%"; Hit description =Envelope-like protein
PTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGIDDGEAAEEEEDATEDTESDDDDSDATP

SEQ ID NO: 170848 - protein, 221 aa, Glycine max
  Coding DNA Sequence Number=SeqID_54070
  Gene Ontology: Mol. function=DNA binding; Biological process=DNA integration
  Homolog annotation: Hit_ID=Q1SRA3; Match level="QueryCoverage=86%, HitCoverage=29%, E-value=1e-27, Identity=36%"; Hit description =Integrase, catalytic region
MEDMEWQEALNVKRTKLQDKSEVMVLIGYHSTGGYKLYNPKLKKTCISRDLLIKEDESWDWEIGEVKFKAAPEIDICSDSESDDHSAAEVNNDGVNGVVAPNDDVPGDVVHDVPATPAVRPQRQKQLPRRLQDCEVLPDSAVTDEGDLIHFALLADAEPVNFTEALKISEWRAAMEDELRSIERNHTWDLVQLPKNKKPISVKWVFKLKLDPEGRIVKHKG

SEQ ID NO: 170849 - protein, 308 aa, Glycine max
  Coding DNA Sequence Number=SeqID_54071
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=4e-36, Identity=30%"; Hit description= UPI00006A17C9 related cluster
MYSISEDYMSSTSEDYTFSPLEDYMSLPYEGYTASPFEDYTPSPSEDYTGLHNLAFRGLDALAFRGVHILPLRGLHALAFVGLHTLTFKALHILNFRGLYIVTIRGLHVLAFRGLHVLPFRGQHDLPFRGLHALALTGLHVLTFRGLHNLAFRGLDALAFRGVHILPLRGLHALAFVGLHTLTFKGVHVLNIRGLYIVAIRRLHVLAFRGLHVLHFRGLHAHTFKGYLHRTTRPWLRKASRPHLQRTTHARLQRTTRLCLRRATRPHLQRTTHPRFLSDTCPRLQRTTRLTFQGSARPCLQWATRPCL

SEQ ID NO: 170850 - protein, 209 aa, Glycine max
  Coding DNA Sequence Number=SeqID_54072
MEDLLVKDLFYFDYTVNPVVIRRESHHRSQQTSSQKSLPTHQARKVIDIEVVGGVVKLSGAGGVVGIVRKRGKKGQCITRLLVVMKSMTLVVSLTALRTSAQMQIGIIGNDLKLEHGGFISSSEHTKMRKKLEPTSTPTPTVRSSNSKSSTLSNSLKIVYVNLRKFLFLTSLIKANGERLYNGEVQRRNDGHGGTAGSLIKSQRGATKG

SEQ ID NO: 170851 - protein, 616 aa, Glycine max
  Coding DNA Sequence Number=SeqID_54073
  Gene Ontology: Mol. function=RNA-directed DNA polymerase activity; Cellular component=chromatin; Biological process=chromatin assembly or disassembly
  Pfam annotation: Domain name=RVP_2; Domain location=101-225; Score= -43.9; E_value=0.0027; Accession=PF08284.2; Description=Retroviral aspartyl protease
  Pfam module annotation: Pfam domain module=RVP_2::RVT_1; Domain location=101-225::259-453
VPQSSLTYHDLTVTIHWGGSSKSLSSLIIKEHQRKTASSSHPFILTAWRLAGSNGCIEMASSYSDESSTSNTIFIEAPSQSIEETISPFDPTPLHPHISLHAMAGVPATDTFRLYGVINHARVTILVDSSSMHNFIQPRVAKFLGLSMEETMPLQVMVGNGSVLECRQLCPATTLLIQDHSFTVTLRVLPLSGADIIFGIEWLHTLGPIITNYTSFTMQFTHLGQPISLHANVHTNTDPTSAHQHKHIIHTHSVSGLFHLSLLPVNLPEPNTDPPHPIPAINELLLKFQTIFQQPTTLPSPQQHDHHINLIPSAHPVNVRPYRMACARRMCVDYRELNSIKVRDRFPIPTIEELLDELGRASWVMPFGLCNAPSTFQAAMNSLLSPFLQKFVAVFFDDILIYSGSLPDHLHHLECIFHALSGVQLDPSKVQAVVDWPTPHSPKDLRAFLGLTGFYQKFVKGYASMSAPLTKLLCRDAFHWVPESQAAFDTLKNAMTATPILTLPNFALPFVLEMDASGIAMREVLQQKGHPIAFFSKPFCLHLQHASAYVRELHAIIAAVRRPPEPPGTYVSGGSEPEQQFYLAKLLGFDYDIQYKAGSLNVVADSLSHIDSSTSG

SEQ ID NO: 170852 - protein, 100 aa, Glycine max
  Coding DNA Sequence Number=SeqID_54074
MEAHALVARLIEKDLQFPFMAVLISESGVRTREERGREVHFSGTFSEWRRGRRGEERYICQMKIARLFPGLGKDRRGHGRIQASRSPAGDIFTVMVIEVT

SEQ ID NO: 170853 - protein, 63 aa, Glycine max
  Coding DNA Sequence Number=SeqID_54075
MSLNQVLVKRKKAEWCDKNTEIMLKVCIEELIGKDTGLGWDGEKKTIAASDEWWEAKIQILDL

SEQ ID NO: 170854 - protein, 203 aa, Glycine max
  Coding DNA Sequence Number=SeqID_54076
  Gene Ontology: Mol. function=RNA-directed DNA polymerase activity; Biological process=RNA-dependent DNA replication
PLQCTGCSAFHLPQFVLRKINAICRSFVWTGKQEISKKSLVAWDTMCRNKSQGGVGIINLQGNDAITAFVRPNSSWILKNIMNQRDKLGQIQQHWDQALSRQKFPMSAMYHGLTEDHQRVPWRSVMCGNKARLRAVICLWLACHKKLSTKDRLRRFGMIKSSDCSICNCADESINHLFFNCSGTREIWGNILDWLGRRHDPRE

SEQ ID NO: 170855 - protein, 262 aa, Glycine max
  Coding DNA Sequence Number=SeqID_54077
  Gene Ontology: Mol. function=RNA-directed DNA polymerase activity; Biological process=RNA-dependent DNA replication
  Homolog annotation: Hit_ID=Q1RYS5; Match level="QueryCoverage=36%, HitCoverage=56%, E-value=4e-10, Identity=38%"; Hit description =Peptidase aspartic, catalytic
MIQKAIDEGRLKFEEKPMQVDIDLFQVQTNYVEPIQILMVGASIGMSKVKIALFEYEDNQALVEIKKEEEYVSPLVGETLIEFLTKKQKAGKKGDALALMITKDPPSFQKKIPTKVGEENEVVTNCFESRDYAREECFEDPSLSPKVVWVTQVSCFTPHHNVVVFDLPTDEMKCHIKPLHLTAMVEYQIINKILVDGGVAINILPKSMLTRFGKTVDDLIPHNIVVSDFYGKTYGLDEVIFSDEFMDFFAWDYEKWLDSVEI

SEQ ID NO: 170856 - protein, 137 aa, Glycine max
  Coding DNA Sequence Number=SeqID_54078
MCFVCGDNNGDGGGVSSNSDRDANGGCGGSSDIGNGDGCVSNADGVDDDGGHGISVDGDSRGGICGSSDDNDGDGDNDGGDGGDLVVVVVVVALVVVVIVVVIWWLGGGGDYGDSDGGGDSEDLGSSDDDSDSNSER

SEQ ID NO: 170857 - protein, 118 aa, Glycine max
  Coding DNA Sequence Number=SeqID_54079
  Gene Ontology: Mol. function=protein serine/threonine kinase activity; Cellular component=integral to membrane; Biological process=protein amino acid phosphorylation
  Homolog annotation: Hit_ID=Q9ZQC2; Match level="QueryCoverage=65%, HitCoverage=8%, E-value=8e-29, Identity=78%"; Hit description =Putative receptor-like protein kinase
MDWIGHGGSDGLHGYVPSLDHVVVDTVLSSKTCPLTHGWSINWMKHLEIAEDFTKGIEYLHMGCVHPVIHRDLKNNNILLDKQMRAKVSDFGLSKLAVDGASHVSRIVRGTVGYLDPK

SEQ ID NO: 170858 - protein, 225 aa, Glycine max
  Coding DNA Sequence Number=SeqID_54080
  Homolog annotation: Hit_ID=Q1SKD7; Match level="QueryCoverage=66%, HitCoverage=39%, E-value=8e-12, Identity=26%"; Hit description =Ankyrin
MGSSAASEFDSHRFRCVKHQQCFEAIKGWSFHRERRVQLREDKYPDFQGDISRRHWARLVTPMAKFDPEIVIEFYANAWPTEEGVRDMRSRVRGHWVPFDADVSSQFLGDPLILKKDQQCEFSQRRSQADGFDEEAIAQLLCIPGQDFARIAAGRQMSVHMPQVIADAIYLFAGIAPTRHPLDPEKSNRALGFPALITGLCQSYGVPITPNKVIRPLITRAFIEK

SEQ ID NO: 170859 - protein, 318 aa, Glycine max
  Coding DNA Sequence Number=SeqID_54081
  Gene Ontology: Mol. function=protein-tyrosine kinase activity; Cellular component=chloroplast; Biological process=protein amino acid phosphorylation
  Homolog annotation: Hit_ID=Q8LEG7; Match level="QueryCoverage=100%, HitCoverage=64%, E-value=1e-149, Identity=81%"; Hit description =Protein kinase-like protein
  Pfam annotation: Domain name=Pkinase; Domain location=59-310; Score= -1.5; E_value=1.8e-08; Accession=PF00069.15; Description=Protein kinase domain
  Pfam annotation: Domain name=Pkinase_Tyr; Domain location=72-310; Score=-37.3; E_value=3.5e-10; Accession=PF07714.7; Description =Protein tyrosine kinase
  Pfam module annotation: Pfam domain module=Pkinase::Pkinase_Tyr; Domain location=59-310::72-310
MGARCSKFSFCWFHSHLKPSVLESSDQENGEKGERKLWPSFGEFNLEQLKVATNGFSSENIVSEHGEKAPNVVYKGKLDNGQWIAIKRFNKFAWPDSRQFLEEAKQVGSLRSERLANLVGYCYEGEERLLVAEFMPHETLAKHLFHWEAQPMKWAMRLRVAFYLAQALEYCTSKGRGLYHDLNAYRILFDQDANPRLSCFGLMKNSRDGKSYSTNLAFTPPEYLRTGRVTPESVVYSFGTLLLDLLSGKHIPPSHALDLIRGKNFLMLMDSALEGHFSKDDGTELVRLASRCLQYEARERPNAKSLVASLLSLQKETE

SEQ ID NO: 170860 - protein, 210 aa, Glycine max
  Coding DNA Sequence Number=SeqID_54082
  Gene Ontology: Mol. function=RNA-directed DNA polymerase activity; Cellular component=nucleus; Biological process=RNA-dependent DNA replication
MATSYYKDLFKDLGIFDEEIHEAIRRMMGFKAPSLEGLQTIFYQSQWSIAGLALCDLIHMMEDNIGDIADVNETFIMFILKVDNVTFSKHMRPIGLCNVSYKVLTKVLAHSLKTVMETWLAPNQCSFVPQTKPMTYLIGTLLEDALGYLSSSFLHLIGFGFINTPKMRMLWNNEVLDEFEPSWGKQQGDSISLYLFVLSSMDQVDIIQIA

SEQ ID NO: 170861 - protein, 59 aa, Glycine max
  Coding DNA Sequence Number=SeqID_54083
MFGNEFRTWCSNFTTIQRFDGIRENERVLGGGEEKTKVRGRGGVEGIVSLKTDLRCPYL

SEQ ID NO: 170862 - protein, 120 aa, Glycine max
  Coding DNA Sequence Number=SeqID_54084
MPTRSQPRVTKVWISTGGKNPQEERVKETPYGGANMSKNKQVVSHGVNAMKSSPENIEKDSAKWSLEVLEYSNHFFHFKVTQGVVSWLWTIVYVSPHSQFKVHLWRDLRGIVDHVTYTRA

SEQ ID NO: 170863 - protein, 97 aa, Glycine max
  Coding DNA Sequence Number=SeqID_54085
  Homolog annotation: Hit_ID=Q10LA0; Match level="QueryCoverage=84%, HitCoverage=9%, E-value=4e-16, Identity=74%"; Hit description =Adapter-related protein complex 1 beta 1 subunit, putative, expressed
MVAANVVAELAEVQENSCSPIFEISSHRLSKLLSALNECTEYKAADTREAENIVERVTPRLQHANCAVVLSVVKVVFSFYPMSPYVSDNPSANGAYH

SEQ ID NO: 170864 - protein, 188 aa, Glycine max
  Coding DNA Sequence Number=SeqID_54086
  Homolog annotation: Hit_ID=Q1SKZ9; Match level="QueryCoverage=44%, HitCoverage=16%, E-value=3e-10, Identity=36%"; Hit description=Zinc finger, CCHC-type
MGKGSKKMREKTNSIRISELSPTKDDILSIGVKKKVKTKDINALVKEAMTEQLVAKGVVEEVSMTEQPITEGGVEERYKIPRRNYFKEREIIDDMGKDLDPCPTIPITAEEFEEWREPWKNTLIVNVLGKRMSYKMMENKLQRHWLKTGSIRIVDLPQDYFLVPFIVVEDYRHATFEGPWMLADHYLL

SEQ ID NO: 170865 - protein, 103 aa, Glycine max
  Coding DNA Sequence Number=SeqID_54087
  Gene Ontology: Mol. function=protein serine/threonine kinase activity; Biological process=protein amino acid phosphorylation
  Homolog annotation: Hit_ID=Q8GRZ5; Match level="QueryCoverage=57%, HitCoverage=21%, E-value=4e-21, Identity=79%"; Hit description =Phosphoenolpyruvate carboxylase kinase
MEVGESTKEKVDDASPSQNETLVTEVNASQLSTDNADLYGPWMIPDNIVFDSANNLNLIDFDLVEWFRDGKSMSNVVGTPYYVTPEVLLGREYDEKVDVWSYG

SEQ ID NO: 170866 - protein, 180 aa, Glycine max
  Coding DNA Sequence Number=SeqID_54088
  Gene Ontology: Mol. function=nucleic acid binding; Biological process= DNA integration
  Homolog annotation: Hit_ID=Q1S9I4; Match level="QueryCoverage=82%, HitCoverage=13%, E-value=2e-12, Identity=28%"; Hit description =Integrase, catalytic region; Zinc finger, CCHC-type
  Pfam annotation: Domain name=zf-CCHC; Domain location=39-56; Score =12.8; E_value=0.0076; Accession=PF00098.13; Description=Zinc knuckle
MMISGSFVKRLNKFLRNKENQRRSNVKPKKRGEDSSFVPKYYECNQPGHLRVDYPSSKKRMERSERKTFNDKKANKAYITWEDNNMDSSEDSENDVMNLSLMEKNCESEEEDTLKKSWYIDSRYSKRTMGDASKFTYISPKNSGHVTYGDNNKGRILGVRKLDKTSDHDQCFLCKDDDSW

SEQ ID NO: 170867 - protein, 368 aa, Glycine max
  Coding DNA Sequence Number=SeqID_54089
  Gene Ontology: Mol. function=nucleic acid binding
MWKITLVLHHGGIFTKNEADGKLEYVGGELDVWDKIETNYLNFFLLTNLVKHCRKYNNVGDIHWVVDKEVDLEEGLRVCETDFDIQDMVISARHNGDEVELYYDHKVDEQPILFEADVPEDGLSNLNPIPEVEEEGDKDDGDVGIDDNNGVDVNTNGEEQEDIASEEHDDIDGDEDVDVDVRVGREWWSDIPEYNDEVQEDEAEPVGYESEKLDSPRSSNDEGGFEKEVFPQFNECSKFGNVLEVGMEFSNLEIFKETVRDYTIELGRDIKWKKNDAIRARAKCREPECDWEIFCISACFISNSDEMEFEDVVSAIDEDQLLQPDQLYFALPLSLLRHPLQPHEMAALAIKASSALMKTTDKCGSRRK

SEQ ID NO: 170868 - protein, 97 aa, Glycine max
  Coding DNA Sequence Number=SeqID_54090
MRLNDIVPVQLRWFNARRPNAVKNKTLASTGKHRLHQVTKSGNHHHWESDDRREPSTGTLSFNHRREKMVALNMPHHTFTNDVRRLLTAGTNVTNRV

SEQ ID NO: 170869 - protein, 175 aa, Glycine max
  Coding DNA Sequence Number=SeqID_54091
  Gene Ontology: Mol. function=enzyme inhibitor activity
  Homolog annotation: Hit_ID=Q1S1D0; Match level="QueryCoverage=83%, HitCoverage=84%, E-value=2e-29, Identity=44%"; Hit description =Pectinesterase inhibitor
  Pfam annotation: Domain name=PMEI; Domain location=23-166; Score =13.4; E_value=0.0011; Accession=PF04043.6; Description=Plant invertasepectin methylesterase inhibitor
MNSSTLFLLSFTLSLILISPLPTLGTSLYESLCDNAGVDKARCLEVLKGEPQIVGAKDSVELCKLVLELGLKKGLEAQTFLKEAMKTNPSPAIMQCATTLYDGTIGSFKSSLGELSEDGLTANYDAKVAGDGPTTCDTALSNANIINPSISALNKDILLISKLAYLATDNLPDNP

SEQ ID NO: 170870 - protein, 52 aa, Glycine max
  Coding DNA Sequence Number=SeqID_54092
MVLFSCKILIGLFMQAAKILANLIVMGGGILARAVVQAYRQALTKLVAKSVV

SEQ ID NO: 170871 - protein, 50 aa, Glycine max
  Coding DNA Sequence Number=SeqID_54093
MANARVPIWELLELFSASNTVRCLENSGTGTITKLDIMKVDLGTDFSLSP

SEQ ID NO: 170872 - protein, 93 aa, Glycine max
  Coding DNA Sequence Number=SeqID_54094
MATTRQWPLHQLDIKNAFMHGSMGCFKRIREIPKSLDIVTLIHWRDATVTGDLLLDIVYLHWREHYLLEELEQNFVARSSAEAKYRAMVIATS

SEQ ID NO: 170873 - protein, 111 aa, Glycine max
  Coding DNA Sequence Number=SeqID_54095
MVMTMEMKMILRQTLKMMTMMKRRRMTRLNVISISSPVDIRIFDTIEDVSRLHFCDKETTYKFYCWGYDKVGFIKKDIYYQDMRNMWLTTSDATGVLKYLRQLCDELSSVW

SEQ ID NO: 170874 - protein, 83 aa, Glycine max
  Coding DNA Sequence Number=SeqID_54096
MEDGVSLKEMYPRLYQISQQQNQHIQQMGTIAGIGWEWKLQWKRFFLEAKIDTVAKFMEDLQRSHDENEAHLFFTCANILPLW

SEQ ID NO: 170875 - protein, 375 aa, Glycine max
  Coding DNA Sequence Number=SeqID_54097
  Gene Ontology: Mol. function=zinc ion binding; Cellular component =integral to membrane; Biological process=behavior
  Homolog annotation: Hit_ID=Q1RYL8; Match level="QueryCoverage=92%, HitCoverage=81%, E-value=1e-158, Identity=78%"; Hit description=Zinc finger, DHHC-type
  Pfam annotation: Domain name=zf-DHHC; Domain location=75-139; Score =122.4; E_value=1.3e-33; Accession=PF01529.11; Description=DHHC zinc finger domain
MVGADVRLGFIGMRGCLGKNPVLILLFLTSSRDPGVIPRNLHPPEEEFRYDSSVSVEIGGRQTPSLQFPRTKEVMVNGHSVKVKYCDTCMLYRPPRCSHCSICNNCVERFDHHCPWVGQCIGLRNYRYFFLFVSSATILCIYVFSISAFYIKVLMDHYKGTVWKAMKESPASVILMAYCFISLWFVGGLTGFHLYLIGTNQTTYENFRYRADNRINVYNLGCFNNFLEVFCTKVKPSRNNFRAFVQEEVPRPPPPVISREPEPDLGGGDPRSKVEDDLDIGEDLLKISQRRNIEEIDEDIRSRGSNGPPHNTSEVDSVLGSDRRAPTIRSEARHSSEGRSESWEIGSEVLANSTVTESRSYVVSKEVRQKLGGSF

SEQ ID NO: 170876 - protein, 49 aa, Glycine max
  Coding DNA Sequence Number=SeqID_54098
MKNKIGSGAQQSGKPDPQARTGMSLIFGPDRDQGRKRGELGELGWEYRD

SEQ ID NO: 170877 - protein, 142 aa, Glycine max
  Coding DNA Sequence Number=SeqID_54099
  Homolog annotation: Hit_ID=UPI000044A741; Match level="QueryCoverage =30%, HitCoverage=11%, E-value=1e-08, Identity=70%"; Hit description =PREDICTED: similar to Ac1147, partial
MGGGAWPFLVGGAICLIIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSTGATET

SEQ ID NO: 170878 - protein, 105 aa, Glycine max
  Coding DNA Sequence Number=SeqID_54100
MGLRIRWWRMHEHRKAINSWGSGLNVGGCMNDIQFMGLRIRFDDRQCMNSSWQSIHGATNKMVEDARKLLGNQFVVLRIRFDDGGCTNNSRKSIRGASDSMVEDA

SEQ ID NO: 170879 - protein, 98 aa, Glycine max
  Coding DNA Sequence Number=SeqID_54101
MSNRLQEDWARAIEEGLMILINLRGLSQPTLLRASEARLVGAFSKGGKCTESPPTFICGKRQKNRRKPVIKNIPDSGVVFTFEEGISTSHVCPKGQQP

SEQ ID NO: 170880 - protein, 110 aa, Glycine max
  Coding DNA Sequence Number=SeqID_54102
MLATGNRLLSSGNGLPENIPSTIWAPLSGQLLKVDKSVLELQDEKAQSLILLSLFDEVLYELSKEKIAFVLWLKLEKLFLRKSIYNKLVLKPYLFGLRMRKRKSTKRTSL

SEQ ID NO: 170881 - protein, 161 aa, Glycine max
  Coding DNA Sequence Number=SeqID_54103
  Gene Ontology: Mol. function=glutamate-ammonia ligase activity; Cellular component=chloroplast; Biological process=nitrogen compound metabolic process
  Homolog annotation: Hit_ID=Q9AWA8; Match level="QueryCoverage=60%, HitCoverage=20%, E-value=7e-40, Identity=77%"; Hit description =Glutamine synthetase GS2
  Pfam annotation: Domain name=Gln-synt_N; Domain location=36-120; Score=58.9; E_value=1.6e-14; Accession=PF03951.9; Description =Glutamine synthetase, beta-Grasp domain
LRSLSQHIGGYILCGTSRGYIYLGSTENRRGYISCGSVLVEGTSTRFKENKGGYIPCGSLLTISKPVEDPSKLPKWNYDGSSTGQAPGDDNEVILYPQAIFKDPFRGGNNILVRAVILERGHMVICDSYTPQGEPIPTNKRHRAAEIFSNPKVQVEVPWYI

SEQ ID NO: 170882 - protein, 263 aa, Glycine max
  Coding DNA Sequence Number=SeqID_54104
  Gene Ontology: Mol. function=nucleic acid binding; Biological process= DNA integration
  Homolog annotation: Hit_ID=Q1S3I6; Match level="QueryCoverage=52%, HitCoverage=9%, E-value=3e-18, Identity=41%"; Hit description =Integrase, catalytic region
MASLKIMQLEEEEEIKVLVEAILVENELYKPQGSSINNMNASKEDGDSVVPEQSQDTHNAEMRLTSQQYKALMTLLQQQSSIHNNSHDMHNLKKIGTIDMVEGLYRLKMLPFKPLKKTLTDHAIDEPNTIIPDLAISQRATQTPRRSMRQIQRLSKYKDFHITYPLSTAANLSIGTTLYPLNSVLSYGKLSPSCHNVILYVTQQVEPQSCSATSKHPNWIEAMNAEIKALEVNNTWSLTDLPKHKTAIGCKWAYKINTGLMVL

SEQ ID NO: 170883 - protein, 389 aa, Glycine max
  Coding DNA Sequence Number=SeqID_54105
  Homolog annotation: Hit_ID=Q1RVR4; Match level="QueryCoverage=33%, HitCoverage=43%, E-value=4e-12, Identity=32%"; Hit description =Peptidase aspartic, active site; Aldehyde dehydrogenase
MESKVASLKSEVASLRNVLVTMQSKVKENQAKLLTLLEERLSLNEGEKSVMKTSANVIVDEFHQEWYGGIGEGDVYEQLAALQQTGEVDEYIQEFKRLIAQYANVGNSISFSVAQFVTSNRSSGWSNRANQNPISPCTNLDHQYGCDWRMFHGNKDVCNDNANGHGPGLVLQKDHFLTEIVTNPKINCPDHQLRVMLIDDDDEEERWTTSNAEELRHHKRGSNMILETHPMRIKIGNGYKATTQGTCKGIELKLGEITIPIDTFLFDLEWINIVLGISWLTSLGRMWVDLGKQSMQFQLENKWVELQVLQINHSKSLGSEHDVLSNQPLLEITSLLDGYFEIFREPKGFLPQHDKEHVITLMEGPLMVIFHHGDAAEDKGEEARGGAIH

SEQ ID NO: 170884 - protein, 105 aa, Glycine max
  Coding DNA Sequence Number=SeqID_54106
MRQLEANVREGTNVENIQQGVGRKGISLGLGVPFEAFNQLNRVSVSSGDQVFHHSVRPPDISTGDGVHLHVQFHQPSYVLNEGSTGNFSMEVVMESPLDQGVPGV

SEQ ID NO: 170885 - protein, 143 aa, Glycine max
  Coding DNA Sequence Number=SeqID_54107
  Gene Ontology: Mol. function=chromatin binding; Cellular component =chromatin; Biological process=chromatin assembly or disassembly
MYEEEELNDMAHHPIWPEGKAVIEEVHHNDVLRNIIEALQQNKDTKPDYFFIGRGCFFIKGGCYKRLTTSLFWVGMKKDVKDFVKECDVCQCQKYLAVAPGGLLQPLNIPNQIWEEISMDFITGLPKSKRYTAILLDKRPQKF

SEQ ID NO: 170886 - protein, 1502 aa, Glycine max
  Coding DNA Sequence Number=SeqID_54108
  Gene Ontology: Mol. function=RNA-directed DNA polymerase activity; Cellular component=chromatin; Biological process=chromatin assembly or disassembly
  Pfam annotation: Domain name=Chromo; Domain location=1413-1459; Score= 27.7; E_value=4.1e-05; Accession=PF00385.14; Description='chromo' (CHRromatin Organisation MOdifier
  Pfam annotation: Domain name=RVP_2; Domain location=349-470; Score= -43.0; E_value=0.0023; Accession=PF08284.2; Description=Retroviral aspartyl protease
  Pfam annotation: Domain name=RnaseH; Domain location=851-971; Score= -19.6; E_value=0.0039; Accession=PF00075.14; Description=RNase H
  Pfam annotation: Domain name=rve; Domain location=1107-1263; Score =90.4; E_value=5.6e-24; Accession=PF00665.16; Description=Integrase core domain
  Pfam annotation: Domain name=zf-H2C2; Domain location=1048-1089; Score=18.2; E_value=0.0014; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1413 -1459::349-470::593-762::99-189::851-971::1107-1263::1048-1089
MADSTPTSADKLEDALVRLTQQQLTMTSKIDELLHRLPPIFSPNTNPNTILSHPPPPPASIHKMKLDVPRFDGTYPFGWIFKIHQYFEYHGTPAHERLTIASFYMEGQALAWFQWMANNGQFTSWSNFLQALQNRFAPSHYEDPTGTLFKLTQKGTVSAYLAEFEALANHVVGLPSPFLLSCFISGLSPDIRREVQVLQPLTMAQAAGLARMQEEKLMDARPLPRPRQPYISTTTSPRPSIPALSSSPPNPLPLLPTLPRPPSTIKRLTPEEMASRRECGLCFTCKEKYHRGHKCASRVFLLLVEGDDPTTAHINPIDPTTDPPDPDPAHYIPDSHDPIPAQISLNSLVGHVAPKTLRLVGTISGLQVLILIDGGSTHNFIQEQLVRKLGLHCRQTTPLRVMVGNGQHLECQQLCMEIPVEIQTTSFTVDLYVLPISGANIVLSVQWLQSLGPILTYYNTLCMQFFHQGRLVELKGENDTNLRQLSSPQFHRLCQTQGDGFCFHITMLPDNPSTTEITSLHPALQTLLLRYDALFQPPHTLPPARTTDHHIHLIPQATPVNVRPYRYPHFQKQEIESQVDLMLQRGLIQPSTSPFSSPVLLVKKSDGTWRFCVDYRALNAVTVKDRFPIPTIDELLDELGGACCFSKLDLLQGYHQIRMHDADIHKTAFRTHHGHYEFKVMPFGLCNAPSSFQATMNLLFGPYLRHFIIVFFDDILVYSSSFNEHLQHLETTFQVLLTNQFVLKLSKCFFAQAQVEYLGHVVSTKGVEPIASKIDTIKQWPIPQCTRALRSFLGLAGFYKRFIRNYATMAAPLVKITTLPSFQWSTDAQLAFDHLKEALSSAPVLALPDFTTPFTLETDASGVGMGAVLSQKGHPVAFFSKPFTPKLLRSSTYVRELCAITTAVRKWRQYLLGRHFTIITDHRSLKELLTQVIQTPEQHQYMARLMGYDYDIQYRSGSHNQAADALSRISEQQPTLTMILSVPCLSFMKELRAQFDSHDGYGQLRQAILAEPFRHPDYSVIHNLIIHKGCIWIPHDLPIISTLLHEYHTTPTGGHAGTRKTLARLSKNFIWQGLREDVARCVANCLDCQLTKYEAKKFAGLLCPLPVPQRPWEDLSMDFIVGLPPYHGHTTIFVVVNRFSKGIHLGTLPTSHTAHMVASLFLNIVIKLHGFPRSIVSDRDPLFISHFWQDLFRLSGTVLRMSSAYHPQTDGQTEVLNRVIEQYLRAFVHGRPRNLGRFIPWVEWSHNSSWTVGSGSTPYEITYGRKPFAFPEYLLGTSRIDAVEEFLVDRDTTFQSIRKKLIKAQEAMKLYADKNRREVNYEINDWVLVKLRPYRQSTVRGSPASSGKLTKRYFGPFRVIERIGMAAYRLELPEGAKIHSVFHCSLLKPFRGSPTQPDSTSLPPQFIDGHPSTTPLAILSSRKVNNSWEVLVQWQGMSPDEASWENWTTLCQAYHLEDKVDFQGPWSDRNMQETPMARVQGEEETNSKRRVKKPSYLKDYTT

SEQ ID NO: 170887 - protein, 120 aa, Glycine max
  Coding DNA Sequence Number=SeqID_54109
MHPPQSYSEPHELIVIHASSTIKSGAPRIDCLALFVRPPPSSLEPHELIVIHASSTIESGAPRIDCLALFVHPPPSSSEPRELIAIHASSTIESGAPRIDCLALFVHPPPSYSGPYELIA

SEQ ID NO: 170888 - protein, 126 aa, Glycine max
  Coding DNA Sequence Number=SeqID_54110
MGKQVAAKARGEGSRAGNEIAKLNSAKASIDGAQSVGNENQGDLNMYGGTHKNKRTHMYERMGEHGEQINNDAHGQKGMFFPDGLKKTIYVGTSALMITIVESFKNKSTKEFCSTELTYVKLRNMI

SEQ ID NO: 170889 - protein, 256 aa, Glycine max
  Coding DNA Sequence Number=SeqID_54111
MAPTGKSHGDGDEVKEGFKVKTMMPMKIVASNKMEWVLEADMLDISMVEETSLGELPFGVYASPNFATRRTFWRYLEVLQEQDGGVFPNMRALEFKASWRLAIPETSMEHLMQQHSGHNPLLGREAWSKGSQSVPVALMHVGEDLVKFNRDIFESVLRWKHEMEARLKGIQRSLKRHNKIHGLHIIDGSWCTDEIKLKNEVVSFFMSLFCLVEAQGGKEVGDLVGRLPYEAKVNLLATVTKGEDDMWRFVEEAFQT

SEQ ID NO: 170890 - protein, 72 aa, Glycine max
  Coding DNA Sequence Number=SeqID_54112
MEPWCWLGCGTRWHGCGHGIEVSRGRGVGIGAFVGGDCTEEENRGRWLGIMVFNFRRIASSLESMEAWVAAK

SEQ ID NO: 170891 - protein, 257 aa, Glycine max
  Coding DNA Sequence Number=SeqID_54113
MSVEVGVETEGASYNSVLYLASLTPSASSEECSNVVHTWRSIHIVLGHLPESNDHVSTKVYEMVRRKNFYCGGDSSTNSILVWDIHSAYGLMPPHNEIGKEVGWVKPNYGWVALNVNGSVMEANQAAGNIKYMDILCVEIQALLQGIKLCWEKGFRKVIYLFRFISIGLHVRHTMREGNRCMDMLAKMGLTKMRSCEAFIHPLGDSNPILLWPLWILSLNNRHFLNKGDAPPDSNIVVADTRPTRFNRRPTYVTDYA

SEQ ID NO: 170892 - protein, 174 aa, Glycine max
  Coding DNA Sequence Number=SeqID_54114
MSLSDLALVKEFCANLYSSEDRPPNQSRVKDYREIEVALCTPGRGFILNSEGHPGKILRKDLTTLAQVWSVLLYSNLAPTSHTSDLTVDRARLIFGLVSRMDMNIGALISGQMTSIAQSNTSRLGFPALITALCRARRVTSDSLTFERLSPIINLAYIKKNCWNPEDLTVSIRG

SEQ ID NO: 170893 - protein, 254 aa, Glycine max
  Coding DNA Sequence Number=SeqID_54115
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=4e-37, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHALAIRGLHALAFRGLHVLVIRGLHVLSFRGLHVLTFIGQHVLTFRGLHAFAFRGIHVLAIRVLNVLAFRALHVLTFRGLHVLTFGGLHVLQFRGLHVLAFRGLHVLTFSGLHVLTLRGLHVLTLRGLHVLPFKGLHVLTFSGLHLLTLRGLHVPTFRVQHALAIRGLHVLAFGGLHALVFRGLHALTFRGLHVLTFRGLHALAIRGLHALAIRGQHAFTFSGLHVLSYRALHALIVRGLHVLTFIVDTSSHS

SEQ ID NO: 170894 - protein, 232 aa, Glycine max
  Coding DNA Sequence Number=SeqID_54116
MMPNRTCPRLPICDEGENKGFRLYFIKEIRSRDLVPRLKAHHVFYIRKTTMEKLEARVQCLLRLQQADKAKYDATWKIRLEKEAKQKADAEARHKTNVKRKKAEAKAEKTRPSKLVSKPIVVTAETTKMAKSTPIPTAEMPKDKENVAPTESTLHEATSIKATVVTVHTTIYGPTPINFSPPEVMTKAKVKEMIGLAMDSFAEKQRASNEEFRQTMQQAISIYSKKKDQSTQ

SEQ ID NO: 170895 - protein, 82 aa, Glycine max
  Coding DNA Sequence Number=SeqID_54117
MAHKTILLSFLVFLILQHNFGSMEASRKRINIHPPPAIPRSPQPPSVYWYIPNDDNVGGGDAYRPTSPGHSPGVGHETPPTK

SEQ ID NO: 170896 - protein, 82 aa, Glycine max
  Coding DNA Sequence Number=SeqID_54118
  Homolog annotation: Hit_ID=Q2HTU7; Match level="QueryCoverage=100%, HitCoverage=43%, E-value=2e-20, Identity=48%"; Hit description =Uncharacterized Cys-rich domain
MGDLEKKQERVMEEEDKERLVEGVAVLDFDMLCSTVALRAAHGKWGKLGVEDRGRRRRGGCCPCYRFGKNMKRADFGSCYIQ

SEQ ID NO: 170897 - protein, 130 aa, Glycine max
  Coding DNA Sequence Number=SeqID_54119
MDSSKRKTIASTSLAGYDRSRFVSQEAWDRYSDNEFYANLYVPDDKFPKQVRVRGNLIKFDVDSLNTFLETPVVVEQGESLPFYSRFAKLRPDPQELAARLCIPGRGFVLNVEGLPWKLLRKYLTTLAQT

SEQ ID NO: 170898 - protein, 284 aa, Glycine max
  Coding DNA Sequence Number=SeqID_54120
  Homolog annotation: Hit_ID=Q3KD20; Match level="QueryCoverage=68%, HitCoverage=78%, E-value=4e-10, Identity=25%"; Hit description =Hypothetical protein precursor
MALLLMAPALPLQAADGRTGRGLTEIPDPELSLMRGRYTVGGNNVAWFGVTMVSQWQASNGTTLQGSLTLGMDFRGGGAPKLSFQPSVHVTAADAPLPDTHGRSIDSSGLANASGLVQSVQVAGDGNVARNVTTLTVREGGVPAVLSDGAGNVTAQQAGASATAVLEGNQAHLLLQVDGQGLVQQWIRNGSVGQGIALTGDGQIASNQLRLELMRNSVGGNLPLSQNVAQAIALNRGMGPGQYQGLALGETLHNAGHEHAHPDEDHPVGAGGAGGHRPYRAADA

SEQ ID NO: 170899 - protein, 55 aa, Glycine max
  Coding DNA Sequence Number=SeqID_54121
MAETGQCDGPYALRDLTLTRRYAWGAAGLVHMYDQLNDANLSTSRQLAGYITLLQ

SEQ ID NO: 170900 - protein, 68 aa, Glycine max
  Coding DNA Sequence Number=SeqID_54122
MATSTQTISNSTNSNTASSMEKRHNIVQRDQNLPYKKMETRSLLVPPLDKGGYKSPIADVYRTRDQRT

SEQ ID NO: 170901 - protein, 130 aa, Glycine max
  Coding DNA Sequence Number=SeqID_54123
MDRSMIDAASGGAVGDMTPAEARNLIEKMASNSQQFNSRNDVIVLRGVHEQYGVNEQPEAYAANIYNRPPQQQNQQWQNNYELSSNRYNPGWRNHPNLRWTSPPQQQQPVPPFQNPAGPSKPYVPPPIQQ

SEQ ID NO: 170902 - protein, 69 aa, Glycine max
  Coding DNA Sequence Number=SeqID_54124
MKRVYTRVYDFTRETRAWVYKREDLWGKGFTQERVSSSYDGGLDGEMTWMSSLKLLIKEHYAQPCSSRC

SEQ ID NO: 170903 - protein, 359 aa, Glycine max
  Coding DNA Sequence Number=SeqID_54125
  Gene Ontology: Mol. function=hydrolase activity, acting on ester bonds; Cellular component=cellular_component; Biological process =lipid metabolic process
  Homolog annotation: Hit_ID=Q9FJ45; Match level="QueryCoverage=97%, HitCoverage=99%, E-value=2e-75, Identity=41%"; Hit description=GDSL -motif lipase/hydrolase-like protein
  Pfam annotation: Domain name=Lipase_GDSL; Domain location=31-341; Score=167.0; E_value=5e-47; Accession=PF00657.12; Description=GDSL -like LipaseAcylhydrolase
MKIFILFSIAFAYGFLGNVVSNANPHPYEAIFNFGDSISDTGNAATYHPKMPSNSPYGSTYFKHPSGRKSNGRLIIDFIAEAYGMSMLPAYLNLTEAQDIKKGVNFAFAGSTALDKDFLEQKRINVQEAAYSLSTQLDWFKKLKPSLCESREECNKYFKNSLFLVGEIGGNDINAIIPYKNITELREMKLIEEGAIELVVPGNFPIGCNSTVLAIVNSDKKDDYDQFGCLVTYNTFIEYYNEQLKKAIETLRQENPDVKITYFDYYGATKRLFQAPQQYGFSSGKIETFRACCGKGEPYNLSAQIACGSLAATVCSNPLKYINWDGPHFTEAAYKLIAKGLIEGPFASPSLKSPPFKIA

SEQ ID NO: 170904 - protein, 442 aa, Glycine max
  Coding DNA Sequence Number=SeqID_54126
  Gene Ontology: Mol. function=protein serine/threonine kinase activity; Cellular component=mitochondrion; Biological process =protein amino acid phosphorylation
  Homolog annotation: Hit_ID=Q2HTU1; Match level="QueryCoverage=99%, HitCoverage=88%, E-value=0.0, Identity=44%"; Hit description =Tetratricopeptide-like helical
  Pfam annotation: Domain name=PPR; Domain location=11-45; Score=42.2; E_value=1.8e-09; Accession=PF01535.11; Description=PPR repeat
  Pfam annotation: Domain name=PPR; Domain location=115-148; Score =24.6; E_value=0.00034; Accession=PF01535.11; Description=PPR repeat
  Pfam annotation: Domain name=PPR; Domain location=154-187; Score =31.4; E_value=3.1e-06; Accession=PF01535.11; Description=PPR repeat
  Pfam annotation: Domain name=PPR; Domain location=189-223; Score =37.5; E_value=4.7e-08; Accession=PF01535.11; Description=PPR repeat
  Pfam annotation: Domain name=PPR; Domain location=224-258; Score =44.1; E_value=4.8e-10; Accession=PF01535.11; Description=PPR repeat
  Pfam annotation: Domain name=PPR; Domain location=259-293; Score =50.0; E_value=7.7e-12; Accession=PF01535.11; Description=PPR repeat
  Pfam annotation: Domain name=PPR; Domain location=294-328; Score =33.7; E_value=6.6e-07; Accession=PF01535.11; Description=PPR repeat
  Pfam annotation: Domain name=PPR; Domain location=329-362; Score =27.2; E_value=5.7e-05; Accession=PF01535.11; Description=PPR repeat
  Pfam annotation: Domain name=PPR; Domain location=386-420; Score =48.9; E_value=1.7e-11; Accession=PF01535.11; Description=PPR repeat
  Pfam annotation: Domain name=PPR; Domain location=46-79; Score=6.3; E_ value=1.3; Accession=PF01535.11; Description=PPR repeat
  Pfam annotation: Domain name=PPR; Domain location=80-114; Score=37.9; E_value=3.6e-08; Accession=PF01535.11; Description=PPR repeat
  Pfam module annotation: Pfam domain module=PPR::PPR::PPR::PPR::PPR::PP R::PPR::PPR::PPR::PPR::PPR; Domain location=11-45::115-148::154 -187::189-223::224-258::259-293::294-328::329-362::386-420::46-79::80- 114
MLAARVAPQTYTFNLLIHSLCESRAFDHALQLFEKMPQKGCCPNEFTLGILVRGLCRAGLVKQALELVNNNNSCRIANRVVYNTLVSRFCREEMNNEAERLVERMNELGVLPDVVTFNSRISALCRAGKVMEASRIFRDMQMDAELGLPRPNVVTFNLMLKGFCKHGMMGDARGLVETMKKVGNFDSLECYNIWLMGLLRNGELLEARLVLDEMVAKGIEPNAYTYNIMMDGLCRNHMLSDARGLMDLMMRNGVYPDTVAYSTLLHGYCSRGKVFEAKSVLHEMIRNGCQPNTYTCNTLLHSLWKEGRTLEAEEMLQKMNEKCYQPDTVTCNIVVNGLCRNGELDKASEIVSEMWTNGPTSLDKGNSFASLINSIHNVSNCLPDGITYTTLINGLCKVGRLEEAKKKFIEMLAKNLRPDSVTYDTFIWSFCKQGKISSAFRV

SEQ ID NO: 170905 - protein, 238 aa, Glycine max
  Coding DNA Sequence Number=SeqID_54127
  Gene Ontology: Mol. function=helicase activity; Cellular component =intracellular; Biological process=translation
  Homolog annotation: Hit_ID=Q2HTU1; Match level="QueryCoverage=89%, HitCoverage=70%, E-value=8e-88, Identity=45%"; Hit description =Tetratricopeptide-like helical
  Pfam annotation: Domain name=PPR; Domain location=11-45; Score=44.8; E_value=2.9e-10; Accession=PF01535.11; Description=PPR repeat
  Pfam annotation: Domain name=PPR; Domain location=115-149; Score =14.0; E_value=0.16; Accession=PF01535.11; Description=PPR repeat
  Pfam annotation: Domain name=PPR; Domain location=150-183; Score=3.6; E_value=2.8; Accession=PF01535.11; Description=PPR repeat
  Pfam annotation: Domain name=PPR; Domain location=46-79; Score=0.7; E_ value=6.2; Accession=PF01535.11; Description=PPR repeat
  Pfam annotation: Domain name=PPR; Domain location=80-114; Score=4.4; E_value=2.3; Accession=PF01535.11; Description=PPR repeat
  Pfam module annotation: Pfam domain module=PPR::PPR::PPR::PPR::PPR; Domain location=11-45::115-149::150-183::46-79::80-114
MKEKGISPDICTYNNIITCLCEGGKAKDAISLLHEMLDKGISPNVSSFKILIKAFSKSSDFKVACELFEVALNICGRKEALYSLMFNELLAGGQLSEAKELFEVSLDRYLTLKNFMYKDLIARLCQDERLADANSLLYKLIDKGYGFDHASFMPVIDGLSKRGNKRQADELAKRMMELELEDRPVDRTYSNRKRVIPGKLLKDGGSDWQDIINRYGHMGDEDNQFLLFSILFIFGKNK

SEQ ID NO: 170906 - protein, 424 aa, Glycine max
  Coding DNA Sequence Number=SeqID_54128
  Homolog annotation: Hit_ID=Q1S175; Match level="QueryCoverage=58%, HitCoverage=90%, E-value=2e-57, Identity=41%"; Hit description=MtN19- related
  Pfam annotation: Domain name=SURNod19; Domain location=23-283; Score =138.9; E_value=1.4e-38; Accession=PF07712.3; Description=Stress up -regulated Nod 19
MSEVMILSLSIIVVLSGTTYSIFLESENHIKSATFVSKSFEVGPGKIASKALYDIEFPKGHIGVKSFDAELVDEDGKSVPLYETYLHHWFAIKYNENITMSRYIEQSHDISKGINYTRNDGACRGFLLPHYWGLGGESRGTSSNLPDPFAVEFGNPKNIPHGFKEKWLFDIMAEYTIPRIGHGDFPHVKKANIPMKKGGYLIYGTSHMHTGVVNATLYGQDGRVLCTSTPKYGTGKEAGNERGYLVGMSGCYPKPGSVEIKDELGLRLSSCQSRGKKIPKTTEEGFNVNKPPMFKGANYDDWKEGIIAFFESTHIDMWDVVEKGSQIPLEEYSEVDSYRSAKQMWDTFAITYEGSCEAKHKRLSLLMRKYKLFSMEEGIDVQTMPKHNTTSKESLSKALAIDDASEEEFDDDDSDEEDCECISC

SEQ ID NO: 170907 - protein, 86 aa, Glycine max
  Coding DNA Sequence Number=SeqID_54129
MEVEEWKVVTFVVKAEAYNVAPCRACRPWIFFITRVLRFLKINGRVPVQFPIWFLLLQFLTNIFKGNEILASAPGHQPKVLNLDPS

SEQ ID NO: 170908 - protein, 64 aa, Glycine max
  Coding DNA Sequence Number=SeqID_54130
  Homolog annotation: Hit_ID=Q2HTU1; Match level="QueryCoverage=56%, HitCoverage=5%, E-value=3e-10, Identity=81%"; Hit description =Tetratricopeptide-like helical
YPQFTYAAYSSIFTNDLLPTAYRDAGSGIALKTLKRVQKGWGQGSISSLQPQQNDFLDYYDGSG

SEQ ID NO: 170909 - protein, 436 aa, Glycine max
  Coding DNA Sequence Number=SeqID_54131
  Gene Ontology: Mol. function=protein serine/threonine kinase activity; Cellular component=membrane; Biological process=protein amino acid phosphorylation
  Homolog annotation: Hit_ID=Q9S971; Match level="QueryCoverage=94%, HitCoverage=48%, E-value=1e-141, Identity=57%"; Hit description=ARK3 product/receptor-like serine/threonine protein kinase ARK3
  Pfam annotation: Domain name=B_lectin; Domain location=75-190; Score =138.3; E_value=2.1e-38; Accession=PF01453.15; Description=D-mannose binding lectin
  Pfam annotation: Domain name=PAN_2; Domain location=347-412; Score =113.4; E_value=6.3e-31; Accession=PF08276.2; Description=PAN-like domain
  Pfam annotation: Domain name=S_locus_glycop; Domain location=204-330; Score=237.8; E_value=2.3e-68; Accession=PF00954.11; Description=S -locus glycoprotein family
  Pfam module annotation: Pfam domain module=B_lectin::PAN_2::S_locus _glycop; Domain location=75-190::347-412::204-330
  Subcellular localization annotation: CTP_CleavageSite=27; ConfidenceScore=5.41e-01
MGGSTNPLSLFLLCFTTFLTLFEVSISTDTLTSSQSLRTNQTLLSPNAIFELGFFSYTNSTWYLGIWYKTIHDRDRTVVWVANRDIPLQTSLGFLKINDQGNLVIINQSQKPIWSSNQTTTTPSNLILQLFDSGNLVLKEPNENDPKKILWQSFDYPTDTLLPGMKLGWNFDTGIEKHITSWSATNEDPSSGDFSFKLDPRGLPEIFLWNKNQRIYRSGPWNGERFSGVPEMQPNTDSIKFTFFVDQHEAYYTFSIVNVSLFSRLSVNSIGELQRLTWIQSTQVWNKFWYAPKDQCDNYKECGAYGVCDTNASPVCQCIKGFRPRNPQAWNLRDGSDGCVRNTELKCGSDGFLRMQNVKLPETTLVFVNRSMGIVECGELCKKNCSCSGYANVEIVNGGSGCVMWVGELLDVRKYPSGGQDLYVRLAASDVEIQKH

SEQ ID NO: 170910 - protein, 570 aa, Glycine max
  Coding DNA Sequence Number=SeqID_54132
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q2HTU0; Match level="QueryCoverage=99%, HitCoverage=99%, E-value=0.0, Identity=64%"; Hit description=Ricin B lectin; Glycoside hydrolase, family 5
  Pfam annotation: Domain name=Cellulase; Domain location=29-350; Score= 6.9; E_value=1e-07; Accession=PF00150.8; Description=Cellulase (glycosyl hydrolase family 5
MVRKSSILLACLLAIFTSCCNSLPLSVHKRWIIDDATGKRVKLHCAHWVAHATPMLAEGLDKSPMNDIAANIAKAGFNCVRLSYATYMFTRYANNTVRDIFHTHDIPGIVSAIENYNPRVLNMTHLQAYEAVVDALGDHGVMVLIDNHVSLAKWCCANDDQNGFFGDRHFNTSEWLQGLAFIAHHFKGKPNVFAMDLRNELRGSRQNHHDWYKYMTQGANTIHDINPDFIVIISGLAFDNDLSFLKKKPLDLNFPHKIVYESHIYSVSGDTHRWRVQPVNWICNATIQLLHQQSSFLLSGKNPAPLLVSEFGYDMTGGSFADNMYLPCIVSYFASVDLDWSLWAFQGSYYYRQGKVGLGESYAVMDDDWKSYRDPNFTQKFELLQRMVQVTTIIADVNGYSLLNRKALLAFWEAPNKPYLGLFNSWTAYPTSNVSKSNIIFHPLTGYCAHVNNSKELVMGDCKSNSLWSYEGDGSPIRLMNSAKCLKAVGERLPPSLSEDCLSPQSSWKTVSMTGLHLATFDKDGDLLCLEKDSNSSKIVTSKCICISDDDSSCLDNPQSQWFKLVSTNV

SEQ ID NO: 170911 - protein, 543 aa, Glycine max
  Coding DNA Sequence Number=SeqID_54133
  Gene Ontology: Mol. function=transporter activity; Cellular component= integral to membrane; Biological process=transport
  Homolog annotation: Hit_ID=Q2A9H2; Match level="QueryCoverage=81%, HitCoverage=92%, E-value=1e-159, Identity=60%"; Hit description =Transporter, putative
  Pfam annotation: Domain name=MFS_1; Domain location=37-427; Score =86.8; E_value=6.6e-23; Accession=PF07690.6; Description=Major Facilitator Superfamily
MSRHCDCCCGGIPPGLLLIRGKQWNLQTYRYMVLLTTFIAYACYHASRKPTGIVKSVLCPEHKGTNQGWSPFNGHDGTSKLGEIDVAFLACYSMGMYVAGHLGDSLDLRLFLTTGMVGSGIFVSLFGMGLPGGLRLWRLSVTGFGKRKRGLIMGVWNAHTSVGNISGSLLAASVLEYGWGWSFVVPGVVIVLGGVLVYLFLAPYPEDVGFSCVHGGGGGGDEEAQVNGVKKGGGGGGVAPPTREGSVNRKSVGLVEACMIPGVIPFALCLFFAKLVAYTFLYWLPFYLTQTAEIGGKYISVKSAGNLSALFDVGGIFGGILAGYVSDKLNARAITAASFMYAAIPSMLLYRHYGSVSMNANIGLMMVSGLFVNGPYALITTAVSADLGTHSSLKGDSRALATVTAIIDGTGSVGAALGPLLTGFISSRGWDEVFMMLVLGAFIAGLLLSRLIIAEIAERSGKPLSSGQQNPEATASQPLLEERLWKVPKGITTHNWGWNLISFHRELIFSRDNCGDLLLALNHLDTRYSKVTFVPLILVSHSF

SEQ ID NO: 170912 - protein, 113 aa, Glycine max
  Coding DNA Sequence Number=SeqID_54134
MRLHCHQANQRLGMTTDRPPLIMAHIDPVPSGVANCGNLPSSGGATWASMVHLPRKKNAWSRHQRLFEENVRKTRKGKCRGFAYFENEGSSVIYARGRYLHPTCPSQGTTTSN

SEQ ID NO: 170913 - protein, 112 aa, Glycine max
  Coding DNA Sequence Number=SeqID_54135
MELRLQVTTCGGAKNMGTEGSGEKKHKNGSKFVATEIAWSEPKRRKTSKSEETEEREFWCGVVLRTPTSPQWECMRERERERELAHVSNGGNVYVRFQNARGVLVTCQWKES

SEQ ID NO: 170914 - protein, 77 aa, Glycine max
  Coding DNA Sequence Number=SeqID_54136
MRASGNRLPRGCNRLPGLELKAAGCRGLCFHALKLCDSSLASGNRLPRLCNRLPEMKSLKIPLLLACNGYEKHCVAA

SEQ ID NO: 170915 - protein, 153 aa, Glycine max
  Coding DNA Sequence Number=SeqID_54137
  Gene Ontology: Mol. function=structural molecule activity; Cellular component=protein storage vacuole; Biological process=lipid transport
  Homolog annotation: Hit_ID=Q9LVU1; Match level="QueryCoverage=53%, HitCoverage=37%, E-value=2e-20, Identity=57%"; Hit description=VAMP (Vesicle-associated membrane protein)-associated protein-like
TLQAQQEYPPDMQCKDKFLLQSTIVNPNTDVDDLPPDTFNKDGEKSIEDMKLRVVYISPMSPQGSTEDDTVKNSTQKLDANSSYVAYYVSRWNPDLHIQALALYKKCKFCNRLSLTNEIKGFLRMIWPSEKRNDIYSIGHTQLYSRLYPDFLG

SEQ ID NO: 170916 - protein, 75 aa, Glycine max
  Coding DNA Sequence Number=SeqID_54138
  Subcellular localization annotation: CTP_CleavageSite=67; ConfidenceScore=5.02e-01
MKNKLKHSKSATHCARSLINHRLIFSIKSNRGWQRKKSSGVTGLAKLMILEAWDSVPNLVTMVSVLQAASGGHAD

SEQ ID NO: 170917 - protein, 74 aa, Glycine max
  Coding DNA Sequence Number=SeqID_54139
MTNEEHRTKNDVEVDYGRNSKNEGTWWSYSSPRRAGYFTPKLFGGPRRAKAQKIPKMTFLPLPLGIYRILEPKH

SEQ ID NO: 170918 - protein, 77 aa, Glycine max
  Coding DNA Sequence Number=SeqID_54140
MVLWKGKIDPLKELELFKMKQSYRNEDIGFQDKDIDLEDETKVEELEQNKEITSTPPKDLIREWRTQKRHFLGQHYW

SEQ ID NO: 170919 - protein, 151 aa, Glycine max
  Coding DNA Sequence Number=SeqID_54141
MRGTMHEPQANLGADKKFSPGPLKESTSCFLIRLSPLVLVPSGLFHRTQRPLLYDFMGFKVLTFILHRTQSPSSPRLAFGSPGPPNNFKAKELACLGELQPPQGLEGSKVEGIKRIKKDEEERRGNEVEALPNRDCDRPYVVSRSVFIVPV

SEQ ID NO: 170920 - protein, 122 aa, Glycine max
  Coding DNA Sequence Number=SeqID_54142
  Homolog annotation: Hit_ID=Q10QE9; Match level="QueryCoverage=63%, HitCoverage=20%, E-value=1e-07, Identity=43%"; Hit description =Expressed protein
MGGQSSKIPSNSDVPTPIKMGTYCLYPADLSSYEATCVKHPNLQSLDATIEERTNRVITSLVQGIEVHSISIESLGEVVVKYPKCYLVVTCEILVYTLGSEQKAGPYIVWFLGQFSDRAHTE

SEQ ID NO: 170921 - protein, 50 aa, Glycine max
  Coding DNA Sequence Number=SeqID_54143
MVREQGLVVFGSKEGVKKWCLNKVQCIIDTDMDTGHDTNMDMWTPVMLKM

SEQ ID NO: 170922 - protein, 75 aa, Glycine max
  Coding DNA Sequence Number=SeqID_54144
MVSVTLTGERPYYHRKHHLFTVAITFTGKCTLCNKRCVPTSFNIIFLKAVHLVICSPEHKVQDHHRIQTQTANWE

SEQ ID NO: 170923 - protein, 181 aa, Glycine max
  Coding DNA Sequence Number=SeqID_54145
  Gene Ontology: Mol. function=RNA-directed DNA polymerase activity; Biological process=RNA-dependent DNA replication
MTHQWSMAEGLAKDNEHPQLELLELGTIRMKFGFDSCFSVNVNGDFNDLLSNDETIGNSEHANRLIEEFHDSIFHSNLHDLPMKGYKYTWARRKGKPNDIEEKLDRALALDWHFPSIQTHKWNLYNIFKFENSWLLKPELEKIVHEGWLNSCSNEVMEKFKSCTSNMYTWGRKHNSILATH

SEQ ID NO: 170924 - protein, 60 aa, Glycine max
  Coding DNA Sequence Number=SeqID_54146
MGKGWGPSAAGVGAPSSACEPRWTLEMVAAVEVAVVRSRPTAAAGPAPAAVLALTCSTSQ

SEQ ID NO: 170925 - protein, 75 aa, Glycine max
  Coding DNA Sequence Number=SeqID_54147
MGHLRFVILFGKSNQHENTEKGVEGRSPEFQEPLDLRSNPFQGGGDDAILPPQEHWIEGSKNIGPKMQEKALGFS

SEQ ID NO: 170926 - protein, 157 aa, Glycine max
  Coding DNA Sequence Number=SeqID_54148
  Gene Ontology: Mol. function=DNA binding; Cellular component =mitochondrion; Biological process=DNA integration
  Homolog annotation: Hit_ID=Q1SF88; Match level="QueryCoverage=98%, HitCoverage=12%, E-value=2e-77, Identity=86%"; Hit description =Integrase, catalytic region
ADWGGCPDTHRSTSGYCVFLGDNPISWSSKRQPILSRSNAEAEYRGVANVVSDSCWIRNLLLELHCPIQKATIAYCDNVSAIYLSGNRVQHQRTKHIEMDIHFVREKVARGEVRVLHVSSRYQIADIFTKGLPRVLFIDFRDSLSIREPPASTEGEC

SEQ ID NO: 170927 - protein, 99 aa, Glycine max
  Coding DNA Sequence Number=SeqID_54149
  Homolog annotation: Hit_ID=Q1S9T3; Match level="QueryCoverage=91%, HitCoverage=68%, E-value=6e-19, Identity=50%"; Hit description =Ankyrin
MAQSAKFHPALTITNVKSLVPVTLDNEQALYYSWAALFTNLTRVHDLYDHIVPPTEEPARAAYLVAKTVDPAMWKRLDAAILQWIYGTISSDLLLAILR

SEQ ID NO: 170928 - protein, 208 aa, Glycine max
  Coding DNA Sequence Number=SeqID_54150
GGIGHILNITPKEEKRIEGLKMLTLASHISMEKDNVEAYLDWEMKVEQLFACHHISEERKVPLATLSIQGYALYWWTSLVRERRIYGCQTQISSGDYHSWIFGFSLAELSCSTPVTVQDERSFDVLVKGAKDTKRDGQKGLFRDFSRPQLAQASLWLTWAPPNGLGLKSPTRPGKPSHFRVKHQLNTHLSRVRAEVPNALTTSFVLVS

SEQ ID NO: 170929 - protein, 217 aa, Glycine max
  Coding DNA Sequence Number=SeqID_54151
  Gene Ontology: Mol. function=DNA binding
  Homolog annotation: Hit_ID=Q1SFS3; Match level="QueryCoverage=81%, HitCoverage=33%, E-value=4e-22, Identity=32%"; Hit description =Lambda repressor-like, DNA-binding
MGFGHGRSAVEAITSLTQYYDQSLRCFTFREFQLTPTIEEFEEILGCPLGGRKSYLFARFYPSMARIAKAIQISEQELNRVKQNRNGVIGIPRKHLEEKAEALANKREWTSFIDILALLVFGTILFLNVDGLVDLAAIDTYLAYHHSKQSLVITILADTYDTLDLRCEKSSARIIYCTPTLYVWLVSHVFVMKVGLFVLYKVIACAPKREKKIGKNS

SEQ ID NO: 170930 - protein, 93 aa, Glycine max
  Coding DNA Sequence Number=SeqID_54152
MTAVEVFLLKIEIYAVLSGDIVATRWVVTFGTLNLSHQLRVEPPRLTYGEVTRSFSMRWKDMVERYWHLVDKNGNMHTIVYNQDLDGPTIVLG

SEQ ID NO: 170931 - protein, 81 aa, Glycine max
  Coding DNA Sequence Number=SeqID_54153
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=100%, HitCoverage=24%, E-value=3e-35, Identity=77%"; Hit description =Acetyl-coenzyme A carboxylase carboxyl transferase subunit beta
MGSSDRIELSIDSGTWNPMDEDMKTGLTEAVQTGTGQLNGIPVAIGIMDFQFMGGSMGSAVGEKITRLVEYATNQLLPLIL

SEQ ID NO: 170932 - protein, 386 aa, Glycine max
  Coding DNA Sequence Number=SeqID_54154
  Gene Ontology: Mol. function=phosphopyruvate hydratase activity; Cellular component=integral to membrane; Biological process =glycolysis
  Homolog annotation: Hit_ID=Q2T6E6; Match level="QueryCoverage=99%, HitCoverage=27%, E-value=6e-77, Identity=43%"; Hit description=Gp14
MAKKLREIVVAVTADTGAYQREMNRQSRMGGEYFKSVEQGAKRADAAYQRNAASIRMQVTAMDEATQSVAAYTRAIAAAFSAGKLVSYADSWTNLNNRLKLVTDGAGEFTAAQTAVFNIAQNARAPLQATAELYQRIATNQDALGLSGQGVASIVDTISKTMVISGASTQAADAALVQLGQAFASGTLRGEELNSVMEQTPALAKAIADGLGIPIGELRALGATGQLTAQQVVTALQKMAGSVDTQFSKMQVTVSQSLTVLNNEITKWIGQADEATGASKALADGIISLSKNLDTAAAVAGGVAVVALGRSLGQASSQAFQATQAFMANRAALIDQARAQSLAAEAGLRKAQLDVFLAEKEAVAARGTAVQTQMAIQLAQARAVER

SEQ ID NO: 170933 - protein, 445 aa, Glycine max
  Coding DNA Sequence Number=SeqID_54155
  Homolog annotation: Hit_ID=Q1I667; Match level="QueryCoverage=29%, HitCoverage=29%, E-value=7e-14, Identity=40%"; Hit description =Putative phage protein
MVSQAYENTYQRALDTGAERTATQFSGIAANTEVKRTGKKSGDDWAKWVKERQAETAAQLDLAAAYLEGGAAVEKATQAKRIEEEVLKQGAKRRAEIVSLLDAEAQARAKADAAKQIADMGKEIALIDAKTEAERILWETQNGSYAALDENIRKALVGRARELDLARKAQAQQAYIGQVSGRTEADETLEKMGWLADAFDRNQLSAEQYKRALGELTGEGLGSLTEFAVQGARNIQSYLGDGLYQAVTGKFEGIGNAFFDMLARMATEAAAANLGEMLFGSFGKTNQIGGLFGAIGGAIGGMFGGGSSMPSTASWAMPKFAKGGAFTNGVVDSPVAFPMGLMGEAGPEAIMPLHRGADGSLGVRAEFPSVPGGGLGGGGFGGMQVNINVDRRGETSSNSSDGAEDFERGLAAVVQGYVQQYVPQEIQKSFRPGGSLWNAQQNRRP

SEQ ID NO: 170934 - protein, 304 aa, Glycine max
  Coding DNA Sequence Number=SeqID_54156
  Gene Ontology: Mol. function=diacylglycerol kinase activity; Cellular component=cytoplasm; Biological process=protein kinase C activation
  Homolog annotation: Hit_ID=Q9RJ98; Match level="QueryCoverage=94%, HitCoverage=97%, E-value=2e-22, Identity=31%"; Hit description =Putative secreted protein
  Pfam annotation: Domain name=DAGK_cat; Domain location=4-130; Score =90.7; E_value=4.6e-24; Accession=PF00781.14; Description =Diacylglycerol kinase catalytic domain
MAEHIAVLVNPLSGKGQGARAAEAAIGHLRERGAEVRAYAGGSAADTARLAIAAVADEPRVLVVVGGDGTLSGVLDTVCAAAMPVVLVAAGTGNDLARALGLPRGDAGAAAELALVGVPRAVDVGVVRTATGSRKFLTIAALGFDAKVSDRTNRLRWPHGAARYYLALLIELVRLRPMDFTLAVDGEPARSAPGTLIAAGSTSSYGGGMPICVGAVPDDGLLDVVQVAPLSRRRLLRLFPLLLRGTHLARREVSHRRARSVTVSAPDLVVYADGERIGEDECTISVLPGALTMLVPKEPDDRVR

SEQ ID NO: 170935 - protein, 144 aa, Glycine max
  Coding DNA Sequence Number=SeqID_54157
  Subcellular localization annotation: CTP_CleavageSite=41; ConfidenceScore=5.53e-01
MSNTSSGRACLPEFFRKNHFFRKVSGKGFPGVFRKTFGYFRKNTSSGNFPENVLPELPEEPLTGLPEDSTVSLFRHFFRRTLVFSPLVFYPKVTILRFHCYANSAAHYKQRVRGRGTNLFAEKKKKALARLAEKKLHGEEKKKQ

SEQ ID NO: 170936 - protein, 72 aa, Glycine max
  Coding DNA Sequence Number=SeqID_54158
MGDLPVVRVFPKVFPEDISGLPPEKERVFCRPVMQSYPQRTLDRRLQEDWARDAREGPRILMSLRVDFGSMG

SEQ ID NO: 170937 - protein, 196 aa, Glycine max
  Coding DNA Sequence Number=SeqID_54159
MSHTSSTASIETIIPISSFYHKQWAPDYPQHVDLKYDGTIYKIRVRQHKTRCYLADGLENFRRELEIYESTIINFFACNHLYEFDIHFTPPLHRQTCGRPRHLCIKHIWSVNITQAMVVAPQPLKLPPFVEIPLNACGHHMTVLRRLGPPLQWPVETLNPGIATKAITQPSYDFLAESDFDHGDEVSFYYRRFDKV

SEQ ID NO: 170938 - protein, 175 aa, Glycine max
  Coding DNA Sequence Number=SeqID_54160
  Subcellular localization annotation: CTP_CleavageSite=50; ConfidenceScore=5.17e-01
MKTIKNAKPTTGKSKQVSVASSNKTLVATTDKTKETIAPSRKPILALATVIATDKNTFAKIKTSDATSTNVTHAPATIARKLKTSFVSRKRNQKGKMQHPKSLNDQTPTATSVDGPSTQMPSLIAKSSNMLVGLGSSSSMDSFASWKINGSGMEKEEREETPLQGEDKSRRSSPP

SEQ ID NO: 170939 - protein, 493 aa, Glycine max
  Coding DNA Sequence Number=SeqID_54161
  Gene Ontology: Mol. function=protein translocase activity; Cellular component=integral to membrane; Biological process=protein transport
  Homolog annotation: Hit_ID=Q9XQU4; Match level="QueryCoverage=98%, HitCoverage=90%, E-value=0.0, Identity=83%"; Hit description =Preprotein translocase secY subunit, chloroplast precursor
  Pfam annotation: Domain name=SecY; Domain location=137-472; Score =362.5; E_value=6.8e-106; Accession=PF00344.11; Description =eubacterial secY protein
MDFDTDTDTLTCSELANFDPLGINSDLSSGLNSTWKNLVCSITQTFESTSSAEKGKPNSSQGVAAAIEDSSIDFGDFFKGPLPGKFLKLLGFLALSRLGVYIPLGGVNREAFVGNLDQNSLLSTLDSFSGGGIGRLGVCSLGIVPFINAQIVFQLLAQVYPKLQDLQKREGEAGRKKVLQYTRYASVGFAIVQAIGQVLFLRPYVNDFSTEWVISSVILLTLGSVFTMYIGERITDLKLGNGTSLLIFTNIISYLPASFGRTIAQAFNDANYIGLGTIVLSFFLLVVGIVYVQEAERKIPLNYASRFTSRSTGLEKSAYLPFKVNSSGVMPIIFSTSSLALPGTLARFTGLTALKKAAVALNPGGSFYLPFNILLIAFFNYYYTFLQLDPDDVSEQLKRQGASIPLVRPGRTTATFIKTVLSRISVLGSTFLAILAAGPAVVEQITHLTAFRGFAGTSILILVGCATDTARKVQAEIISQKYKNIEFYDFDKY

SEQ ID NO: 170940 - protein, 74 aa, Glycine max
  Coding DNA Sequence Number=SeqID_54162
MTKLGLCLSSGPPPLDDKRVRITIRMTKLGLCLSSGPPPLDDKRVRITVRYLRVSWVQNDQTWSLLVIGLAASG

SEQ ID NO: 170941 - protein, 70 aa, Glycine max
  Coding DNA Sequence Number=SeqID_54163
MAGIALSELVSLSKLFTMDGIALSKHVGTKQAVQQYLSSPSHLLPRTQSSRSSQDPNTNSKLGVSYHIPN

SEQ ID NO: 170942 - protein, 300 aa, Glycine max
  Coding DNA Sequence Number=SeqID_54164
  Gene Ontology: Mol. function=receptor activity; Cellular component =integral to membrane; Biological process=response to sucrose stimulus
  Homolog annotation: Hit_ID=Q84N34; Match level="QueryCoverage=90%, HitCoverage=78%, E-value=2e-81, Identity=55%"; Hit description=HHP2
  Pfam annotation: Domain name=HlyIII; Domain location=22-282; Score =173.3; E_value=6.2e-49; Accession=PF03006.10; Description=Haemolysin- III related
MVHTSDGLLSFIRCVYIEGPRKGLRREGHLVGFLVFAAMTVLGGCLSNMFREPAMELLTMGKEINGSRPAITGFLDLHLRHILVPSIIHELRDDGAETIPIWPWFVFLAGGMGCLAFSTLSHLLACHSKPFNLFFWRLDYAGISLMIVCSFYAPIYYVFYCNPYIRTFYLTSISVFGVLAIITLLAPSLSSPHLRPFRASLFLCMGFSGVIPAVHALATHWHHSHVVVALGYELLMAILYATGAVFYVTRIPERWKPGAFDIAGHSHQIFHVFVVLGALAHTLATLLVMEFRRGSPTCTF

SEQ ID NO: 170943 - protein, 148 aa, Glycine max
  Coding DNA Sequence Number=SeqID_54165
VRDADAPILIPTEEVKLVGQTLNTLFAWPTYLVKHLSKQGAMGPAKPAVRPDHHVNDPLYLMTLTIPQLFLKLLQVMWDTTVFRVFNDNFPLYIKHENLSEIAHSGQCLNISVIHLWIMHMTKTKIKEGCVPRSLLEWCTLANGCHFA

SEQ ID NO: 170944 - protein, 159 aa, Glycine max
  Coding DNA Sequence Number=SeqID_54166
  Pfam annotation: Domain name=zf-CCHC; Domain location=116-133; Score =27.5; E_value=2.9e-05; Accession=PF00098.13; Description=Zinc knuckle
MNLQELVATLKVHGQEIKKDEEFKKGKFVALSTQTERKTPSSKESSSRPSSKSVYKALSVEYFSVVEFKEESDEDDELAFIARKIRKMWKNKNGSRWKNFSKKVFKEKKDTRKSSIICYECKKPGHFKSKCPKLEKSKESKSLMSTSEDLDEPPLMKKE

SEQ ID NO: 170945 - protein, 50 aa, Glycine max
  Coding DNA Sequence Number=SeqID_54167
MAPKTGKTKPHKAKGEKKKKEEKVLPIVIEITVETPDESQVTLKVWDTEW

SEQ ID NO: 170946 - protein, 1018 aa, Glycine max
  Coding DNA Sequence Number=SeqID_54168
  Gene Ontology: Mol. function=binding
  Homolog annotation: Hit_ID=Q7EY18; Match level="QueryCoverage=96%, HitCoverage=52%, E-value=0.0, Identity=50%"; Hit description =Putative tetratricopeptide repeat(TPR)-containing protein
  Pfam annotation: Domain name=TPR_1; Domain location=868-901; Score =17.6; E_value=0.043; Accession=PF00515.18; Description =Tetratricopeptide repeat
  Pfam annotation: Domain name=TPR_1; Domain location=910-943; Score =3.0; E_value=2.4; Accession=PF00515.18; Description=Tetratricopeptide repeat
  Pfam annotation: Domain name=TPR_1; Domain location=952-985; Score =6.8; E_value=0.82; Accession=PF00515.18; Description=Tetratricopeptid e repeat
  Pfam annotation: Domain name=TPR_2; Domain location=868-901; Score =23.8; E_value=0.00062; Accession=PF07719.7; Description =Tetratricopeptide repeat
  Pfam annotation: Domain name=TPR_2; Domain location=910-943; Score =8.3; E_value=3.6; Accession=PF07719.7; Description=Tetratricopeptide repeat
  Pfam annotation: Domain name=TPR_2; Domain location=952-985; Score =15.8; E_value=0.16; Accession=PF07719.7; Description=Tetratricopeptid e repeat
  Pfam module annotation: Pfam domain module=TPR_1::TPR_1::TPR_1::TPR _2::TPR_2::TPR_2; Domain location=868-901::910-943::952-985::868 -901::910-943::952-985
MSPIILGWTKVRGARLKDTVEIVSLKPCHLTIVQEDYTEELAVAHIRRLLDIVACTTSFASASAAAAAKPPAGKSKDPNEPGSENGPETNPKPKPVDPNSDLVNAKSDKADADISMCPPPRLGQFYDFFSFWHLTPPFQYIRRSNRPFLEDKTEDDFFQIDVRVCSGKPTTIVASRIGFYPAGKRPLVSHTLVGLLQQISRVFDAAYKALMKAFTEHNKFGNLPYGFRANTWVVPPVVSDNPSVFLPLPMEDETWGGNGGGQGRDGKHENRQWARDFAILAAMPCQTAEERQIRDRKAFLLHSLFVDVSVFKAVSAIKHLVDIKQNSFSNSALPTSYEERIGDLTIKVTRDVSDASLKLDCKNDGNRVLGLSDDELAQRNLLKGITADESATVHDTPTLGAVLISHCGYTAVVKVSGERDMEGSHNSLEIDIEEQPEGGANALNVNSFSLKVLLLFCLLSLRMLLHRSSTPQSSNAIQRIQSSDIEYSHFTRSLVRKVLEESLLKLKEETTRHSKSIRWELGACWVQHLQNQATGKTEPKKEEEAKVEPAVKGLGKQGGLLKELKKKIDIRNSKVEVGKDISPCNGNDINKPEATKQELERQDEEKEIIWKKLLSDAAYTRLKESKTDLHLKSPDELMEMAHKYYVDTALPKLVADFGSLELSPVDGRTLTDFMHTRGLQMSSLGRVVELADKLPHVQSLCIHEMVVRAYKHILQAVVAAVDNVSELASSIASCLNILLGTPSPETNDEDITSCEELKWRWVENFLLKRFGWQWKDENGKDLRKFAILRGLCHKVGLELVPRDYDMDTATPFKKTDIHVACSSADGRTLLESSKTSLDKGKLEDAVNYGTKALSKLVSVCGPYHRMTAGAYSLLAVVLYHTGDFNQATIYQQKALDINERELGLDHPDTMKSYGDLAVFYYRLQHTELALKYVNRALYLLHLTCGPSHPNTAATYINVAMMEEGLGNVHVALRYLHEALKCNKRLLGADHIQAKSISSCTNSSSSNLAIQPPPPQQQQ

SEQ ID NO: 170947 - protein, 203 aa, Glycine max
  Coding DNA Sequence Number=SeqID_54169
  Gene Ontology: Mol. function=binding
  Homolog annotation: Hit_ID=Q1S6C9; Match level="QueryCoverage=90%, HitCoverage=11%, E-value=6e-36, Identity=49%"; Hit description=TPR repeat
MGSLKALPHVQFLHKYASERTAASYHAIAIALSLMEAYSLSVQHEQTTLQILQAKLGSDDLRTQDAAAWLEYFESKALEQQEAARNGTPKPDASISSKDLLDYITPDADQKAREAQKKARAKGKPGQNWETASDENQKDEDMSRGYSITEITNDKENKSEAQIKDHGIDKVESAHLDQTMLNESDNLAQDDSSDEGWQEAVPK

SEQ ID NO: 170948 - protein, 111 aa, Glycine max
  Coding DNA Sequence Number=SeqID_54170
MASVTLRKRGVELRCKDYSPIELSISLFGLTMHTGITLPLCSGILYNKRPTLKNPSTISRPWKILFARINCFFHSSSLRGREDKTTLGTSKPYTGAMRGTVHEPQVNLGAD

SEQ ID NO: 170949 - protein, 112 aa, Glycine max
  Coding DNA Sequence Number=SeqID_54171
  Gene Ontology: Mol. function=oxidoreductase activity; Cellular component=integral to membrane; Biological process=electron transport
  Homolog annotation: Hit_ID=O81973; Match level="QueryCoverage=75%, HitCoverage=17%, E-value=3e-21, Identity=65%"; Hit description =Cytochrome P450 93A3
MLVFIFLYITILGETPLLDMTFQQRLRDPKHWDNPLEFRPERFLSNDHESGKMGQVGVRGQHYQLLPFRSGRRGCPGASLALKVAHTTLPGMIQCFELKAEEKRRVLWSFLN

SEQ ID NO: 170950 - protein, 115 aa, Glycine max
  Coding DNA Sequence Number=SeqID_54172
MTGPCPRLVSIVPIKESSNLLCLISLRHIKTVTSIPMSTKVIHVLANFFEADLFTKEIVFGVTSWVWLSCSVSRLRHFGSDEDGELVRKEIREKERKRRGILRYNLQYLCLHLVS

SEQ ID NO: 170951 - protein, 179 aa, Glycine max
  Coding DNA Sequence Number=SeqID_54173
MTLLLSNVLPSDHNSDLPLPVGVCHPDTDEHPRGPGMAPTRHPLDPDKSNRALGFPALIMGLCQSYGVLVSPIKAQGDAHQAADAPPPPRQADPAGSLGVECYLQHLVRQQATNHRGQGSAPFVCPTLEQFGDEVAWPGDWHDAQVREEPAGSLGEADESHMDEDMTDLLGFLGGSGAT

SEQ ID NO: 170952 - protein, 52 aa, Glycine max
  Coding DNA Sequence Number=SeqID_54174
MEDHLYCKDLHEPIIYKDKVEVKVKERSTQRIIFIRLKPKTTSSSWQPPRFH

SEQ ID NO: 170953 - protein, 106 aa, Glycine max
  Coding DNA Sequence Number=SeqID_54175
MQKIPKREGKRVSWKLFLTLGLPRPPNNFMVKGAEREVLRSRGEGLGKKKRKEEGRREKEAKSPSSRSCNRFLHRSSVVLRLFFVYSSFFIRLVFVFKDLNMIHDP

SEQ ID NO: 170954 - protein, 155 aa, Glycine max
  Coding DNA Sequence Number=SeqID_54176
MEMTIVRANNEEGTKAVHDGFTNKISFQHHDQKIILKPLSPREVQIAKKNESYAKQANKKRKEVVLEPGDDHGHFWANAFQEGRNDENPKIGQIQGPMTKSRTKHSVDTFQQMVAVIFNKAQVEKDESPSGEGRRPKWRRMKAQVEKDEGPSGEE

SEQ ID NO: 170955 - protein, 180 aa, Glycine max
  Coding DNA Sequence Number=SeqID_54177
VRKAWDAAQRKDKELRGSSNGIIGGYHKWLRVRTQGLDWLPKLRAARKEEAETPEESEEVQALKAELEQARAVKEKFKSTAIKVRKEYDELKDINMATTEALEQETKKALKEEHDRNKFRGALWGRYNELKLQRDEKDQSRVEVMILKDELKDCHRSKRSLSQQLSKTEGNIWAIINDYK

SEQ ID NO: 170956 - protein, 65 aa, Glycine max
  Coding DNA Sequence Number=SeqID_54178
MCIVGTKSAVTWSFLDQKFMKGPLWAMESVKEITEKLLAKTNTDNPEIVTRSTGSRKKKRDTFKQ

SEQ ID NO: 170957 - protein, 234 aa, Glycine max
  Coding DNA Sequence Number=SeqID_54179
MMPWKSADKRKWKTLNYYPNFLQKKRILLSQPTIRREGDTRLMGASSKEGKMHGVATNVYSRKTREKPKAGLRILRNKGSGVFYAQGRKMSGGGCTSAHPCELVVSSKGNLACLSELVASSLSFLVSMHQGCRWTIRNGLKVKIWDDPWLRDSNTHVRSAVPLACKIWVVNTLFEQDGAIDGLKMSKSPKRKESNLELEHSPKEEFGMREIQFPANLRLGIFISYVCHDSQTLK

SEQ ID NO: 170958 - protein, 86 aa, Glycine max
  Coding DNA Sequence Number=SeqID_54180
  Gene Ontology: Mol. function=RNA-directed DNA polymerase activity; Cellular component=chromatin; Biological process=RNA-dependent DNA replication
MDPSKVRAVLEWPIPTSTKDIRKFLCLTGYYRRFIRDYGKMTQPLTALSDFTQEFVIEWDVSGQGIGVILMQNQQPIAYFSKALSL

SEQ ID NO: 170959 - protein, 76 aa, Glycine max
  Coding DNA Sequence Number=SeqID_54181
MEEMRESGLEDWVEIEDSCDSSKFDGGKVSFHGIEMLGCHPSAHTRKGRLSMKSTNDMSSIKDPKDDISNHRNTPL

SEQ ID NO: 170960 - protein, 98 aa, Glycine max
  Coding DNA Sequence Number=SeqID_54182
MELLIILLLVTRDSLADSVGHTTIDRQKKTKKTMSFEDHNQLITLQGTNPVSVRQYKNAYHHKDEIKRQVQELLTKDIIRHSISPFSSPIILVKKDES

SEQ ID NO: 170961 - protein, 301 aa, Glycine max
  Coding DNA Sequence Number=SeqID_54183
  Pfam annotation: Domain name=AT_hook; Domain location=226-238; Score =14.9; E_value=0.061; Accession=PF02178.9; Description=AT hook motif
MERECSLKNLNQNMGLNSTVPINQTFFEVYLHRRQVDGETRVGVFAACSIEAGEPLTYDYRLVILANSSWIPILLQEFHSIPMGNGWPFGLIHIEDWLKMSIGVLALENLRHGLALLCDAKVPIKLKGKFYRTAVRPAILYGTECWAVKSQHENKVGVAEMRMLRWMCGKTRQDKIRNKAIRERVGVAPIVEKMVENRLRWFGHVERRPVDSVVRRVDQMERRQTIRGRGRPKKTIREVIKKDLEINGLNQSMKYKGCEQREETREQFFRVPMCKLAGNSTRVMGWSEIPLAILPECNGFA

SEQ ID NO: 170962 - protein, 201 aa, Glycine max
  Coding DNA Sequence Number=SeqID_54184
  Homolog annotation: Hit_ID=Q1SKD7; Match level="QueryCoverage=75%, HitCoverage=39%, E-value=8e-07, Identity=27%"; Hit description =Ankyrin
MNFATSDFVPLKDWAKYLQIVVPRKILTERNVVIYHTEFDDFKEELERRNWHEELTSFVEGSIDVAIVKEFYANLYDPEDKLPKQVRVRGHLVKFDEDALNTFLKTPVIIEEGGTLSTYSMFALLMPDPQELAAKLCIPGRGFELNADGLSLKILRKSLTTIAQTCSVLSFSNLVPTSHTSNITLDRAKLIYRIIQRIGPS

SEQ ID NO: 170963 - protein, 67 aa, Glycine max
  Coding DNA Sequence Number=SeqID_54185
MQREKGEAEEEKKRRSRRGHGTRLVFTILPGPALRPNYEGTAEIFNFPVKDKSGLRSVSTGRKDALK

SEQ ID NO: 170964 - protein, 145 aa, Glycine max
  Coding DNA Sequence Number=SeqID_54186
  Homolog annotation: Hit_ID=Q1S7C5; Match level="QueryCoverage=57%, HitCoverage=7%, E-value=3e-10, Identity=39%"; Hit description =Integrase, catalytic region
MTSANNNSSLPPPLPPPPPPVPMLVQLVIIRHGLLGCIPSLQIPQKFLIAENRDNNIVSIAYRFWEQQDQLILSWLQSTISEAVLPCIINCATLWHLWDRLYEHFQSIACAKKKQLLSELRSSSLETIYMQKPLGLESSDKTLVC

SEQ ID NO: 170965 - protein, 151 aa, Glycine max
  Coding DNA Sequence Number=SeqID_54187
  Gene Ontology: Mol. function=RNA-directed DNA polymerase activity; Cellular component=chromatin; Biological process=RNA-dependent DNA replication
MDKSLKVGEDEWRERERKGTKFMPQMRMAPTELVELKKQFNKLTIKNKYPLPRIYDLKDHLHGATIFSKIYLRSRYHHIRVKDEDIPKMTFQTQRGHYEYEVMPFGVTNDPDIFMDYMNRIFCPFLDKFVVVFIDDILICSFFLMKNMENI

SEQ ID NO: 170966 - protein, 49 aa, Glycine max
  Coding DNA Sequence Number=SeqID_54188
MPRCTRHLQYLKVVDCRVGSDQHIRIDGTPIPKLPTQKALSQSPSRVAK

SEQ ID NO: 170967 - protein, 348 aa, Glycine max
  Coding DNA Sequence Number=SeqID_54189
  Gene Ontology: Mol. function=galactosyltransferase activity; Cellular component=membrane; Biological process=protein amino acid glycosylation
  Homolog annotation: Hit_ID=Q67X53; Match level="QueryCoverage=95%, HitCoverage=52%, E-value=6e-84, Identity=48%"; Hit description =Putative beta-1,3-galactosyltransferase
  Pfam annotation: Domain name=Gal-bind_lectin; Domain location=179 -348; Score=98.5; E_value=1.9e-26; Accession=PF00337.12; Description =Galactoside-binding lectin
MKIQDYWLVHRIIKMKKLYGGVLIVSLFTLFMLMILRYGVMKNPIGEGYLTIPAIINGTNPLEWINPTVPAAIKKHPDGPSQVISSDILVSSLFTGSNFSKEEQQALQTWNQLNHLIDNVQGLPNAAEAIKEAASAWNSFISSIEEQKQGHGNDSSRAKEKQCPHFLNKMNSTELGNSSYKLQLPCGLTQGSSITIIGIPNGLLGNFRIDLTGEPLPGEPDPPIVLHYNVRLHGDKITEDPVIVQNTWTQAHDWGEEDRCPSPTPEKVEKVDDLEQCNKIVGRNISQHHTAGMHSHSSRQSSTMEEQSINRKYFPFKQGYPFVATLRVGSEGIQMTVDGKHITSFAFR

SEQ ID NO: 170968 - protein, 87 aa, Glycine max
  Coding DNA Sequence Number=SeqID_54190
MAENVERERERNYRRFCVCIVSVFSKVKFRCSFVSSSSFFSPCDRGSFNLIVRRFKEKKDRETKVKTPTETPRYRVLRCNWSSWIHA

SEQ ID NO: 170969 - protein, 282 aa, Glycine max
  Coding DNA Sequence Number=SeqID_54191
  Homolog annotation: Hit_ID=Q5RZZ9; Match level="QueryCoverage=12%, HitCoverage=3%, E-value=3e-09, Identity=83%"; Hit description =Pyruvate orthophosphate dikinase
MTFGYSRDDVGKFLPTYLSDGILQHDPFELLLRVGVVNALSVLRVPPLSASVHYTHNTSSYRVFKKDQVGVEEVRDTDAPIHVPTKEVKVIGQTLNTFLAWLTHLVKHLSEHGAVGPAKPVDRPDHEVDDPLYLMTLTIPQLFLKPLQHENLFEIAHGGQCLNISVIHLWILHMIETRMRVGNVDVYGFLEPQSIQRSGHRNLNQKDLLHQWIPLLLGRRMAAEWRRKRERRCHFKEKMSLEEAHHHRRPWIRAWRKKETNEGRGREEHEILCSKRALKSEV

SEQ ID NO: 170970 - protein, 444 aa, Glycine max
  Coding DNA Sequence Number=SeqID_54192
  Gene Ontology: Mol. function=sequence-specific DNA binding; Cellular component=nucleus; Biological process=regulation of transcription
  Homolog annotation: Hit_ID=Q1RWH4; Match level="QueryCoverage=87%, HitCoverage=92%, E-value=1e-72, Identity=37%"; Hit description=WRKY DNA-binding domain, putative
  Pfam annotation: Domain name=WRKY; Domain location=217-264; Score =20.9; E_value=1.9e-06; Accession=PF03106.6; Description=WRKY DNA -binding domain
  Pfam annotation: Domain name=WRKY; Domain location=326-385; Score =130.1; E_value=6e-36; Accession=PF03106.6; Description=WRKY DNA -binding domain
  Pfam module annotation: Pfam domain module=WRKY::WRKY; Domain location=217-264::326-385
MPNRFTHLVELDLTQFVSHSFYPGVIDSDLAIIGIAFMAPIAKEGTAVAEGLVGNDNKDEETQQNQQQITDSSLSTESRTSTPSDGAPPNSETLVLRSSLLHDLATHMQGSSTARKGGKAESKVSAQPPDEETVVKDAVEAPKKQTENRLQSFCSTSLSGVSPTSVSHSLSSALSPTVPQQRPSPPKANSVQVPKVDKGTPSDGTTLSSVSVARASASDGYNWRKYGQKQVKSPMGSRSYYSQHSHDPPHKIDTAKESKLLPSSEPKVESSVSKHSTNVLNDSDPSSSPKELLQETPCSGDKNLENSSNVENGKIILNDEHDVGISGDGYRWRKYGQKLVKGNPHFRNYYRCTTAGCPVRKHIETAVDNSKALIITYKGMHDHDMPVPKKRHGPPSASLVAAAAPASTNNVQLKKTGLLQNQETEAQCLEDTEGELTGEALDLG

SEQ ID NO: 170971 - protein, 198 aa, Glycine max
  Coding DNA Sequence Number=SeqID_54193
  Homolog annotation: Hit_ID=Q2HRX8; Match level="QueryCoverage=69%, HitCoverage=18%, E-value=4e-16, Identity=34%"; Hit description=IMP dehydrogenase/GMP reductase
MAAKLNSLRQYALRDLTQARRYAWGATGLVHMYDHLNDASIGTSRQVASYITLLQHFPSVSECNADPDHDEVSPRACQWIATKKTVKKISTTTYRQRLDCLRILDVCWMPYAEHRPVQEFHPITCFLGQLLWGPVVVRYRPERVMLQFGCVWCIPAHPVDSWVSFDDVDDRWAHYSDHLAPASDICVVPGQCAFDYID

SEQ ID NO: 170972 - protein, 228 aa, Glycine max
  Coding DNA Sequence Number=SeqID_54194
  Gene Ontology: Mol. function=endoribonuclease activity; Cellular component=lysosome; Biological process=RNA catabolic process
  Homolog annotation: Hit_ID=Q9FQL6; Match level="QueryCoverage=88%, HitCoverage=88%, E-value=1e-100, Identity=78%"; Hit description=S -like ribonuclease
  Pfam annotation: Domain name=Ribonuclease_T2; Domain location=28-217; Score=363.0; E_value=4.7e-106; Accession=PF00445.9; Description =Ribonuclease T2 family
MYALNKLLEKECDMIRISHNMPYKLFEFDFFYFVQQWPGAYCDTKQSCCYPKTGKPAADFSIHGLWPNFKDGSWPSNCDPDSVFDKSQISDLISNMEKDWPSLSCPSSNGMRFWSHEWEKHGTCAESELDQREYFETTLKLKQKVNLLRILKNAGIEPDDEIYTLERVTEAIKKGTGFTPGIECNRDSARNSQLYQVYMCVDTSGSNLIECPVLPRSRCGEQIQFPKF

SEQ ID NO: 170973 - protein, 112 aa, Glycine max
  Coding DNA Sequence Number=SeqID_54195
  Gene Ontology: Mol. function=endoribonuclease activity
  Homolog annotation: Hit_ID=Q9ZQX1; Match level="QueryCoverage=77%, HitCoverage=39%, E-value=7e-36, Identity=72%"; Hit description =Ribonuclease T2
  Pfam annotation: Domain name=Ribonuclease_T2; Domain location=27-111; Score=-44.6; E_value=6.5e-05; Accession=PF00445.9; Description =Ribonuclease T2 family
MEFKGSVFIKLLLLLHFFSVLCASQDFDFFYFVQQWPGSYCDTQKSCCYPTKGKPAADFGIHGLWPNYNDGKYPSNCDPNNPFDPSGVLHSAPIEFFILSCVASKTVLLLTL

SEQ ID NO: 170974 - protein, 153 aa, Glycine max
  Coding DNA Sequence Number=SeqID_54196
  Gene Ontology: Mol. function=ATP-dependent helicase activity; Cellular component=nucleolus; Biological process=rRNA processing
  Homolog annotation: Hit_ID=Q1S897; Match level="QueryCoverage=97%, HitCoverage=24%, E-value=2e-46, Identity=54%"; Hit description =Helicase, C-terminal
  Pfam annotation: Domain name=Helicase_C; Domain location=1-53; Score =32.8; E_value=1.2e-06; Accession=PF00271.21; Description=Helicase conserved C-terminal domain
MDRFHENENGILVATDVAARGLDILGVRIVVHYQLPHSAEGYVHRSGRTTRAFAEGCSIALISSRDTSKFVSLCKSFSKDKKNWFDRNASSLELVTENYDSEEAQVNKHKQMKTISRQLKKLQKMQVMVLKEIQTLLQKGYTKMVLKEIQTRF

SEQ ID NO: 170975 - protein, 186 aa, Glycine max
  Coding DNA Sequence Number=SeqID_54197
  Homolog annotation: Hit_ID=Q94K24; Match level="QueryCoverage=37%, HitCoverage=31%, E-value=3e-21, Identity=70%"; Hit description=Ran binding protein-1
  Pfam annotation: Domain name=Ran_BP1; Domain location=115-185; Score =17.7; E_value=2.1e-09; Accession=PF00638.9; Description=RanBP1 domain
MAKFETSSSVGMLAIVEDRDGVDVGIEDGPHASRCDGDGLTSVRGGDGVGATSKDLTGIDTVDMDGVAIITDKEEKMQSWIYNGLSFSHFSSFLLPDFTIFPLIGAIDACFLADRNKLKLYQFDKDENQWKERGADTMKFLKHKASSKVRLLMRQSKTLKIYANHLILPMMSVQEQAGNEKSRVFY

SEQ ID NO: 170976 - protein, 402 aa, Glycine max
  Coding DNA Sequence Number=SeqID_54198
MIKNEQLKHGQQEKWFNNFHENLDLNVTAQELEQQPDFRWELLENRYSQYSELSGKIEKHRDSISLEAQQQGNQIPQTKISEACVNDLLILAQSAEIVAQSEDSVAGEHTNNQKNKDLQSDLIDQMSQEHASNINVDDQECSLELLDRLSAVCHRDDNSRCKHSQGKTIRLNQIKHQARCKSKNDLAPQMISRAENEQPKGRILRLSQMKHRARSKGNSTVKDGTEKHMDQSLPCNRFKDSSPSVEDVPAHNFRGAIQSSVVRRDIENLKEHQRIARRLRAFKTKKLRQQFRRECKRSVSSAGLHAMGTSLTGLKGYKVLGSPTTMASFCSVVLPRSYQLVSCFSNYNGVDDDAIVAIKEWMLYMNHMHLKEYHRVVACQHRAECVEEKRASNVKKKNNPAL

SEQ ID NO: 170977 - protein, 477 aa, Glycine max
  Coding DNA Sequence Number=SeqID_54199
  Gene Ontology: Mol. function=hydrolase activity; Cellular component =integral to plasma membrane; Biological process=cell-cell signaling
  Homolog annotation: Hit_ID=Q1S6W0; Match level="QueryCoverage=97%, HitCoverage=98%, E-value=1e-169, Identity=65%"; Hit description =Nucleoside phosphatase GDA1/CD39
  Pfam annotation: Domain name=GDA1_CD39; Domain location=47-476; Score= 127.3; E_value=4.3e-35; Accession=PF01150.8; Description=GDA1CD39 (nucleoside phosphatase) family
  Subcellular localization annotation: CTP_CleavageSite=88; ConfidenceScore=5.66e-01
MDPIKTKTRSNNLFSRNPKPSQSRSLRSVILISLSLSFLFLVSYYAFSSPMANFRYRIIVDGGSTGTRVHVFKYRSGRSLEFGRDGLKSMRVNPGLSAFAEDPQGAGGSVAELAEFAKRWIPRESWGETEIRLMATAGLRMLDAAAQERILASCRKVLRDSGFKFRDEWASVITVWSWTGVKLLIGSLDEWDGHKTSHMELCSWNVFFVGVSGRGNGSDEGMYAWVVANYALGTLGGDPLETTGIIELGGASAQVTFVSREVVLPSFSRTVKFANTTYNLYSHSFLHFGLNAAHDSWKEALVLGEFNLASQSLQEGLRIDPCTPTGYSYNVESWKFPPSTESEKKHQSIVQTRGNFSECRSAALTLLQKGKESCSYQHCDIGSTFIPKLQGKFLATENFFYTSKFFGLRSRAYLSKLMSVGQEFCGEDWLRLKKKYVSHDEDDLLRYCFSSAYIVALLHDSLGIALDDERYSCLFFF

SEQ ID NO: 170978 - protein, 80 aa, Glycine max
  Coding DNA Sequence Number=SeqID_54200
MVLGLLMWRHCCDYDENIYPLKLDGHIILLKATPSGAQIVNHWILDAELSVIPIALLVSDNSKARSGAGQPRNCCQGELV

SEQ ID NO: 170979 - protein, 512 aa, Glycine max
  Coding DNA Sequence Number=SeqID_54201
  Gene Ontology: Mol. function=zinc ion binding
  Homolog annotation: Hit_ID=Q7X6Y7; Match level="QueryCoverage=98%, HitCoverage=74%, E-value=2e-80, Identity=33%"; Hit description=Male meiotic MMD1
  Pfam annotation: Domain name=PHD; Domain location=456-504; Score =39.2; E_value=1.4e-08; Accession=PF00628.19; Description=PHD-finger
MNKGHMMHGVFHSNGFGHLLCINGLEMGSNLAGNQIMEFWNRLCYGLQARKVSLNDISQKRGMELRLVNGIAYNESWFGHWGYKFGRGCFGVTQSMYHKAIQAIRSMPLYLIIHHIANSNHGIPLIFSRYQTLSDQSLVTLGDLFCYMLDLKSRLPRETCISSYNTNTLAVETNCRWSPKRIEMATRVIVEALKRTKFRWVSRQEVRDAARAYIGDTGLLDFVLKSLGNHVVGNYLVRRSLNPVTKVLEYCLEDISNVHPYDNEGLVMSNKVKDKYKITRAQLMKDMLYLYKYILIDPKPMMGSEFLSAIPLAARIILDTKYFIKDYFGDIPYQVELGSNDKLNLYCTIWLRNNVGSDEYLNKAIMPPHECFTLKRNATINDLKLEVERNFREIYWGLRSFVVESFRNLSVNNETEMVFGLIEVGGKVVLEGWQGDIGINMIEQICESDPNNGIMDCTCGTIEDDGERMVSCDICEIWQHSRCVRIPNDEEIPHIFLCKKCEQEIVLFPSLP

SEQ ID NO: 170980 - protein, 43 aa, Glycine max
  Coding DNA Sequence Number=SeqID_54202
  Homolog annotation: Hit_ID=Q1SFG1; Match level="QueryCoverage=93%, HitCoverage=5%, E-value=2e-14, Identity=90%"; Hit description=AAA ATPase
MGAIQGVPKIKEGYNPATWMLEVTSAGIEASLKVNFTNVYRNS

SEQ ID NO: 170981 - protein, 70 aa, Glycine max
  Coding DNA Sequence Number=SeqID_54203
MEGENSSTIRAKEEKVKAADDSLSKANWLSEMHPLSEASSSLSGWETLEEDKLEICTANMPSEDVVSSRA

SEQ ID NO: 170982 - protein, 376 aa, Glycine max
  Coding DNA Sequence Number=SeqID_54204
  Gene Ontology: Mol. function=binding; Cellular component=membrane; Biological process=protein folding
MDGGEHAPGRLVIEEITEDVPSGSSSLEQTVVQPKKSGDSSKSYSTANNGNPKTNADSLDALKKDPEAVRSFQNFISNTDPDMLASLNAGQFKDVSPDMIKTTSDMVSKMSPEELQRMLDMASSFQGDNPFFRGGSPDSSFNPGSMPPNVTPDMFKAASDMISKMPADELKRMFEMASSLKGKESTPLAAAVDENERNVSRSNLPSSSTNGTTAFGESSSHNVFSNMRNASQSNFPSSSTDLQEQMRNQMKDPAMRKMSLPLSKIDFSYSHCIFFWQVVQMFSSMVKNMSPEMMANMGEQFGVKLSPGEAAKAHQAMSSLSPESLDKMMLWADRIQRGVESARKTKNWLLGKPGMIFAIFMLILAVILHRLGFIGG

SEQ ID NO: 170983 - protein, 197 aa, Glycine max
  Coding DNA Sequence Number=SeqID_54205
  Gene Ontology: Mol. function=zinc ion binding
  Homolog annotation: Hit_ID=Q0KIL9; Match level="QueryCoverage=84%, HitCoverage=92%, E-value=8e-36, Identity=50%"; Hit description=Zinc finger protein, putative
MGCLLPRYQTQASCIDIQCSLKFYIHPYQPGYTAPPPRPNPEETTIDIGGGWTISGTPLDLRDPRLLAIAEAERQFLDAEYDEYAASNASGAAFCRSAALILMALLLLRHALSVSDGDNSDDDPSNFFSLFLLRAAGFLLPCYIMAWAISILQRRRQRQEAAALAATQVAFVLQSGQRRGLQFAIAPGSPTVPQEQV

SEQ ID NO: 170984 - protein, 94 aa, Glycine max
  Coding DNA Sequence Number=SeqID_54206
MKSWMQSSKCDDCLGVYLNGPDNYLKGKINSALKGLDNTPQPKSKAGARWIIVKCNKQKESTECGYNIMHWISTIILGTFRNNWETIIVYFKQS

SEQ ID NO: 170985 - protein, 184 aa, Glycine max
  Coding DNA Sequence Number=SeqID_54207
MGGILQGVHKAWSVVQKKYKELRGSSNGIIDGYHKWLKARMQELDWLPKLKVSSEAEAETPEESEEVQVLKEELERAQAVKEKFKTTAIKVRKECNKLRDVNTTTAKALEQETKRARKEEWGRNKFRGALWGSNNKLKLRRAERDQSRVKSMILEDELKACQWSKRSLSEHLSKTNENMWAIID

SEQ ID NO: 170986 - protein, 85 aa, Glycine max
  Coding DNA Sequence Number=SeqID_54208
MVFHPSRTIILLLFVGFLISIQTENVLGLRSSEIALRHSHKDQRILLQNQDALKATEELSNTKKNSANANKGRNRTKKNSENFTH

SEQ ID NO: 170987 - protein, 291 aa, Glycine max
  Coding DNA Sequence Number=SeqID_54209
  Gene Ontology: Mol. function=DNA binding; Cellular component=nucleus; Biological process=regulation of transcription
  Homolog annotation: Hit_ID=Q6L416; Match level="QueryCoverage=71%, HitCoverage=59%, E-value=2e-42, Identity=51%"; Hit description =Putative ZF-HD homeobox protein, identical
  Pfam annotation: Domain name=ZF-HD_dimer; Domain location=41-102; Score=137.1; E_value=4.7e-38; Accession=PF04770.3; Description=ZF-HD protein dimerisation region
  Subcellular localization annotation: CTP_CleavageSite=40; ConfidenceScore=5.13e-01
MDLTKDTNSQTPPQPNTTTNGSLKHHHHHPTTVSPPQQPPSTTVFYKECLKNHAASIGGHALDGCGEFMPSSSSNPNEPRSLTCAACGCHRNFHRRRDTQENHHRSNSRPNFISFYHSPPLSRHGPGLSPTPSPMSSPSPSPPPISHHFPPSSHHFQGPIPAHGLLGLGNENHHHHMSFNFNSSSHSTQGNTSGKKRHRTKFSHEQKQKMYNFAEKLGWRMQKAEEGLVQDFCNEIGVSRGVFKVWMHNNKNTSARNKSLEPGEKINGTGTHSNNNNNHPYNTNSTNDDTH

SEQ ID NO: 170988 - protein, 246 aa, Glycine max
  Coding DNA Sequence Number=SeqID_54210
MGHIDARGGGGMMMGGVHTTTTAQKQKVVMEVWGEVNRVCLGEKRPPCAIRIIPELIKNTLSSRNERMKISVVEVESFCDVDSGIKKEGVVKLLAAVGDAWGLLLARRGTTAMGSGADKGVGCDCMSVGGGGGVGMGGGVDMGDGVDVGNRVDKGDWLCCIGTGHEGAVSVEGGGDGGDCTEEEDGYNKFGHGDLKAVLSSGRKFDVRHSSWYGNHGLSMKAPKCYVLKFENQDKSPKREEEKELS

SEQ ID NO: 170989 - protein, 1149 aa, Glycine max
  Coding DNA Sequence Number=SeqID_54211
  Gene Ontology: Mol. function=structural constituent of ribosome; Cellular component=intracellular; Biological process=translation
  Homolog annotation: Hit_ID=Q42351; Match level="QueryCoverage=12%, HitCoverage=79%, E-value=9e-38, Identity=61%"; Hit description=60S ribosomal protein L34-1
  Pfam annotation: Domain name=DUF1666; Domain location=669-881; Score =256.2; E_value=6.7e-74; Accession=PF07891.2; Description=Protein of unknown function (DUF1666)
  Pfam annotation: Domain name=Ribosomal_L34e; Domain location=983 -1132; Score=168.2; E_value=2e-47; Accession=PF01199.8; Description =Ribosomal protein L34e
  Pfam module annotation: Pfam domain module=DUF1666::Ribosomal_L34e; Domain location=669-881::983-1132
FHEETEGETESSVSFMEVAPESERRDGETEFSAFSMEITPESEKRNVETDCSVFMDIHCDAHEDGVKTEVPTESSVSEEIDSDIREGGMSRGIEEEGFVFMKSESENSIIHENSHEVGKETDELFSKETNSDVHQHGKKIDEDEIENFVYLENDSGLHHRIMKREEEEEIDEPVSAEIDSVVHEEFKKIDENETGSGALMENVSSETVNDDGEKIDENEDSVFEEQESNVHGDDTKREEKEEETNVPVLGDSNSVTTTSKCEYLSGKDISGFMEEPTTLRFSFREFYMGPDVSTVSDNAYASTKIIADKEFSEFGSEKKPLAQAQTEDSVQEEVSAPSTHIPLHFESEMFGGSDSSDEDYFLYNENSVTSDSESESSSSSGLNWGNSNKMDDSIVYQFLGGKNGGEGFQPEILKLMMREERAEDVEEKHSSCDGKVSEFSAHGIYSKDGYVEMEPCMKGLKSLKAHGFGGKESKKAVVKDQREGSKNKEEEVCRNGLKRNEEIRWEDELSDSESDEGDFEWEHDDLVEQLKLELKNSRQGGLATILEEVEEANEEEEVVAFEEEERVSPRVVEDPKPMEIEEKLEYKDQIDEIHIVYKSYAEKMKKLDILNYQTMHALGLLQLKDPLKLISLPKSAIQGAKPVISQNLWPRKASKNSSDPLVKLVHELHRDLELVYVGQVCLSWEILCWQHKKALELQQYDSQGSHSHRYNHVAGEFQLFQVLVQRFIENEPFQGPRLQNYVKNRCVIRNLLQVPGIKDDSKGDEEEDAIASGKLADIIKESMRVFWEFVRADKDYGNVIFKASQHNRIDLKDPIISGLMVDIKTQLQKKDRRLKDIVRTGNCIVKKFQKHHEDQLDHEQLVAQEDCPERVLLGAPSIFAASYSIFKELSSRFPLFPAALSLVRGGSKVECSSEGEVSGVKRCGGRWRQTSFLRIKQVAPRGIPPYGVDETQMLLAAHVFAFAENPNNTGAERDPLTKMVQRLTYRKRHSYATKSNQHRVVKTPGGKLVYQTTKKRASGPKCPVTGKRIQGCDKKLLAQVDQYLGPLTKIWGSITGLFMEGQLQIPLYPKRADPVGGGLHLLIPHLRPAEYKRSRLPRNRRTVNRAYGGVLSGSAVRERIIRAFLVEEQKIVKKVLKIQKAKEKQASKA

SEQ ID NO: 170990 - protein, 441 aa, Glycine max
  Coding DNA Sequence Number=SeqID_54212
  Gene Ontology: Mol. function=DNA binding; Cellular component=nucleus; Biological process=regulation of transcription, DNA-dependent
  Homolog annotation: Hit_ID=Q9ZVH0; Match level="QueryCoverage=54%, HitCoverage=56%, E-value=4e-91, Identity=68%"; Hit description =Putative NAC domain-containing protein 9
  Pfam annotation: Domain name=NAM; Domain location=17-145; Score =293.2; E_value=4.8e-85; Accession=PF02365.6; Description=No apical meristem (NAM) protein
MEERNNNDAAEKLDEVMLPGFRFHPTDEELVGFYLKRKIQQRPLTIELIKQLDIYKFDPWDLPKLATTGEKEWYFYCPRDRKYRNSARPNRVTGAGFWKATGTDRPIYSSEGSKCIGLKKSLVFYKGRAAKGVKTDWMMHEFRLPSLTDSLSPKYIDKITIPANESWAICRIFKKTNATAQRALSHSWVSSLPETRTSDHHILTKDQDNTTQFCSDNMSMTKKTTLASQYCSNNYNDSQPLTTNSSTLCPLDVASCKSIINPLLYKAFDHFPISNEDLSTSLLFSSPPFETSETNPKSTIMDVSSMLLNMSSSVLGDFNKTTSEDTNTNAASNFGVLQEHCSGYPIPFLRENMQTTFGNQQQQYCDNIYALVKGPNVNVPRVDDPELELETVVQRSIGFPLSVTMPLNIGDAWKSNNLLWDTSSFPCDVPSSYYSTTKCYT

SEQ ID NO: 170991 - protein, 66 aa, Glycine max
  Coding DNA Sequence Number=SeqID_54213
  Homolog annotation: Hit_ID=Q84VH5; Match level="QueryCoverage=98%, HitCoverage=30%, E-value=7e-15, Identity=65%"; Hit description =Envelope-like protein
  Subcellular localization annotation: CTP_CleavageSite=52; ConfidenceScore=5.45e-01
MGVFPFLLCNLSAMPGANLLAMGSSSDSTSSRSMRSPGAEGEPGDEVSFGEVAMEKQSLWSGFVNL

SEQ ID NO: 170992 - protein, 665 aa, Glycine max
  Coding DNA Sequence Number=SeqID_54214
  Gene Ontology: Mol. function=methyltransferase activity; Cellular component=cellulose and pectin-containing cell wall
  Homolog annotation: Hit_ID=Q1SBL8; Match level="QueryCoverage=99%, HitCoverage=100%, E-value=0.0, Identity=77%"; Hit description =Putative methyltransferase
  Pfam annotation: Domain name=DUF248; Domain location=93-654; Score =1191.9; E_value=0; Accession=PF03141.7; Description=Putative methyltransferase
  Pfam annotation: Domain name=Methyltransf_11; Domain location=210 -305; Score=20.5; E_value=0.00052; Accession=PF08241.2; Description =Methyltransferase domain
  Pfam module annotation: Pfam domain module=DUF248::Methyltransf_11; Domain location=93-654::210-305
MAKPSSANGRTRSHVQIFIVVGMCCFFYILGAWQRSGFGKGDSIALEITKKGADCNVVPNLSFDSHHGGEVSKIDEFESKSKVFEPCDARYIDYTPCQDQRRAMTFPRENMNYRERHCPPEEEKLHCMIPAPKGYVTPFPWPKSRDYVPYANAPYKSLTVEKAIQNWIQYEGNVFRFPGGGTQFPQGADRYIDQLASVIPIKDGTVRTALDTGCGVASWGAYLWSRNVIAMSFAPRDSHEAQVQFALERGVPAVIGVLGTIKLPYPSAAFDMAHCSRCLIPWGANDGMYMMEVDRVLRPGGYWVLSGPPINWKINYKAWQRPKEDLEEEQRKIEETAKLLCWEKKSENSEIAIWQKTLDTESCRSRQEESSVKFCESTDANDVWYKKMEVCVTPSPKVSGDYKPFPERLYAIPPRIASGSVPGVSVETYQEDNKKWKKHVNAYKKINRLLDTGRYRNIMDMNAGLGSFAAAIQSSKLWVMNVVPTIAEKSTLGVIYERGLIGIYHDWCEGFSTYPRTYDLIHSDSLFSLYKDNYSKFIKYQFISNIFGHQGCLAQLVEQGVQVLTCWGVYNNSRTHAQSTFVESNVCLYILCDTEDILLEMDRILRPEGAVIIRDEVDVLIKVKKLVEGMRWNTKMVDHEDGPLVPEKILIAVKQYWVANATSTQ

SEQ ID NO: 170993 - protein, 467 aa, Glycine max
  Coding DNA Sequence Number=SeqID_54215
  Gene Ontology: Mol. function=DNA binding; Cellular component=nucleus; Biological process=regulation of transcription
  Homolog annotation: Hit_ID=Q1SLX7; Match level="QueryCoverage=82%, HitCoverage=87%, E-value=2e-90, Identity=52%"; Hit description =Homeodomain-related
  Pfam annotation: Domain name=Myb_DNA-binding; Domain location=139 -185; Score=54.8; E_value=2.8e-13; Accession=PF00249.21; Description =Myb-like DNA-binding domain
  Pfam annotation: Domain name=Myb_DNA-binding; Domain location=191 -236; Score=52.5; E_value=1.4e-12; Accession=PF00249.21; Description =Myb-like DNA-binding domain
  Pfam module annotation: Pfam domain module=Myb_DNA-binding::Myb_DNA -binding; Domain location=139-185::191-236
  Subcellular localization annotation: CTP_CleavageSite=29; ConfidenceScore=5.49e-01
MASSKCCMISPQQNQNAPTCYPSPMGMVYADMMGSLSLATVSNNASSSQESNGYSYGYASGVENARSTRWSFPFTREFLSSNFEDCSDVVVGAGDSNNNINEKTNHNNGKFSEEESNPNENNPAGGKEVDSGHSKLCARGHWRPAEDSKLKELVALHGPQNWNLIAEKLEGRSGKSCRLRWFNQLDPRINRRAFSEEEEERLMQAHRIYGNKWAMIARLFPGRTDNAVKNHWHVIMARKYREQSSAYRRRRMSQPVYRRVDQNPTFVCSSRDNNASTTEPEPESSPSYYPNLNDRGVALTNNMASFPSLHGVAAGAGGVVEFGSNVSPLNMTRGREAVSNTTHVGLCAQAQQQAPFDFFSGGGSHDMVLESMSQMRSRERTNESYNHHCQLSGFYPHHPQQYLMAMQQQLDNNNFYSFLNSSSSASTTRTREPSSPCVAEIRDKVVNSDPPDGVPPPFFDFFGVGAT

SEQ ID NO: 170994 - protein, 110 aa, Glycine max
  Coding DNA Sequence Number=SeqID_54216
MDADQWRYDFAVSQEVHMDYDYDNQEECGVNEPHVDCSNAFNTSQVFATRDDVLQWARTVAHENEFVAVIMRSDTETEIKNSLEMTPGVGNVVVPSGFVGNQCMEGKVGW

SEQ ID NO: 170995 - protein, 183 aa, Glycine max
  Coding DNA Sequence Number=SeqID_54217
  Gene Ontology: Mol. function=calcium ion binding; Cellular component =flagellin-based flagellum; Biological process=ciliary or flagellar motility
  Homolog annotation: Hit_ID=Q1SLX8; Match level="QueryCoverage=78%, HitCoverage=74%, E-value=4e-31, Identity=51%"; Hit description =Calcium-binding EF-hand
  Pfam annotation: Domain name=efhand; Domain location=117-145; Score =34.0; E_value=5.1e-07; Accession=PF00036.22; Description=EF hand
  Pfam annotation: Domain name=efhand; Domain location=153-181; Score =28.0; E_value=3.3e-05; Accession=PF00036.22; Description=EF hand
  Pfam module annotation: Pfam domain module=efhand::efhand; Domain location=117-145::153-181
MSPKSKNKNIIREVTRTSLLAYEAKAIPISLELVVVFIYVSQTWKAWTKTRVNNSNCEHVKQSLDYIERSARVSKEDVVLVMEKLGINAELCDDGIEEFGLKIIGELFDDEDVNLSEVEQAFDVFDQNKDGFIEARELQRVLSCLGLGKDLMECEEMINAVDQNGDELIDRNEFFRIMEQCFG

SEQ ID NO: 170996 - protein, 485 aa, Glycine max
  Coding DNA Sequence Number=SeqID_54218
  Gene Ontology: Mol. function=zinc ion binding; Cellular component =nucleus; Biological process=regulation of transcription
  Homolog annotation: Hit_ID=Q1SLX9; Match level="QueryCoverage=99%, HitCoverage=100%, E-value=1e-108, Identity=49%"; Hit description =Zinc finger, Dof-type
  Pfam annotation: Domain name=zf-Dof; Domain location=145-207; Score =140.9; E_value=3.4e-39; Accession=PF02701.6; Description=Dof domain, zinc finger
  Subcellular localization annotation: CTP_CleavageSite=80; ConfidenceScore=5.40e-01
MSEVVTKDSAIKLFGRTISLSRNNNNNNNNNEVSSSANGFSSDEPAPPEDSSSSFPREVSSTTEHEAGRDKEPSRKELTSAQEEDEEASHQTIEEPKSPTSSSCNLENPKTPSTERETSILKSSKNGDQSDATTTSPSQDKTLKKPDKVLPCPRCNSMDTKFCYYNNYNVNQPRHFCKNCQRYWTAGGTMRNVPVGAGRRKNKNTPSSLSHFRQIMVPEGLQNGSLHGAAVLTFGSDPPLCDSMASVLSLAEKTTQNGFHSPNGDEYYDTVMASTLSERRDNATTSTNSRQESLDNHKSYHHHHHHHHHQGFTPQLCFPGSSSSPWPYPSNNPIMTPSAFCHPVPFYPTQAFWGSMPPPSWSVNYQSAPGSGPNSPTLGKHSRDGDILFSTDMAANNNNNTVLIPKTLRIDDPTEAAKSSIWSTLGIKNEKGNSLNGGGLFKAFASKGNSDDKKNHAVMVEASPSPVLQANPAALSRSLVFHERT

SEQ ID NO: 170997 - protein, 374 aa, Glycine max
  Coding DNA Sequence Number=SeqID_54219
  Gene Ontology: Mol. function=DNA binding; Biological process =regulation of transcription
  Homolog annotation: Hit_ID=Q9SEZ2; Match level="QueryCoverage=85%, HitCoverage=84%, E-value=4e-36, Identity=37%"; Hit description =Transfactor, putative; 28697-27224
MDPQNMQNQTMHFVLSTDSKPRLKWTPELHRRFIEATNQLGGEDTYIICHTVASCGRSNSKESHEGDGDSRTHFVPSEEPFTGIHSPFKFRLGKSQQLETCSDNKQEDYIETKSSSDDYVSHREMVFPRAFIDLVLCLLTRNMQIAQALQMQMEVQRKLYEQIEKHLQLRIEAQGKYLQSVLKKAQEALAGYNSSPVGIELTKAELSQLVTIINDACPSSPISELTETRGLSLSCGERKRDRGTMCSLESSLTSSESSGRKEEKQPMEEIVEFKSSNNVSFELPLMEIHTEDKASNGGLSSNEGSGRKRSLAATESDDGSCVVEQPCGKRCGNKLLRKVKLSEMLDLNSQCQSDMDSTGSKTLDLNCSLNLWEP

SEQ ID NO: 170998 - protein, 69 aa, Glycine max
  Coding DNA Sequence Number=SeqID_54220
MKKKVERGVNIRGKQRRGAAPTDMILRECCGRIWNIVLVVASLSCAVLCYEVTGHVYLHNSITILVIKT

SEQ ID NO: 170999 - protein, 543 aa, Glycine max
  Coding DNA Sequence Number=SeqID_54221
  Gene Ontology: Mol. function=oxidoreductase activity, acting on CH-OH group of donors; Cellular component=membrane; Biological process =alcohol metabolic process
  Homolog annotation: Hit_ID=Q6Z290; Match level="QueryCoverage=89%, HitCoverage=92%, E-value=1e-103, Identity=40%"; Hit description =Putative mandelonitrile lyase
  Pfam annotation: Domain name=GMC_oxred_C; Domain location=384-522; Score=104.8; E_value=2.6e-28; Accession=PF05199.4; Description=GMC oxidoreductase
  Pfam annotation: Domain name=GMC_oxred_N; Domain location=54-351; Score=58.9; E_value=1.7e-14; Accession=PF00732.10; Description=GMC oxidoreductase
  Pfam module annotation: Pfam domain module=GMC_oxred_C::GMC_oxred_N; Domain location=384-522::54-351
MEHPQINKVHKLLLTAFVLFFLASLGLSFPLEPPGNNRQWHMTSDVKQVAGKSYDYIIVGGGTCGCPLAATLSQDFSVLLIERGSSPYGNPLVIDRRYYGFPLIKTDKYMSVAQSFTSEDGVGNVRGRVLGGSSAINGGFYSRASEEFVCKAGWDKELVKEAYEWVESKVVFPPFYLSPWQSVAEFSILEAGVLPYNGFSLEHIKGTKISGSVFDEFGKRHTSADLLNAGNPNNLTVLLNATVKSIIFHHSSNRNETRAKGIRFIQSNGTLDETYEAYINKAKNSSSKGDVILAAGALGSPQLMMLSGIGPKEQLRRFNISIVHEMKGVGQGMQDNPCIAVLVDSKPQNRLPDPPQIAGITDDFKIIVEASILPLTSNSSRVNVAAKIAMPTSKGMLELNNTDPRLNPSVRFNYLASDDDMEECVKMTKLLERIARSKSIAFFLGESKQEKLTSTDIDLRNFCKKNVRTIYHYHGGCTVGSVVDEHYKVYGIKGLRILDGSTFSESPGTNPMASLLMLGRYQGLKILRERNAESGLNAKEHRK

SEQ ID NO: 171000 - protein, 155 aa, Glycine max
  Coding DNA Sequence Number=SeqID_54222
MKEHTLWNPYRMHAKARIMSKIEEVQEQMKVDIGAMKEQMTTMMEAMMSMRKMMEVNTATVIAASITTDVDPTHPSGLSQGGKALGSMDDPHFVQVKSKHSFPPYGLPPNYIPPNVAHAPDENVDNSDPTPIENQQPQSGHAQVLQPMGETHELP

SEQ ID NO: 171001 - protein, 64 aa, Glycine max
  Coding DNA Sequence Number=SeqID_54223
MESWLPQKKSERVSTENNGGLWWLMVAMGDGKSAWDIRNGFGRKKEEEMTFFLSYMKAKAEMLK

SEQ ID NO: 171002 - protein, 254 aa, Glycine max
  Coding DNA Sequence Number=SeqID_54224
  Gene Ontology: Mol. function=lyase activity; Biological process =metabolic process
  Homolog annotation: Hit_ID=Q2U0J1; Match level="QueryCoverage=73%, HitCoverage=33%, E-value=1e-34, Identity=41%"; Hit description =Uncharacterized conserved protein
  Pfam annotation: Domain name=DUF126; Domain location=65-192; Score =46.9; E_value=6.9e-11; Accession=PF01989.7; Description=Protein of unknown function DUF126
MDGFSPVAAGQPAGHRRSAAHGTGGLCFRPRASGADAIGGHGPHRRRSSDGAKTRHRYKGIFAATILAGAAEGPVIATTEALSFWGGVDPATGRVIDVHHPLHGICLTGGVLFMPTSRGSCTGSGVLLDLILTGRAPSALVFCEAEDVLTLGALVAAEMFDRALPVIRLDAENFARFSRATHARIDGNSIEADGLSLAIAPPAIAHLDLEDEDRAMLEGRDGIAVRQAMRIIVAMAAQQGASALIDITQGHIDG

SEQ ID NO: 171003 - protein, 146 aa, Glycine max
  Coding DNA Sequence Number=SeqID_54225
MPIVPPCPTPVQPFLAPLPAPLPMPAAYLLDLCHTRATISCNKLFSTVAQYGRATTPNDKALKGRNMTLFEIGTEYYGPTMVACKRQPVMFALWTATDPEEPCRNKHWDPGNSLYKDATIRQLGNEFEYECFRVEGSPLFSKQGSQ

SEQ ID NO: 171004 - protein, 133 aa, Glycine max
  Coding DNA Sequence Number=SeqID_54226
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q10MX5; Match level="QueryCoverage=82%, HitCoverage=28%, E-value=3e-39, Identity=61%"; Hit description =Expressed protein
  Pfam annotation: Domain name=DUF231; Domain location=72-133; Score= -50.7; E_value=0.0018; Accession=PF03005.6; Description=Arabidopsis proteins of unknown function
MTLDYKATYILLLWDKESVEKSYGVSISFYRAPYLDVDVVQGKRILRLEKVGENGDAWKRADVLSFKTGHWWSHQGSLQGWDYVELGGKYYPDMDGLAALESGMKTWANWVDNNIDRSKTRVFFQAISPTHYK

SEQ ID NO: 171005 - protein, 43 aa, Glycine max
  Coding DNA Sequence Number=SeqID_54227
MATTVNKKLDRWVMMWKTDMKRRRLMVVVSWFTIGVDRKKEQD

SEQ ID NO: 171006 - protein, 749 aa, Glycine max
  Coding DNA Sequence Number=SeqID_54228
  Gene Ontology: Mol. function=metal ion binding
  Homolog annotation: Hit_ID=Q2HTV0; Match level="QueryCoverage=98%, HitCoverage=76%, E-value=1e-133, Identity=60%"; Hit description=Zinc finger, RING-type; Transcription factor jumonji, jmjC; Zinc finger, C2H2-type
  Pfam annotation: Domain name=WRC; Domain location=14-59; Score=74.7; E_value=2.9e-19; Accession=PF08879.1; Description=WRC
MSKTPKEKETEEPLPDHLRCGRTDGRQWRCRRRVKENLKLCEIHYLQGRHRQYKEKVPESLKLQRKRKSNNNNNNNNEEEEEEEEEEKPEPDKKNVLDDNVESRARRTSRIVKKKRMLSEDSDASASSPPARKKALKQGDMQLELLRMVLKREAEKNKNKSKSKNKKNNNKKKNKKKEKRRKEEKEELCYTKEELRRELPNGVMEISPASPTRDYNNVGSHCDVKVGVDSKTVTPRYFRSKNVDRVPAGKLQIVPYGSNLKKGKRKKCHWCQRSESGNLIQCSSCQREFFCMDCVKERYFDAENEIKKACPVCRGTCPCKYCSASQCKDSESKECLTGKSRVDRILHFHYLICMLLPVLKQISEDQNIELETEVKIKGKNISDIQIKQVEFGCSEKNYCNHCKTPILDLHRSCPSCSYSLCSSCCQELSQGKASGAMNSSVFKRPDKMKPCSASENHTLEERATSIGNLTDTSVLPEWTNGNGIDSLSCPPTELGGCGKSHLELRSVFPSSWIKEMEAKAEEIVCSYDFPETSDKSSSCSLCFDTDHGTNRYKQLQEAALREDSNDNYLFCPTVMDISGDNFEHFQKHWGKGHPIVVQDALRSTSNLSWDPLTMFCTYLEQSITRYENNKNLLESCLDWWEVEINIKQYFTGSVKRRPQRNTWDEMLKLKGWLSSQIFKEQFPAHFAEVIDALPVQEYMHPLCGLLNLAANLPHGSAKHDIGPYVYISYGSADKETDSVTKLCYDSYDV

SEQ ID NO: 171007 - protein, 65 aa, Glycine max
  Coding DNA Sequence Number=SeqID_54229
  Subcellular localization annotation: CTP_CleavageSite=58; ConfidenceScore=5.16e-01
MGVQIATRPTWAFQGVPIEGENPRRSASVTLPRRFHERFREHSSPFFTVLHRSSFVLRRSSVFNQ

SEQ ID NO: 171008 - protein, 162 aa, Glycine max
  Coding DNA Sequence Number=SeqID_54230
  Gene Ontology: Mol. function=oxidoreductase activity; Cellular component=integral to membrane; Biological process=potassium ion transport
  Homolog annotation: Hit_ID=Q5PNE8; Match level="QueryCoverage=99%, HitCoverage=48%, E-value=1e-84, Identity=88%"; Hit description =Putative ion-channel protein
  Pfam annotation: Domain name=Aldo_ket_red; Domain location=19-162; Score=-102.0; E_value=0.0023; Accession=PF00248.11; Description =Aldoketo reductase family
MGYQPDKNRYQTMQYRRCGQSGLRLPVISLGLWHNFGDATRLENSRQLLQRAFDLGITHFDLANNYGPPPGSAERNFGRILQEDFLPWRDELIISTKAGYTMWEGPYGDWGSRKYLLASLDQSLKRMELEYVDIFYHHRPDPETPLTETMKALDHLVRQGKA

SEQ ID NO: 171009 - protein, 128 aa, Glycine max
  Coding DNA Sequence Number=SeqID_54231
MGACFNGKVSHKKAEVEPLEVTKPVYRDELTKKQPPRKTVKKTVRFAESEPTILGEDSEKEFEKTRWGSGNEVGEKEGMRVRIKLTKEEAARLLSKCNNGGILQFKDVAHELVLIPVNRVSVAPDAQC

SEQ ID NO: 171010 - protein, 642 aa, Glycine max
  Coding DNA Sequence Number=SeqID_54232
  Gene Ontology: Mol. function=GTPase activity; Cellular component =microtubule; Biological process=cell division
  Homolog annotation: Hit_ID=Q39821; Match level="QueryCoverage=99%, HitCoverage=100%, E-value=0.0, Identity=93%"; Hit description=SDL12A
  Pfam annotation: Domain name=Dynamin_M; Domain location=251-540; Score=349.1; E_value=7.1e-102; Accession=PF01031.10; Description =Dynamin central region
  Pfam annotation: Domain name=Dynamin_N; Domain location=72-242; Score= 282.3; E_value=9.6e-82; Accession=PF00350.13; Description=Dynamin family
  Pfam annotation: Domain name=GED; Domain location=545-638; Score =149.0; E_value=1.2e-41; Accession=PF02212.8; Description=Dynamin GTPase effector domain
  Pfam annotation: Domain name=MMR_HSR1; Domain location=64-243; Score=- 10.3; E_value=0.0088; Accession=PF01926.13; Description=GTPase of unknown function
  Pfam module annotation: Pfam domain module=Dynamin_M::Dynamin _N::GED::MMR_HSR1; Domain location=251-540::72-242::545-638::64-243
MENLISLVNKIQRACTALGDHGENSALPTLWDSLPAIAVVGGQVTPPIPLSLLLYSLFISQRIITSCFSHFQSSGKSSVLESVVGKDFLPRGSGIVTRRPLVLQLHKIEEGSREYAEFLHLPRKRFTDFVAVRKEIQDETDRETGRTKQISTVPIHLSIYSPNVVNLTLVDLPGLTKVAVEGQPDSIVKDIEDMVRSYIEKPNCIILAISPANQDLATSDAIKISREVDPTGDRTIGVLTKIDLMDKGTDAVDILEGRAYRLKFPWIGVVNRSQQDINKNVDMIAARRREREYFNSTPEYKHLANRMGSEHLAKMLSKHLETVIKSKIPGIQSLINKTIAELEAELTRLGKPVAADAGGKLYAIMEICRSFDQIFKDHLDGVRPGGDKIYNVFDNQLPAALKRLQFDKQLSMENIRKLITEADGYQPHLIAPEQGYRRLIESSLITIRGPAEAAVDAVHSLLKDLVHKAISETLLCLDLKQYPGLRVEVGAAAVDSLERMRDESKRATLQLVDMECGYLTVDFFRKLPQDVDKGGNPTHSIFDRYNDSYLRRIGTTILSYVNMVCATLRNSIPKSIVYCQVREAKRSLLDHFFTELGKMETKRLSSLLNEDPAIMERRSALAKRLELYRSAQAEIDAVAWSK

SEQ ID NO: 171011 - protein, 74 aa, Glycine max
  Coding DNA Sequence Number=SeqID_54233
MVPNFTVTKRKVRRNLRGKCLGGILQSSLYRGDKSKSFKEEEGQNINLVVGLARLEAAQCCLLTYLGEIPSVAS

SEQ ID NO: 171012 - protein, 283 aa, Glycine max
  Coding DNA Sequence Number=SeqID_54234
  Pfam annotation: Domain name=F-box; Domain location=50-97; Score =27.4; E_value=5.2e-05; Accession=PF00646.23; Description=F-box domain
FTPPRKHHCDCTSNSDAAAVPYLNGGRTEMLEPSPVPAPAVLTERRMGSSMMEELVPEITTHALSYLDYPSLCRLSMTNSLMRKAANDDNAWKALYHKDFTLEQDSITPTNGWKAYYAATRAIVNINTEFFNIVRDKSLQAMSHFWLNADYVKCIHASGFFSGNHLPSRSRFLLFCSVKVGRVPCAGEISSSLYNAVMQGWQLVFNWEQGLNFQVRDVCARVLTDMAWVTMKTYVDMDTGPFNFCGWGCGPSDCAWIIVRDDDTLFMSETGYKRWFYLQKQDA

SEQ ID NO: 171013 - protein, 116 aa, Glycine max
  Coding DNA Sequence Number=SeqID_54235
MSSKVLSRQGLPSIIIIRSLSHQRICHGEATETRIIQVTERVRRNLRNQFLHHGRPHSPLRQNRRRRNRTGLEHFSAAAVEVGNGGGVGIGGAIAVMLPRRRESPGKGEGGSEERE

SEQ ID NO: 171014 - protein, 162 aa, Glycine max
  Coding DNA Sequence Number=SeqID_54236
  Homolog annotation: Hit_ID=Q01E94; Match level="QueryCoverage=60%, HitCoverage=93%, E-value=6e-16, Identity=40%"; Hit description =Homology to unknown gene
  Subcellular localization annotation: CTP_CleavageSite=65; ConfidenceScore=5.47e-01
MTISVFLVPSTPQLCNYRISWPIPTYPSLSSSKLTVSLCSPSPPTSVIEEGPSPSPELTSGCKACGREEVEQGCNGEGRIQGGIATVPGFGWWPIKAYRPCPAFVASGGRYRRQGQSMDEVVSGSGKTKTPIATDSNTRYTCNNSTIHCLVFSIPGDSIFTF

SEQ ID NO: 171015 - protein, 206 aa, Glycine max
  Coding DNA Sequence Number=SeqID_54237
  Gene Ontology: Mol. function=heat shock protein binding; Cellular component=cellular_component; Biological process=protein folding
  Homolog annotation: Hit_ID=Q6EIX7; Match level="QueryCoverage=96%, HitCoverage=83%, E-value=4e-37, Identity=42%"; Hit description =Potyviral capsid protein interacting protein 2b
  Pfam annotation: Domain name=DnaJ; Domain location=4-41; Score=-0.7; E_value=0.0052; Accession=PF00226.21; Description=DnaJ domain
MGADENHDQDPLRKEEFEAKFKQVSEAYDVLSDPKKRQLYDFYGDHYPIESNSFSKENGDGNMRLAVVSECSLICILEDLYKGCKKKVLKSARRNLEDRHKTWLEKGHKNHFSWEMQQRTMRPHAIFKRERNDLVVIQKILLVDALKGKTLNLTTLDGRDLTIQVTDIVKSGYELVVPNEGACPSQRNLARKEISESSLMLCFHQG

SEQ ID NO: 171016 - protein, 93 aa, Glycine max
  Coding DNA Sequence Number=SeqID_54238
MEARNEPSPTTPSTNWGASVASSKLSLWVDVLKLLGLSMWLSLYNGQRVRDEGPYDKCLAENSPASLSKSASSPDKKYGNFLQLEVKVQRMNL

SEQ ID NO: 171017 - protein, 327 aa, Glycine max
  Coding DNA Sequence Number=SeqID_54239
  Homolog annotation: Hit_ID=Q5JZR1; Match level="QueryCoverage=99%, HitCoverage=99%, E-value=7e-84, Identity=72%"; Hit description=N -rich protein
MENNNQSFWQFSDQLRLQASNLANLSLNDSIWSNSYISKRRDERINFDIKVGGEINSFKSKEPACDYNENMNGSLLAVPYNNNNILGVGGVGLNGGFNKGIYSKPGFANLNNNINLNINPKGHKFKDEDELFHPSKPSKKNNNINKKHGGNTNNDDNSKDSKAAGDKRFKTLPPAESLPRNETIGGYIFVCNNDTMAENLKRQLFGLPPRYRDSVRAITPGLPLFLYNYSTHQLHGIFEAASFGGSNIDPSAWEDKKCPGESRFPAQVRVITRKTCEPLEEDSFRPILHHYDGPKFRLELNVPEALSLLDIFAEQDTFSDTFKALPA

SEQ ID NO: 171018 - protein, 235 aa, Glycine max
  Coding DNA Sequence Number=SeqID_54240
  Gene Ontology: Mol. function=calcium ion binding; Cellular component =membrane; Biological process=abscisic acid mediated signaling
  Homolog annotation: Hit_ID=Q4W3B4; Match level="QueryCoverage=88%, HitCoverage=98%, E-value=9e-70, Identity=61%"; Hit description =Calcium sensor calcineurin B-like protein
  Pfam annotation: Domain name=efhand; Domain location=105-133; Score =13.8; E_value=0.4; Accession=PF00036.22; Description=EF hand
  Pfam annotation: Domain name=efhand; Domain location=149-177; Score =27.3; E_value=5.3e-05; Accession=PF00036.22; Description=EF hand
  Pfam annotation: Domain name=efhand; Domain location=68-96; Score =26.0; E_value=0.00013; Accession=PF00036.22; Description=EF hand
  Pfam module annotation: Pfam domain module=efhand::efhand::efhand; Domain location=105-133::149-177::68-96
MGCCCTKQRVDQKDPAVLASQTYFNLSEIEALYDLFKKLSSSIIDDGVISKEEFQLGLFGSSEKRSLFADRVFELFDSKNNGVIEFGEFVQALSVFHPAAPQTQKADFAFRLYDICQRGFIQRHEVREMILALLNESNLVLSHEIIEVIIDKTFEEADSKGDGRIDPEEWQEFVARNPSLLLRNMTIPYLKDLTTQFHSFKLTSGIEDCTSRSSTSPEKDNILELKDNFNGVSIN

SEQ ID NO: 171019 - protein, 202 aa, Glycine max
  Coding DNA Sequence Number=SeqID_54241
  Homolog annotation: Hit_ID=Q1SI69; Match level="QueryCoverage=70%, HitCoverage=70%, E-value=2e-43, Identity=61%"; Hit description =Harpin-induced 1
MAKLCIGEGKLKNRLYNYNRDALVWLLNMTNNYNRSISYGNGNPATGFGVNVMGEKVQHFDAPRHLQLRLDFQSGLNPKPIVEAHSVAVGQCGAHSRRRREGEGLDGEGGGHVLRPARVDLAGGDEHEADLAAGVDELEGAVVVRECGAVRVSNGGVLGEGEVDGAVSDGEGGELDGVNGNFGVLGFEDGVVDNEDDDDDED

SEQ ID NO: 171020 - protein, 569 aa, Glycine max
  Coding DNA Sequence Number=SeqID_54242
  Gene Ontology: Mol. function=phosphotransferase activity, alcohol group as acceptor; Cellular component=membrane; Biological process =protein modification process
  Homolog annotation: Hit_ID=Q1SI70; Match level="QueryCoverage=99%, HitCoverage=98%, E-value=0.0, Identity=67%"; Hit description =Phosphatidylinositol 3-and 4-kinase, catalytic; Ubiquitin
  Pfam annotation: Domain name=PI3_PI4_kinase; Domain location=263-524; Score=312.1; E_value=1e-90; Accession=PF00454.17; Description =Phosphatidylinositol 3- and 4-kinase
  Pfam annotation: Domain name=ubiquitin; Domain location=108-181; Score=6.4; E_value=0.058; Accession=PF00240.13; Description =Ubiquitin family
  Pfam annotation: Domain name=ubiquitin; Domain location=31-100; Score= 70.8; E_value=4.3e-18; Accession=PF00240.13; Description=Ubiquitin family
  Pfam module annotation: Pfam domain module=PI3_PI4_kinase::ubiquitin:: ubiquitin; Domain location=263-524::108-181::31-100
MSIALSSVCKEKVNWEGQPGHCSGEPILIYLTVDGAVTAMRVLESDSIASVKLRIQQCKGFVVKKQKLVFSGRELARNGTLIKEYGVTDGNVLHLVLRLSDLLFIVVRTVSGKEFEFHIDRHRNVGYLKQRIRKNKGECFIDLEDDDQEFFCNDQKLDDDSLFHDICKSGDDVIHLIIKKSVKVRTTPIHKDLNLSVVAPGESVKHKRDKHVQIAKVPPDVGFWLEPIIVNPKIIFFPFLWDMVKSTFEGLKKGNHPVRSSEGTGGTYLMQDSTGQEHVSVFKPMDEEPMAVNNPKGLPNSSNGEGLKRGTKVGEGAFREVAAYLLDHPKSGPRLASGEAVGFSGVPPTVMVQCLHQEFNHPNGFASSSKHVKIGSLQKFISNDGNCEDYGPSAFPVEEVHKIAVLDIRLANADRHAGNILIKKEADGQIKLIPIDHGYCLPDKFEDCTFDWLYWPQVRQPYSPETVNYINSLDAEKDLELLKCYGWDIPLECARTLRISTMLLKKGVERGLTPYAIGSIMCRENLNKESVIEEIIGEAQDSLLPGMEESAFLEAISQIMDYHLDKLAN

SEQ ID NO: 171021 - protein, 219 aa, Glycine max
  Coding DNA Sequence Number=SeqID_54243
  Homolog annotation: Hit_ID=Q1SI69; Match level="QueryCoverage=84%, HitCoverage=92%, E-value=3e-52, Identity=58%"; Hit description =Harpin-induced 1
  Pfam annotation: Domain name=Hin1; Domain location=47-193; Score =79.7; E_value=9.4e-21; Accession=PF07320.4; Description=Harpin -induced protein 1 (Hin1)
  Subcellular localization annotation: CTP_CleavageSite=9; ConfidenceScore=5.05e-01
MAAGAAPVPAPRPKRPRPPSGRTNLASCVVATIFLIFIVIVILIVYYTIFKPQDPKIAVNAVQLPSFSVANGTVNFTFSQYASVRNPNRAAFSHYDSSLQLIYSGSQVGFMFIPAGEIDAGRTQYMAATFSVQSFPLSAPPRMGPTLANGDGVGFNYGLRVEPTLEIESKLEMAGRVKVLHFFTHHVYAKAGCRVAIAVTDGSVLEQAERREGNETFNL

SEQ ID NO: 171022 - protein, 235 aa, Glycine max
  Coding DNA Sequence Number=SeqID_54244
  Gene Ontology: Mol. function=4 iron, 4 sulfur cluster binding; Cellular component=cytosol; Biological process=metabolic process
  Homolog annotation: Hit_ID=Q6AFD6; Match level="QueryCoverage=90%, HitCoverage=22%, E-value=4e-91, Identity=78%"; Hit description =Aconitase
LCKKRPSTVRAPLDPTPRNRVSPRTQHVLQDAAVAVVVGLTGGVDADDRVELDRLLALGRVLARGGRDLDGLRGDPVVELLEPRDRDDLGAVETQRLPALTRGELQRDDTHADQVRAVDALEALGDDRLDAQQARALGRPVARRAGAILLAAEHDERGALLGVVHARVVDVRLRAARLREVSGVATLDDLAVVHGRDHEVLQTDVRERAADHDLVVATTRTEGVEVLAVDAVLGE

SEQ ID NO: 171023 - protein, 162 aa, Glycine max
  Coding DNA Sequence Number=SeqID_54245
MRLSARSMSDKCAETNSAPFIIQEQRVEWNNKLGGKHAETDYAPFIIQEQRVEWNNKLGGKRAETDSAPFVIQEQRVEWFRWQGGSLAKWCFARTKLVSYLYFPFISNKRQVKRGNCHTLISSGDHPLLGCDPHLTTSRYLAPIVRKFVKFRDMPEAKRKAL

SEQ ID NO: 171024 - protein, 180 aa, Glycine max
  Coding DNA Sequence Number=SeqID_54246
  Gene Ontology: Mol. function=zinc ion binding; Cellular component =integral to membrane
  Homolog annotation: Hit_ID=UPI0000162A17; Match level="QueryCoverage =84%, HitCoverage=82%, E-value=1e-64, Identity=67%"; Hit description =DNA binding / protein binding / ubiquitin-protein ligase/ zinc ion binding
  Pfam annotation: Domain name=PHD; Domain location=131-180; Score =15.4; E_value=0.0016; Accession=PF00628.19; Description=PHD-finger
  Pfam annotation: Domain name=zf-C3HC4; Domain location=33-71; Score =16.1; E_value=0.0034; Accession=PF00097.15; Description=Zinc finger, C3HC4 type (RING finger)
  Pfam module annotation: Pfam domain module=PHD::zf-C3HC4; Domain location=131-180::33-71
MEADFVTNDMLTLTQDAFYANDNDDAAVEGERCGICMDMVIDRGLLDCCQHWFCFVCIDNWATITNLCPLCQNEFQLITCVPVYDTIGNNKVEDDSFFRDDDWSIEEKNNTLSFPSYYIDENAVICLDGDGCKVRNGLATIEGDSDLDTSIACDSCDIWYHAFCVGFDTEGTSDSTWLCP

SEQ ID NO: 171025 - protein, 37 aa, Glycine max
  Coding DNA Sequence Number=SeqID_54247
MSKHLGFAPIGIPKYRKGMANSLRRATITQYGYRSGF

SEQ ID NO: 171026 - protein, 55 aa, Glycine max
  Coding DNA Sequence Number=SeqID_54248
MELRSELRGTYRPKFFSYEGHPQCSANPLPRLTKPGSDDFVSRVLEGKPEPSATQ

SEQ ID NO: 171027 - protein, 435 aa, Glycine max
  Coding DNA Sequence Number=SeqID_54249
  Gene Ontology: Mol. function=nucleoside-triphosphatase activity; Cellular component=integral to membrane; Biological process =metabolic process
  Homolog annotation: Hit_ID=O22993; Match level="QueryCoverage=96%, HitCoverage=49%, E-value=0.0, Identity=72%"; Hit description=Cell division protein isolog
  Pfam annotation: Domain name=AAA; Domain location=8-175; Score=208.7; E_value=1.4e-59; Accession=PF00004.19; Description=ATPase family associated with various cellular activities (AAA)
  Pfam annotation: Domain name=AAA_5; Domain location=8-177; Score= -12.7; E_value=0.017; Accession=PF07728.4; Description=ATPase family associated with various
  Pfam annotation: Domain name=Peptidase_M41; Domain location=182-392; Score=-111.2; E_value=0.00059; Accession=PF01434.8; Description =Peptidase family M41
  Pfam module annotation: Pfam domain module=AAA::AAA_5::Peptidase_M41; Domain location=8-175::8-177::182-392
MGIKPPHGVLLEGPPGCGKTLVAKAIAGEAGVPFYQMAGSEFVEVLVGVGSARIRDLFKRAKENTDHLYNAATQERETTLNQLLIELDGFDTGKGVIFLAATNRKDLLDPALLRPGRFDRKIRIRPPSAKGRHDILKIHSSKVKMSESVDLSSYAQNLPARLAQLVQEAALVAVRKQHNSILQSDMDDAVDRLTVGPKRVGIELGYQGQCRRATTELGLALTSHLLRRYEHAKVECCDRISIVPRGQFEPLSPKQVLLGGRAAEEVIYGRDTSKASVDYLADASWLARKILTIWNLENPMVIHGEPPPWRKSVKFVGPRLDFEGSLYDDYNLIEPPLNFKMDDQVAQRTEELIRDMYRKTVSLLRRHHAALLKTIKVLLDQKEISGEEIEFILNKYPPQTPIYLLEEEYAGNLPFTREQVHDLEYALKIQSNEET

SEQ ID NO: 171028 - protein, 121 aa, Glycine max
  Coding DNA Sequence Number=SeqID_54250
MSKDGILYSEVQNIPIVINQSLFFSLTKLPSQGVPFEGTIFYDWKFDYSSRDARRMVCNDQADMTGSLLAGSLTFDCRIMHYIIVHILLPRSSNLAQASEGGLDFDMGFPYRSLDRLGSLG

SEQ ID NO: 171029 - protein, 151 aa, Glycine max
  Coding DNA Sequence Number=SeqID_54251
MDDSSTIEETEVNSEFEEVLEAFNEMHEEAQRLAILNKKLKSDLKLHITKLTSTQSELDKLRQENEKLVSSYKATGCVCASTFLNMDDYKSLQTEFEKFKKDHYAKQMKFQTDISYLKYLFRKLNKGKSDLNQLLSVQKHTTDKTSLGYNK

SEQ ID NO: 171030 - protein, 61 aa, Glycine max
  Coding DNA Sequence Number=SeqID_54252
MRVKSISRRIALNRRRKRDMGDQRSHNGDAMLSQKGNNKACKGIGIGAVTPKLAEGAIRTL

SEQ ID NO: 171031 - protein, 126 aa, Glycine max
  Coding DNA Sequence Number=SeqID_54253
MSFSRDFVSGNRLPKYVIDYQCLKMNYTAFAHWKLKITLGNRLHLNGNRLPLPYHPGPFSILSPFLTPVIDFPQMVIDYQRLISRYHPRYIAGQPPHKPPCFVDFVLLLVDCQELAGLGTSQVLTD

SEQ ID NO: 171032 - protein, 104 aa, Glycine max
  Coding DNA Sequence Number=SeqID_54254
MAHENPRAFPWISSQSTWSLLPNALTGVYFVGKYLWFFMRKNVGTWGISLSWAKLNSWAKRSFSVLSAKENLAKHQHQGRALSARPSRPSLTRGICRRSLDKLG

SEQ ID NO: 171033 - protein, 91 aa, Glycine max
  Coding DNA Sequence Number=SeqID_54255
MDAQFARMDTRITKLEEDDCHHQKGGDCGSEASKPILMMPKTQLKNQESSKFQESKSCSIKNQDPSKESREDSRYARTIKISIKRVFQSIE

SEQ ID NO: 171034 - protein, 76 aa, Glycine max
  Coding DNA Sequence Number=SeqID_54256
MDVVTESVKFHEISERKQPQTQKWGDELIKIGVKIESKSFYNTSVSDSVEILHRSSPFFVPSSSFFSLQLFSFLPL

SEQ ID NO: 171035 - protein, 86 aa, Glycine max
  Coding DNA Sequence Number=SeqID_54257
MINAGMIFHYDPMKRCMMQSRKPDMGLSATMHHQKRKTLDEASLLSSESGTKHTTDRPPFPMAHTNPGIGPNISKCVQKSVGVMCE

SEQ ID NO: 171036 - protein, 168 aa, Glycine max
  Coding DNA Sequence Number=SeqID_54258
KTADNFGKGVDGHIGLYMSSDLGSPNEEVRITVRYLRVPPESQSVRVIGLGVFECWCADNLKVSPHATGLSGRWIATDGVDNRKVSVYATGLSGRWIAKGETKWSQPEDGDISEKGETKWSRLEDADISKKGADDHIGLCVSLDLVSLNYEVWITIRCLRMLPDFRVA

SEQ ID NO: 171037 - protein, 57 aa, Glycine max
  Coding DNA Sequence Number=SeqID_54259
MKFPGNGAKNLFGSSKCTGSQGEAPQQPGDDQQQAACAPPPPLESTSNHLRRLERNI

SEQ ID NO: 171038 - protein, 137 aa, Glycine max
  Coding DNA Sequence Number=SeqID_54260
MAPPKEIATIIYHDGHIVDDPVQGSMYTSATPIFFYVSHSITFTQFIQKINNRLPAQATEQVAQLLFRVPISFHLNQTRFISAQLFDNDDLRGAMETILQNPQLNSPEFYAITELILQPQPLSPQPSCPQLQLPPTQ

SEQ ID NO: 171039 - protein, 84 aa, Glycine max
  Coding DNA Sequence Number=SeqID_54261
MEMAVVWLSFLVRKQNLGGVRECMALRIKTNWVSSKRKVDQHHIHVLPFACLLSFDFQIPLGVIFASVDPALIAVSKSAHVLII

SEQ ID NO: 171040 - protein, 56 aa, Glycine max
  Coding DNA Sequence Number=SeqID_54262
  Gene Ontology: Mol. function=isomerase activity; Biological process =protein folding
  Homolog annotation: Hit_ID=Q1SYU9; Match level="QueryCoverage=70%, HitCoverage=21%, E-value=1e-12, Identity=82%"; Hit description =Peptidylprolyl isomerase, FKBP-type
MARIVTKAWEIAVKIVKVGEVAKITCKPEYAYGSAGSPPDIFPEYCSHAIDICLET

SEQ ID NO: 171041 - protein, 124 aa, Glycine max
  Coding DNA Sequence Number=SeqID_54263
  Subcellular localization annotation: CTP_CleavageSite=46; ConfidenceScore=5.01e-01
MVTTTVTKTIMVVVPTLTVVAIVAMIMMVMVVVVAVVVALLVVIVVAMLEEVAMLVVAVATMVMVVVTMANVTLVVWCDDNDDNGGSGGIIGGGGDSGVGVTTLMMMVVAVPMVVIAAVTTTLI

SEQ ID NO: 171042 - protein, 223 aa, Glycine max
  Coding DNA Sequence Number=SeqID_54264
EHQTKRRHESAMFAPASPPAINPVAQRLKGISETNDDGEGLEDPTSSSLDGESTDDTPFMPLRKSAPIPQSRPPSSLLHLDRFRREASREPLTDAQLFPLAYIHSNPTPLYPYSEVIFIELVGTYNLKKMTKAQMIAHVTQIYEAKQKRRAQAAVGVVEIVEQKAIAKEATTTIQAEAYAKVMDDTIVHGVLIDLTNTSVIEEIGEASNAAMANDVEPLILDP

SEQ ID NO: 171043 - protein, 75 aa, Glycine max
  Coding DNA Sequence Number=SeqID_54265
MVGEVGKVVERIEGVVVLEPRVVVEVQEWKVWRLVEKQVQLMLCIIKKGRTRTCGVYNYNIMVTLVSGGGFIGSY

SEQ ID NO: 171044 - protein, 113 aa, Glycine max
  Coding DNA Sequence Number=SeqID_54266
  Homolog annotation: Hit_ID=Q1SMF0; Match level="QueryCoverage=92%, HitCoverage=19%, E-value=3e-07, Identity=31%"; Hit description =Tetratricopeptide-like helical
MSEEISMNEDTREELAVVENIDCFDAFNTSQVFPTYEDVLQWARIIAYDIGFVTVIMRSDTSTRKKGRILSILIGCERSGKYRPHKKDLVPTVTSTRKCGCPFNLRAKPVLGG

SEQ ID NO: 171045 - protein, 521 aa, Glycine max
  Coding DNA Sequence Number=SeqID_54267
  Gene Ontology: Mol. function=nucleotide binding
  Homolog annotation: Hit_ID=Q93ZR8; Match level="QueryCoverage=88%, HitCoverage=93%, E-value=1e-169, Identity=60%"; Hit description =Putative auxin-independent growth promoter
  Pfam annotation: Domain name=DUF246; Domain location=128-476; Score =678.7; E_value=4.5e-201; Accession=PF03138.5; Description=Plant protein family
MLYNKVVIEESELEKRRKEKSYSKMRYEALINLVIGGVKNEKFKGLLNDGIKGEHKLRFITLARKRSSLLKLWTLRAAFVMLLWTIIVVQFKGLGDMVTPAMFKTSTHSSAFSLPPQRVYENNNGYLMVSSNGGLNQMRAGICDMVTIASYLNVTLIVPELDNISFWNDHSQFKDIFNVDYFINSLRDEIQILKELPPQQKKKVETKSIYSMPPISWSNMSYYYDVILPRIKTYGVVHFTKSDARLANNGIPEEAQKLRCRVNYHALRFVPPIEQLAKKIVKILKERGSFLSLHLRYEMDMIAFTGCNEGCNKEEIDQLTKMRYAYPWWKEKEIDSEKKRKDGLCPLTPEETALTLRALDIDRNIQVYIAAGDIYKPEKRMASLKEAFPNLVKKETLLEPTELDPFRNHSNQMAALDYYVSIESDIFVPSYIGNMAKLVEGHRRYLGFKKTILLNRKILVKLIDKYKNGIINWNQFSTSVKVAHADRVGNPITRSMVPGKPKEEDYFYTNPQECLSPVDGP

SEQ ID NO: 171046 - protein, 229 aa, Glycine max
  Coding DNA Sequence Number=SeqID_54268
MDEDQWMYDNIRSEEVDMNEQNEDKVGVNEEHVDCFDMFNTSQLHGKPVVGGEGWMMKLICGSHNHELVKSFVGHSYAGRLTKAKIEFVHWALSRLLPNSLRDLCSVWEAMNNMITLQHTKIKASFETSAPKKLMTKKQRSTKRGPSYWEYVDALHFVQNSNSSVKRSTSSSEQPIQRRTMPMLMHYIQRRTKQQRSTKCDSSYWEYVDALHSMQNSNSSVKHSASSSE

SEQ ID NO: 171047 - protein, 394 aa, Glycine max
  Coding DNA Sequence Number=SeqID_54269
  Gene Ontology: Mol. function=transcription regulator activity; Cellular component=nucleus; Biological process=regulation of transcription, DNA-dependent
  Homolog annotation: Hit_ID=Q9CAA4; Match level="QueryCoverage=77%, HitCoverage=93%, E-value=5e-83, Identity=54%"; Hit description =Putative transcription factor BIM2
  Pfam annotation: Domain name=HLH; Domain location=45-95; Score=59.7; E_value=9.4e-15; Accession=PF00010.16; Description=Helix-loop-helix DNA-binding domain
MRAGKGSQEEDEYEEEEFGSSKKQGTSSAPNANKDGKAIDKASAIRSKHSVTEQRRRSKINERFQILRDLIPHSDQKRDTASFLLEVMEYVQYLQEKVQKYEGSYQGWGQEPLKLMPWRNSHWRVQSFAGQPTAVKNGLGPVSPFPVKFDESNASISPTMLSGTQNTIDPYQSRDIVNKTAERQPDLVNKGMPLPLAMHANMSVPVRSDGVLAHPLHGTVSDPQSTECPTTSEPQNQQDEFTVEGGTISISSAYSQGLLNNLTQALQSAGLDLSQASISVQINLGKRGNKGLSCGTSSPKPAPHNSQVNRVLPADTKLNLNPFGTLTSTLRLPASCTHQPPASHHAGTATAVTAVISWMHHDNPSSNNQTIAHFRDAGSGEDSDQVQKRMKTYK

SEQ ID NO: 171048 - protein, 49 aa, Glycine max
  Coding DNA Sequence Number=SeqID_54270
MAAENNTICEHFCLMKLVVWPYYPSVGKEEPLKDKTIPRDLRGNMRGKK

SEQ ID NO: 171049 - protein, 90 aa, Glycine max
  Coding DNA Sequence Number=SeqID_54271
  Gene Ontology: Mol. function=glutamate-5-semialdehyde dehydrogenase activity; Biological process=proline biosynthetic process
  Homolog annotation: Hit_ID=P32296; Match level="QueryCoverage=62%, HitCoverage=8%, E-value=2e-12, Identity=70%"; Hit description=Delta 1-pyrroline-5-carboxylate synthetase (P5CS) [Includes: Glutamate 5 -kinase (EC ...
  Homolog annotation: Hit description=2.7.2.11) (Gamma-glutamyl kinase) (GK); Gamma-glutamyl phosphate reductase (GPR) (EC 1.2.1.41) (Glutamate-5-semialdehyde dehydrogenase) (Glutamyl-gamma -semialdehyde dehydrogenase)]
MAIPDTVGGKLIGLVTSREEIPKLLKLDDVIDLVIPRGSNKLVSQIKSSTKIPVLGHAACCVFTLFKRLESLTEAEKQALLEEVEEENNH

SEQ ID NO: 171050 - protein, 176 aa, Glycine max
  Coding DNA Sequence Number=SeqID_54272
MEIIIQQAQGSTQSNIFKLKMGARDSSFINKAHHEVRKGHPGLVEAMPLVAAPDSRSWILCITKHKPWWRLCDIGTVTSELGVEVLEGTGVAGTGAGGVGGGAGARGAEEEVASDSQARALRVPEKEIMGSSGDSKVRELDMTPLAMHKAVIRAGKPSREELDWAIYEIWPEMSKP

SEQ ID NO: 171051 - protein, 74 aa, Glycine max
  Coding DNA Sequence Number=SeqID_54273
  Subcellular localization annotation: CTP_CleavageSite=36; ConfidenceScore=5.54e-01
MPRPTQLVTQAQRHKDPLSAASPQPTHKHSSPPRPRATTFSRPCTAANAHPPSFLTHLYLPVVQAFFVYYSISV

SEQ ID NO: 171052 - protein, 167 aa, Glycine max
  Coding DNA Sequence Number=SeqID_54274
  Gene Ontology: Mol. function=protein binding; Biological process =defense response
  Homolog annotation: Hit_ID=Q19PL4; Match level="QueryCoverage=85%, HitCoverage=16%, E-value=3e-16, Identity=34%"; Hit description=NBS -LRR type disease resistance protein
MAESAVSFLLERLKPVFENKLKLFIGVEAEVIYLKAQLELIRAFLRAADVFEETDEELKVWVRQVRDVVHEAEDLLDELELVQVHNHTNGFSNYLSIRNMKARYRIAHELKAINSRMKTISSTRKRFLSKLDTASEASNSTYTGEPLNYAIIGVLLFQILSPSQSFN

SEQ ID NO: 171053 - protein, 81 aa, Glycine max
  Coding DNA Sequence Number=SeqID_54275
MYIVVVKQGQDHLGLPSEVETKRERQKPIKVGYLRTDASRDGVTTDRSLPLLCARQAENVAARQPRILCILQLSFTICKYK

SEQ ID NO: 171054 - protein, 204 aa, Glycine max
  Coding DNA Sequence Number=SeqID_54276
  Gene Ontology: Mol. function=calpain activity; Cellular component =intracellular; Biological process=proteolysis
  Homolog annotation: Hit_ID=Q2HS67; Match level="QueryCoverage=93%, HitCoverage=47%, E-value=8e-23, Identity=38%"; Hit description=F-box associated, putative
  Pfam annotation: Domain name=F-box; Domain location=7-54; Score=40.3; E_value=6.6e-09; Accession=PF00646.23; Description=F-box domain
MRSEKKPWSPLLCDELIEEILSRLPVKPLIQFKCVCKGWNSLMSDPYFIKLHLSKSAAKDDLEHLQLMKNVCLGSIPEIHMESCDVSSLFHSLQIETFLFNFANMPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLK

SEQ ID NO: 171055 - protein, 53 aa, Glycine max
  Coding DNA Sequence Number=SeqID_54277
MGSRQDHPQLQNPPTPSHPPRSGVLRQIPFCYHKVRKKHLGGCDGVGEFSNSS

SEQ ID NO: 171056 - protein, 213 aa, Glycine max
  Coding DNA Sequence Number=SeqID_54278
  Gene Ontology: Mol. function=DNA binding; Cellular component =membrane; Biological process=DNA integration
  Homolog annotation: Hit_ID=Q2HT49; Match level="QueryCoverage=86%, HitCoverage=19%, E-value=5e-53, Identity=50%"; Hit description =Integrase, catalytic region
VYKIKYKSDGSVERHKARLVAKGYTQVEGQGYLDTFSPFAKLTKVRLLLALAAINKWYLKQLDVNNSFLHGDLNEEVYMMLPQGNDLIEIQAITQLLDNAFKIKDLGDLRYFLGFEVARKPTGINLCQRKYALDILSDAGMLGSKPVSTPSDYATKLHQQSGTPLSLEDASSFRRLIGRLIYLTNTRPDITYVVQHLSQFVAAPTSAHQQATV

SEQ ID NO: 171057 - protein, 115 aa, Glycine max
  Coding DNA Sequence Number=SeqID_54279
MEWYILYFNQVVEGINSSTVAIKSELLKEELVCTTAKRPYNNGSKPLLKMNKMHQKTMDYTRNEIAKFVEIAVSQNVHTIQRVKLNYTVVHQVEILFNGSNQGHAQTFWGLRRKC

SEQ ID NO: 171058 - protein, 286 aa, Glycine max
  Coding DNA Sequence Number=SeqID_54280
  Homolog annotation: Hit_ID=Q5XM22; Match level="QueryCoverage=28%, HitCoverage=66%, E-value=4e-10, Identity=32%"; Hit description =Resistance-like protein HAAS-2
MAAIILFSPIQRAIAAVAKDIEHVDDAVDGAHEEPHYPTTEDERIELKLTSHGRKVEKLGRPTPEIDGLVVGAFHTYDAINVDQDVELLVELQGVTTQEAIDETKQCCALFANKSSTHISVVFLDAFRDPNQRGGFSWGAAELIHMYENLNYASLNKAKYLSWISEHFPSIENMIANEDYHKSKPRVCRWKCGKVLPVTTYHKRLDKLTTNAVCWIPYGYMEWFYMISHPFMSPPQVGEPPKHPPMVHNPIVVMPHPTVLPDDITTMPHPPATTPIDVEMPRNAVV

SEQ ID NO: 171059 - protein, 66 aa, Glycine max
  Coding DNA Sequence Number=SeqID_54281
  Homolog annotation: Hit_ID=Q8GS71; Match level="QueryCoverage=59%, HitCoverage=3%, E-value=3e-07, Identity=65%"; Hit description =Kinesin-like protein
MVNRDLISNEMQQLRQQLKYLQAKLCSRGGAPVDEVWFSRKGLLGLSLLMRTFVENFTNITVDVVL

SEQ ID NO: 171060 - protein, 48 aa, Glycine max
  Coding DNA Sequence Number=SeqID_54282
MSHGRLYQRRVKNAFDMKGKWAPNCEGPFIVNKAFFGGALLLANMDDE

SEQ ID NO: 171061 - protein, 128 aa, Glycine max
  Coding DNA Sequence Number=SeqID_54283
  Pfam annotation: Domain name=G-patch; Domain location=4-48; Score =7.1; E_value=0.025; Accession=PF01585.13; Description=G-patch domain
MSDVVMMVARVMLGHDFEPNMGLGKNNNDMDNLVDVKENRGKFGLGYKPTRADLRRSVIERRRRVAGLQVRPQAGEVPPCHISKRSVSVGFRLEEQVAVIYEEVPQECSDLVQPCLHDFQLGNWQVVE

SEQ ID NO: 171062 - protein, 36 aa, Glycine max
  Coding DNA Sequence Number=SeqID_54284
MGAKYLEAVKQRMHAINNGPWTKLGEYGVEEKLNRK

SEQ ID NO: 171063 - protein, 33 aa, Glycine max
  Coding DNA Sequence Number=SeqID_54285
MPDSPRVYHLFVHIGDNIHLRNDRSNNAISLNQ

SEQ ID NO: 171064 - protein, 106 aa, Glycine max
  Coding DNA Sequence Number=SeqID_54286
MHDAIKEQAKGLSVTMHHQKRKTLDEASLLSSESETQHEHRSTSTPYCGSNVFQGYFDDAKESRVKQSFKQRFKNQVSRIKNQESRIIKIKIQDSRFKNQEKTHSR

SEQ ID NO: 171065 - protein, 75 aa, Glycine max
  Coding DNA Sequence Number=SeqID_54287
MYENPTPSNILLIKLVKSTLKGSLWFHLLSFLGLSGPKQNTPKKNDAFREPITIHENQMTLNGVSGRSYENVPAN

SEQ ID NO: 171066 - protein, 123 aa, Glycine max
  Coding DNA Sequence Number=SeqID_54288
MGKCVDGRWVSGFRWRREWFEWEKQRVEEFLHEINNANICGQGGDQWIWLLGIHTVAPEKAIDHFRHISLGLQGEKPKLWWAVGWSSIVWNLMAYQSHFDTSYQQWQIDPECPASIPACTPES

SEQ ID NO: 171067 - protein, 154 aa, Glycine max
  Coding DNA Sequence Number=SeqID_54289
  Gene Ontology: Mol. function=structural constituent of ribosome; Cellular component=ribonucleoprotein complex; Biological process =translation
  Homolog annotation: Hit_ID=O48549; Match level="QueryCoverage=52%, HitCoverage=28%, E-value=4e-22, Identity=81%"; Hit description=40S ribosomal protein S6-1
  Pfam annotation: Domain name=Ribosomal_S6e; Domain location=63-151; Score=13.4; E_value=2.5e-06; Accession=PF01092.9; Description =Ribosomal protein S6e
MEKAQATSNMESFVVEDARGPARLTRRVRRAGRTNLFSPCKKRGRLAQSAANADLCGRTLHGVDGLTYPPLLAVRAFWDKRISQEVSGDALGEEFKGYVFKITGGCGKQGFPMKQGVLTPGHMHVFLFYDFIPFEDGPERNSLLLWVRKAQWRA

SEQ ID NO: 171068 - protein, 79 aa, Glycine max
  Coding DNA Sequence Number=SeqID_54290
MKTKKLKELQLQIVIDLELLLAAVGFTLLRGVLGTGNCNDSGVVLGEKKNRKLGWGLWLNVERGRKRKRYAKMELWVIK

SEQ ID NO: 171069 - protein, 97 aa, Glycine max
  Coding DNA Sequence Number=SeqID_54291
  Gene Ontology: Mol. function=protein serine/threonine kinase activity; Cellular component=integral to membrane; Biological process=protein amino acid phosphorylation
  Homolog annotation: Hit_ID=Q0ZCC5; Match level="QueryCoverage=80%, HitCoverage=3%, E-value=3e-30, Identity=82%"; Hit description=CCHC -type integrase
MGCYMKPDWKLRLEIAFGVARGLAYLHEECITQIIHCDIKPQNILLDEYHNARISDFGLAKLLKMDQSRTNTAIRGTKGEKSHKRAWKYITRHATQW

SEQ ID NO: 171070 - protein, 181 aa, Glycine max
  Coding DNA Sequence Number=SeqID_54292
  Gene Ontology: Mol. function=protein serine/threonine kinase activity; Cellular component=cell surface; Biological process =protein amino acid phosphorylation
  Homolog annotation: Hit_ID=Q0ZCC5; Match level="QueryCoverage=88%, HitCoverage=8%, E-value=2e-30, Identity=45%"; Hit description=CCHC -type integrase
  Pfam annotation: Domain name=B_lectin; Domain location=77-180; Score =53.9; E_value=5.5e-13; Accession=PF01453.15; Description=D-mannose binding lectin
MASSLLLFFLFCSVILLPFVVAQTKTNIAIGDSHTAGKSTTPWLVSSPSGDFAFGFLPLEATPDHFILCIWYANIQDRTIVWFANRDNKPAPKGSKVELSADDGLVLTAPNGDKLWNTGGFTARVSSGVFNDTGNLVLLDGASSSTWESFDDYRDTLLPSQTMERGQKLSSKLRRNDFNIG

SEQ ID NO: 171071 - protein, 99 aa, Glycine max
  Coding DNA Sequence Number=SeqID_54293
  Gene Ontology: Mol. function=nucleic acid binding
  Homolog annotation: Hit_ID=Q1STK5; Match level="QueryCoverage=67%, HitCoverage=16%, E-value=1e-12, Identity=55%"; Hit description=Zinc finger, CCHC-type
MKKKEATTPNALPYVAGEACLYPCKKRSKLQQVIIGSKKFKKQTQETCSKSYVKPDSSFKNLISNMIKGCSQSTQDEDKSLVLNLENPNHHLLDQVASE

SEQ ID NO: 171072 - protein, 75 aa, Glycine max
  Coding DNA Sequence Number=SeqID_54294
MNKALKREGDSIGQGEDFEPSKVENFEPSEGKDFESSKGEDFEPYKDEAFESLKARTLSPIKQRMLSPMIQANGH

SEQ ID NO: 171073 - protein, 91 aa, Glycine max
  Coding DNA Sequence Number=SeqID_54295
TLPAAASKFVYGSKKSITIHHGLSKSTKWPLTIHHDIPAITQPWFNLIHEKNLRPGDEVVFYYRFHDHAWELLIRKAIEWNNSNTNLDFDE

SEQ ID NO: 171074 - protein, 337 aa, Glycine max
  Coding DNA Sequence Number=SeqID_54296
  Gene Ontology: Mol. function=RNA-directed DNA polymerase activity; Cellular component=intracellular; Biological process=RNA-dependent DNA replication
MEAIKEQMVIMMEAMMSMKKITEVSAAAVAATSAVAELGSTSDPHFGQVQNKHAFPSYGLPPNYTPPNVTHTPDDNPYLGYATKGKAVVPLAMVEREEFNHIEEMLRAIERGGDYAFADMAELCLVPDVIIPPKFKVLDFNKYKGTTCPKNHLKMYTQVAPPMMEREMITMIVDTLPVFYYEKMVGYTPSSFADLVFVGERIEVGLKRGKFYYPALMNRKPREKGENEKEGGTHAVTVVPTWPNFPPIQQSKKPIEFTPIPVSYANLLPYLLDNAMEAITPAKVPQPPFFRGYNSNATCAYHGGVPGHSIEHCMTLKHKVQNIIDAGWLKFEEDNHL

SEQ ID NO: 171075 - protein, 376 aa, Glycine max
  Coding DNA Sequence Number=SeqID_54297
MTLSLRKTRQQVSRSPYRAQATLPPHGDQPESQWSSKPSDMPPSTSIPPYEKLQQATTARGGHQWLWVVEEEFLGWFGQSFEIERPEIMFFTLKNVGKVQASEQVEEMVVKLARLCLLSLCLLRRHAKLKIQRISLISYYLINIKQMSLNQFFLHFLLYVPLHILNEFFNNSHLHKGSPLQLSGSKLWLHQRNLYSNNPQDLGKDHSIRNRIFLHLGVETIFERLHPVEEDDIRCCLLVTSVWARLSIEHLFQSFLGYLFLTISAHCQTIQSTSRCNNNSGWRNYHLSLSNSPLMLAPSCFFVPRRWHMGHNARDKLVFKESLNGIFNIIDDGNAGGLTFPWKCHCSQRVLKIRTGEKVLKFYEFSDDDLYKHKYF

SEQ ID NO: 171076 - protein, 335 aa, Glycine max
  Coding DNA Sequence Number=SeqID_54298
  Gene Ontology: Mol. function=protein histidine kinase activity; Cellular component=integral to membrane; Biological process=two -component signal transduction system (phosphorelay)
  Homolog annotation: Hit_ID=UPI00005F76FC; Match level="QueryCoverage =60%, HitCoverage=36%, E-value=2e-85, Identity=79%"; Hit description =COG3275: Putative regulator of cell autolysis
RQLGLARGDHLFFILDALHQQHDQADAHRAEDHRQGNLRHDVQPKLGRLGPQHDQQHGEGFAQHAADDAGAPALLFFHLEVDVAGADAGDDAGDKARHRGDAADVDQIAMHPGDDAGDDPHPGAEQDAAGHDGDDAHVDQRPFDVDAGVGAEQREQREDRRDDAELERRMVFFLQQLAEQPGAGQEKQTDQHQRGAIKHRQQHFKKRVHDGFSLRPTDGGSIPQRKGPVARATGGGSAHAELRFAQRRQQVDGGAAVEIHLEVVGGEVRRRSAVDKARQLALQIGVVFRAARRGGDVHHVAVELAVMLVLHRVDHVAVPKYRVARLQIGNRGNPT

SEQ ID NO: 171077 - protein, 625 aa, Glycine max
  Coding DNA Sequence Number=SeqID_54299
  Gene Ontology: Mol. function=transporter activity; Cellular component= membrane; Biological process=transport
  Homolog annotation: Hit_ID=Q9FM07; Match level="QueryCoverage=71%, HitCoverage=86%, E-value=0.0, Identity=80%"; Hit description =Permease 1
  Pfam annotation: Domain name=Xan_ur_permease; Domain location=36-431; Score=153.2; E_value=6.9e-43; Accession=PF00860.11; Description =Permease family
  Pfam annotation: Domain name=zf-CCHC; Domain location=565-582; Score =19.5; E_value=0.0006; Accession=PF00098.13; Description=Zinc knuckle
  Pfam module annotation: Pfam domain module=Xan_ur_permease::zf-CCHC; Domain location=36-431::565-582
MAGGGAPAKADEPQPHPPKDQLPNISYCITSPPPWPEAILLGFQHFLVMLGTTVLIPTALVPQMGGGNNEKARVIETLLFVAGINTLLQTMFGTRLPAVIGGSYTFVPTTISIILAGRFSDEPDPIEKFKRIMRSIQGALIVASTLQIVLGFSGLWRNVARFLSPLSSVPLVSLVGFGLYELGFPGVAKCVEIGLPQLILLVFVSQYVPHVLHSGKHIFDRFAVLFTIVIVWIYAHLLTVGGAYNDAPHKTQISCRTDRAGLIDAAPWIRIPYPFQWGAPSFDAGEAFAMMMASFVSLVESSGAFIAVYRYASATPLPPSILSRGIGWQNFVGFPTRENAGLLALTRVGSRRVVQISAGFMIFFSILGKFGAVFASIPPPIIAALYCLFFAYVGAGGLSFLQFCNLNSFRTKFILGFSIFIGLSVPQYFNEYTAINGYGPVHTGARWWYQSYDWEHTKQSLDQALEDEKPVSINEIEWTKIQRRVVSTIRLALAPDIKHALKETTLKALWEKLKNIDTSKSLTNCLCLKMELYQLKMEMEGDLHDHINKDDADSQSRPQRDMNNIQCYYCGENDHVQVRCKQIKEDLKKLRDMNKDDTNSQANVVKSVEDEDMFFATNDEVAKTK

SEQ ID NO: 171078 - protein, 294 aa, Glycine max
  Coding DNA Sequence Number=SeqID_54300
  Gene Ontology: Mol. function=nucleic acid binding; Cellular component= nucleus; Biological process=DNA integration
  Homolog annotation: Hit_ID=Q1T010; Match level="QueryCoverage=80%, HitCoverage=17%, E-value=1e-69, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKIEELQGSLEAQELMLIQRSKESLRLKIKQNLPIGERLVLRIREIERRKTKGRLNGHKEWLIDLDTSRSKKVKLAGSRTLNVERVGNIVIRRKDGKTTFIESVLFVPGMQCNLMSVGQLVEKGFSVIMQNDSLKLFDPNKRLVLRSSLSKNITFQANINVAYAKCRTTIVAKEESCLWHLRFGPLNFRSLSQLQSKDMVIALPNVHVPDRMCKVCSASKQPRNSFCVYLPMRSLELLHVVHSYVCGPFKVASLGGHKYFVSFVDEHNRMIWLYLIKAKNEVFEVFKRFKLLDK

SEQ ID NO: 171079 - protein, 68 aa, Glycine max
  Coding DNA Sequence Number=SeqID_54301
MYKDNWTQPWPMGSEIYPKVHENHRAFFSSSSLIFLEPLAHGSSDWSLPREDCITVMISNFVFVGVDG

SEQ ID NO: 171080 - protein, 175 aa, Glycine max
  Coding DNA Sequence Number=SeqID_54302
  Gene Ontology: Mol. function=DNA binding; Biological process=DNA integration
MVERQSGKLVKVLRIDGGGEYTFREFEDFCEKCGTQHEVTTPYTPQHNDLAKRRNKTILDMARSLLKQKGLLHNFGGKALTIAAYLLNKCSTKRLKEKLQDVHLESEQNRRESNDEIEATTNVNKTQRPQKERHIPSRLSKYETLHDSEVTPDGNSVHFTLIAHVKPIDHEEALQ

SEQ ID NO: 171081 - protein, 116 aa, Glycine max
  Coding DNA Sequence Number=SeqID_54303
  Gene Ontology: Mol. function=DNA binding; Biological process=DNA integration
  Homolog annotation: Hit_ID=Q1T010; Match level="QueryCoverage=69%, HitCoverage=6%, E-value=7e-22, Identity=58%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MSKPRKSHLMETKIILRDKSDEKRTTGYIIEVKKSIQLLMDNKSDINLAKHLVSYGRSKHIETKFHFLRELVNHGRIEVIYCKTKMQVVDILTKALKIDRFVKLTEALGVVDRKSF

SEQ ID NO: 171082 - protein, 179 aa, Glycine max
  Coding DNA Sequence Number=SeqID_54304
MVGYVPSSFAGLVFTDERIEVGLKRGKFNHPAWTNEKTGANEEDEKEGETHAVTAIPIRPSSPPTQQCHYLANNNPSPYLPPSYPQRPSLNQPQNPPLAQTKTPIKEGILQQKACRIHPNSSVYANLFHYLLDTAMVAITLARFPEPPFFQGYDSNAMCAYHGGAPGHSIEHCMTLKHK

SEQ ID NO: 171083 - protein, 199 aa, Glycine max
  Coding DNA Sequence Number=SeqID_54305
  Gene Ontology: Mol. function=hydrolase activity, acting on ester bonds; Biological process=lipid metabolic process
  Homolog annotation: Hit_ID=Q9C6U9; Match level="QueryCoverage=99%, HitCoverage=69%, E-value=4e-19, Identity=29%"; Hit description =Lipase, putative
  Pfam annotation: Domain name=Lipase_GDSL; Domain location=31-199; Score=-13.0; E_value=0.02; Accession=PF00657.12; Description=GDSL -like LipaseAcylhydrolase
MKIFILFSITFAYGFLGNVVSNANPLPYEAIFNFGDSISDTGNAATYHPQMPSNSLYAEAYGMPMLSAYLNLTKAQNIKKGVNFAFAGSTALDKDFLQGKRIHVHEVAYSLSAQLDLFKKLKPPLCKSKEEGAVELVVPGNFPIGCNFAVLTIVNSDKKDDYDQFGCLTAYNAFIEYYNEQLKKAIETLRQEKPNVNIF

SEQ ID NO: 171084 - protein, 103 aa, Glycine max
  Coding DNA Sequence Number=SeqID_54306
MASRKCKSISSRPTTQYDTRRFHSLDAWNRYTDNTELERRNLHKRLTNLVDGSINVALVKEFYANLYNSEGPSPKQARARGHLVKIDADNLNTFLETPVVLAE

SEQ ID NO: 171085 - protein, 189 aa, Glycine max
  Coding DNA Sequence Number=SeqID_54307
  Gene Ontology: Mol. function=metal ion binding; Cellular component =ribonucleoprotein complex; Biological process=ubiquitin cycle
  Homolog annotation: Hit_ID=Q84RR2; Match level="QueryCoverage=99%, HitCoverage=34%, E-value=1e-73, Identity=68%"; Hit description =ARIADNE-like protein ARI2
  Pfam annotation: Domain name=IBR; Domain location=132-170; Score =11.6; E_value=0.0012; Accession=PF01485.11; Description=IBR domain
MDMLSVREQHARTLLIFHRWDVENLFEVLVDKGKSFLFAEAGVSVDEHRNSDSPVPPAFMCYICMEEVPSSKTTRMDCGHCFCNGCWIEHFIVKINEGQSKRIRCMEHKCNSICDDAVVRTLLSREHPHMAEKYERFLLESYIEDNKRVKWCPSTPHCGNAIRVEDDELCELFVRSTLPLFMSDVGALG

SEQ ID NO: 171086 - protein, 136 aa, Glycine max
  Coding DNA Sequence Number=SeqID_54308
MEAREGISTLPIPEIFPLPMPPKETSPPSYGLRSRNIDLSPAVCCEHPVSSSKEEHHKAYLHHLMKHKKSLSTLKGICQSEYGFSDELHNGQITIYPFSFRSSNGNIPIGDDEPEKHGDLVKDVPSVMNWHWLFVI

SEQ ID NO: 171087 - protein, 304 aa, Glycine max
  Coding DNA Sequence Number=SeqID_54309
  Homolog annotation: Hit_ID=Q1T493; Match level="QueryCoverage=75%, HitCoverage=43%, E-value=2e-12, Identity=24%"; Hit description =Nucleic acid-binding, OB-fold, subgroup
  Pfam annotation: Domain name=DUF223; Domain location=73-169; Score= -1.0; E_value=0.0036; Accession=PF02721.5; Description=Domain of unknown function DUF223
MKLSFDSSFSRFLFSSNFFCRIAPVCCCLQNQKVMSHKENLISELHTRKGTWKIVVRITDLWQARKQNSKQTIEMVLMDQTGSKIGTTLWQELFTELRDKLQCGCSYLIQNLRIVDNQSEYRVSPAPYLVYFLKTTFVKEIHHPEIPSNVYLITPFTDIISGLAPRHTLVDIVGVIVDLIDVKTVNPPHRMIVRLRDNSNCDILITVWEDYAIQLHDAIDKNLLLQEPLVVMLTLGKIKDATDKYPLSVQNIKFGSKLYVNADITEIHEFRQSLSMPFYSGGMINDKDGSQSQSSQSNVVEKFL

SEQ ID NO: 171088 - protein, 253 aa, Glycine max
  Coding DNA Sequence Number=SeqID_54310
  Gene Ontology: Mol. function=helicase activity
  Homolog annotation: Hit_ID=Q9LTU4; Match level="QueryCoverage=87%, HitCoverage=15%, E-value=3e-66, Identity=51%"; Hit description =Helicase-like protein
MSASINNNSGVDKYIHLIGSNDHPQTLGRDRGKRIILPSSFVGGQRYIEQLYFDGMAICGHLGFPDLFLTMTCNPTWPEIRRKVTQSNLTPNNCPDIITRVFKIKLNQLMNDLKHGNIFGNIIGYIYTIEWQKRGLPHAHILIFLHPTNKLPNPHDIDQMISAEIPDKQSQAQLFEIVSNHMMHGPCGFANKKSPCMVNGKCIRCFPKNFHGATIVDQDGFPVYRRRNDGRAVMKNGIELDNRFVVPYNPQIL

SEQ ID NO: 171089 - protein, 331 aa, Glycine max
  Coding DNA Sequence Number=SeqID_54311
  Gene Ontology: Mol. function=protein binding; Cellular component =nucleus; Biological process=regulation of transcription
  Homolog annotation: Hit_ID=Q7XAM3; Match level="QueryCoverage=96%, HitCoverage=98%, E-value=1e-114, Identity=59%"; Hit description =Putative cobW protein
  Pfam annotation: Domain name=CobW_C; Domain location=233-329; Score =73.0; E_value=9.7e-19; Accession=PF07683.4; Description=Cobalamin synthesis protein cobW C-ter
  Pfam annotation: Domain name=cobW; Domain location=30-219; Score =249.0; E_value=9.8e-72; Accession=PF02492.9; Description=Cobalamin synthesis proteinP47K
  Pfam module annotation: Pfam domain module=CobW_C::cobW; Domain location=233-329::30-219
MEHDEDEEPPLAVQIQGNDESVSQQSSSVGVTLITGYLGSGKSTLVNHILNSQHGKRIAVILNEFGEEIGVERAMINEGDKGALVEEWVELANGCICCTVKHSLVQALEQLVQRKERLDHILLETTGLANPAPLASVLWLDEQLESEVKLDSIVTVVDAKNLRFQLDEHRGSSSFPEAYFQIAFADIIILNKVDLVSVESSGALEELERATQLEALLEESRSLSTKKLHDSDVRTICICETRMINLDKTRIWLEEILWEKKYDMDVYRCKGVLSVQNSDQLHTLQAVKELYEIVPSRKWEKEEKRINKIVFIGHNLKEDILINSFRDRATC

SEQ ID NO: 171090 - protein, 273 aa, Glycine max
  Coding DNA Sequence Number=SeqID_54312
  Subcellular localization annotation: CTP_CleavageSite=40; ConfidenceScore=5.69e-01
MVPSSTIVAPLLSVGVATTGVLAMLPLSSSTVVALPATILASMASPSLSSCPRVSLDHLYTSSDVDLLWGATYKLEQKTLVNFVSAFDKNLFRLAGVLNDTNFAKVFLQRSLAILEENGLRHQEAVQKVASLEADVAKWRATARTLWRVEHPKVANATIDGLGCQSGVEKDRLAKRIAKLEARIKVSESRLEESELRASKEREASKELEEELILYKKEATEQYDKGFQKTVRQADFFANDLVLGLFDPFKDVKEGVLLDEEEIDVKEQAADEG

SEQ ID NO: 171091 - protein, 75 aa, Glycine max
  Coding DNA Sequence Number=SeqID_54313
MHVDLLKQFNNISSSSANTEQHGVHIENQQSKSNGVQAYEEAEDDGDNVQLDPAIEINTEDSVNNSTIITSLLPL

SEQ ID NO: 171092 - protein, 73 aa, Glycine max
  Coding DNA Sequence Number=SeqID_54314
MVFIGRQVLNNDGTSYCDVGDGVVATSDDGNFVDATTTKGMVVATKDGDGDGATNGAWANDPGASLCNNTLIT

SEQ ID NO: 171093 - protein, 628 aa, Glycine max
  Coding DNA Sequence Number=SeqID_54315
  Gene Ontology: Mol. function=methyltransferase activity; Cellular component=cellulose and pectin-containing cell wall; Biological process=metabolic process
  Homolog annotation: Hit_ID=Q1SBM2; Match level="QueryCoverage=63%, HitCoverage=92%, E-value=1e-162, Identity=70%"; Hit description =Putative methyltransferase, putative
  Pfam annotation: Domain name=DUF248; Domain location=164-626; Score =314.8; E_value=1.6e-91; Accession=PF03141.7; Description=Putative methyltransferase
  Pfam annotation: Domain name=Methyltransf_11; Domain location=290 -385; Score=32.1; E_value=2e-06; Accession=PF08241.2; Description =Methyltransferase domain
  Pfam annotation: Domain name=Methyltransf_12; Domain location=290 -383; Score=9.2; E_value=0.064; Accession=PF08242.2; Description =Methyltransferase domain
  Pfam module annotation: Pfam domain module=DUF248::Methyltransf _11::Methyltransf_12; Domain location=164-626::290-385::290-383
  Subcellular localization annotation: CTP_CleavageSite=43; ConfidenceScore=5.18e-01
MGNWDFGLRGFSPSFCSIFWVLMNPLTFLRYWGRNVVVFYFACCSWNSGLVEFGVGFDSVCLRKFKDLDMRSSWFNKLSIIIGPRPPVNWLFLCLISLLVLIVVLGSSSSNIDDQAPDIPVSLIYTNYRRVKEQAVVDYLELRSVARGVSRQREFDLCGKERENFVPCYNVSANLLAGFKDGEEFDRHCELLVEAERCLVRPPKEYKIPLQWPAGRDVIWSGNVKITKNQFLASGSMTKRLMLLEENQIAFHSEDGLIYDGMKDYSRQLAEMIGLGSDNELPQAGVRTILDINCGFGSFAAHLASLKIMTVCIAPYEATGSQVQLALERGLPAVIGNFVARQLSYPSLSYDMVHCAQCGIIWDGKDGRFLIEVDRVLKPGGYFVLTSPTSRSQGSSSQMKRRNMLMPMEELTQQLCWTLLAQQDETFIWQKTADVNCYAYRKKHAIPLCKEDDDAQSYYRPLQPCVQPEDFFEDLQFWRSALKNYWSLLTPLIFSDHPKRPGDEDPLPPFNMIRNVMDMSTKFGGLNTALLEEKKSVWVMNVVPATASNSLPFLLDRGFAGVMHDWCEPFPTYPRTYDMLHANGILSHLTSERCSLMNLFLEMDRILRPEWHLHSSFNSFILLTYSPA

SEQ ID NO: 171094 - protein, 368 aa, Glycine max
  Coding DNA Sequence Number=SeqID_54316
  Gene Ontology: Mol. function=protein binding; Cellular component =intracellular; Biological process=defense response
  Homolog annotation: Hit_ID=Q6Z7U2; Match level="QueryCoverage=72%, HitCoverage=50%, E-value=6e-24, Identity=28%"; Hit description =Pentatricopeptide (PPR) repeat-containing protein-like
  Pfam annotation: Domain name=PPR; Domain location=10-44; Score=15.1; E_value=0.12; Accession=PF01535.11; Description=PPR repeat
  Pfam annotation: Domain name=PPR; Domain location=150-184; Score =41.6; E_value=2.8e-09; Accession=PF01535.11; Description=PPR repeat
  Pfam annotation: Domain name=PPR; Domain location=216-250; Score =28.0; E_value=3.3e-05; Accession=PF01535.11; Description=PPR repeat
  Pfam annotation: Domain name=PPR; Domain location=274-308; Score=0.8; E_value=6; Accession=PF01535.11; Description=PPR repeat
  Pfam annotation: Domain name=PPR; Domain location=45-78; Score=5.6; E_ value=1.6; Accession=PF01535.11; Description=PPR repeat
  Pfam annotation: Domain name=PPR; Domain location=79-113; Score=35.5; E_value=1.9e-07; Accession=PF01535.11; Description=PPR repeat
  Pfam module annotation: Pfam domain module=PPR::PPR::PPR::PPR::PPR::PP R; Domain location=10-44::150-184::216-250::274-308::45-78::79-113
MARRHFVNDTTFVIALRTLGGARELKKCVEFFHLMNSNGCEYNLGTLNKVVEAMCKSRLVDEAKFVVFKLRECVRPDGVTYKNLIIGYCDKGDLVGASKVWNLMEDEGFEADVDAVEKMMETFFKVNEYGEALRLFETMRFKRMNELGASTYGLVIRWLCKKGMMARAHEVFEEMRERGVRVNDSTLGDVVYGLLTRRRVREAYRVFEGIEVPDLCVYHGFIKGLLKLRRAGEATQVFREMIRRGCEPTMHTYIMLLQGHLGRRGRKGTDPLVNFDTIFVGGMVKAGKSKEATKYVERVLNRGMEVPRFDYNKFLHYFSNEEGVHMFEDVGKKLREVGLVDLADILDRYGQKMATRDRRRDRSPITED

SEQ ID NO: 171095 - protein, 267 aa, Glycine max
  Coding DNA Sequence Number=SeqID_54317
  Gene Ontology: Mol. function=nucleoside-triphosphatase activity; Cellular component=integral to membrane; Biological process=transport
  Homolog annotation: Hit_ID=Q8RWI9; Match level="QueryCoverage=73%, HitCoverage=37%, E-value=2e-45, Identity=42%"; Hit description=White- brown complex homolog protein 15
  Pfam annotation: Domain name=ABC2_membrane; Domain location=74-267; Score=11.8; E_value=0.00058; Accession=PF01061.14; Description=ABC-2 type transporter
MYAFIDGYPCVRLMNLSGTISCSSESPRSLILSLSKFFDPGRDKVVAPIVRFENVDIIAEPSADVPNSPDPFMNLATAQIKATLVEKYRRSTYATRAKNRIQELSIDGFNLQHNMEVKLVGGSNYLTLTKRSFVNMCRDVGYYWLNGYYGVAAYILANFLSSFPFLVLIALTSCTIMYNMVKFRPGINHFVFFFLNIYSCISVIESLMIVVASLVPNFLMGIITGAGIIGIMMMTSGFFTLLSDLPKPVWRYPYLYISYGSCLLGQY

SEQ ID NO: 171096 - protein, 401 aa, Glycine max
  Coding DNA Sequence Number=SeqID_54318
  Gene Ontology: Mol. function=transferase activity; Cellular component= membrane
  Homolog annotation: Hit_ID=Q5BM99; Match level="QueryCoverage=99%, HitCoverage=76%, E-value=1e-173, Identity=72%"; Hit description =Secondary cell wall-related glycosyltransferase family 47
  Pfam annotation: Domain name=Exostosin; Domain location=1-337; Score =337.3; E_value=2.5e-98; Accession=PF03016.6; Description=Exostosin family
MYDLPPEFHFGLLDWKPSGNSVWPDVRTNIPGYPGGLNLQHSIEFWLTLDILASEFPQASKARTVIRVQNSSEADIIFVPFFSSLSYNRYSKSKPHVKKSKNKILQEKLVTYLMAQEEWKRSGGKDHLILAHHPNSMLDARMKLWPATFILSDFGRYPPNIANVEKDVIAPYKHLISSYVNDNSNFDSRPTLLYFQGAIYRKDGVRNGTNQPIVLEMGGLARQELFYLLKDEKDVHFSFGSIGKDGIKKATEGMRASKFCLNIAGDTPSSNRLFDAIASHCVPVIISDKIELPYEDVIDYSEFCIFVRTSDAIKEKFLINFIRGIAKEEWTRMWNKLKEVEHFFEFHFPSKENDAVQMIWQAVARKVPAMRLKLNRFERFSRSPPSTDEGLRSIPVPKNFW

SEQ ID NO: 171097 - protein, 134 aa, Glycine max
  Coding DNA Sequence Number=SeqID_54319
  Pfam annotation: Domain name=zf-CCHC; Domain location=84-101; Score =13.2; E_value=0.0065; Accession=PF00098.13; Description=Zinc knuckle
MELMRLYQHEENDKKKKGIALKASSSSIHEENDKEDSNEKNLEEDDDDFNLFVKRFNKFPRNKGNQRRSNFNPKKKGEDSSLVQKFYECDQPGHLRFDCPIFKRRMEKSDKKTFKDKKEKKAYITCKDNDMDSS

SEQ ID NO: 171098 - protein, 101 aa, Glycine max
  Coding DNA Sequence Number=SeqID_54320
MALDRMQLQNMCKKGHESFKEYAQRWRDLEAQVTPPMTEKEMIKMIVATLPVFYYENMVGYTPSSFADLVFSGERIEVGLKRGKFDHPTLMNGKPGANRED

SEQ ID NO: 171099 - protein, 71 aa, Glycine max
  Coding DNA Sequence Number=SeqID_54321
MINAGMICPLRCHEEMHDAIKEQARGLSATMHHQKRKTLDEASLLSSESKTQHDHRSTSTPYGSHRPEYRA

SEQ ID NO: 171100 - protein, 186 aa, Glycine max
  Coding DNA Sequence Number=SeqID_54322
  Gene Ontology: Mol. function=nucleic acid binding; Cellular component= mitochondrion; Biological process=DNA integration
MNDELTALHSNKTWELVPRPPNTNIVGSKWVFRTKYLSNGSIDRFKARLVAQGFTQTPGLDYDYTFNPMVKASTVCVILTLAVMQHWPLHQLDVNNAFLNGLLSNLVYMEQPPGFIDPRFPYHVCRLRKALYGLKQAPLSWFQRFISFLLHLGFIGSKADPSLFIYHHNTATLYLLVYIDDIILTS

SEQ ID NO: 171101 - protein, 409 aa, Glycine max
  Coding DNA Sequence Number=SeqID_54323
  Gene Ontology: Mol. function=nucleic acid binding; Cellular component= chromatin; Biological process=DNA integration
MAHAASLSDGALSFNTMIHMLNIRLTPSTFILWRRQLLPLLQGQALYDHIDGSTPAPPTMLTSVDGSLSSTVNPAFTSWKQQGQQLVSLLLTSLTEETLAEVLHCETSQQIWTTLESLFGGDSKQWEIVIRDQLLHLKNDLSSVRDFSKSFCALCDQLILMGKPVDDLDKLHWFLGGLGPTFTSFGASQLAMLPLPTFRDLVSAAESFEFYINAMEVVSSQASFYSTTHCPSHPSHPHSSSGDRSSSGSHAPLSGRKGRGRGGRGREGHYATFCPQQYNGAPLSSANIVESFAVSCNISSPNNSDWYLDTGASAHMMSSSSTLDAMEPYFGNHKVLVGNGNVLPISHIGSRRLNSTLQLLDILVVPGLQKNLISISKLTRDFPVDAIFTNNSFLLQKRDTKEILAQGRH

SEQ ID NO: 171102 - protein, 100 aa, Glycine max
  Coding DNA Sequence Number=SeqID_54324
  Gene Ontology: Mol. function=DNA binding; Biological process=DNA integration
MSFEGHKPQGRDNSGIDNYKDGLEGAGGETATSLEGSSKRENPKCEIEEIGPVLEKGNKTKSIKPIRSGHVGMKKHCKTCLGNVAMLAFGPAILSRGMGA

SEQ ID NO: 171103 - protein, 66 aa, Glycine max
  Coding DNA Sequence Number=SeqID_54325
  Gene Ontology: Mol. function=RNA-directed DNA polymerase activity; Biological process=DNA integration
  Homolog annotation: Hit_ID=Q1SDN3; Match level="QueryCoverage=94%, HitCoverage=4%, E-value=9e-14, Identity=56%"; Hit description =Polynucleotidyl transferase, Ribonuclease H fold
SAKKQPTVAHSSCESEYRAMANATVELMWFTHLLHDLHVYSAPPTLLCDNKSAIFLSQNPVAHKRA

SEQ ID NO: 171104 - protein, 46 aa, Glycine max
  Coding DNA Sequence Number=SeqID_54326
MAEMENNCQRWSNNTCAYNPHKPPFPKLNANKGTYKEKKQHEKGRK

SEQ ID NO: 171105 - protein, 139 aa, Glycine max
  Coding DNA Sequence Number=SeqID_54327
MWDFNMPHFPYGYPPCGTFNTPLYLGVITPPLTLEATCLERDKHRDPFRIGSDTMLESEFGLNSTLQNRLIRAKPEETLLEARNDTNVQIVCLTWVGSSGWKSTARCVVFSVPPVALENPEDRVPPTPDRTHNRIKSPR

SEQ ID NO: 171106 - protein, 181 aa, Glycine max
  Coding DNA Sequence Number=SeqID_54328
  Gene Ontology: Mol. function=pyruvate kinase activity; Biological process=intracellular protein transport
  Homolog annotation: Hit_ID=UPI0000E69930; Match level="QueryCoverage =86%, HitCoverage=88%, E-value=6e-21, Identity=34%"; Hit description =conserved hypothetical protein
  Pfam annotation: Domain name=DUF615; Domain location=1-166; Score =198.8; E_value=1.3e-56; Accession=PF04751.4; Description=Protein of unknown function (DUF615)
MTSETLDDSQPSKTRLKAEADAAQDIGRKLVELPKDKLKKLQLEEILLDAITEAKRITSNGAIRRQMQYIGRLMRDTDLAPIVEQLEKWEGKHQEENARFHHMERWRSRLLEEAKAIELFIAEFPQTNVQQMRTLIRNAQKEHAAGKPPKSSRELFKMIREIMEGKSVVEDESFDDGAFEE

SEQ ID NO: 171107 - protein, 260 aa, Glycine max
  Coding DNA Sequence Number=SeqID_54329
  Gene Ontology: Mol. function=peptidase activity
  Homolog annotation: Hit_ID=Q1H3T3; Match level="QueryCoverage=96%, HitCoverage=58%, E-value=3e-87, Identity=64%"; Hit description =Peptidase U62, modulator of DNA gyrase
  Pfam annotation: Domain name=PmbA_TldD; Domain location=23-260; Score= 56.8; E_value=7.1e-14; Accession=PF01523.7; Description=Putative modulator of DNA gyrase
MQQDQLQQIAKDIIQLTRKAGASSAEAEVSFGTGQNVSVRQGETENIEYNRDKGCSVTVYFGQRKGYASTSDLSPQALKDTVEAACNIAKYTAEDPFCGLAEAALMATEFPDLSLHHPWHIDVDAALALAKRCEAAALAVDPRISNSEGASIYSQSGAFAYANSHGFMGGYPSSRHSISCSVIAEAEGLMQRDYWYSSARDAQDLATPEQVGQIAGIRTVKRLGAHPIKTGQYPVIFEAPLASGLISTLISAISGGNLYR

SEQ ID NO: 171108 - protein, 348 aa, Glycine max
  Coding DNA Sequence Number=SeqID_54330
  Gene Ontology: Cellular component=integral to membrane
  Homolog annotation: Hit_ID=Q1H3U1; Match level="QueryCoverage=97%, HitCoverage=50%, E-value=5e-85, Identity=50%"; Hit description =Putative site-specific recombinase, prophage insertion
MPDQVWRDFMLTLDISRGDWQLQQNCIQELKDALQVLSFRLSASGLDPELILQHEDLESNSSPFITQNIEIQKFLALTSIQAEDVQHLYSVLKRCEQLTYEIRKSNAKTGTSISLTALMQRILQQIQRMQLVVDILHGLILKHDVSQAITRLLKQLVDAECKKNNLSDYWRQNTELLALRVTENASHTGEHYIAQKRSEYFKLMGSAMGAGLIIAFMAMFKILIASYHLPPLTEAILFSLNYGLGFVIIHLLHFTVATKQPAMTAATIAATIDDHGHDSKNIHNLVNIVAQTTSSQTIAILGNVVVVIPVAILIDWLIMQATGHHFIGIEKAHALLDSNKPVNQLDRL

SEQ ID NO: 171109 - protein, 96 aa, Glycine max
  Coding DNA Sequence Number=SeqID_54331
MVRISKEKNQLRQATKTYFEGKHVVQEQFKALNAKFDDLQSTSKSKVPLIEIMIRKKKRSIIMKSLEGEEKVNQEKDDHLGNIQMTIPLFQSKNYP

SEQ ID NO: 171110 - protein, 304 aa, Glycine max
  Coding DNA Sequence Number=SeqID_54332
  Gene Ontology: Mol. function=protein domain specific binding; Cellular component=spindle pole body; Biological process =intracellular signaling cascade
  Homolog annotation: Hit_ID=Q9C5W6; Match level="QueryCoverage=81%, HitCoverage=86%, E-value=1e-105, Identity=79%"; Hit description=14-3- 3-like protein GF14 iota
  Pfam annotation: Domain name=14-3-3; Domain location=1-235; Score =392.8; E_value=5.1e-115; Accession=PF00244.10; Description=14-3-3 protein
MVECMKKVAKLDLDLTVEERNLLSVGYKNVIGARRASWRIMSSIEQKEESKGNEHNVKLIKSYCQKVEEELSKICGDILTIIDQHLIPSSASAEASVFYYKIYNCIFWLKAKRKVLVRIWKGDYFRYLAEFKTDQERKEAAEQSLKGYEAASATANTDLPSTHPIRLGLALNFSVFYYEIMNSPERACHLAKQAFDEAIAELDTLSEESYKDSTLIMQLLRDNLTLWTSDLPEDGGEDSIKAEETKPSEPELVLACWGISLSFWHVGDIIIAEPNAYIGFTGKRVIEQTLNKAVPEGSQVAERK

SEQ ID NO: 171111 - protein, 165 aa, Glycine max
  Coding DNA Sequence Number=SeqID_54333
MGYYFYHPPDHKVFVAREKTILERRFSQKEIMIKKLSLHEVQENDEAPKAQEHGNENDYPKVFWGARKSAGMRTTILPKSMVVLFFKVHIFTLFQLVPHQLTLSFCLTPTYIKTLNNTIETLSQWTLGWREMCDRLRSDKESWKKARGFCFGHDIIEENIVFGFH

SEQ ID NO: 171112 - protein, 90 aa, Glycine max
  Coding DNA Sequence Number=SeqID_54334
MVRDLVSWVRSMEAGSAWKEKAAMVTAQWKKMGSVEWHREGLAAEEGRPVWWPCIPYIEALAKGAAKTKGARMRKENNRKIWKWRQCNAA

SEQ ID NO: 171113 - protein, 355 aa, Glycine max
  Coding DNA Sequence Number=SeqID_54335
  Subcellular localization annotation: CTP_CleavageSite=59; ConfidenceScore=5.08e-01
TVHGFCGKGKGYNAKGISLSSNMMPKFPTVRWPAGKREDFGRREKKRNCEAEEAQVSVRSDVDQGRLWKEGWVLIIGWGVCGDSKWVGSSTQGMSARRDTGGEARLDKIVSATTVDEDDHLMVCDGSIEGKAGVLRRRDWGRRRRSMAVFVLIGNQQVEARTTTVTICRHSGNISLCHGEGQGALSPKKKVARVTVVDDPRSSPLAAWREQWHVVETRAVEPAPPDEAPVSAKCDSKAWSNAGHEEMNPLRVIHCYQERAASCGFWCLVKKVWGDEKVEVAGEKVVRLAWAWASLAMASSIRSRLDWRVLWSGMVAGGGRAVLRVVVVLSFVHATCMAGSVGNICSSKGDAVNEG

SEQ ID NO: 171114 - protein, 96 aa, Glycine max
  Coding DNA Sequence Number=SeqID_54336
MPDHNTRQSNLDRMEEAIAKLAQAQANLIQDHATLAQTQTSMTTKMDSMLEHLATITVQPFPLQPPPSHHPTPSSPNTKTHMKLDVPRFDGHDPIG

SEQ ID NO: 171115 - protein, 134 aa, Glycine max
  Coding DNA Sequence Number=SeqID_54337
  Gene Ontology: Mol. function=RNA-directed DNA polymerase activity; Cellular component=chromatin; Biological process=chromatin assembly or disassembly
MAFRTYHGHYEFKVMPFGLTNASSTFQATMNDLLRPFLWKACSTFVVPNVPSPNSNYLGHIVSLHGIAPDPKKIKVMIDWPTPITPSDLRSFLGLTAQTTFQQLKTLMTQAPILASPDFTMPFILETDASGTTI

SEQ ID NO: 171116 - protein, 673 aa, Glycine max
  Coding DNA Sequence Number=SeqID_54338
  Gene Ontology: Cellular component=mitochondrion
  Homolog annotation: Hit_ID=Q7XAM2; Match level="QueryCoverage=90%, HitCoverage=88%, E-value=1e-175, Identity=52%"; Hit description =Pentatricopeptide (PPR) repeat-containing protein-like protein
  Pfam annotation: Domain name=PPR; Domain location=276-310; Score=6.9; E_value=1.1; Accession=PF01535.11; Description=PPR repeat
  Pfam annotation: Domain name=PPR; Domain location=552-586; Score =22.6; E_value=0.0014; Accession=PF01535.11; Description=PPR repeat
  Pfam annotation: Domain name=PPR; Domain location=587-621; Score =24.0; E_value=0.00054; Accession=PF01535.11; Description=PPR repeat
  Pfam module annotation: Pfam domain module=PPR::PPR::PPR; Domain location=276-310::552-586::587-621
  Subcellular localization annotation: CTP_CleavageSite=41; ConfidenceScore=5.61e-01
MASQMAILFRTRTLLSSKPTTTTLIKTITTFPFLSQEPQLVDSTPPPSSSTTPLPPNPASGSPLYNENWRSPIPPPPPASSAATSHALAPVGFYNRATSETYDPRALLDLFGDWMASQQWHDVKFLFEAWVRSLDKTGKPNKPDVNLFNHYLRANLMLGASAAELLDLVAQMAEFDVAPNTASFNLVLKAMCQAKETLAADKLLQRQDCCFVIAGNTVYQARATGARRTVFLNCNCSLICFCLLPVLFDLDVEESPLLFKAKLMLQSGNDALPDDESYDLVIGMLFSMDQIDTAFKYIDLILKSGNVLSMKVFMNCAGSCVNKGRLDTLVTIIERCRASDQNKALCPNWDLCNFIVEIATREDNSKLAFYGLEFMAKWIVKGERQRPPIYISVDEGLVLSALLTAGRTYNTDLLVASWAVLDRSLRKKKAPNPESYLGKIYAHASLGNLQKAFGTLNEYESAYGDSGQEAEDLFCPFTSLHPLVVACSKKGFETLDNVYFQLENLNRAEPPYKSVAALNCVILGCANIWDLDRAYQTFESIGSTFGLIPDIHSYNGLIYAFGKLKKTHEATRVFEHLVSLGLKSNAKSYSLLVDAHLINRDVKSALAVIDDMRAAGYEPSKEMLKKVRRRCTREMDNESDARVQSLANSLNYQLGSENRRDILFNLNYSMGYA

SEQ ID NO: 171117 - protein, 60 aa, Glycine max
  Coding DNA Sequence Number=SeqID_54339
MDHAADKVHEEFHKPVTDHEGADTKGFPGRPQDTSVLTSYVDYVASRERTKLKLASHGMK

SEQ ID NO: 171118 - protein, 50 aa, Glycine max
  Coding DNA Sequence Number=SeqID_54340
MVGAFSQNTVTLTGLPMILPSESDLTYYCVMNRWMDYEEPHARGHGNTTL

SEQ ID NO: 171119 - protein, 241 aa, Glycine max
  Coding DNA Sequence Number=SeqID_54341
GLDQEATKGLCLSKGNEDIRLIVVEENARDGPLNGEKFWVKKDREDANNLLTVGKNLGVSMAEKHTAMVEKLVFMEPWDINRPESWKVCYKHGGSWWAMRMYKLFSQETKKEVINKELCFTLWGDLEVCRGMHGRGGDRDVVLVSIYLPYDLVGKRRLWDELKVIKEDSNVTRWHVMGDFNCIRKRGDKSLGGAQQESGATHIEGWHARAVEEEVTFTHSAGRGREALQSVGDSVTSTPSK

SEQ ID NO: 171120 - protein, 164 aa, Glycine max
  Coding DNA Sequence Number=SeqID_54342
MIQASSSQILPCQTEALYRKQKARSIAVDSERKRRSKAIPVKISDQAEAENSDNDGDESQEASRKTTSSKRKASSTTASEKVLEEVFKEVKEASKDSLDEDSEYGIRQSTSFKSDPCVKSRRKEAAGTKEITLEVTSNLDHLHEIKIDSELATHVTYLNEFRCL

SEQ ID NO: 171121 - protein, 635 aa, Glycine max
  Coding DNA Sequence Number=SeqID_54343
  Gene Ontology: Mol. function=ubiquitin-protein ligase activity; Cellular component=ubiquitin ligase complex; Biological process =protein ubiquitination
  Homolog annotation: Hit_ID=Q681N2; Match level="QueryCoverage=98%, HitCoverage=94%, E-value=0.0, Identity=62%"; Hit description=Arm repeat containing protein
  Pfam annotation: Domain name=Arm; Domain location=385-425; Score =53.6; E_value=6.7e-13; Accession=PF00514.13; Description =Armadillobeta-catenin-like repeat
  Pfam annotation: Domain name=Arm; Domain location=426-466; Score =22.2; E_value=0.0019; Accession=PF00514.13; Description =Armadillobeta-catenin-like repeat
  Pfam annotation: Domain name=Arm; Domain location=467-507; Score =27.4; E_value=5e-05; Accession=PF00514.13; Description=Armadillobeta- catenin-like repeat
  Pfam annotation: Domain name=Arm; Domain location=508-548; Score =21.4; E_value=0.0032; Accession=PF00514.13; Description =Armadillobeta-catenin-like repeat
  Pfam annotation: Domain name=Arm; Domain location=549-589; Score =25.0; E_value=0.00026; Accession=PF00514.13; Description =Armadillobeta-catenin-like repeat
  Pfam annotation: Domain name=U-box; Domain location=262-335; Score =108.6; E_value=1.8e-29; Accession=PF04564.6; Description=U-box domain
  Pfam module annotation: Pfam domain module=Arm::Arm::Arm::Arm::Arm::U- box; Domain location=385-425::426-466::467-507::508-548::549-589::262- 335
MTTMEEERDVSSDELSEEKYDPVEEIQRVIQSIVQFGEYRRTQRKESHNLVRRFKLMLPLWEELRDLPQPFPEIGVTWLSKVKDVLLFAKDLLKLCSQGSKIHLALETEVVMITFQKVYDKLSQAFGDVPCDEMGISDEVKEQLELMHVQLKRARRRTDTQDIELAMDMMVVFSDNDDRNADSAIIERLAKKLELHSVEDLNIETLAIRNLAAERKGQQAESTQKIIYLLNKFKRIAGMEETGILDDPAAPKMLERCTSLVIPHEFLCPITLEIMTDPVIVTSGQTYERESIKKWFQSNHNTCPKTRQPLEHLSLAPNRALKSLIEEWCENNNFKLPKKYNSSGPESCPIDSKEEIPALVESLSSIHLEEQRKAVEKIRMLSKENPENRVLVAEHGGIPPLVQLLSYPDSKIQEHAVTALLNLSIDEGNKSLISTEGAIPAIIEVLENGSCVAKENSAAALFSLSMLDEIKEIVGQSNGYPPLVDLLRNGTIRGKKDAVTALFNLSINHANKGRAIRAGIVTPLLQLLKDRNLGMIDEALSILLLLVSNSEARQEIGQLSFIETLVEFMREGSPKNKECAASVLLELCSSNSSFTLAALQFGVYEYLMEIKQNGTNRAQRKANAILDLISRSEQI

SEQ ID NO: 171122 - protein, 154 aa, Glycine max
  Coding DNA Sequence Number=SeqID_54344
  Gene Ontology: Mol. function=nucleic acid binding
MEHTEGHSMTENMRIFYNTMNQLTVTYIKLDYELRALLLFNSLLDSWDWEVHVVTLTNSAPNGKLSMSMLKDSILNEEAKRTECLSITSTQSKALVADSQGRMLLIMEPYIIVGDSGTIKMENERICKLLLKLRISTAMTFTLVVAYSSSPKGH

SEQ ID NO: 171123 - protein, 70 aa, Glycine max
  Coding DNA Sequence Number=SeqID_54345
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=78%, HitCoverage=29%, E-value=1e-20, Identity=85%"; Hit description =Anaphase-promoting complex subunit 10
  Pfam annotation: Domain name=APC10; Domain location=3-70; Score= -80.7; E_value=0.021; Accession=PF03256.7; Description=Anaphase -promoting complex, subunit 10 (APC10)
MGAQSSKLYTLPVNKLIVLYVVFKLDESYTPSKVSIRAGDGFHNLKEIKTVELVKATGWVYLSLSGADPR

SEQ ID NO: 171124 - protein, 39 aa, Glycine max
  Coding DNA Sequence Number=SeqID_54346
MKMHVCKFPSLDKAHVDKTEVSEWALSMTYMQIVKTHIP

SEQ ID NO: 171125 - protein, 72 aa, Glycine max
  Coding DNA Sequence Number=SeqID_54347
  Subcellular localization annotation: CTP_CleavageSite=59; ConfidenceScore=5.15e-01
MSPPPLEPHNHSQTHPKFSGRLPLQARFSAADGLKRCASLDDPSFSANEQLILLPNSSSCSAEECCARRMAR

SEQ ID NO: 171126 - protein, 94 aa, Glycine max
  Coding DNA Sequence Number=SeqID_54348
MIQTLPATASKFVYGSKKSITIHHGLSKSTKWPLTIQHDIPAITQPWFNLIHEKNLRPGDEVVFYYRFHDHAWELLIRKAIEWNNNNTDLDFDE

SEQ ID NO: 171127 - protein, 67 aa, Glycine max
  Coding DNA Sequence Number=SeqID_54349
MDDRGDEREGGTGAGHYNRLQASIIDYSLAVLRNMINKYSIIRKLLLHPKNLGTTTASKNVFRFSSG

SEQ ID NO: 171128 - protein, 121 aa, Glycine max
  Coding DNA Sequence Number=SeqID_54350
  Gene Ontology: Mol. function=protein serine/threonine kinase activity; Biological process=protein amino acid phosphorylation
MYPSIQHLNHNHSTHNGLFWKTGTKKEEAAKQQQQKNISFKWIHKVNTYLRKKQTLSSFTQHQHQQREVAIMSTLLEHANMVKLKVTYEDEENIPLVMELCTGGNSSTRSLCGGTTTSVLS

SEQ ID NO: 171129 - protein, 97 aa, Glycine max
  Coding DNA Sequence Number=SeqID_54351
  Homolog annotation: Hit_ID=Q9LT89; Match level="QueryCoverage=35%, HitCoverage=11%, E-value=6e-08, Identity=74%"; Hit description =Similarity to DNA binding protein PCF1
MAYSEAKFLFMKLVSSKQRNSPKYEWLSTRNNETTISRTLEGRFHFLFEAASFLLDEVVDILNVPVALMIADSACSKSHRMVLPSDLWSISWVNWKI

SEQ ID NO: 171130 - protein, 72 aa, Glycine max
  Coding DNA Sequence Number=SeqID_54352
ALGGPAARPGELRLSHEATGSPRQAGYFTWKSFGGPSEPEASLGKLWFRKLNEKTLLPPSFGIFCILDQYTE

SEQ ID NO: 171131 - protein, 133 aa, Glycine max
  Coding DNA Sequence Number=SeqID_54353
  Subcellular localization annotation: CTP_CleavageSite=54; ConfidenceScore=5.02e-01
MASKSIACIVLLSLNLLFFTMVSPNTIAPSPAIQPPPPPPSPPLPHHGNRKAACADLRGDHFGSFVFAITCNLGFCSVLEAELRAIYHGLKIIRDKAIVVESDSSLAVQMLNDGCSRQHSSYLLANKVVSLVS

SEQ ID NO: 171132 - protein, 345 aa, Glycine max
  Coding DNA Sequence Number=SeqID_54354
  Gene Ontology: Mol. function=nucleotide binding; Cellular component =integral to membrane; Biological process=transport
  Homolog annotation: Hit_ID=Q6S9Z3; Match level="QueryCoverage=93%, HitCoverage=100%, E-value=2e-91, Identity=72%"; Hit description =Allantoin permease
  Pfam annotation: Domain name=FAE_3-kCoA_syn1; Domain location=37-290; Score=417.0; E_value=2.6e-122; Accession=PF07168.2; Description=Fatty acid elongase 3-ketoacyl-CoA sy
  Pfam annotation: Domain name=Sugar_transport; Domain location=79-332; Score=-171.6; E_value=0.0059; Accession=PF06800.3; Description=Sugar transport protein
  Pfam module annotation: Pfam domain module=FAE_3-kCoA_syn1::Sugar _transport; Domain location=37-290::79-332
EFSGLCSLVSSLSESILCTTGLKMYLVESKGGAITCMFLALFFLGTWPALLTMLERRGRLPQHTYLDYSITNFLSALLIAFTLGGIGKGTHDQPNFLVQLAQDNWPSVLFAMGGGLFLSLGNLSSQYAFAFVGLSVTEVITASITVVIGTTLNYFLDDKINKAEILFPGVGCFLIAVFLGSAVHSSNAADNKAKLSNFTGDYKDGDISSSKEGDIGEKISCGSICEIIVFDNVEAGTAVFLVELEEKRAIKADSDGRVWALLAGLLCGFGNGLQFMGGQAAGYAAADAVQALPLVSTFWGVILFGEYRKSSRRTYILLGSMLFMFIVAVAVLMASSGQRNSTAKE

SEQ ID NO: 171133 - protein, 139 aa, Glycine max
  Coding DNA Sequence Number=SeqID_54355
MASESYGYYCLHHNGVSLNTLAYMLAVADEHKTYIGPKALMHASHKEEIFGPNFTRALLPAKDSNSWYPISLQTNASLYSGVAIVSGALKPMMILKSSRECHMAHVPRDGLEQVEKEAVVVVMTNDDERRMKNRAHVDV

SEQ ID NO: 171134 - protein, 198 aa, Glycine max
  Coding DNA Sequence Number=SeqID_54356
MEDYLLTTREALMFHVKRIMKRTLNQVEDEVATSGLGQHIQALSKQIETLMNAQSLFQVPNSTPFYHTYDRDPCTLPSQIETSSKKEDTKAIMTRNKKVEEVLIGENMVPDKEVEERECTDISQGTYSFHSKGLRELEPTNIPLHLADCSMVHPRRVIEDVLATFLSVGVIDPIERVLIHEDFEWAMSLDEEEILMLF

SEQ ID NO: 171135 - protein, 143 aa, Glycine max
  Coding DNA Sequence Number=SeqID_54357
  Gene Ontology: Mol. function=chromatin binding; Cellular component =chromatin; Biological process=chromatin assembly or disassembly
  Homolog annotation: Hit_ID=Q1SAV4; Match level="QueryCoverage=71%, HitCoverage=94%, E-value=1e-17, Identity=70%"; Hit description =Integrase, catalytic region
MRNKEATRITPTLTRSYYDLGRPFAGFHHGIATVTWLLRHSRHHRPFLEWGSLQSSATQKWDTSSTPPTQKVLVQWLELALEDTTWEDWDSLRDTYNLKDNVVFPEKGVDSNRAQRESVEAKLHDESRLIQRCFDDNKDDNKR

SEQ ID NO: 171136 - protein, 195 aa, Glycine max
  Coding DNA Sequence Number=SeqID_54358
MAIWAICKFQLLKEIKECIVLGHKVSHVAIEVNLAKVKVIARLPPLNRVRDEATFEFYNEFLRAVNFLKERLLMCDASDSVVGAVLGKRKNKASPVSQSADDGIIKENFPDISLLIVANISRAPWYADIVNYLACKGGFYWPTIYVDAHAFVAAYDRCQLIGALSRKMEMPQNNIPVIELLNWVEAVELPNNSSC

SEQ ID NO: 171137 - protein, 43 aa, Glycine max
  Coding DNA Sequence Number=SeqID_54359
MKLGMIRVRKWPPVVETRDSASTVALPEPGELGVSEPIELILP

SEQ ID NO: 171138 - protein, 161 aa, Glycine max
  Coding DNA Sequence Number=SeqID_54360
MASRKRARTEVILSSSNPFPSTAAMEPDAQQAHSLIPMLQSLFRGQLMIVYNQQELAHNRPIISMEQFLEKVAWLEAQLPLERSHKVVPPGTVPARTKPTSAEPQPPVVDPPTSPELETLSPPAPPLIIIPDDSADEAAAPPDSPSCNIDDGSDFSNWMDC

SEQ ID NO: 171139 - protein, 45 aa, Glycine max
  Coding DNA Sequence Number=SeqID_54361
MRYQAHDCNSMAQPPITRSTFDDVCHSSLYRPWCAQDAKEPCIVW

SEQ ID NO: 171140 - protein, 88 aa, Glycine max
  Coding DNA Sequence Number=SeqID_54362
MALPKEIAIVIYHHAHIADDSVQGSVYTCANPIFLYNPQLNYAELYTVTDLIPQPQPPSPQPLCPQLQLPHPQQLTYNNLDLNDPVFI

SEQ ID NO: 171141 - protein, 105 aa, Glycine max
  Coding DNA Sequence Number=SeqID_54363
  Gene Ontology: Mol. function=electron transporter, transferring electrons within cytochrome b6/f complex of photosystem II activity; Cellular component=integral to membrane; Biological process=electron transport
  Homolog annotation: Hit_ID=P56773; Match level="QueryCoverage=61%, HitCoverage=40%, E-value=9e-23, Identity=92%"; Hit description =Cytochrome b6
  Pfam annotation: Domain name=Cytochrom_B_N; Domain location=1-96; Score=-73.3; E_value=0.043; Accession=PF00033.9; Description =Cytochrome b(N-terminal)b6petB
MVGKCDGLNDDPTLLAVLTASFGVTGYSLPWDQIGYWAVKIVTGVPDAIPVIGSSLVELLRGSSSNEPSSSLAYSTQAELKSSKVWLGSAHFHPYMQGRARCKAN

SEQ ID NO: 171142 - protein, 76 aa, Glycine max
  Coding DNA Sequence Number=SeqID_54364
MNPGIGPLFYSNPWVLRMQCKNAEKIAASEARLTGALSKGGKMRGVATNEGISTSHVDKSRAIAPMYPPSKRKSDL

SEQ ID NO: 171143 - protein, 101 aa, Glycine max
  Coding DNA Sequence Number=SeqID_54365
MLQPYEINIGLKEYSNPLTPKANTPKSSSGSLPPSSGINEALSLIRILVVDLKRENKAMFTLASLGSADFHPLAMPIYWLSEPSAERNTPRLSARKNLEEG

SEQ ID NO: 171144 - protein, 65 aa, Glycine max
  Coding DNA Sequence Number=SeqID_54366
MIQYRFQRQAKVARGGHRWSVVVEVGGVGGGFRGREGERNGSFMLLDVFVVCNTCPGEISLTWAS

SEQ ID NO: 171145 - protein, 123 aa, Glycine max
  Coding DNA Sequence Number=SeqID_54367
  Gene Ontology: Mol. function=DNA binding; Cellular component =mitochondrion
  Homolog annotation: Hit_ID=Q9MQV2; Match level="QueryCoverage=88%, HitCoverage=18%, E-value=7e-27, Identity=50%"; Hit description=DNA -binding protein
  Pfam annotation: Domain name=PPR; Domain location=46-80; Score=20.0; E_value=0.0088; Accession=PF01535.11; Description=PPR repeat
MISEWLETTKQFEFYASRLNLIAKVQGVDVAEKYTKNVPDYFRGELLYRTLLANCVRSGNMEKTEEVFGKMISLGLPTTIYTLNQMIILYKKCDRRKIPGILSFIKKDSLTPSHLKDSDSHQR

SEQ ID NO: 171146 - protein, 334 aa, Glycine max
  Coding DNA Sequence Number=SeqID_54368
  Subcellular localization annotation: CTP_CleavageSite=62; ConfidenceScore=5.10e-01
MNDIQVWNNAAFDDRGGNGNGNGNGNEDNSFFPMKTSRSSSECTKENLSPPAPNNSSKKNITATNKNPKGYGFGSDDNNNNNRNIDDEIEEIERKIHRLTTRLDALRLEKAKRGKRVVMGRVVPAKFMEPRPNAVISRKPEETPKTKVRVNNDNAWRRGMSLGPNEIAAATPATALQSRRKSCYWKIPEISEESRAKTTVGRVKKKEENLVVQVQGKKLFEKEKAKSVCESSKKGRVVASRYNSDVRKRSLPEGGSEIRVKKTWEIPKNGREEATAGAVVLPKIKTTKCVNESPRDSGAAKRVAELVGKRPYFSTDEKDVCQILNFAEEEEESQ

SEQ ID NO: 171147 - protein, 137 aa, Glycine max
  Coding DNA Sequence Number=SeqID_54369
MWDTLASTYEGSSQVKCNKLILLTSHWNLKVHEQELQQDEGFKKGKSSTLTTQKATISSTCKESSSRSASKSSSKAVNIDTPHDDESNDEGSDKDDQLAFISRKIRNMWKKRSGSNWKGSKKPHRERKDREKRSFIC

SEQ ID NO: 171148 - protein, 157 aa, Glycine max
  Coding DNA Sequence Number=SeqID_54370
MKSLKATKKDCKDMLMIFSACSSCLSEIFDLINDDDLKSSDEEDLDRFKATKQGILDEDDFKSSSLTRSKISERQLLQAKKDFKGILNVAVHVVALQPNEQYVEYFSIVNEIIHWMKQFSIALPSSAARRTIHLQRLLLLHHQRCWMVNKAHRSNQI

SEQ ID NO: 171149 - protein, 45 aa, Glycine max
  Coding DNA Sequence Number=SeqID_54371
MGACHIAPILLQFMSKHAPTKCSVKCPNDGQHRRFKIGAQMQFQA

SEQ ID NO: 171150 - protein, 159 aa, Glycine max
  Coding DNA Sequence Number=SeqID_54372
  Subcellular localization annotation: CTP_CleavageSite=49; ConfidenceScore=5.36e-01
YMLAQLKPPSYSASSSDLASSTTDADNASSLPTKAAKQKSLLSLSSDIKLATDSPTDSGTETATGTETSAAYLTFSADSPTLAYSNSSLSGSPTDSETYSVDAATADSDSSSSASSGERETRRAYLWHRAFFLSSGWNFRAFEIIAVALSFFHREGTYP

SEQ ID NO: 171151 - protein, 151 aa, Glycine max
  Coding DNA Sequence Number=SeqID_54373
  Subcellular localization annotation: CTP_CleavageSite=38; ConfidenceScore=5.05e-01
MHHIPLSQPTFRREGNVRLTGASSKKGKCTESPPTFIRGKRRKNRKGFRKSMLTNKGKDDRLRRWTLKRLLGDFYGQRLIWEKREVVAAQLAQASWVASTRRHRLLLEHPRRPKTLRIVRQCSLLTSGMPLNFTDYLTMGVKYLEAVKQRL

SEQ ID NO: 171152 - protein, 70 aa, Glycine max
  Coding DNA Sequence Number=SeqID_54374
MRGVLIPSSWVKTIPEPFTLKVHRPPLFRFFRCLPQIKVGGDSARFLPMEDAPVSPRVALPPKGRLRPLG

SEQ ID NO: 171153 - protein, 98 aa, Glycine max
  Coding DNA Sequence Number=SeqID_54375
MGLRLQSSLCALNHVQLLITLSLFAQSVGCPKRLIKTEPDQLSNRLRQWSNARMGLKAETNQGKTIVATCPALDKQEAQLRDNLVSFKLPVIIVKVSL

SEQ ID NO: 171154 - protein, 68 aa, Glycine max
  Coding DNA Sequence Number=SeqID_54376
MIFVSQAPIQANKVLSDPPEEENTSLVRKVRQARCDQDSKGLTNRLCVLCFHFEMLPDAERTTGRRRN

SEQ ID NO: 171155 - protein, 217 aa, Glycine max
  Coding DNA Sequence Number=SeqID_54377
  Gene Ontology: Mol. function=phosphoribosylaminoimidazolecarboxamide formyltransferase activity; Cellular component=cytoplasm; Biological process=purine nucleotide biosynthetic process
  Homolog annotation: Hit_ID=Q84XA4; Match level="QueryCoverage=99%, HitCoverage=31%, E-value=8e-99, Identity=86%"; Hit description =Aminoimidazolecarboximide ribonucleotide transformylase/inosine monophosphate cyclohydrolase
  Pfam annotation: Domain name=AICARFT_IMPCHas; Domain location=1-141; Score=10.5; E_value=2.6e-14; Accession=PF01808.9; Description =AICARFTIMPCHase bienzyme
ALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCVKHVKSNAIVIAKNNCMLGMGSGQPNRVESLRIAMRKAGDDVKGAALVSDAFFPFVVERGREFQGKDGALWPGIYLNLLTAWKDAVEEACESGIGVIAEPGGSIRDQDAIDCCN

SEQ ID NO: 171156 - protein, 278 aa, Glycine max
  Coding DNA Sequence Number=SeqID_54378
  Gene Ontology: Mol. function=phosphoribosylaminoimidazolecarboxamide formyltransferase activity; Cellular component=cytoplasm; Biological process=purine nucleotide biosynthetic process
  Homolog annotation: Hit_ID=Q84XA4; Match level="QueryCoverage=97%, HitCoverage=43%, E-value=1e-136, Identity=87%"; Hit description =Aminoimidazolecarboximide ribonucleotide transformylase/inosine monophosphate cyclohydrolase
  Pfam annotation: Domain name=AICARFT_IMPCHas; Domain location=77-278; Score=202.0; E_value=1.4e-57; Accession=PF01808.9; Description =AICARFTIMPCHase bienzyme
  Pfam annotation: Domain name=MGS; Domain location=1-72; Score=30.6; E_ value=5.3e-06; Accession=PF02142.12; Description=MGS-like domain
  Pfam module annotation: Pfam domain module=AICARFT_IMPCHas::MGS; Domain location=77-278::1-72
MFWPFSQLDGRVKTLHPNIHGGILARRDQKHHIDALSAHGIVNLYPFYDKVTSAGGVEFEDGIENIDIGGPAMIRAAAKNHKDVLVVVDTEDYPALLEFLKRNQDDQKFRLKLAWKAFQHVASYDSAVSEWLWKQSVGDLLVSILVTDKFPPSLTVPLSLKSSLRYGENPHQKAAFYIDKSISEVNAGGIATAIQHHGKEMSYNNYLDADAAWNCVCEFRNPTCVVVKHTNPCGVASRDDILEAYRLAVKADPVSAFGGIVAFNVEIDEIQALSLLTF

SEQ ID NO: 171157 - protein, 105 aa, Glycine max
  Coding DNA Sequence Number=SeqID_54379
MCKKEHESSKEYAQWWRDLAAQVVPPMMEREMITMIVDTLPVFYYEKMVGYMPLSFANLVFACKRIKVGLRRGKFDYPALMNRKPGENGENKKEGETHVVTAVPT

SEQ ID NO: 171158 - protein, 59 aa, Glycine max
  Coding DNA Sequence Number=SeqID_54380
MANLKDMSHQMHLVVAQGGIWKGEIGHKRRNGWGMAMGGGERHITSGKWLWVLMIILGS

SEQ ID NO: 171159 - protein, 90 aa, Glycine max
  Coding DNA Sequence Number=SeqID_54381
MASLLVLTLPIFPELFMLEIDASITLVGVVLSQKGHPRAFFSKKCHLQAFSIYIREIRDSLICFPFLTSTRFDLYLISVLCHLKNREGNT

SEQ ID NO: 171160 - protein, 160 aa, Glycine max
  Coding DNA Sequence Number=SeqID_54382
  Subcellular localization annotation: CTP_CleavageSite=33; ConfidenceScore=5.29e-01
MQMSISSKRVSILSKRSSKCARRLRNSVRMAFRSTKESCHGGEGICSSIGCGWASFFTQEPSNSLRPFGRHQDLKNQISSHQQWCPQKNSKSRYLGSKIKREEKWEEHHIHYSYDENNIEDDKEEEIGVGGALVAPGRGVPVPTVEVDEPLRFLDDYAIW

SEQ ID NO: 171161 - protein, 85 aa, Glycine max
  Coding DNA Sequence Number=SeqID_54383
  Subcellular localization annotation: CTP_CleavageSite=30; ConfidenceScore=5.12e-01
MAVGSTALEDGDGSSPTAANDAQMCVVFVSCPLPRSFSLRFKLQPTTWPRHTGFRQADDLMDPITEWNWLVHSITIEPIQSIGSI

SEQ ID NO: 171162 - protein, 161 aa, Glycine max
  Coding DNA Sequence Number=SeqID_54384
  Gene Ontology: Mol. function=phosphoinositide phospholipase C activity; Biological process=intracellular signaling cascade
  Homolog annotation: Hit_ID=Q1S1N3; Match level="QueryCoverage=69%, HitCoverage=34%, E-value=1e-19, Identity=47%"; Hit description =Calcineurin-like phosphoesterase family protein, related
  Pfam annotation: Domain name=DUF1723; Domain location=58-108; Score =42.0; E_value=2.1e-09; Accession=PF08330.1; Description=Protein of unknown function (DUF1723)
MEHADAHFLWKLHLHTSRQPTNVVIQSYAQSMHVSDPIIQSLLVQVGFSDVAKLGHFKISNVLVTTLVERWRPESHNKFHLAIGECTITLEDVVLQLGLQVDRKAVIDQTYFEWEKMCAKYLGVIPPKVALVGSTLKLKCLKENIFPLPKESTKTTFSNPL

SEQ ID NO: 171163 - protein, 177 aa, Glycine max
  Coding DNA Sequence Number=SeqID_54385
MADDKFCGGRESHVAKTRRKNHESVYTVRGLLKCKKIYVEHLIGIPILDEELPKGRRNFFVQMKDVEVVVIDDVAGDKDDAQVVGKDSKEEVVELEGAGEDMKMKNVAKPPTQPKKSKKDATFKSRPEESSTSAQRVPIAHVVVVVPTPSVESVAQVPPQSNQSATSVPSRINRSRV

SEQ ID NO: 171164 - protein, 116 aa, Glycine max
  Coding DNA Sequence Number=SeqID_54386
  Gene Ontology: Mol. function=protoporphyrinogen oxidase activity; Cellular component=mitochondrial inner membrane; Biological process =porphyrin biosynthetic process
  Homolog annotation: Hit_ID=Q9SLW5; Match level="QueryCoverage=98%, HitCoverage=22%, E-value=1e-50, Identity=88%"; Hit description =Protoporphyrinogen IX oxidase
FGSIIAGALQSKLFAKREKTGENRTALRKNKHKRGSFSFQGGMQTLTDTLCKELGKDDLKLNEKVLTLAYGHDGSSSSQNWSITSASNQSTQDVDAVIMTMYLLQILHEYVNMTKK

SEQ ID NO: 171165 - protein, 48 aa, Glycine max
  Coding DNA Sequence Number=SeqID_54387
MAYAPFNLRPNSNINGKITRDKNWALRRTVSRAGIGGHKNKNKVAVIT

SEQ ID NO: 171166 - protein, 146 aa, Glycine max
  Coding DNA Sequence Number=SeqID_54388
  Gene Ontology: Mol. function=catechol oxidase activity; Cellular component=chloroplast; Biological process=metabolic process
  Homolog annotation: Hit_ID=Q7Y249; Match level="QueryCoverage=61%, HitCoverage=15%, E-value=3e-19, Identity=54%"; Hit description =Polyphenol oxidase
MGIWNIWKTVPEGIRGDFTDEDWPKKEVEKEKEEVLVVEVEYDMTEDVKFDVFINDQGDDEIGPEDSEFAGSFMILAHSHGHQSKRTTNSFRMAIMDLLKDLRAQDDQSIVVTLAPRYGNKPVTIKVIKIKLVPLVEYVWCETFNF

SEQ ID NO: 171167 - protein, 68 aa, Glycine max
  Coding DNA Sequence Number=SeqID_54389
MQAIPAPCPQVAKDEFLPQHIDLSLAIPAPCPQVAEDEFLPQHIDLREITSIDTDLNVLKKRIETLHL

SEQ ID NO: 171168 - protein, 83 aa, Glycine max
  Coding DNA Sequence Number=SeqID_54390
MKLKNNVQVEQHLGESDSRSNINLVRESLSDPTLNAFDIDNLVLNDNVKYHFSTKEELLDDGNKDDGGGGDIEDDLIRGLMNI

SEQ ID NO: 171169 - protein, 74 aa, Glycine max
  Coding DNA Sequence Number=SeqID_54391
  Homolog annotation: Hit_ID=Q9FLB0; Match level="QueryCoverage=48%, HitCoverage=6%, E-value=2e-09, Identity=80%"; Hit description=DEAD -box ATP-dependent RNA helicase 18
MTKARVLPKPVAALTLTSLKLQSRGMVATLTGVQNLKPECAGEEEEAKEKDGAEEEEAKEKEIGDGNRRGCGGM

SEQ ID NO: 171170 - protein, 121 aa, Glycine max
  Coding DNA Sequence Number=SeqID_54392
  Gene Ontology: Mol. function=hydrolase activity; Cellular component =integral to membrane
  Homolog annotation: Hit_ID=Q75IA4; Match level="QueryCoverage=77%, HitCoverage=34%, E-value=2e-32, Identity=67%"; Hit description =Expressed protein
  Pfam annotation: Domain name=SNARE_assoc; Domain location=6-84; Score= -19.9; E_value=0.0096; Accession=PF09335.1; Description=SNARE associated Golgi protein
MGMDNLESYTSDYTAQVLVGYCVVAKRRKGLLNYMLFLRLTPTLPNTFINFASPIVDVPYHIFFLATVIGLIPAAYVTVKAGLALGELQSVGDLYDFNSIATLFLIGVVSVTPTLMSKNES

SEQ ID NO: 171171 - protein, 126 aa, Glycine max
  Coding DNA Sequence Number=SeqID_54393
  Gene Ontology: Mol. function=sequence-specific DNA binding
  Homolog annotation: Hit_ID=Q1XLN4; Match level="QueryCoverage=94%, HitCoverage=96%, E-value=6e-14, Identity=35%"; Hit description=Helix- turn-helix motif
  Pfam annotation: Domain name=HTH_3; Domain location=6-60; Score=36.0; E_value=1.3e-07; Accession=PF01381.12; Description=Helix-turn-helix
MQKEKLRSIRKKKGYTQQQIADIIATDVSNYSRKESGDVKIVRAEWEKIANFLDVTMEDIYEEDDAQIVVNNDHPVFNDSSASGVYQYNNNTIPLSIVENLQEYISLLKAENQKLQAEIKTLKARK

SEQ ID NO: 171172 - protein, 77 aa, Glycine max
  Coding DNA Sequence Number=SeqID_54394
MTETVCTDNRLGISVRHLTSWVMITKGGVVDKSGAFALTYIIVAICSFMASMLAFIYSCTSSTPSITLPLAWVRTWG

SEQ ID NO: 171173 - protein, 192 aa, Glycine max
  Coding DNA Sequence Number=SeqID_54395
  Gene Ontology: Cellular component=mitochondrion
MVRVTNRTDMRQLRGITSQGATHAKDGGKRPVLLPETNNKQNIMKRIGLSAVPEVLSKIEQNYDVFTITDKFRNLSLKDSSASSSNHSFLSTLTPTASLLERFKIRTNPSAFTRNVIEMTKAPFFDIKNPIINLTEKANNYMMSIGFRFMPGQGEFLIKDLRAPDTLVGLRKLKDSLGLSLTKGSLNSQSIT

SEQ ID NO: 171174 - protein, 155 aa, Glycine max
  Coding DNA Sequence Number=SeqID_54396
  Subcellular localization annotation: CTP_CleavageSite=52; ConfidenceScore=5.37e-01
MTTLVSACQWARLPLADESRKTLTSPGRVQMTTLVSACQRARLPLADGSLVRKMLTSPGRVQMTTLVSECQWARLPLDVESRKTLISLGRVQMTTLASASADNHKVSPHATGLTGHDSRMGWLTKASLPKDVDLSRKGANDHIGLCLSIGLGVFE

SEQ ID NO: 171175 - protein, 110 aa, Glycine max
  Coding DNA Sequence Number=SeqID_54397
MNVILVNFAFFAFLFPLLWEIEVAVTASIIIILAYRFFAARTGYAEGEQQENQEGTETPPTWRMRWGRRLDPAPSRSEGDSCRERVQWEGFFALRRVALFSRRWWHLDES

SEQ ID NO: 171176 - protein, 141 aa, Glycine max
  Coding DNA Sequence Number=SeqID_54398
MSVYASGVSVLMPGDEIPTFIAHPAPCYPERISWPSHQHNNTLPCSSSNTLPTTTINQVVNLRLHHDAFVDVVEGVRGSTEFGGEPLVVVAAAVAVAVGGVSFCWRLALPLWWVSQRDMVAGEECREVAGGGEDEDVVGIK

SEQ ID NO: 171177 - protein, 162 aa, Glycine max
  Coding DNA Sequence Number=SeqID_54399
  Gene Ontology: Mol. function=RNA-directed DNA polymerase activity; Cellular component=chromatin; Biological process=chromatin assembly or disassembly
MVMPFDLCNAPSTFQATMNELLRPFLLRFIVVFFDDILVYSPIFEDHLGHLRTVFDYPSKIEAMVNWPTPMTTQSLRGFLGLTDFYRKFIRDYAAFAALLTSLLQKDNFHWGEDSQLAFDSLKRAMTQAPVLALPDFSRPFTLETDASGTAMGIVLMQGGHP

SEQ ID NO: 171178 - protein, 401 aa, Glycine max
  Coding DNA Sequence Number=SeqID_54400
  Subcellular localization annotation: CTP_CleavageSite=23; ConfidenceScore=5.33e-01
MLFSRHLARSSISNGSPAEDPTSKTMKQNQVRQGVRRWSTSEENRLLLNRIRLEDSISFTCFSISVFWGLEQMGVLVKEGGDSWVWVGDGCRLRLGRMVGDRNVKEGRGRMSFHQASELDRGDVRGDCQGVNTEENGVAIDVELHGEGGIVCDDEAELLKPLNVENDVGVVDRKNMKEWSGKKGVVGTCDSGLDKIVGTPAVDENRDAGMVHNTEQAEGLGGGSSREGIVAYLGRGGVRGRCGVVRIGVILIDDDQKEECLAFVGRLAGGGLVVAEVGGLWMDGGVLVRFGVGRMGELGACTSRCNFGKRPEMKQLSKQEGERPMMRFAKRSNSACRRDVHDVMKPLRVMEVGGVEVREVAGVGVAGAATALGWSPGVGKSRGGSGLSGEPLLTNDLWFWS

SEQ ID NO: 171179 - protein, 130 aa, Glycine max
  Coding DNA Sequence Number=SeqID_54401
  Subcellular localization annotation: CTP_CleavageSite=93; ConfidenceScore=5.12e-01
MEASGSDTAATTTSDHSDKENVPPPPPPPPPPPCSSNTNETKTSSKTQIPLIVPTSFKKKKRSKRKPKRVPLADITSLFDNSATTTTTTVTPSQESQQQQQQQQQQQQSGASALPRRSPRSSKTLRMGFR

SEQ ID NO: 171180 - protein, 171 aa, Glycine max
  Coding DNA Sequence Number=SeqID_54402
  Gene Ontology: Mol. function=oxidoreductase activity; Cellular component=intracellular; Biological process=lignin catabolic process
  Homolog annotation: Hit_ID=P93366; Match level="QueryCoverage=99%, HitCoverage=30%, E-value=3e-84, Identity=81%"; Hit description =Diphenol oxidase
  Pfam annotation: Domain name=Cu-oxidase_2; Domain location=21-155; Score=197.7; E_value=2.7e-56; Accession=PF07731.4; Description =Multicopper oxidase
  Subcellular localization annotation: CTP_CleavageSite=41; ConfidenceScore=5.21e-01
MPKISLRQAHFFKIKGVFTDDFPGNPPVVYNFTGTQPSNLKTMKGTRVYRLAYNSTVQLVLQDTGMITPENHPIHLHGFNFFVVGRGQGNFNPTKDPKKFNLVDPVERNTVGVPAGGWTAIRFRADNPGVWFMHCHLEIHTTWGLKMAFVVDNGKGPNESLLPPPTDLPKC

SEQ ID NO: 171181 - protein, 93 aa, Glycine max
  Coding DNA Sequence Number=SeqID_54403
  Gene Ontology: Mol. function=helicase activity
  Homolog annotation: Hit_ID=Q1SRJ5; Match level="QueryCoverage=97%, HitCoverage=11%, E-value=3e-19, Identity=48%"; Hit description =Probable helicase [imported]-Arabidopsis thaliana-related
MPRKRGYFIGRLFHVPLSSGELFYLSLLLNTIEGPESYSQVRIVDGVEYPSVRDSCYKLGLLNDEKEFIDAIKEASLWDTGHCLRALFVNVVV

SEQ ID NO: 171182 - protein, 243 aa, Glycine max
  Coding DNA Sequence Number=SeqID_54404
  Subcellular localization annotation: CTP_CleavageSite=36; ConfidenceScore=5.23e-01
MGCCVSSSHKTSTSSLAKFHDPPKPLTKPSESNSTVEETVKEVLLETPTTFAKSKPQKPHQNTNFHKFMEEKSKVEKRALTLSIYKAEDTTTSEEVCSLSRTVSRATSITDQREEMRKRVYRSHPKLQKNRSFPGERRERTVVHGARNNNNVGSVRLVQCRDQTSQKIGNGGTGRRRDAAENSLRRSRSQATVAGAGAARPVMGRSPYVRKPNRSTASIGIGTAENGGRKTEKPATTEKWPYA

SEQ ID NO: 171183 - protein, 147 aa, Glycine max
  Coding DNA Sequence Number=SeqID_54405
PPVGSRAPRHYYHGYYRPEPKEGKERTKARSSLAIHSEWGWGIRNEWRSCGTCKTTYWITLVQHKAADVEPAPMPLVMPCLVLRHGGGLIARHEHRAKSPGVPVKGANAYPRGGWHYWQRSFGQCRGSTTSVGKGARMVEEPGGRVI

SEQ ID NO: 171184 - protein, 122 aa, Glycine max
  Coding DNA Sequence Number=SeqID_54406
  Subcellular localization annotation: CTP_CleavageSite=75; ConfidenceScore=5.19e-01
TYQGNPCGVYPDLSSFTGSGVYPDLSSFTGSGVYPDLSSFTGSGVYPDLSSFTGSGVIQKLYSLYQAIRPVRFTSLMSVDKYQSGLLTTNVRYCFFLFHPPIIFARCLLGNIRSSSSGESSF

SEQ ID NO: 171185 - protein, 95 aa, Glycine max
  Coding DNA Sequence Number=SeqID_54407
MAGYISLLQIYEHFPSVHRCVVDDGYAEASPRACRWLTGKAQMMGIKGAPYRARIDALTVTDFGYIQIVPPPPVRDSLTGELCVVPGQVVPDNME

SEQ ID NO: 171186 - protein, 93 aa, Glycine max
  Coding DNA Sequence Number=SeqID_54408
MTKRLLRRLKARGTRKQGAVVVVGEILIDFSIEKRKRVETRNFLNFVLEEEEKSINNNHDARGNSQSPERKVLSFSSIAMATMLLISHPSKDQ

SEQ ID NO: 171187 - protein, 570 aa, Glycine max
  Coding DNA Sequence Number=SeqID_54409
  Gene Ontology: Mol. function=protein-tyrosine kinase activity; Cellular component=integral to membrane; Biological process=protein amino acid phosphorylation
  Homolog annotation: Hit_ID=Q6R2K3; Match level="QueryCoverage=87%, HitCoverage=75%, E-value=1e-105, Identity=40%"; Hit description =Strubbelig receptor family 3
  Pfam annotation: Domain name=LRRNT_2; Domain location=30-70; Score =20.2; E_value=0.0067; Accession=PF08263.3; Description=Leucine rich repeat N-terminal domain
  Pfam annotation: Domain name=LRR_1; Domain location=120-142; Score =10.3; E_value=3.4; Accession=PF00560.23; Description=Leucine Rich Repeat
  Pfam annotation: Domain name=LRR_1; Domain location=144-166; Score =15.6; E_value=0.19; Accession=PF00560.23; Description=Leucine Rich Repeat
  Pfam annotation: Domain name=LRR_1; Domain location=168-189; Score =12.5; E_value=1.3; Accession=PF00560.23; Description=Leucine Rich Repeat
  Pfam annotation: Domain name=LRR_1; Domain location=190-212; Score =8.1; E_value=8.6; Accession=PF00560.23; Description=Leucine Rich Repeat
  Pfam annotation: Domain name=LRR_1; Domain location=73-92; Score=3.6; E_value=61; Accession=PF00560.23; Description=Leucine Rich Repeat
  Pfam annotation: Domain name=LRR_1; Domain location=96-118; Score =11.0; E_value=2.5; Accession=PF00560.23; Description=Leucine Rich Repeat
  Pfam annotation: Domain name=Pkinase_Tyr; Domain location=399-563; Score=-133.6; E_value=0.00028; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase_Tyr; Domain location=30-70::120 -142::144-166::168-189::190-212::73-92::96-118::399-563
MGWSNSELNSQILILSMLIFTASFCVGDTDPLDVAAINSLYVALGSPLLEGWKATGGDPCLEQWEGVSCVFSNITALRLGGMDLSGKLGTNLDFPSIIEMSLSSNQLNGSIPDALSLLTQLSDLSLKDNHLNGQIPNAFLELTGLMNLDLSGNNLSGKLPPSMGNLSSLITLNLQNNQLSGTLFVLQDLPLQDLNIENNIFSGPIPPELLSIPNFRKDGNPFNTTIIPSPPAAFPAPAAMAPSPEKSPWKMAHNPSDTIKAPIPAIAGRSFKTTKLVWIVGAGFLIFIALGVCLLMLWCFKRRQENKKYKKHNTNMYTRSLHKRTCSNSPFEATNDEEKEWSSKLPPLQPAPPHHIPIIPGENLIINPAISTQAAERQIVTNSIKVYTVASLQQYTNSFSQENYIGEGMLGPVYRAELPDGKLLAVRKMNTTASMGQNHEQFLQLVFSISKIQHANIVKLMGYCAEYSQRLLVHEYCNNGTLHEALHTDDKLQIKLSWDDRIQVSLGAARALELRPINLVSRARFRSKRWMVVTRHIMENRIDTMEERLGNVEATVVEIRQLLREQNERP

SEQ ID NO: 171188 - protein, 261 aa, Glycine max
  Coding DNA Sequence Number=SeqID_54410
  Gene Ontology: Mol. function=oxidoreductase activity; Cellular component=intracellular; Biological process=lignin catabolic process
  Homolog annotation: Hit_ID=P93366; Match level="QueryCoverage=90%, HitCoverage=42%, E-value=1e-121, Identity=85%"; Hit description =Diphenol oxidase
  Pfam annotation: Domain name=Cu-oxidase; Domain location=151-261; Score=107.0; E_value=5.4e-29; Accession=PF00394.12; Description =Multicopper oxidase
  Pfam annotation: Domain name=Cu-oxidase_3; Domain location=25-140; Score=220.9; E_value=2.8e-63; Accession=PF07732.5; Description =Multicopper oxidase
  Pfam module annotation: Pfam domain module=Cu-oxidase::Cu-oxidase_3; Domain location=151-261::25-140
MAAFGIQIMLLLAAFLLPLSVEAMVVQKNTTRLGSTKPIVTINGKFPGPTIYAREDDTVLVKVVNQVKYNVSIHWHGVRQLRTGWADGPAYITQCPILPSQAYVYNFTLTGQRGTLWWHAHILWLRATVHGALVILPKLGVPYPFPKPNMEQVIILSEWWKSDTEAVINEALKSGLAPNASDAHTINGHPGPIQGYASQGGYKLDVQPGKTYLLRIINAALNEELFFKIAGHELTVVEVDAVYTKPLKTDTIVIAPGQTTN

SEQ ID NO: 171189 - protein, 70 aa, Glycine max
  Coding DNA Sequence Number=SeqID_54411
MVIILPKENVVICVLKELDDTPQSKSKVAARWIIVKYFNDARPLKPERLKALRIRWATYYLKVKNETISI

SEQ ID NO: 171190 - protein, 81 aa, Glycine max
  Coding DNA Sequence Number=SeqID_54412
  Subcellular localization annotation: CTP_CleavageSite=68; ConfidenceScore=5.03e-01
MEASDIATITIDHSNKENVPPACNTNKVKNKNHNKPKPNRVPLTDITNLFNNSATATFTLAHQQQNIVSALPGTTLRMGFR

SEQ ID NO: 171191 - protein, 81 aa, Glycine max
  Coding DNA Sequence Number=SeqID_54413
MTQRITQRLEELHVNSCQCRCQGAIEERKEGQEARSRLERRSQVKRRGAQMRACKERRKGNVMGQLLVLMLRIWVKQTKPE

SEQ ID NO: 171192 - protein, 52 aa, Glycine max
  Coding DNA Sequence Number=SeqID_54414
MPSRHVLPESRVPPSVDLVDLVLKDEGEALEEDTSFEKDPSMDEEDLVKESF

SEQ ID NO: 171193 - protein, 187 aa, Glycine max
  Coding DNA Sequence Number=SeqID_54415
  Homolog annotation: Hit_ID=Q2HS45; Match level="QueryCoverage=27%, HitCoverage=7%, E-value=6e-08, Identity=53%"; Hit description=RNA -directed DNA polymerase
MDKEGRAGGLAVLWRKSIPCSIMSFSQNFINMLGEPSLAKVVNQSWENMEESDLIDKLKGCADDLEIWGRDLKRGLGMKSTSVRENRWTFIRAKMQNCNPFNPRRELLEVYSGSRMETLIRSSSIHGFRLVERFFRLVLSGRKMLVISKCISKEQSAFVEGRSIIDSVLIAIEIIHHLKCKHNEKMR

SEQ ID NO: 171194 - protein, 148 aa, Glycine max
  Coding DNA Sequence Number=SeqID_54416
  Gene Ontology: Mol. function=RNA-directed DNA polymerase activity; Cellular component=chromatin; Biological process=chromatin assembly or disassembly
MAVLQRQTGYETTKKERERKTEDSIHQPLKFGQGFFGIIIECGYGIRLQSLQEFGPGSDESITEHPLVPTQCRAIQVEGRERNTFFLRPLGCCHQARNVQLDRRALDGVRAGNGSRVSVGRMIEVVENGVDFAGEFRVVETQAGNDLL

SEQ ID NO: 171195 - protein, 282 aa, Glycine max
  Coding DNA Sequence Number=SeqID_54417
  Gene Ontology: Mol. function=RNA-directed DNA polymerase activity; Cellular component=chromatin; Biological process=RNA-dependent DNA replication
MNVCPYWYLYFQKSKIEKQVSELLSLRMIQVSQSPFWSPVLLVKKKDGNWRMCVDYHALNAITVCDRFLMPTIDELLDDLGQPSWFSKLDLRQGFHQIVTAKEDIEKIAFRMHQGHYKYRVMPFVLCNTPSMFQAMMNVLLQPFLRRFVVVFIDDILGYDIAIPLTSLLCKNDFNWTSDSQLAFEKLKQAMKQALVLSLPNFELPFVVETDASGTTMGVVLMQQGHPLAFFSKPFGPRLLCSSTYVRELHAIVTAVKKWRQYLLGHTFMILTDHKSLKDLIS

SEQ ID NO: 171196 - protein, 218 aa, Glycine max
  Coding DNA Sequence Number=SeqID_54418
  Homolog annotation: Hit_ID=Q47522; Match level="QueryCoverage=23%, HitCoverage=64%, E-value=9e-24, Identity=100%"; Hit description=LacZ protein
MEHRRCALSKRYDEYGDLPVTTGASSTARNECWRGTARFEGDLESLRFEATKVEGERGYEFNSKSQHIPGTIVDYAASKKNSQVHQMSLSACPDTIKCELCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 171197 - protein, 193 aa, Glycine max
  Coding DNA Sequence Number=SeqID_54419
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=72%, HitCoverage=16%, E-value=7e-39, Identity=57%"; Hit description =Receptor protein kinase-like
  Pfam annotation: Domain name=Pkinase_Tyr; Domain location=11-193; Score=-140.2; E_value=0.00072; Accession=PF07714.7; Description =Protein tyrosine kinase
MTSLSATTKPTEVQSPSVTKAVLPTRITILVKKIEWEERSSKVASEFIIRLGNARHKNLVRLLGFCHNPHLVYLLYDYLPNGNLAEKMEMKWDWAAKFRTVVGIARGLCFLHHECYPAIPHGDKRASNIVFDENMEPHLAEFGFKQVLRWSKGSSPTTNKWEIGTKNSKAFALNNNTQLVNDLTEKGEFECPN

SEQ ID NO: 171198 - protein, 121 aa, Glycine max
  Coding DNA Sequence Number=SeqID_54420
MELNLDKRVSIAGMVLGGFEAGPGLVVDSTQRWNMAEVEWVCIEGLSLGRCECSRGWTRCQPKHEMRWWVQTVTREWFMYPKSLKVPGVGRPKRALRLIWGVGEGGSMVGKVFGLKGGGGP

SEQ ID NO: 171199 - protein, 168 aa, Glycine max
  Coding DNA Sequence Number=SeqID_54421
  Homolog annotation: Hit_ID=Q9FJD4; Match level="QueryCoverage=34%, HitCoverage=8%, E-value=1e-08, Identity=49%"; Hit description =Importin beta
MTFYAGFKITDIVVPNIMGVVGDVCRGFEEKSGAELAADISAADDSMTEYTNCLTNGILEAYSGIFEGFKAGNLYNPMEERRTLEESHKWLWKEEKKRRLNVDRERERGREGIVATDNELVEIIIKKGEGYLRRQSECSKKERGMDCNGGAAEDGGDGKQRTKDARLQ

SEQ ID NO: 171200 - protein, 124 aa, Glycine max
  Coding DNA Sequence Number=SeqID_54422
  Gene Ontology: Mol. function=RNA-directed DNA polymerase activity; Cellular component=chromatin; Biological process=chromatin assembly or disassembly
MCYLCLDPVMIWNFVFVGANDRWMAMENLMLKDGVTKCVPLRRKSSRQNELMKGPEMNALREAIHHNQDYGKPAGRTLSGGLRLLAGGAVADELLNITMHIGLIKIGMDAVGSLGNAQMSTNGC

SEQ ID NO: 171201 - protein, 173 aa, Glycine max
  Coding DNA Sequence Number=SeqID_54423
  Gene Ontology: Mol. function=RNA-directed DNA polymerase activity; Biological process=RNA-dependent DNA replication
MTTLVSQVEYMTSLIKLALRSFSTSSLTAWRRSFPIFIFFLDTGLVWGQMASLWHIMLGGFPACQMAATKIGSCSYVDSPGLAWRPFIHAHDLSVVTCCGVRPSRLPSGRIGCHLQAFSVALSCLLLICLDRHDLPRQGRELHFKMRCGDSGSELIERFLTNQSKVRGIYVNN

SEQ ID NO: 171202 - protein, 157 aa, Glycine max
  Coding DNA Sequence Number=SeqID_54424
  Subcellular localization annotation: CTP_CleavageSite=61; ConfidenceScore=5.14e-01
MSKLSMDLGGSLPYQVNVVPLRKTSKCLSGLEVPSYCSRLSGFQPNGMAASMIVLGYDSPLSALRQCVRRVLVALEAFYTSLHPIMLLESINIHHGCWRRIGALEKGFAYEARPRANHGGKERLWDKLYHGPKVGAKCTYQNPELAHVKLDVAKVDS

SEQ ID NO: 171203 - protein, 536 aa, Glycine max
  Coding DNA Sequence Number=SeqID_54425
MPMYAKFMKDILTKKGKYIDNESIVVEGNYNIAIKRILPQKFKDPESVTIPCSIGMISVGKALIDLGSSINLVPLCICRRLGNLKDVLVKVKQFTFSTDFVIMDIKEDTHILIILGQPFMLTTNCVVNMGNDNMEMSVKDQKAMFQLCCCALSVHIAFFLRAKPKYLSVRIFMLIGLSARLLAKRALPVGVERPSVRLVPQSTMASKKCRASTSQARPQEPKPKWDSTRNVQLAYSDYDEFLEKLEQRHWDRKVTRILEKNIDLALEKEFYSNVYDHEDSSPKQCKVRGKVIKFNAQTLNTFLETPVVLQEGERKLAFSQFLYSYPDHQAIKAKLYLPGGRFILNTEKDMTTLAQTWGVLSYSNLVHTSHTSDLSMDRACLIYEDGHGLGAQEGSGESHIGGPSNTTTLYFCIDSSFATATISGAFITHVVEHSPRLVLDHPGIVVDRDNTPPAHFDARGIPSELAATAKEPTTIIVEESPEVAIAEEEPTVATTVDGLTSLSTVILDEPIPTEYPTAAIVEPGLREDYIADISTT

SEQ ID NO: 171204 - protein, 81 aa, Glycine max
  Coding DNA Sequence Number=SeqID_54426
MWKATWNSVTHVSPPCQFWHRSTDVPPLAVRLSINSLTLELTPVIMDSGSLHGGKFDDTLSLRNEEGTYKRDKDSHAQVRV

SEQ ID NO: 171205 - protein, 361 aa, Glycine max
  Coding DNA Sequence Number=SeqID_54427
  Subcellular localization annotation: CTP_CleavageSite=28; ConfidenceScore=5.08e-01
MGDFAWRPLVKQAGLAGGTVPPSVAIPPAREGGQPTIEVSPTVEVVEVSPNVSSFLLVNRKRDDGARVSGQKKSRGCPLSLLGSPSAPLAIEAPALIVAIPTPTPPPPPLVSVQGLLLLLNAPEVSTPSFLAFPVPPSVVLASAFPSTSSHPSMSYKLEQKTPVGFVSTFDKNLISQLGSRMPLIQPRHQQDLNKVASLEAEVSKWRSTACIVWRVDHPKVANATVTFAEAVKEKNELTNRVENNMVELGGLAKVVADLEARLKELESRLEESELRASKERDANKELEDELLMYKKEFVEQHLKRFNKAVVEFFVKDLDLGLFDPFKDVKNSILLDEKDIAVKEEASEEQDAKEQGDDANV

SEQ ID NO: 171206 - protein, 65 aa, Glycine max
  Coding DNA Sequence Number=SeqID_54428
MKKRQVVVKRDYATSSPAVGNIRYGECQKNHAANTGVPVKEQMRRLRVRLAAATGTFTRGKYCTA

SEQ ID NO: 171207 - protein, 124 aa, Glycine max
  Coding DNA Sequence Number=SeqID_54429
MDELRERAKGYILMEEMSKFRNDVRQTGQKCDKKEGGSKTKSHKSDKRHNSDKRQPLPKGPKGRTIIQYERESEDTKKISIGIMTLTVEGTKHKIKGDRDTICKDASDNLCKNMKMSPPSKLEA

SEQ ID NO: 171208 - protein, 314 aa, Glycine max
  Coding DNA Sequence Number=SeqID_54430
  Gene Ontology: Mol. function=RNA-directed DNA polymerase activity; Biological process=RNA-dependent DNA replication
MKFPTLTGEIVTVAPYPSTRKSARPHPTTGDDTQVMSVDKGSPGQAWTVYLASLDDVFDVDSCNDNADRGPKPIEELFKLDLTNHEDKHITDDLHRNTNLFSWQPSDMLGIHPALYATSSPFVPRPNQGHVFYLAHQCRHGQKGGCALTTLILIGLTPKDAYPFPNINRLVDGASKFQVLSFLHAYSGYNQIWIHAPDEEKMKFITKDANFCYRGRKRQVPGLYDHTLGNRSQSRQMHRHTRDAQSYQRLGSLEAEWLGVPILLYLLIAGEAVSSALVKEQGKHQFLIYFTSHILHDAEKHYQMIEKVALAFIT

SEQ ID NO: 171209 - protein, 161 aa, Glycine max
  Coding DNA Sequence Number=SeqID_54431
  Subcellular localization annotation: CTP_CleavageSite=33; ConfidenceScore=5.03e-01
MGAEGGNACPHTSHTTLDLSSRIDSSPISKSPYSSKRRKKENWTKRNNLENGWGKNTNEYTIDMFDVERHEEPPPPTPSQSKELERTSPQWVSNMCTFEKVTKDKDSCLSIRHGLPLKTMRVGGTTPILFLLTHPTITHIFMSCRSQNFVILLKRFQYLAM

SEQ ID NO: 171210 - protein, 284 aa, Glycine max
  Coding DNA Sequence Number=SeqID_54432
  Gene Ontology: Mol. function=RNA-directed DNA polymerase activity; Biological process=RNA-dependent DNA replication
MGNRHIGTTAKGPRSSQVFTSHYRLLYQVDRGKTTARNHSQRGGEVHLEIPHMQTGTNETPFQLIYGTNSMIPIEVGEPSTKRMLFQQQQNKENIRVELETMNKVQEVARIEEEATKLQASRKYNTKLGPNWESPFRVIASLGNEAYRLQELDGKAIPRTWNGTNLKFYFSEPAAHQTQGPPLVSLTGSSNLRSTLGESHFSKGSSNPRSILGESRFSKGLTNPRFVLGHSLGTTKTIVKSPSSTRQTNYHQNGQQDLQLGGSHINCSQASGEKLSKAKRSLTG

SEQ ID NO: 171211 - protein, 375 aa, Glycine max
  Coding DNA Sequence Number=SeqID_54433
MSTISDSTLGIGGSDSGGSIQQPMVEREVVLIGDSLSEERLMNFKNVGEGSFEPRAGIKSPLASMEDQSSLVTTIMCLPPWENPVTDEAVGKDDCGEVRVSSSPHGKVKDDVLKYHLLVTSPLSVDALWCQLELTKPGDAHKMTLVVCREDEYPIMCPAPDGIMDDFAWRPLVKQVGLVDGDVPPPLVSVNEPSKGGGDSIEARLTHPGLLMLSRLHLVCLFLQLPRGNAVKRLEQPDYARSQRLPLFFEPLASHRTIAAIANVSNPIAPPPLSTQVVSVSLPSAPAIFAPSSVMFSPVSFVAPSLLSAGLTMIGVVTSMPHLPSVVPPLAPIVLNSEMPSSSSQNGSKHKEAMNRIASLEEEVAKWRVTARIVW

SEQ ID NO: 171212 - protein, 348 aa, Glycine max
  Coding DNA Sequence Number=SeqID_54434
  Gene Ontology: Mol. function=oxidoreductase activity; Biological process=electron transport
  Homolog annotation: Hit_ID=UPI0000E695EC; Match level="QueryCoverage =96%, HitCoverage=55%, E-value=1e-129, Identity=69%"; Hit description= twin-arginine translocation pathway signal
MSELAIRYLQQTTHDFQTVGIDGTSCSDARICDLPGLDGMNLPPLDEESQADLDDPYVFHVPDGNATLARLMARKLIPTVAPAGQDMDDVVLAKFDYGQLDRPESPVKHAFEQHRAACGQRRRQGGSHLHDRREDDQGARRAGGDGRLQHDDPIPGAGDVARAAGGAEAERQVAAGVQQGGDPQLATVHQAGRARDLFAGRAHPRDPDRPIGLHMVYVPTLPGSGLSPREQSRKGRALLLGTPFEVHEQMIREQLQGMLGEAGFDHQRDIQAITVNRWSHGYSYFLNGLFDDEDEATKIIETARQPIGKIVIANSDADWSPYANSAIDQAWRAVNELAYGKVAAKEGA

SEQ ID NO: 171213 - protein, 514 aa, Glycine max
  Coding DNA Sequence Number=SeqID_54435
  Gene Ontology: Mol. function=histidine ammonia-lyase activity; Cellular component=cytoplasm; Biological process=histidine catabolic process
  Homolog annotation: Hit_ID=Q4BSD1; Match level="QueryCoverage=46%, HitCoverage=91%, E-value=1e-91, Identity=70%"; Hit description=ABC transporter
  Pfam annotation: Domain name=ABC_tran; Domain location=14-210; Score =223.1; E_value=6.4e-64; Accession=PF00005.17; Description=ABC transporter
  Pfam annotation: Domain name=PAL; Domain location=240-514; Score= -97.2; E_value=2.8e-10; Accession=PF00221.9; Description =Phenylalanine and histidine ammonia-lyase
  Pfam annotation: Domain name=SMC_N; Domain location=3-213; Score= -126.1; E_value=0.022; Accession=PF02463.9; Description=RecFRecNSMC N terminal domain
  Pfam module annotation: Pfam domain module=ABC_tran::PAL::SMC_N; Domain location=14-210::240-514::3-213
MEVLKGISLQAHQGDVISILGASGSGKSTLLRCINLLETPDAGVVSVGGETIEMKRHARGHQLAANPKQIERLRSRLGMVFQSFNLWSHMTVLQNVIEGPHYVLKRDKKSCIAQAEQLLDRVGLLNRKDFYPAQLSGGQQQRVAIARALAMDPEVMLFDEPTSALDPELVGEVLKVMRSLAEEGRTMLVVTHEMGFARNVSNRVVFMHQGNIDCEGTPEAMFGASGSSRFKQFISSHQSHHAEQPALVQVARHNAELTLSAAAWQRIARGREIVEQIVASGQIAYGINTGLGALCNITLPEDQLSQLSRNTLLSHACGVGPLLTREQTRAILCAAIANYSHGKSGVSVALVQHLLALLNQQITPQVPSQGSVGYLTHMAHIGLALIGVGDVEYQQQVMPAEQALRLAGLQPYRPGAKEGLSLVNGTPCMTGLSCLALDDAARLLDCADVTGAMSFEALRGQLAAFDAEVIALKASPGMQHSGQRLRALLSDSPLLAASCGIRTQDALSLRSMPH

SEQ ID NO: 171214 - protein, 188 aa, Glycine max
  Coding DNA Sequence Number=SeqID_54436
MADQGDLYERDGIVLDRSKRDKSRVSNPLMKWALLTTTSEDKMQKYGRSKVGSRVVPYHEDQSEDSVPVSFVSKDLQRNGKESEDSEAAVKSTQSTVVDGRKDEIPSFPTDVAMKSHLHFGELVTVNVQRLGMSLSLTLDAMSFNMIGVRHMFDEIDYVLKGKNTDCFASLYCWSAIYTFKCCKYKDN

SEQ ID NO: 171215 - protein, 124 aa, Glycine max
  Coding DNA Sequence Number=SeqID_54437
  Gene Ontology: Cellular component=chloroplast
  Homolog annotation: Hit_ID=Q9ME51; Match level="QueryCoverage=46%, HitCoverage=100%, E-value=4e-10, Identity=90%"; Hit description =Hypothetical protein trnI
MSPHGGDMDGGEKRKERDGVSLAFGIAGPGGRPARRAISSVEDRWAIQVRSNVDPTFSSLVGSGRSGGDHHGSSLLENSYIPYQYMDSYLSSTGLGLASMEKNGAPNNVSSQTKNYEIAPFILG

SEQ ID NO: 171216 - protein, 82 aa, Glycine max
  Coding DNA Sequence Number=SeqID_54438
MDEVNNNRPSTETKGRKNEHECLSIYFTRYFSRPHNERARELHRTTIVTKVRVTQSCSWRQRQQHDGEVTTRDELQRVYGVT

SEQ ID NO: 171217 - protein, 80 aa, Glycine max
  Coding DNA Sequence Number=SeqID_54439
  Gene Ontology: Mol. function=DNA binding; Biological process=DNA integration
MVVSPQYAGEFFLPQAFGFVKFNVQGFKGDLVHYFSLAVCLRMLDRGLGFELNVFVSYNGTVESIPAYEVLLSNFFYFVS

SEQ ID NO: 171218 - protein, 90 aa, Glycine max
  Coding DNA Sequence Number=SeqID_54440
MHHIPRKDNTRADFFSKLASTKKIRHLKTIIQETLQAPMIDTDEMKMKHNVGKERPITASSPYSRNLWPPHRGVFPSNHGSMCWLLLVDT

SEQ ID NO: 171219 - protein, 113 aa, Glycine max
  Coding DNA Sequence Number=SeqID_54441
  Gene Ontology: Mol. function=galactosylgalactosylxylosylprotein 3 -beta-glucuronosyltransferase activity; Cellular component=membrane
  Homolog annotation: Hit_ID=Q4VZ79; Match level="QueryCoverage=78%, HitCoverage=18%, E-value=5e-23, Identity=62%"; Hit description =Glycosyltransferase
MKLSVLQQTYLTRWGNSFRGLAQLDLSGDSVVKSLTAIFWLVIHGVCCLISLVLSFRFSRLVFFFLFSTSLYTAPFRSGSKISAPHDVPPAVNRTATTVASTASRMVVGWHGI

SEQ ID NO: 171220 - protein, 75 aa, Glycine max
  Coding DNA Sequence Number=SeqID_54442
MKFDRLDKIKHYRYNRNHGHNTEDCWALKDKIEELIQAGYLAQKKLNELRAIVLTPHLKMKYPTLTGEIVTVKAN

SEQ ID NO: 171221 - protein, 80 aa, Glycine max
  Coding DNA Sequence Number=SeqID_54443
MEVNLQLGWKPLNLEHYDGTTNPDEYLNTFLTQANLYTNDNAILCRVFPMSLRRSILMWYEGLPPRSIDSFDTLVSHFSF

SEQ ID NO: 171222 - protein, 80 aa, Glycine max
  Coding DNA Sequence Number=SeqID_54444
  Homolog annotation: Hit_ID=Q9SNC3; Match level="QueryCoverage=90%, HitCoverage=18%, E-value=2e-07, Identity=44%"; Hit description =Fasciclin-like arabinogalactan protein 4 precursor
MVALEREYSAGERSVKGEGAEVRPGEKLEEDVVAKDINEGGQGEVIIDGEVGVGDGENGEGGAVREICGEGHGKDDERGE

SEQ ID NO: 171223 - protein, 70 aa, Glycine max
  Coding DNA Sequence Number=SeqID_54445
MHEYCTFQFCPASLAFEPRSLPVFMATTTPFPPIPTFVVVEWLGLAFTKEGPAWKKVVFRVLGSAEKEEE

SEQ ID NO: 171224 - protein, 106 aa, Glycine max
  Coding DNA Sequence Number=SeqID_54446
QVATGWNWGKRCCSGHENREGAGLESEGGGAKLEGAVLVHVDVGVVVVEKGRRGGGRCKEEKKGGGGGSGEPIEERGGGGERGGEDSVDGVVEGRGGEEANDGGEE

SEQ ID NO: 171225 - protein, 46 aa, Glycine max
  Coding DNA Sequence Number=SeqID_54447
MEFNGGGGHNPLFEDSPSESGSRAATVRYGLISNDTHEARCKYKAV

SEQ ID NO: 171226 - protein, 254 aa, Glycine max
  Coding DNA Sequence Number=SeqID_54448
  Homolog annotation: Hit_ID=Q1SCN3; Match level="QueryCoverage=38%, HitCoverage=39%, E-value=2e-27, Identity=67%"; Hit description=MatE, putative
  Subcellular localization annotation: CTP_CleavageSite=50; ConfidenceScore=5.08e-01
MASLKALILLKPNPRFHFDLVRLNWKNFKFSQKIEKLKFSIQSQARSLFLSATLSCHTCSLFLSATLTHTTLALSLPLCTLALSLPLSHSHAPHVAFSHKFTNTLVLRLDTIFVLPYIVVVIQVRLAVSLLADGLAVAGQAILAGAFANKDFDKATATASRVLQRHTLCKCDALFVILHMGLVLGLALAFILGTGLHFGAKIFTQDANVHHLIQIGIPNWNGIRTLGVPKELMTAHGRHHSYSFILGLGFSGVC

SEQ ID NO: 171227 - protein, 137 aa, Glycine max
  Coding DNA Sequence Number=SeqID_54449
MTSEAARQIINRTDSLEEESAQGSFVAHRRQDVLTTAIRRPEHPGCQVLRRGAFLLRIQDKGHTSKLKLECEIFNLLCELFVRERLQPSTASPSPTPPAHEDNEEEAIGNEEERVMDHCNKFSGEILASLGFERRYL

SEQ ID NO: 171228 - protein, 207 aa, Glycine max
  Coding DNA Sequence Number=SeqID_54450
  Homolog annotation: Hit_ID=Q2HU19; Match level="QueryCoverage=37%, HitCoverage=5%, E-value=9e-15, Identity=54%"; Hit description =Bromodomain; WD40-like
MAQQKLNGLEKQKEEMMKLNSPQYLLQWIQEAMNKTEVEYEILHQQVLDREIDIGVGKIRWGMVRARSSKPLRVGEAMPSDTDPYYGKCSNHLDEKENVSSGHNKDDKNFSALTPELTPELEIHKDDYRVDSLTEIKGEKENVISGHEKEDKNFSALTPELTPEIEIQKDDYKVICPPEAAIPVRVRVGVRTNSRSSWCSSMCWSLS

SEQ ID NO: 171229 - protein, 50 aa, Glycine max
  Coding DNA Sequence Number=SeqID_54451
MTMAFDILKLELGFQAAQDQGQGKQFSLVQPIESSSTRHKPESIIFPKEL

SEQ ID NO: 171230 - protein, 136 aa, Glycine max
  Coding DNA Sequence Number=SeqID_54452
KEGRIRILSSCEGCPMRGVPSDESITPFIARGFSDHNARDRELRGSSNGIIGGYHKWLRVRTQGLDWLPNLKTVSDDEVKASEESDEVQALKAELERAWVVEEKFKAAIVSSSSEEVKGIITGQRHDLEGRAKGLP

SEQ ID NO: 171231 - protein, 73 aa, Glycine max
  Coding DNA Sequence Number=SeqID_54453
MGAHTLMIEKSIKNSEEKMKALTCVLETNHHEWREAERKVKGSEILFLSSFKEIKVHGREVSMEKGTSLPIEK

SEQ ID NO: 171232 - protein, 72 aa, Glycine max
  Coding DNA Sequence Number=SeqID_54454
MTEKCFLSLIAITNGERQKERSKEVKSYFSPLSRKSKCTGEKFLWRKVQVFLWRKCCRSFCPLSNAFGPMSL

SEQ ID NO: 171233 - protein, 275 aa, Glycine max
  Coding DNA Sequence Number=SeqID_54455
  Gene Ontology: Mol. function=protein serine/threonine kinase activity; Biological process=lipid transport
  Homolog annotation: Hit_ID=Q1SVS0; Match level="QueryCoverage=96%, HitCoverage=40%, E-value=2e-27, Identity=35%"; Hit description =Bromodomain
MASEPMVGGDDEAREKQRFGERKVYTRRKVKKDPNAVASTTENNGTATSTVTNDNSVSNSTVQKSNTGEAAEAKSKGDNVSTQALAQPVVLPEDGNLAQPQVVSGLEDGNLGQPQLEDQNMVQTEVGSGLEDGNKAQPRGEDQNMAQTQEGSRLENENRAQPQGEDQNLAQTQVNSRLEDGDTAQLQLEDQNMVQSQSEDQNMVQPQSEDQNMVHPQSEDQNMAQPQSEDQNTAQPRLGDQNTAQLQGNSKLEDENMAQPQVSSRSEDANTAQPQ

SEQ ID NO: 171234 - protein, 38 aa, Glycine max
  Coding DNA Sequence Number=SeqID_54456
MARDVAWRVCHTLGWEGAFGLAGARKVHTLALVAGGEC

SEQ ID NO: 171235 - protein, 435 aa, Glycine max
  Coding DNA Sequence Number=SeqID_54457
  Gene Ontology: Mol. function=kinase activity; Cellular component =intracellular; Biological process=regulation of transcription, DNA -dependent
  Homolog annotation: Hit_ID=Q1SVS0; Match level="QueryCoverage=87%, HitCoverage=37%, E-value=1e-127, Identity=65%"; Hit description =Bromodomain
  Pfam annotation: Domain name=Bromodomain; Domain location=68-157; Score=116.6; E_value=7e-32; Accession=PF00439.15; Description =Bromodomain
MLENSQGICETVEKEKRTPKANQFYRNSEFLLAKDKFPPAESNKKSKLNWKKQGGGEMGHGFGMGSKFFKSCSSLLEKLMKHKHGWVFNAPVDVEALGLHDYFTIITHPMDLGTVKSRLNKNWYKSPKEFAEDVRLTFRNAMTYNPPGQDVHIMAEQLSKIFEDRWAIIESDYNREMRYGFDYGAVAPALSPLSRRVSAFTPPPLDMRRILNRSESMTQTPRLMSITPSSRTPAPKKPKAKDPHKRDMTFEEKQKLSTNLQSLPSEKLDAIVQIIKKRNSALNQHDDEIEVDIDSVDAETLWELDRFVTNYKKSLSKNKRKAELAQARAEALQQNAIQKSQAPAMAEIPKETLTGELLRIRMKGIFPNPCLRKGEIKQIMGVGQAVQAAPAVILDLLQVILIVTVPQHLDLRQGRKGPECAPSALLPFHSEEECL

SEQ ID NO: 171236 - protein, 381 aa, Glycine max
  Coding DNA Sequence Number=SeqID_54458
MEDKSPRQVRVRGHLVKFDEDTLNTFLKTPVIIQEGETLSAYSRFALWRPDPQELAAKLCIPGRGFELNVDGQPLKILRKNMTTLAQTWSVLSYSNLVPTSHTSDITLDRAKLICGIIMKMDMNLALCKARGVISDSRSLESLSPAINLAYIKKNCWNLDDPTVTFRGPRKARGKRSEAPLTSTTPDASAPSSSILPDHLAPSSSTPATPTPSPAQIPVLALSSSGPSDFSFTPKMLYAMIQSLHRGHAIIMQSFQSLGLPSIMGMEEFHSQVAWPGVQPSPSGGGGTSTAQEPEQAAEEPILAEYELTPLEPFSFAADTSMAQEEEISPDHMPEPSPAPISEDTMPSALAMEPEQSILQDVLAAPVLDLNEDQPQDEQDV

SEQ ID NO: 171237 - protein, 90 aa, Glycine max
  Coding DNA Sequence Number=SeqID_54459
MGCTDGPEIYPKAHENPRAFSCIFGPIFLESSIQCPWGSLHGGQVIIMQSLHSSGLPSIMSTNDDVNLTRSGSFDTGYGVLDDATSSEGR

SEQ ID NO: 171238 - protein, 62 aa, Glycine max
  Coding DNA Sequence Number=SeqID_54460
MRPLDPTLSFSELLQWRFSAMELQRKIKEKSLGSFLEKLPLEASLRSFLEKLELSYTHPSNS

SEQ ID NO: 171239 - protein, 122 aa, Glycine max
  Coding DNA Sequence Number=SeqID_54461
  Gene Ontology: Mol. function=DNA binding; Cellular component =chromatin; Biological process=DNA integration
  Homolog annotation: Hit_ID=Q1SXA8; Match level="QueryCoverage=56%, HitCoverage=4%, E-value=6e-24, Identity=78%"; Hit description=Zinc finger, CCHC-type; Polynucleotidyl transferase, Ribonuclease H fold
MTLKKKMKETMKILKIMELEQIMNFQKNGKPQEIIPSTTLLVIYQKGLVAKWYNQEEGIDYEETYAPVARLEAIRMLLAYASIMNFKLYQMDVKSAFLNGLIQEEVYVEQPSGFENNFRFRK

SEQ ID NO: 171240 - protein, 223 aa, Glycine max
  Coding DNA Sequence Number=SeqID_54462
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=1e-36, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDSRGSHRGLHLFAFIGLHALAFSGLHVLLFRGLHVLAFIGLHALAFRGLHILAFRGLHVLAFRGLHALTFRGLHVLTFRGLQALAFRGLHVLAFRGLYVLSFRGLHVLTFRGLHILIFRGLHALAIRGLHVLSFRGLHVLTLRGLHFLIFKGLHVLAFRGLHALTFRGLHSLAFIGLDALTFRGLHVLAFRGLHVLAFRGLHVLAFKGFHILAFRGLHILRL

SEQ ID NO: 171241 - protein, 95 aa, Glycine max
  Coding DNA Sequence Number=SeqID_54463
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q7VVT9; Match level="QueryCoverage=96%, HitCoverage=20%, E-value=4e-14, Identity=40%"; Hit description =Sensor protein
  Pfam annotation: Domain name=HATPase_c; Domain location=3-95; Score =44.9; E_value=2.7e-10; Accession=PF02518.16; Description=Histidine kinase-, DNA gyrase B-, and HSP90-like ATPase
MLHTPEGSLVDVLLHRVGHHTVVDIVDNGPGMPESFIERAFDRFTRSPDVQAQGSGLGLSIVRSVAQKHQMQVALSNCLNPQGEVCGLQVRVTLP

SEQ ID NO: 171242 - protein, 82 aa, Glycine max
  Coding DNA Sequence Number=SeqID_54464
MKDKRTEEEYLEKQKKKKDSKALSSKAKGKEKEEKDSSKTDVKKENHFATKGHIKIALILQGKHPLALPYLLRLRYYDASNP

SEQ ID NO: 171243 - protein, 86 aa, Glycine max
  Coding DNA Sequence Number=SeqID_54465
  Gene Ontology: Mol. function=RNA-directed DNA polymerase activity
MDKEVKDLVHEATKVEQKLKRKGVIRRSSSNFNSPSWKDKNKEGNTSSSNSIVVPQRTQIKSYGSPKKIRSSEIKCFKCLGKGHNF

SEQ ID NO: 171244 - protein, 99 aa, Glycine max
  Coding DNA Sequence Number=SeqID_54466
  Gene Ontology: Mol. function=cysteine-type endopeptidase activity; Cellular component=vacuole; Biological process=proteolysis
  Homolog annotation: Hit_ID=Q6F6A9; Match level="QueryCoverage=79%, HitCoverage=16%, E-value=5e-34, Identity=83%"; Hit description =Cysteine protease
  Pfam annotation: Domain name=Peptidase_C1; Domain location=7-99; Score=-47.0; E_value=2.7e-08; Accession=PF00112.13; Description =Papain family cysteine protease
MYCVNLVVDFKFWIDFGLHEGSCWAFSTVGAVEGINQIVTGNLTSLSEQELVDCDRGYNMGCNGGLMDYAFEFIVQNGGIDTEEDYPYHAKDNTCDPNR

SEQ ID NO: 171245 - protein, 220 aa, Glycine max
  Coding DNA Sequence Number=SeqID_54467
  Gene Ontology: Mol. function=cysteine-type endopeptidase activity; Cellular component=endoplasmic reticulum; Biological process =proteolysis
  Homolog annotation: Hit_ID=Q6F6A9; Match level="QueryCoverage=89%, HitCoverage=41%, E-value=2e-79, Identity=67%"; Hit description =Cysteine protease
  Pfam annotation: Domain name=Granulin; Domain location=150-197; Score= 8.8; E_value=0.0014; Accession=PF00396.9; Description=Granulin
  Pfam annotation: Domain name=Peptidase_C1; Domain location=1-116; Score=49.5; E_value=3.4e-15; Accession=PF00112.13; Description =Papain family cysteine protease
  Pfam module annotation: Pfam domain module=Granulin::Peptidase_C1; Domain location=150-197::1-116
KNARVVTIDGYEDVPTNDEKSLMKAVANQPVSVAIEAGGMEFQLYQSGVFTGRCGTNLDHGVVAVGYGTENGTDYWLVRNSWGSAWGENGYIKLERNVQNTETGKCGIAIEASYPIKNGANPPNPGPSPPSPATPSIVCDEYYSCNSGTTCCCLFEYRGFCFGWGCCPIESATCCPDQTSCCPPDFPFCDDSGSCLLVIYPLFHWLCYKSYYQTIMIPEC

SEQ ID NO: 171246 - protein, 47 aa, Glycine max
  Coding DNA Sequence Number=SeqID_54468
MKNEEPSFFTVDGILKNHEQDGFWSYRTTLCCLGERQGKGLERQQQL

SEQ ID NO: 171247 - protein, 489 aa, Glycine max
  Coding DNA Sequence Number=SeqID_54469
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=99%, HitCoverage=90%, E-value=1e-165, Identity=38%"; Hit description =Tetratricopeptide-like helical
  Pfam annotation: Domain name=PPR; Domain location=113-147; Score =30.0; E_value=8.4e-06; Accession=PF01535.11; Description=PPR repeat
  Pfam annotation: Domain name=PPR; Domain location=148-182; Score =44.9; E_value=2.7e-10; Accession=PF01535.11; Description=PPR repeat
  Pfam annotation: Domain name=PPR; Domain location=183-217; Score =35.3; E_value=2e-07; Accession=PF01535.11; Description=PPR repeat
  Pfam annotation: Domain name=PPR; Domain location=218-252; Score =11.6; E_value=0.32; Accession=PF01535.11; Description=PPR repeat
  Pfam annotation: Domain name=PPR; Domain location=253-287; Score =44.9; E_value=2.7e-10; Accession=PF01535.11; Description=PPR repeat
  Pfam annotation: Domain name=PPR; Domain location=288-322; Score =39.2; E_value=1.4e-08; Accession=PF01535.11; Description=PPR repeat
  Pfam annotation: Domain name=PPR; Domain location=323-357; Score =44.9; E_value=2.6e-10; Accession=PF01535.11; Description=PPR repeat
  Pfam annotation: Domain name=PPR; Domain location=358-392; Score =16.3; E_value=0.088; Accession=PF01535.11; Description=PPR repeat
  Pfam annotation: Domain name=PPR; Domain location=393-427; Score =32.6; E_value=1.3e-06; Accession=PF01535.11; Description=PPR repeat
  Pfam annotation: Domain name=PPR; Domain location=428-462; Score =58.6; E_value=2e-14; Accession=PF01535.11; Description=PPR repeat
  Pfam annotation: Domain name=PPR; Domain location=43-77; Score=22.1; E_value=0.002; Accession=PF01535.11; Description=PPR repeat
  Pfam annotation: Domain name=PPR; Domain location=78-112; Score=25.1; E_value=0.00025; Accession=PF01535.11; Description=PPR repeat
  Pfam annotation: Domain name=PPR; Domain location=8-42; Score=10.2; E_ value=0.47; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=113-147::148 -182::183-217::218-252::253-287::288-322::323-357::358-392::393 -427::428-462::43-77::78-112::8-42
MKPFPCVKDFNLLFGIVAKMKHYTTAISLIKHMSYIGVKPNVPTHNIVINCLCRLNHTVFGFSVLGLMFKIGVEPSIVTFTTIVNGLCVEGNVAQAIRFVDHLKDMGYESDRYTRGAIINGLCKVGHSSAALSYLKKMEEQNCNLDVTAYNAVVDGLCKDGMVFEAWDLFSQMTGKGIQPDLFTYNCLIHGLCNFDRWKEAAPLLANMMRKGIMPDVQTFNVIGGRFLKTGMISRAKSIFSFMGHMGIEHDVVTYSSIIGVHCMLNQMKDAMEVFDLMIRKGCLPNIVTYTSLIHGWCEIKNMNKAMYFLGEMVNNGLDPNIVTWNTLIGGFCKAGKPVAAKELFFVMHKHGQLPDLQTCAIILDGLFKCHFHSEAMSLFRELEKMNSDLDIIIYSIILNGMCSSGKLNDALELFSYLSSKGVKIDVVTYNIMINGLCKEGLLDDAEDLLMKMEENGCPPDECTYNVFVQGLLRRYEISKSTKYLMFMK

SEQ ID NO: 171248 - protein, 133 aa, Glycine max
  Coding DNA Sequence Number=SeqID_54470
  Subcellular localization annotation: CTP_CleavageSite=41; ConfidenceScore=5.00e-01
MSHSFSHHSRTQGSKHNIIKSINTQALCNRYTNTQSYMQCGTMSVKNLVGHLGVHDKTNHTLGDQSGSRCFARMFQPCGIGTDLKEHSNQVYLPLRPRLRRVCQGLSLLIQVQPKKYFSTQTLFVNCTKHTTP

SEQ ID NO: 171249 - protein, 494 aa, Glycine max
  Coding DNA Sequence Number=SeqID_54471
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=96%, HitCoverage=98%, E-value=1e-148, Identity=32%"; Hit description =Tetratricopeptide-like helical
  Pfam annotation: Domain name=PPR; Domain location=118-152; Score =24.4; E_value=0.00042; Accession=PF01535.11; Description=PPR repeat
  Pfam annotation: Domain name=PPR; Domain location=153-187; Score =25.1; E_value=0.00025; Accession=PF01535.11; Description=PPR repeat
  Pfam annotation: Domain name=PPR; Domain location=188-222; Score =30.0; E_value=8.4e-06; Accession=PF01535.11; Description=PPR repeat
  Pfam annotation: Domain name=PPR; Domain location=223-257; Score =43.1; E_value=9.2e-10; Accession=PF01535.11; Description=PPR repeat
  Pfam annotation: Domain name=PPR; Domain location=258-292; Score =35.3; E_value=2e-07; Accession=PF01535.11; Description=PPR repeat
  Pfam annotation: Domain name=PPR; Domain location=293-327; Score =14.3; E_value=0.15; Accession=PF01535.11; Description=PPR repeat
  Pfam annotation: Domain name=PPR; Domain location=328-362; Score =49.5; E_value=1.2e-11; Accession=PF01535.11; Description=PPR repeat
  Pfam annotation: Domain name=PPR; Domain location=363-397; Score =43.2; E_value=9.1e-10; Accession=PF01535.11; Description=PPR repeat
  Pfam annotation: Domain name=PPR; Domain location=398-432; Score =42.4; E_value=1.5e-09; Accession=PF01535.11; Description=PPR repeat
  Pfam annotation: Domain name=PPR; Domain location=433-467; Score =16.3; E_value=0.088; Accession=PF01535.11; Description=PPR repeat
  Pfam annotation: Domain name=PPR; Domain location=83-117; Score=10.2; E_value=0.47; Accession=PF01535.11; Description=PPR repeat
  Pfam module annotation: Pfam domain module=PPR::PPR::PPR::PPR::PPR::PP R::PPR::PPR::PPR::PPR::PPR; Domain location=118-152::153-187::188 -222::223-257::258-292::293-327::328-362::363-397::398-432::433 -467::83-117
  Subcellular localization annotation: CTP_CleavageSite=7; ConfidenceScore=5.40e-01
MRFPLLRYFALSSNPTHFLLHPSHSSSTFSTYVRDSDNHNHNNASINTRRAQFLDSMRNVKSVDVALDFYHKMVTMKPFPCVKDFNLLFGIVAKMKHYTTAISLIKHMSYIGVKPNVSTHNIVINCLCRLNHTVFGFSVLGLMFKIGVEPSIVTFTTIVNGLCVEGNVAQAIRFVDHLKDMGYESDRYTRGAIINGLCKVGHSSAALSYLKKMEEQNCNLDVTAYSAVVDGLCKDGMVFEALDLFSQMTGKGIQPNLFTYNCLIHGLCNFDRWKEAAPLLANMMRKGIMPDVQTFNVIAGRFLKTGMISRAKSIFSFMGHMGIEHNVVTYNSIIGAHCMLNQMKDAMEVFDLMIRKGCLPNIVTYNSLIHGWCETKNMNKAMYFLGEMVNNGLDPDVVTWSTLIGGFCKAGKPVAAKELFFVMHKHGQLPDLQTCAIILDGLFKCHFHSEAMSLFRELEKMNSDLDIIIYSIILNGMCSSGKLNDALELFSYLS

SEQ ID NO: 171250 - protein, 392 aa, Glycine max
  Coding DNA Sequence Number=SeqID_54472
  Homolog annotation: Hit_ID=Q017M3; Match level="QueryCoverage=25%, HitCoverage=11%, E-value=3e-21, Identity=47%"; Hit description=[S] KOG1032 Uncharacterized conserved protein
  Pfam annotation: Domain name=GRAM; Domain location=1-55; Score=39.0; E_value=1.7e-08; Accession=PF02893.10; Description=GRAM domain
MVLIEDFNCALQENLLIQGHMYLFVNFICFYSNIFGYETKKIIPFPEVTSVRRAKTAGLFPNAIEILAGNKKYFFASFLSRDEAFRIINEGWSRQGNGAIAIMEQKPCPCICKEAVSGSEPMTVTKAQLCLHESMSESSSQENGFVAVENVKSSDITDNGSLSTDLSKDTTLTSIVGDDPVSTADSEKQCSVKQVAEPELNNDAPSAASVSWKWNEEDIDAPSNNLMDLNLFSKNAVLEAYTCVADSVFPIFSKFRIYTLQMKVEDFFRYLFSDDALNFLESFRQKCGDKDFRCSPWHPQEKFGAILPHHILQHYSSAGSKASNRRWKMWWLAVTNSIWKLRNEMIFHNQSFDITKLADSTLFLLWTWLREWERDFKVPFHCWSSAMPIVFI

SEQ ID NO: 171251 - protein, 108 aa, Glycine max
  Coding DNA Sequence Number=SeqID_54473
  Gene Ontology: Mol. function=chromatin binding; Cellular component =chromatin; Biological process=chromatin assembly or disassembly
MAPFETFYRRHCRSLKPRLVSLDLIQEVIEKVKILERVGQVAYRLALLLDLSGVHPDFHVSMLQKYVHDPFHIIQYHSMQLDENVSYIEQPVPIVDKRVKRLCSKDVV

SEQ ID NO: 171252 - protein, 514 aa, Glycine max
  Coding DNA Sequence Number=SeqID_54474
  Gene Ontology: Mol. function=transferase activity; Cellular component= mitochondrion; Biological process=metabolic process
  Homolog annotation: Hit_ID=Q9FGR7; Match level="QueryCoverage=96%, HitCoverage=67%, E-value=1e-172, Identity=60%"; Hit description =Similarity to salt-inducible protein
  Pfam annotation: Domain name=PPR; Domain location=138-172; Score=5.8; E_value=1.6; Accession=PF01535.11; Description=PPR repeat
  Pfam annotation: Domain name=PPR; Domain location=173-207; Score =40.7; E_value=4.9e-09; Accession=PF01535.11; Description=PPR repeat
  Pfam annotation: Domain name=PPR; Domain location=18-52; Score=6.7; E_ value=1.2; Accession=PF01535.11; Description=PPR repeat
  Pfam annotation: Domain name=PPR; Domain location=208-242; Score =37.9; E_value=3.6e-08; Accession=PF01535.11; Description=PPR repeat
  Pfam annotation: Domain name=PPR; Domain location=280-314; Score =38.0; E_value=3.1e-08; Accession=PF01535.11; Description=PPR repeat
  Pfam annotation: Domain name=PPR; Domain location=315-349; Score =16.6; E_value=0.08; Accession=PF01535.11; Description=PPR repeat
  Pfam annotation: Domain name=PPR; Domain location=350-384; Score =33.6; E_value=7.1e-07; Accession=PF01535.11; Description=PPR repeat
  Pfam annotation: Domain name=PPR; Domain location=385-419; Score =25.9; E_value=0.00014; Accession=PF01535.11; Description=PPR repeat
  Pfam annotation: Domain name=PPR; Domain location=420-454; Score =27.4; E_value=5e-05; Accession=PF01535.11; Description=PPR repeat
  Pfam module annotation: Pfam domain module=PPR::PPR::PPR::PPR::PPR::PP R::PPR::PPR::PPR; Domain location=138-172::173-207::18-52::208 -242::280-314::315-349::350-384::385-419::420-454
MKEGSWMRLQEPSLVTPGTCTVLFPLLGKGGMGDEVMELFRNLPSTKEFRDVHVYNATISGLLSCGRWKIPVGLAWSYVCRYEDAWKVYESMETENIHPDHMTCSIMVTIMRELGHSAKDAWQFFEKMNRKGVRWSEEVLVALIKSFCVEGLRRQALIIQSKMEKTGVSSNAIVFNTLMDAFCKSNHIEAAEGLFVEMKAKCIKPTAATYNILMHAYSRRMQPKIVEKLLEEMQDVGLKPNATSYTCLISAYGKQKNMTDMAAADAFLKMKKVGIKPTLHSYTALIHAYSVSGLHEKAYTAFENMQSEGIKPSIETYTTLLDVFRRAGDAQTLMKIWKLMMSEKVEGTGVTFNILVDGFAKQGLYMEAREVISEFGKVGLQPTVVTYNMPINAYARGGQPSKLPQLMKEMAVLKLKPDSITYSTMIFAFVRVRDFRRAFLYHKQMIKSGQMMDGSSYQTHQALLETRPARKNKVWSSLLGMIKSKMSVKVRRQKDEFWKFKKRQVRKNSSDVSV

SEQ ID NO: 171253 - protein, 317 aa, Glycine max
  Coding DNA Sequence Number=SeqID_54475
  Gene Ontology: Mol. function=nucleic acid binding; Cellular component= integral to membrane; Biological process=isoprenoid biosynthetic process
  Homolog annotation: Hit_ID=Q10Q12; Match level="QueryCoverage=64%, HitCoverage=50%, E-value=4e-76, Identity=60%"; Hit description =Expressed protein
  Pfam annotation: Domain name=DUF647; Domain location=40-317; Score =235.5; E_value=1.1e-67; Accession=PF04884.5; Description=Protein of unknown function, DUF647
MERFFPHKTLQDFHHQGFLFLCPHHKVLSFSHHHHHHPPLSFTLIILSPYSQIWCPLYPCLEKGFPSSVTADYVPFQIWDLLQGLSTYIRTMLSTQALLSAIGVGEKSATVIGATFQGSNLDSNAKMWRLVADLMNDLGMLMDLISPLFPSAFVFVVCLGSISRSFTGVASGATRAALTQHFALQDNAADISAKEGSQETVATMIGMALGMLVARLTIGHPLAIWFSFLSLTVFHMYANYRAVRCLALNSLNPERSSILLQHFMETGQVLSPKQVSSQEHVLPIQFISWSSKKANCLHKKVCLGMRISSFDNMEIFA

SEQ ID NO: 171254 - protein, 187 aa, Glycine max
  Coding DNA Sequence Number=SeqID_54476
  Gene Ontology: Mol. function=nucleic acid binding; Cellular component= membrane; Biological process=DNA integration
  Homolog annotation: Hit_ID=Q8RUQ2; Match level="QueryCoverage=94%, HitCoverage=17%, E-value=5e-36, Identity=42%"; Hit description =Putative retroelement
MEDGSHIYLLLYVDDMLIASQNLLTIQKLKSLLNSEFEMKEMGVAKKFLGMEIKRVREAIFVSKGIHSESAKSFWDGIRKTNVDATRFVIGYTFMIDNSLVSWKATLHPTVTLSSTEVEYMVITEATKERIWLKGLVSNLGFPQEKTIILYDNLSVIYLVMDQVYHEKTKHIDIRYHFIRSKKRVEV

SEQ ID NO: 171255 - protein, 201 aa, Glycine max
  Coding DNA Sequence Number=SeqID_54477
MPISPCKSIGWSVSSRHGDRTHKTPSGPEKVEQGPGVSSSGYGPLSVLQGARTPRQGHVIIVGHCFASGYALLDHNNAIGGCHTLISSGDFCSMTCDHSLVLVRCLAPIIRQFVKFQDMPKNQKDIDAQSHPGPFGPSRRFLQKAVASGGSNPARLGELGGNHLPYFAINRGGSEEERGPAPEALFSLSNLLGKIVSVKKI

SEQ ID NO: 171256 - protein, 150 aa, Glycine max
  Coding DNA Sequence Number=SeqID_54478
  Subcellular localization annotation: CTP_CleavageSite=62; ConfidenceScore=5.56e-01
MTRSKLLNQIRCGSFVNNHQLKFAGQSARVRRNITFPRTTAVDVASLTSLQGGKSRFSGLALVTAKSGDVDTLSVEATYILHICSYSNASGEQRECKLVCSAGLAAGVSASQPSFTWSVSSTGVLLATSVGSMSAIFTFYIQIIGNILPF

SEQ ID NO: 171257 - protein, 241 aa, Glycine max
  Coding DNA Sequence Number=SeqID_54479
  Gene Ontology: Mol. function=transporter activity; Cellular component= membrane; Biological process=transport
  Homolog annotation: Hit_ID=Q949K6; Match level="QueryCoverage=87%, HitCoverage=43%, E-value=6e-24, Identity=33%"; Hit description =Putative permease
METGSSSEFLDRGKAMRDGTGKRHDVSDAKVEPFVPRSDHNPKELKSWAKRTGFVSDYSGEAGTSANENFDSVGFDVKSVDDQREGGSSPTIEIDPVLGLARPNRDNEIEPVFVSKHRVIRGENDRVLRSKDVWNGAVGSQNQRRKIGDEPGLALAGDGDKKVGLRGNGDANGMTVSTNHDSNSHGVSAVAPLPEQKKEEEGVAEGDVKVNLFPEGEESSGREWQGSSGLKYSITENPGLG

SEQ ID NO: 171258 - protein, 62 aa, Glycine max
  Coding DNA Sequence Number=SeqID_54480
MLKVFGCPTYYHASEIYGKPKKLLAELRTMSLSSRRFVALQKIVQANYQPRSPQDKTVQITV

SEQ ID NO: 171259 - protein, 622 aa, Glycine max
  Coding DNA Sequence Number=SeqID_54481
  Gene Ontology: Mol. function=ubiquitin-protein ligase activity; Cellular component=ubiquitin ligase complex; Biological process =protein amino acid phosphorylation
  Homolog annotation: Hit_ID=Q9FGD7; Match level="QueryCoverage=99%, HitCoverage=81%, E-value=1e-126, Identity=41%"; Hit description =Similarity to receptor-like kinase
  Pfam annotation: Domain name=Pkinase; Domain location=290-515; Score=- 63.8; E_value=9.3e-05; Accession=PF00069.15; Description=Protein kinase domain
  Pfam annotation: Domain name=Pkinase_Tyr; Domain location=293-515; Score=-57.3; E_value=5.9e-09; Accession=PF07714.7; Description =Protein tyrosine kinase
  Pfam annotation: Domain name=U-box; Domain location=546-619; Score =46.6; E_value=8.6e-11; Accession=PF04564.6; Description=U-box domain
  Pfam module annotation: Pfam domain module=Pkinase::Pkinase_Tyr::U -box; Domain location=290-515::293-515::546-619
MEDDNGFKIASMRDKINCIDWLERMFFDKTIDTQHRSSCAPSSSSTNFEPYLNQNEWKFSFQEIENYAQELMSLNLEEGSSGQDNHVSHFNPVEPYVKERNSSNNMSAAENIDILKDKVNEAYRTIQLKRKEDEANWERHEKAEWAIYLCNRREEELEYLIKEEVTRKEELRKDLDAEKEQFHKIKMDIEDSKKKLSLVAEQQSELLNRLHIYTLAVPQAETKLGKALAEKTEMLMEMDGLRKQRNAMNRSIEFFQRKRCHKNECRLIEKGCGLREYTKEEITLATQNFSEQMRLKSDGNWTNVYRGQINHSTVAIKMLNHVPDLSQLDFQAKVRNLGKIRQPHLVAMLGFCSEPKCLVLEYMNNGSLEEMLFCKSKNRVLSWRDCIRIAIEVCSGLGFLNAAQPKPIVHCHPSPSKILLDCNLVAKITGFGLHGCSEECNDNSSDMKAIGVLLQNLLNGRRNLVTMDTEACFDEIGEQWPFDVARDVMGLAMRCMSMNCEPNGEMSITRVVEELNEIRKKGDDMVAREGWRNINGGNVHGQDSTHVPSVFICPILQRIMKNPHIAADGFSYELEAIEEWLQSGHDISPKNLKLKHKLLTPNHTLRSLIEDWQGKRSAKVAN

SEQ ID NO: 171260 - protein, 420 aa, Glycine max
  Coding DNA Sequence Number=SeqID_54482
  Gene Ontology: Mol. function=transporter activity; Cellular component= integral to membrane; Biological process=transport
  Homolog annotation: Hit_ID=Q6SZ87; Match level="QueryCoverage=97%, HitCoverage=60%, E-value=1e-165, Identity=68%"; Hit description =Nucleobase-ascorbate transporter 11
  Pfam annotation: Domain name=Xan_ur_permease; Domain location=1-379; Score=118.7; E_value=1.7e-32; Accession=PF00860.11; Description =Permease family
MGGTDNDTANVISTMLFLSGITTILHSYFGTRLPLVQGSSFVYLAPALVIINAEEFRNLTHHKFRHIMRELQGAIIVGSIFQCILGLSGLMSLLLRIINPIVVAPTVAAVGLAFFSYGFPQAGTCIEISIPQIALVLLFTLVPLSVTLTWIYASFLTAGGAYNYKGCNPNIPSSNILTDACRKHAYTMKHCRTDISNALLTSAWLRIPYPLQWGFPIFHFRTCIIMTVVSLVASVDSVGTYHSASLQVNLRPPTPGVVSRGIALEGFCSILAGLWGSGTGSTTLTENVHTIDTTKVASRRVVELGAAFMILFSFMGKVGALIASIPQGLAASVLCFIWALIAALGLSNLQYGQCTSFRNMTIVGVSFFLGLSIPAYFQQYKPQTSLILPAYLVPYGAASSGPFHSGNKQMCRHGYPNVDE

SEQ ID NO: 171261 - protein, 54 aa, Glycine max
  Coding DNA Sequence Number=SeqID_54483
MKDDADEERQFLGGEWWIVIREWAGTHVHEASERHGSPPSHLLPYTSNTRSSKT

SEQ ID NO: 171262 - protein, 66 aa, Glycine max
  Coding DNA Sequence Number=SeqID_54484
MHMASRKRKATTSRPQPHYDTHIFTSEDAWNRYDDNVLGRNILPERNVKLFVTEFDEFRIELIRRN

SEQ ID NO: 171263 - protein, 32 aa, Glycine max
  Coding DNA Sequence Number=SeqID_54485
ACLARVSEDWLSTILVLSAEETIFSLNELMTR

SEQ ID NO: 171264 - protein, 108 aa, Glycine max
  Coding DNA Sequence Number=SeqID_54486
MACPIDFGLTNGFPIMVTRVSDATDSLFKCIWDGLPTNCSRHTRGLTMSYLCPSCNNNPESITHSLCDCHIVGQVWNIITVSMDRQAIVGGVVNVEARLHGECDSKVF

SEQ ID NO: 171265 - protein, 96 aa, Glycine max
  Coding DNA Sequence Number=SeqID_54487
MSKLRPIKALMKPIILSYVNIHSAFEENLQCLKSYLYDDLTCTFDWKKGLREKVVHHRWEKGFQGEIMWFTMDGKMGFRERVYTYSIAGLESGTRD

SEQ ID NO: 171266 - protein, 72 aa, Glycine max
  Coding DNA Sequence Number=SeqID_54488
MVHGRLLEIIMLCFISMNKEEITLDPFLEAWKPFKWRLKSREASIFLLSKCKSNYNPVLVHFKRILRANKRR

SEQ ID NO: 171267 - protein, 63 aa, Glycine max
  Coding DNA Sequence Number=SeqID_54489
  Gene Ontology: Mol. function=nucleic acid binding
  Homolog annotation: Hit_ID=Q1S784; Match level="QueryCoverage=98%, HitCoverage=19%, E-value=3e-11, Identity=57%"; Hit description=Zinc finger, CCHC-type
ECLYHNKKKKLWFLNNGCSKHMTRDKRKFLSLEKRNDGGYVAFGDNRKVFIKGVDKIGKPNSA

SEQ ID NO: 171268 - protein, 250 aa, Glycine max
  Coding DNA Sequence Number=SeqID_54490
EVERRNWHKELTNFLEGSIDVAIVKEFYANLYDPEDKLLKQVRVRGHLIKFDADALNTFLKTPVVIEEGESLPSYSGFANLRPVPQELAARLCLPGRGFELNADGLPLKILRKNLITLAQTWSVLSISNLAPTSHTSEIILDRAKLIYELVMKMDMNLGSLFSAPSTSTLSTSPLPPAPAAPVLSDPSSQSSEPSLSMLQSLHQGQLLIMQSLQDVVHQWPVMSVEEFLQQVPWPRVQPSPLGGGEASVA

SEQ ID NO: 171269 - protein, 102 aa, Glycine max
  Coding DNA Sequence Number=SeqID_54491
  Homolog annotation: Hit_ID=Q2HT07; Match level="QueryCoverage=52%, HitCoverage=3%, E-value=1e-12, Identity=64%"; Hit description =Kinesin, motor region; Prefoldin
MLAKENDELKMKLKALIEDNSKLIELYEQAATENNNRNVNKGEDGQEIGSKIDNGEFMSTSNAINNETITDRTNAGRRYLRLNNTRCWPLCSAGRNDDLRLN

SEQ ID NO: 171270 - protein, 67 aa, Glycine max
  Coding DNA Sequence Number=SeqID_54492
  Subcellular localization annotation: CTP_CleavageSite=19; ConfidenceScore=5.08e-01
QKGAILKKCQRSDRAKRAQCAQRVSMAKPNTSMLIELSARLAQSSNSLTRIKRESGAKRDVEIRKPF

SEQ ID NO: 171271 - protein, 306 aa, Glycine max
  Coding DNA Sequence Number=SeqID_54493
  Gene Ontology: Mol. function=microtubule motor activity; Cellular component=microtubule associated complex; Biological process =microtubule-based movement
  Homolog annotation: Hit_ID=Q2HT07; Match level="QueryCoverage=81%, HitCoverage=16%, E-value=2e-73, Identity=61%"; Hit description =Kinesin, motor region; Prefoldin
MLPFDFRCVTETYGLCINIFWFSGMSWNFTNCLMMGAKHLTRTKERSHVIKQRSPDEIRKEVSRLRGLVGGGEIQDNDILVVSFPGSPGSFKWEGVQGSFTPLTSVKRISQKKDYDIALVGAFRREKDKEMELQALRDEIQASMKLVRQREDEIQSLKMRLRFREAGIKRLETVASEKISAETHLLKEKEEHSKEIEVLRAQVDRNNEATRFAMENLQLKEEIRRHVLLIQLKYFFVAFFLFMCMQKLKSFCMEGERERMSEQIMVLENKLLEALDWKFMHETDLKKNSDLMIEDVHNDGNLISKQ

SEQ ID NO: 171272 - protein, 116 aa, Glycine max
  Coding DNA Sequence Number=SeqID_54494
  Pfam annotation: Domain name=AP2; Domain location=93-116; Score= -18.7; E_value=0.072; Accession=PF00847.10; Description=AP2 domain
  Subcellular localization annotation: CTP_CleavageSite=80; ConfidenceScore=5.07e-01
MGPNQWVNLIHHGCEQACFVASTSVTGYSLSLSSHTQTLLHSSYNFKIPNPSFTLHYSQMCVFGILHLAVLRRLVSSDASCEMRKKTMDPSSEKKFRGVRQRLWGKWVAEVRNLAR

SEQ ID NO: 171273 - protein, 130 aa, Glycine max
  Coding DNA Sequence Number=SeqID_54495
  Gene Ontology: Mol. function=binding
  Homolog annotation: Hit_ID=Q10PS3; Match level="QueryCoverage=79%, HitCoverage=18%, E-value=4e-41, Identity=69%"; Hit description=HEAT repeat family protein, expressed
MAIRLARWWLSWSSGSLFQDLVTESDQFSIEEFIPLLRERMNVLNPYVRQFLVGWITVLDSVPYIDMLGFLPDFLDVLLLKSVDYGRMAEILVQRAGSLDEFTRLTTITWINEFVKLGGDCDTLYPSHIY

SEQ ID NO: 171274 - protein, 119 aa, Glycine max
  Coding DNA Sequence Number=SeqID_54496
  Subcellular localization annotation: CTP_CleavageSite=39; ConfidenceScore=5.29e-01
MKNTTLCYPSFTIDIKHSKNCKVSTTYLNQNESLSPRVSQSLQQKPKKVLGLTTSSPNRPRYSIEQQSLDETYLGKVAMDKKKRVVTVFSAMEKNKIRRRTRQVRRRRREHEQNTSRLI

SEQ ID NO: 171275 - protein, 62 aa, Glycine max
  Coding DNA Sequence Number=SeqID_54497
MRQDMLQAFMGGWQFLFALSSILSTLHREDSGIPPSISHLKVVASSEYVGEALSHSSLWLDA

SEQ ID NO: 171276 - protein, 185 aa, Glycine max
  Coding DNA Sequence Number=SeqID_54498
  Gene Ontology: Mol. function=protein serine/threonine kinase activity; Cellular component=membrane; Biological process=protein amino acid phosphorylation
  Homolog annotation: Hit_ID=Q9LRY1; Match level="QueryCoverage=90%, HitCoverage=46%, E-value=4e-58, Identity=67%"; Hit description =Receptor protein kinase-like protein
  Pfam annotation: Domain name=Pkinase; Domain location=1-165; Score= -91.1; E_value=0.0039; Accession=PF00069.15; Description=Protein kinase domain
  Pfam annotation: Domain name=Pkinase_Tyr; Domain location=1-165; Score=-137.8; E_value=0.00051; Accession=PF07714.7; Description =Protein tyrosine kinase
  Pfam module annotation: Pfam domain module=Pkinase::Pkinase_Tyr; Domain location=1-165::1-165
MKIALDAAKGLQYLHDKANPPVIYHDLKSSNILVDKEFNAKLSDLGLAKLGPTGDKSHVSSRVMGTYGYCAPEYQRTGQLTAKSDVYSFGVVLLELITGRRAIDNTRPTREQNLVTWVSFSIHVLCYKWSNLKCLIILLKVAVAAMCLNEEPSVRPLISDVVTALTFLETAPGRQHITGIAPAYH

SEQ ID NO: 171277 - protein, 68 aa, Glycine max
  Coding DNA Sequence Number=SeqID_54499
MDMSGHSHQSGSRCFARMFQSCEISTGLKEHSNRVTLKTYTPKSPSGSLLPDSGPIPKIIFFARRHCS

SEQ ID NO: 171278 - protein, 79 aa, Glycine max
  Coding DNA Sequence Number=SeqID_54500
  Subcellular localization annotation: CTP_CleavageSite=52; ConfidenceScore=5.29e-01
MASESSADSTKTSTSSDSSSATSKIQYPVHTKPLILQFTVVFRKDMDMIEVPSFYHQQWAPEYPEFVNLDMMEQYTKSG

SEQ ID NO: 171279 - protein, 94 aa, Glycine max
  Coding DNA Sequence Number=SeqID_54501
MEMQRKTKEKRFDLCNYFWLLYDGSLVLFSHCTLLSLHVLQSVSVTTDDGALLRVPLPPTKRLSSGELGDEAMSCDISPVQVSFSKLSSPSATE

SEQ ID NO: 171280 - protein, 194 aa, Glycine max
  Coding DNA Sequence Number=SeqID_54502
MGLYILCHHSTCLVALGKVYDGASSIHNVPYLDDVVKVSVEKVYNGNAHDVYQKPLELLWDSECHKWLNISILQLWMMFMDEWSTRLGHGSVYGFLEPQSIHNSKDRHVECQQYIETWVKESQKEVYLGVYLNCAMKTLKPSLDGKSNQVVPNWTEEKCFGDGTPLDIETIITICKKWATYFLQVKTIKLQRFR

SEQ ID NO: 171281 - protein, 119 aa, Glycine max
  Coding DNA Sequence Number=SeqID_54503
  Gene Ontology: Mol. function=kinase activity
  Homolog annotation: Hit_ID=Q657Z1; Match level="QueryCoverage=62%, HitCoverage=19%, E-value=6e-22, Identity=69%"; Hit description =Carbohydrate kinase-like
MFELVNWTLAGGSVANIIRGLSNGFGISSGIIGGVWGMMSKCVCLVDDFGNHTMRPCLSNGVKVQEEELTKEDFKGSKWLVLRYAILNLEVIQAAILLAKQEGLLVSLDLASFEGNHKG

SEQ ID NO: 171282 - protein, 364 aa, Glycine max
  Coding DNA Sequence Number=SeqID_54504
  Gene Ontology: Mol. function=ubiquitin-protein ligase activity; Cellular component=ubiquitin ligase complex; Biological process =protein ubiquitination
  Homolog annotation: Hit_ID=Q1S238; Match level="QueryCoverage=44%, HitCoverage=45%, E-value=9e-54, Identity=76%"; Hit description=IMP dehydrogenase/GMP reductase
  Pfam annotation: Domain name=ADH_N; Domain location=73-171; Score =5.2; E_value=0.0002; Accession=PF08240.2; Description=Alcohol dehydrogenase GroES-like domain
  Pfam annotation: Domain name=Arm; Domain location=252-292; Score =25.3; E_value=0.00022; Accession=PF00514.13; Description =Armadillobeta-catenin-like repeat
  Pfam module annotation: Pfam domain module=ADH_N::Arm; Domain location=73-171::252-292
MTDNKSSFHSSLAVSNIRNHISITLEMDNSDHQPSFYQARSMLTLEEAGLAMLAASQSIYDSNFSHSNQQQLRDSLSVRIRRPLALTAENEAQRAYPRIFGREASGIVESVREGANDMKEGNLVVPIFNGECGDCKYCKCEKTNMCERFGVDPMRKHALSRFALMAMVTSIPTLKDLPYSVVAYLRHFARGSPDDGENVHRRPPVASVAVKHFAAAKLWLLAKNRADNRVLIVNDSWTQEHAVTALLNLSLHEDNKMSITNAGAVKSLIYVLKTGTETLKQNAACALLSLALVEENKGSIGAFDAIPPLVSFLLNGLSRGEKDVLTTLYKLEGHGGAEQPGGDLGREGHGMNLAAERSDRERDP

SEQ ID NO: 171283 - protein, 210 aa, Glycine max
  Coding DNA Sequence Number=SeqID_54505
MTSHSSSATSKDRSNWLATIRFSVVFRVSKIWQPILFFSDGLKEFRRTHDIGDNVIMRFFGGDKNIAFEVDVIGPILGQHRPRSVLATRRHIFTANPPNYVHTCHTLISSGDHPFVGMQPSFDHFEVLGTHRYAIRPLEPSKKFPLKAVPSGGSNLARLSELGGKLLPLFSINRGRSAEQKCSTLLVYENPLKLVRRIVSVKKIQAEALP

SEQ ID NO: 171284 - protein, 103 aa, Glycine max
  Coding DNA Sequence Number=SeqID_54506
  Homolog annotation: Hit_ID=Q1RSZ9; Match level="QueryCoverage=39%, HitCoverage=2%, E-value=8e-08, Identity=65%"; Hit description =Polynucleotidyl transferase, Ribonuclease H fold
  Subcellular localization annotation: CTP_CleavageSite=23; ConfidenceScore=5.01e-01
MAGPEVAIRSLNSNDTRGKTITCKATVAYGPRGPFVVERVLVHPPQKMERRSAPFFFFSITMSHSNSIFYTALAVSNIKNHVPIILEMENVQYVTWAELFKPR

SEQ ID NO: 171285 - protein, 219 aa, Glycine max
  Coding DNA Sequence Number=SeqID_54507
  Gene Ontology: Mol. function=helicase activity; Biological process =viral genome replication
  Homolog annotation: Hit_ID=Q1SRJ5; Match level="QueryCoverage=91%, HitCoverage=24%, E-value=2e-56, Identity=48%"; Hit description =Probable helicase [imported]-Arabidopsis thaliana-related
MVHDDNGTVPHANTPNDEIKYISPCESTWRIFGFPIHGRKPSVERLQFHLPGQHSVLYQDHDDINDLLSNPGISESKFIAWMNTNQVFVEGQSLTYSEFVTKFVYNQKQRCWQLRKKGYTTGRLQWVPPTTGELFYLRMMLTVCRGPISFENIRTVDGVEYSTYREACFAMGFSQDDREFIVAIQEAKDWGSAPYLRNLFVLLLLTGTMNKPEQVWEKT

SEQ ID NO: 171286 - protein, 266 aa, Glycine max
  Coding DNA Sequence Number=SeqID_54508
  Gene Ontology: Mol. function=RNA-directed DNA polymerase activity; Cellular component=chromatin; Biological process=chromatin assembly or disassembly
MPEHHTRQVTTDKLEEADKTLSQDNSTLNNKIDTIHASLIAKIEALFDRFAAIAVNSPPPPPPMPSHSSSSSHRHHMKLEVPRFDGHDPLGEFLRMRGSQSPPSTWKAPRYPGINGCAATASSRPDRRCCRPWNRVLPLPSTTTPRAHCSNFSKPTRCFISGLIPELRREVQALRPLSLPHATELARLQEDKLLDRRRGQRSSSTPFPLNQCLLSPQAPPESQSSVLPLRDSRSAVNKGFVTTTTTSTLLRIATLAKPRIPSSQTS

SEQ ID NO: 171287 - protein, 1051 aa, Glycine max
  Coding DNA Sequence Number=SeqID_54509
  Gene Ontology: Mol. function=RNA-directed DNA polymerase activity; Cellular component=chromatin; Biological process=chromatin assembly or disassembly
  Pfam annotation: Domain name=Chromo; Domain location=966-1016; Score =24.1; E_value=0.0005; Accession=PF00385.14; Description='chromo' (CHRromatin Organisation MOdifier
  Pfam annotation: Domain name=rve; Domain location=679-820; Score =55.4; E_value=1.9e-13; Accession=PF00665.16; Description=Integrase core domain
  Pfam annotation: Domain name=zf-H2C2; Domain location=624-665; Score =8.5; E_value=0.027; Accession=PF09337.1; Description=His(2)-Cys(2) zinc finger
  Pfam module annotation: Pfam domain module=Chromo::RVT_1::rve::zf -H2C2; Domain location=966-1016::170-339::679-820::624-665
MVGNRNTLECDTQSLQWLKLLGPITTDYQHLTMTFSHLGRNITLRVDAPPSLSPASAHQLKRLAQTQSISALYHITALPLDPSSSPGTATTPTPEPIPPQIASILERFLAIFAEPSSLPPPRNIQHHIHLFPHTAPINVRPYRYPHFQKSEIEKQISAMLATGVIQPSHSPFSSPILLVKKKDDTWRCCVDYRALNAVIVKDKFPMPTIDELLDDLGRASWFSKLDLRQGFHQIRMAEEDTHKTAFRTHQGHYEFLVMSFGLCKAPSTFQAAMNDALQPFLHRFIAVFFDDILVYSPDLPSHVSHLEAVLSTLAEREFLLKHSKCSFAQRKLSYLGHIISSQGVAPDPDKIVAMLEWPPPTCPTSLRGFLGLTGFYRKFVKGYAAIAAPLNSLLRKDKFEWSPDAHQAFRQLQQAMTEALVLANPNFLIPFTLETDASGTAMGAVLLQEGHPIAYYNKALCPRLQRASAYVRELHAITSAVRKWRHYLLGTLFIILTDHKSLKDLMSQTIQTPEQQTYLFKLLGFGYTINYKPGATNVVADVLSCISPAEATCLTLTVPHFLFLQNLRQVLLLEPQYVALLQDIRNHPTAHPDITTHQDLFFLHGRIWIPFATPFTRVLLEEFHSSPLGGHIGVKKTLHRLRQNFDWPHLKEDVRRYVAQCATCQQTKKSAGLLQPLPIPAHVWEDLSLDFVTGLPLSQGYTVILVVVDLFSKAAHFGALPTHHTAYKVAILFLDMILSSSAISGASFSRLSDTKLRMSTAYHLQTDGQTEVLNRTLEQYLRAYVHDHPSRWYRFLSLAEWSYNTTLHSGTRMTPFEAVYGKPPPTVAHYLQGQSSNDAVDSLLTTRLQVHAQLTRRLQRAQELMKVAADKHRRDISFEVGVWVHVRLRPYRQTSLAPTYSKLAKRFYGPFQITARIGPVAYKLMLPASSHVHPIFHVSLLKLHQGSPPVSPATLPEHSTDNHPIIHPFAILDWKLDSSSTPPVKRVLVQWDGLPPEEASWESWDELRVIHNLADKVVFDEGGVDSNTATDQHQHIDTSRPKRECKKPAYL

SEQ ID NO: 171288 - protein, 49 aa, Glycine max
  Coding DNA Sequence Number=SeqID_54510
MVKMWFGRWGKEVEATVESVMMVEVIGDGNGSPYNGVGNCNVKVEVRSR

SEQ ID NO: 171289 - protein, 59 aa, Glycine max
  Coding DNA Sequence Number=SeqID_54511
  Gene Ontology: Mol. function=beta-galactosidase activity; Cellular component=beta-galactosidase complex; Biological process =carbohydrate metabolic process
  Homolog annotation: Hit_ID=Q9XGT3; Match level="QueryCoverage=93%, HitCoverage=30%, E-value=1e-20, Identity=76%"; Hit description=Beta -galactosidase
MDVASPNGISSVAWMQSAIVVQRNQPLTWHKTYFDAPEGDEPLALDMEGMGKGQIWING

SEQ ID NO: 171290 - protein, 166 aa, Glycine max
  Coding DNA Sequence Number=SeqID_54512
  Gene Ontology: Mol. function=DNA binding; Biological process=DNA integration
KKKKKKGKGGKKSKVNPKDIYNYCKEPGHWNCFNHMRPHKHWFVTYEKKYGGNALMGNDAPELKKNHVYVSLIDLKGFSCLVEGSVSVVSQSISDASNGSSDNSLWHLCVSHMSEKGLDILNKRCLFGNHKVESLQFCEHCLWEEASNNVPKGYAHNEGHVGLHPF

SEQ ID NO: 171291 - protein, 313 aa, Glycine max
  Coding DNA Sequence Number=SeqID_54513
  Gene Ontology: Mol. function=protein binding; Cellular component =proteasome regulatory particle (sensu Eukaryota); Biological process= proteolysis
  Homolog annotation: Hit_ID=Q0GEA1; Match level="QueryCoverage=50%, HitCoverage=59%, E-value=2e-62, Identity=74%"; Hit description=26S proteasome regulatory particle non-ATPase subunit 12
  Pfam annotation: Domain name=DUF1012; Domain location=1-169; Score =134.8; E_value=2.3e-37; Accession=PF06241.3; Description=Protein of unknown function (DUF1012)
  Pfam annotation: Domain name=SAC3_GANP; Domain location=126-294; Score=86.2; E_value=1e-22; Accession=PF03399.6; Description=SAC3GANP family
  Pfam module annotation: Pfam domain module=DUF1012::SAC3_GANP; Domain location=1-169::126-294
MDSVPTIVEVSSSKTCDLLKSISALKVELVENVASKLFVQCFRQKGLIKIYRHLLNYRKNVFNLCSLPNLEGLTYRQIRHRFPEAVVCGLYRSGKIYFHPNDGEIRQQTDKINTCNGFYCHKFTPNRPYKPMIWIEAWSGWFTEFGGDIYEHAIVLGVKNEDQDAFERDFFQLKPYYTDACNRLPPSPQEYPILGLNLLRLLVQNRIAEFHTELELLSSAALENPCIKHVVELEQSFMEGAYKRALSARQTVPHDTYVYFMDLLAETVRDEIAGCSEKAYDYLSIKDAKQMLLFSSDQELLEYIKEVSIVMTP

SEQ ID NO: 171292 - protein, 140 aa, Glycine max
  Coding DNA Sequence Number=SeqID_54514
MHMKSGIHCTSAQASMRSLPIQLLCFKQEKSLLFNKIVMNLIWQKQNWMIVFASVLYQLFPSNVDEIGVWSLQGIRNHPEKNVVNLNLKMNLNPLSLKHQILQSIHLESLGMMGLKVSTLDPSDSVLFHLHIMRQNFSRF

SEQ ID NO: 171293 - protein, 53 aa, Glycine max
  Coding DNA Sequence Number=SeqID_54515
  Subcellular localization annotation: CTP_CleavageSite=33; ConfidenceScore=5.09e-01
MPHNGTLCPDVLQHKVPLSTSPSHLFPRTQGSRSSQNPNTNNKPGVIYHIPNY

SEQ ID NO: 171294 - protein, 58 aa, Glycine max
  Coding DNA Sequence Number=SeqID_54516
MSTEGEICIAGRQYKWRLQSLLNLSNVWKPYQSNQRKKLKNLRKLLEMPLSLLEDTDP

SEQ ID NO: 171295 - protein, 159 aa, Glycine max
  Coding DNA Sequence Number=SeqID_54517
  Gene Ontology: Biological process=cell division
  Homolog annotation: Hit_ID=Q9SZA4; Match level="QueryCoverage=97%, HitCoverage=35%, E-value=7e-32, Identity=49%"; Hit description=WD -repeat protein-like protein
MNFDAHYMLTERNKENPVERSPSRDAYKKQLAECLNINRSRIFAFKNKSLALVDLIPHQISLPYQWDNKLANPLRYIPQTRKKTLDASDILNDYYLNLLDWGSDNVLAIALENSVYLWNAANCSTSELFTFDDENGCHIYCWALDGWRFVVGLCNSRNF

SEQ ID NO: 171296 - protein, 185 aa, Glycine max
  Coding DNA Sequence Number=SeqID_54518
  Gene Ontology: Mol. function=carbonate dehydratase activity; Cellular component=extracellular region; Biological process=one-carbon compound metabolic process
  Homolog annotation: Hit_ID=Q6EPY7; Match level="QueryCoverage=85%, HitCoverage=74%, E-value=2e-35, Identity=39%"; Hit description =Putative nectarin III
  Pfam annotation: Domain name=Carb_anhydrase; Domain location=28-185; Score=-77.6; E_value=1.8e-06; Accession=PF00194.11; Description =Eukaryotic-type carbonic anhydrase
MALRVHFSIVSIAVLALCTSADYFSANFSYAGPNGPEYWGSLSPSYAACSHGKSQSPVELMKTDIVINKQLKNLNRNYLPTNATLVDNIFNIGLHLVHLTEDNYNIAVVAVLYKLGDPDPLISQFEDKLVDLEKEIRAGNKDAQIAIGTFDVEEINRSSHRYYRYVGSLTTPPCKEGVTWNILGK

SEQ ID NO: 171297 - protein, 332 aa, Glycine max
  Coding DNA Sequence Number=SeqID_54519
  Gene Ontology: Mol. function=ubiquitin thiolesterase activity; Cellular component=intracellular; Biological process=ubiquitin -dependent protein catabolic process
  Homolog annotation: Hit_ID=Q69MX3; Match level="QueryCoverage=99%, HitCoverage=54%, E-value=1e-114, Identity=64%"; Hit description =Putative U4/U6.U5 tri-snRNP-associated 65 kDa protein
  Pfam annotation: Domain name=zf-UBP; Domain location=133-208; Score =20.5; E_value=0.00064; Accession=PF02148.9; Description=Zn-finger in ubiquitin-hydrolases and other protein
MTSKREREAGDRVEDEGLDNESKRQRLDEDSSPSPPPVSVANPLSGLANNYADIDEEEDDVRRERGSVNERSNDGSHHNGHNKYGEADDSDEEDDDSHEQFTGRNRQVEVRKDCPYLDTVNRQVLDFDFEKFCSVSLSNLNVYACLVCGKYYQGRGKKSHAYTHSLEAGHHVYINLRTEKVYCLPDGYEINDPSLDDIRHVLNPRLEPWLGLFVDRFTAKEVEQLDKNKQWSRALDGSSYLPGMVGLNNIKETDFVNVTIQSLMRVTPLRNFFLIPENYQHCKSPLVHRFGELTRKIWHARNFKGQVSPHEFLQAVMKASKKRFRIGAQSDP

SEQ ID NO: 171298 - protein, 121 aa, Glycine max
  Coding DNA Sequence Number=SeqID_54520
MGEGCCTQPYPCICKEAVSGFEPMTNRKKREKPVLQKGVGWTVVLHHKGRKKTRDSESGIAVVSVAQAPVENKMAKKKHKGVGLDFYVQIKEVQRNGMTTFFYDVWPSFYPENCSVKAISQ

SEQ ID NO: 171299 - protein, 151 aa, Glycine max
  Coding DNA Sequence Number=SeqID_54521
MGLCQSFGVPVTPSKVIRPPITRAFIEKYCMPRQAQGDAPQAAGALPPPHQANPTGSLGMERYLQHLVRQQAANHRGQVQIHECLYQLSLSQQGQGFAPFACPTPDQFRAEVAWPRDWPEDQTEEALAGAPDDAEDARMDEEMTPLSTIKR

SEQ ID NO: 171300 - protein, 138 aa, Glycine max
  Coding DNA Sequence Number=SeqID_54522
MKVWVIYFKISGDCYSSDVSSNSSNRDISGGHDDSDDNGGGGGDISSGDDINGDVMLVVTISGDGDEGGISGGGGGHDGDSGGSNAGGDGGDGEGGGVLEVAVMEVVLLAVVVVNMMVMVVAICGDSGSSVGGCQLWQ

SEQ ID NO: 171301 - protein, 139 aa, Glycine max
  Coding DNA Sequence Number=SeqID_54523
MCTGVFAHVPECVGCVEGLMEPGIYKSRVEQSCGSLFVGVEKITVSDSALVEEAVLLTQSGVDDDSTFSRVSIRSGDRVGIPIAGRNNKAISSFLSLQLNGQAYGKTRCRIADIDWRSIRVGFVGVGRDARLFPQGVRA

SEQ ID NO: 171302 - protein, 114 aa, Glycine max
  Coding DNA Sequence Number=SeqID_54524
  Homolog annotation: Hit_ID=Q10BX7; Match level="QueryCoverage=50%, HitCoverage=6%, E-value=1e-11, Identity=62%"; Hit description=RNA recognition motif family protein, expressed
MADNIFLPITTTKATFKDGSNGHSKTVVELSLKPTTIKVLTNDDSYGIIHSLLLLSMQGRPLKVLKALDKKSVDDKELEKAKNEVHDHRNLYLAKEGLILEGATTAERVLASDM

SEQ ID NO: 171303 - protein, 261 aa, Glycine max
  Coding DNA Sequence Number=SeqID_54525
  Gene Ontology: Mol. function=RNA-directed DNA polymerase activity; Cellular component=intracellular; Biological process=RNA-dependent DNA replication
MVTLSHDMIHKEIEVYADDMITKSRIENEHIVNLHKLFKWLRKYKLRLNLMEACLWSFYGGWIFELQWGPLMGVGLHQNPRKCIFGVKSGKKLGFVVSHKGIEVDLDKVKAILEMPEPCTEKQNQLVKWGDDYQMAFEKIKQCLVNPLVLVPLVPGRSLILYMMVLDESMGCVLGKHDESGRKDTPLEAVYVELHYLFDIVYVTQKAVKGSALANHLAQQPINDYQPMHPESPDEDIMAIFDEESEVEDKDKLTLAVIEIA

SEQ ID NO: 171304 - protein, 673 aa, Glycine max
  Coding DNA Sequence Number=SeqID_54526
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=88%, HitCoverage=91%, E-value=0.0, Identity=55%"; Hit description =Receptor-like serine/threonine kinase
  Pfam annotation: Domain name=DUF26; Domain location=204-257; Score =57.9; E_value=3.3e-14; Accession=PF01657.8; Description=Domain of unknown function DUF26
  Pfam annotation: Domain name=DUF26; Domain location=95-148; Score =63.6; E_value=6.2e-16; Accession=PF01657.8; Description=Domain of unknown function DUF26
  Pfam annotation: Domain name=Pkinase; Domain location=336-604; Score =139.4; E_value=9.5e-39; Accession=PF00069.15; Description=Protein kinase domain
  Pfam annotation: Domain name=Pkinase_Tyr; Domain location=336-604; Score=95.5; E_value=1.6e-25; Accession=PF07714.7; Description =Protein tyrosine kinase
  Pfam module annotation: Pfam domain module=DUF26::DUF26::Pkinase::Pkin ase_Tyr; Domain location=204-257::95-148::336-604::336-604
  Subcellular localization annotation: CTP_CleavageSite=47; ConfidenceScore=5.52e-01
MNSKSFSSSNPSHNKNNYPSWVLFTTLLLSSLSLTVSNPRITEAGLYCGTSKAPLKANYIPSFIKEMESLSQLVTSNNWGTHSVKISGSGSSIPIYGFAQCFRDLSHTDCLLCYAASRTRLPRCLPSVSARIYLDGCFLRYDNYSFYSEGTDPSRDAVNCTGVAAGDEAERVELQERVGRVVDNVVNIAERDGNGFGVGEVEGVYALAQCWNTLGSGGCRECLRKAGREVKGCLPKKEGRALNAGCYLRYSTQKFYNEDGDAGGGNGFLRRRGVIVAEVLAAAAVIMLALSASYAAFTKFSKIKKENNNLGQISSSISKSSLNYKYETLEKATDYFNSSRKVGQGGAGSVFKGILPNGKVVAVKRLIFNNRQWVDEFFNEVNLISGIEHKNLVKLLGCSIEGPESLLVYEYLPKKSLDQFIFEKNRTQILNWKQRFNIILGTAEGLAYLHEGTKIRIIHRDIKSSNVLLDENLTPKIADFGLARCFGGDKSHLSTGIAGTLGYMAPEYLIRGQLTDKADVYSYGVLVLEIVSGRRNNVFREDSGSLLQTAWKLYRSNTLTEAVDPSLGDDFPPSEASRVLQIGLLCTQASASLRPSMSQVVYMLSNTNLDVPTPNQPPFLNTGMLDSDSSIKSYSTNSFISNALKKIGVSYSYSESSRNSDGPSRSEESIIQV

SEQ ID NO: 171305 - protein, 719 aa, Glycine max
  Coding DNA Sequence Number=SeqID_54527
  Gene Ontology: Mol. function=protein kinase activity; Cellular component=mitochondrion; Biological process=protein amino acid phosphorylation
  Homolog annotation: Hit_ID=Q1SNH1; Match level="QueryCoverage=99%, HitCoverage=99%, E-value=0.0, Identity=67%"; Hit description=Protein kinase
  Pfam annotation: Domain name=LRR_1; Domain location=119-141; Score =11.3; E_value=2.2; Accession=PF00560.23; Description=Leucine Rich Repeat
  Pfam annotation: Domain name=LRR_1; Domain location=143-165; Score =10.0; E_value=3.8; Accession=PF00560.23; Description=Leucine Rich Repeat
  Pfam annotation: Domain name=LRR_1; Domain location=167-188; Score =11.6; E_value=1.9; Accession=PF00560.23; Description=Leucine Rich Repeat
  Pfam annotation: Domain name=LRR_1; Domain location=190-209; Score =4.3; E_value=45; Accession=PF00560.23; Description=Leucine Rich Repeat
  Pfam annotation: Domain name=LRR_1; Domain location=211-233; Score =8.0; E_value=9; Accession=PF00560.23; Description=Leucine Rich Repeat
  Pfam annotation: Domain name=LRR_1; Domain location=235-257; Score =19.0; E_value=0.017; Accession=PF00560.23; Description=Leucine Rich Repeat
  Pfam annotation: Domain name=LRR_1; Domain location=259-278; Score =11.1; E_value=2.4; Accession=PF00560.23; Description=Leucine Rich Repeat
  Pfam annotation: Domain name=LRR_1; Domain location=283-302; Score =1.5; E_value=1.5e+02; Accession=PF00560.23; Description=Leucine Rich Repeat
  Pfam annotation: Domain name=LRR_1; Domain location=71-93; Score=6.7; E_value=16; Accession=PF00560.23; Description=Leucine Rich Repeat
  Pfam annotation: Domain name=LRR_1; Domain location=95-117; Score =4.7; E_value=37; Accession=PF00560.23; Description=Leucine Rich Repeat
  Pfam annotation: Domain name=Pkinase; Domain location=434-699; Score=- 7.1; E_value=3.9e-08; Accession=PF00069.15; Description=Protein kinase domain
  Pfam annotation: Domain name=Pkinase_Tyr; Domain location=434-699; Score=-78.0; E_value=1.1e-07; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=119-141::143-165::167-188::190-209::211-233::235 -257::259-278::...
  Pfam module annotation: Domain location=283-302::71-93::95-117::434 -699::434-699
MWENYNVDLCSLPPSAHVSLKCEGNSVTELKIIGDRAVKVDKFNGPAVPNHTLSLSFSIDSFVTTLTRLTNLRVLRLVSLGIWGPLPDKIHRLSLLEVLDMSLNFLYGSVPPRMSTMVKLHTLTLDGNGLNSTMPDWFDSLTNLSVLSLKSNHLKGSFPSSLCKIRSLVDISLSHNELSGGLPDLIALSGLHVLDLRENHLDSELPLMPKAVVTILLSKNSFSGEIPNQFSELGHLQHLDLSSNHLSKMPPSSLFSLPNISYLNLASNELSGSLPQKLNCGSKLGFVDISSNKLNAGLPSCLANTSGKRVIKYGGNCLSIDSQPQRQGTYCKESSLGKKNFWKWKIAAAVAMIIVIVLVLSAFGVFFYRKYHSREMYRHQMLPKAVQDNSITGVSSEVLASARFVSQVVKLGTQATPTCRQFSIEELKEVTRNFDLSTYIGEGSLGKLYKGKLENGTYVVIRCVALSKKCSIQNLKARLDLLSKLNHPNLVSLLGHCVDGDGQDDSSGLKLHLVYEYVLNGSYRTHLSEFSSDKGLKWSDRLSILIGVAKAVHFLHTGVIPGCFRNQLKTNNILLDEHHIPKLSDYGMSMIAEEIEYLEAKGEYPKSCQREKLEDDVYNFGLILFESLVGPIASKKGEKYFLDEKTSFDSQDGRIKIVDPVVLTTCCPESLSIAISITTKCISPESSAPPSFEDVLWNLQYAAQVQATADAEQKSDSTS

SEQ ID NO: 171306 - protein, 249 aa, Glycine max
  Coding DNA Sequence Number=SeqID_54528
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=12%, E-value=4e-55, Identity=53%"; Hit description=Chromo
MDLIGIPKTAFHTHYGHYEYNVMSFGLCNDPSNFQATMNDLFHPFIRKFVLVFFYDILVYSQNFDEHLKHFECVLQTLHQGKFFVKLPKCVFRKRWIDYFKHIMSTNGVEPKPLKIQAMLDWSVPTSLKSLRGFLKLTGFYWYFIKNYTQLASPLTHLLCKDRFKWSSNTQAAFDRPKGAMTRAPILALLNFGIPFVLETNSSDTGMDALSQVNEKPAEALWILTMPHFRFLDDLKKELSGNVEFVALL

SEQ ID NO: 171307 - protein, 127 aa, Glycine max
  Coding DNA Sequence Number=SeqID_54529
MGGGSFEMMEVRLGGTGSFWDSSSEAIRRKNLALHLCFLKVVFGGAGSNGELRQVVLEQGYESHFQGLKEASSRRDLVIAINPLKPTQSGAVEVERCDLESFIVGGAMGVEVRDNLVDFGVEGALGR

SEQ ID NO: 171308 - protein, 189 aa, Glycine max
  Coding DNA Sequence Number=SeqID_54530
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=56%, E-value=1e-57, Identity=50%"; Hit description =Integrase, catalytic region
  Pfam annotation: Domain name=rve; Domain location=2-117; Score=3.9; E_ value=0.0028; Accession=PF00665.16; Description=Integrase core domain
MALDFITGLLVYQGATVILTVLHGFPKSIISNRDPIFMSRFWQELFKLNGTKLRMSTTYHPQSNGRTKVLNQVLQQYLRAFIYNQLSQWGKFLSLTEWCYNTTCHSTTQMTPYEVTYGKPPSSIPQYLPGTSSVEVVNFLQASRQEVFQLLRKKLERTQEQMKKVVDAHRRDTTFVVGDWVYVKLRPYR

SEQ ID NO: 171309 - protein, 289 aa, Glycine max
  Coding DNA Sequence Number=SeqID_54531
  Gene Ontology: Biological process=cell cycle
  Homolog annotation: Hit_ID=Q2QVB9; Match level="QueryCoverage=66%, HitCoverage=20%, E-value=2e-35, Identity=42%"; Hit description =Expressed protein
MKGKNRRSGGVVHMEYLIHIQEIKPWPPSQSLRSLRSVLIQWENGDRSSGSTGVVSPSLGPNSAPGEAKLEFNESFRLPVTLSRDMSIRNSTAAVFQKNCLEFHLHETRRDKTTKGQLLGTAIIDLADCGVLRETLSIRTPLNCQRNYRNTDQPLLFIQIEPVEKSRPKSSLKDSLTKGNNGSESVSALMNGEYAEEAEITSFTDDDVSSHSSVAAVTTSSESSACMPPEHEEEGNCQGHELSDLGGREVAAPGTNGPAQNSGSNDKEHEHPLTSDTRVEKLNVMEHDT

SEQ ID NO: 171310 - protein, 396 aa, Glycine max
  Coding DNA Sequence Number=SeqID_54532
  Homolog annotation: Hit_ID=Q8H0H5; Match level="QueryCoverage=22%, HitCoverage=12%, E-value=7e-18, Identity=54%"; Hit description =Hypothetical protein A20
NGPAQNSGSNDKEHEHPLTSETRVEKLNVMEQDAYERLERSSSYVSSMDVSSEVGSPVNGHTSITSTPNHRSATTPKQVASLNADSSSPTLEENSKSRSRISDDENLDQESCEKVANCRNMSTVVQRNNNESDFDIYSSNTTSLDSNYLVDTNPSFGLETKDKLSESCEEVDKSRVLEGGSDNYYSSIQDQHGNEMFHSDKQYHVEDESVAEGSKDQVLLSSNSYSFGGSDNGMKGNVLKNERLKNVRSVRSSADSVRNIGSLGNNHLIEVKENGVNGDAQNNGANIRSSDRKDAKVYPREARNAILDNKIEHLENKIKMLEGELREAAAIEAALYSVVAEHGSSMSKVHAPARRLSRLYLHACKENFQARRAGAAKSAVSGLVLVAKACGNDVPR

SEQ ID NO: 171311 - protein, 196 aa, Glycine max
  Coding DNA Sequence Number=SeqID_54533
MAQGFEPLHAQNDISTGNWQNIEVKHNPSSQCEAISSGFRHFTASCDGRTGDGKRGTGKEEELRVREREWSGWSRVGADTTRGIGLELSLPRVTRDPRPRQGSTVAEPALHDHRWGRHKGIGQIVSVTLVEKPARSTMVFKKLVDLKDPTKKEKWNEGEEQPEWVVGRVRTSSSLLKECDGGLESAIAMKAPVDRC

SEQ ID NO: 171312 - protein, 604 aa, Glycine max
  Coding DNA Sequence Number=SeqID_54534
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=90%, HitCoverage=93%, E-value=0.0, Identity=56%"; Hit description =Tetratricopeptide-like helical
  Pfam annotation: Domain name=PPR; Domain location=123-157; Score =21.0; E_value=0.0044; Accession=PF01535.11; Description=PPR repeat
  Pfam annotation: Domain name=PPR; Domain location=158-192; Score =27.2; E_value=5.9e-05; Accession=PF01535.11; Description=PPR repeat
  Pfam annotation: Domain name=PPR; Domain location=193-227; Score =29.1; E_value=1.5e-05; Accession=PF01535.11; Description=PPR repeat
  Pfam annotation: Domain name=PPR; Domain location=228-262; Score =38.6; E_value=2.1e-08; Accession=PF01535.11; Description=PPR repeat
  Pfam annotation: Domain name=PPR; Domain location=263-297; Score =35.3; E_value=2e-07; Accession=PF01535.11; Description=PPR repeat
  Pfam annotation: Domain name=PPR; Domain location=298-332; Score =18.6; E_value=0.023; Accession=PF01535.11; Description=PPR repeat
  Pfam annotation: Domain name=PPR; Domain location=333-367; Score =47.3; E_value=5.1e-11; Accession=PF01535.11; Description=PPR repeat
  Pfam annotation: Domain name=PPR; Domain location=368-402; Score =41.3; E_value=3.4e-09; Accession=PF01535.11; Description=PPR repeat
  Pfam annotation: Domain name=PPR; Domain location=403-437; Score =36.9; E_value=7e-08; Accession=PF01535.11; Description=PPR repeat
  Pfam annotation: Domain name=PPR; Domain location=438-472; Score =17.4; E_value=0.052; Accession=PF01535.11; Description=PPR repeat
  Pfam annotation: Domain name=PPR; Domain location=473-507; Score =35.1; E_value=2.4e-07; Accession=PF01535.11; Description=PPR repeat
  Pfam annotation: Domain name=PPR; Domain location=508-542; Score =57.2; E_value=5.6e-14; Accession=PF01535.11; Description=PPR repeat
  Pfam annotation: Domain name=PPR; Domain location=543-577; Score =15.5; E_value=0.11; Accession=PF01535.11; Description=PPR repeat
  Pfam annotation: Domain name=PPR; Domain location=88-122; Score=9.9; E_value=0.51; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=123 -157::158-192::193-227::228-262::263-297::298-332::333-367::368 -402::403-437::438-472::...
  Pfam module annotation: Domain location=473-507::508-542::543-577::88- 122
  Subcellular localization annotation: CTP_CleavageSite=59; ConfidenceScore=5.67e-01
MYSAMMMMMMRRSSCVHGFPLLRYFASSSNSKPFLLHPSHSSSTFSFVSDSDTSRAQFLDSMRNAKSVDVALDFYHKMVTMKPFPCVKDFNLLFSIVAKMKHYTTAISLIKHMSYIGVKPTVHTLNIVINCLCRLSHAVFGFSVLGLMFKIGVEPSIVTFNTIVNGLCVEGNVAQAIRFVDHLKDMGYESDSYTCGAITNGLCKVGHSSAALSYLKKMEEKNCNLDVTAYSGVVDGLCKDGMVFEALNLFSQMTGKGIQPDLFTYNCLIHGLCNFDRWKEAAPLLANMMRKGIMPDVQTFNVIAGRFFKTGMISRAKSIFSFMVHMGIEHDVVTYTSIIGAHCMLNQMKDAMEVFDLMISKGCLPNIVTYTSLIHGWCETKNMNKAMYFLGEMVNNGLDPNVVTWSTLIGGVCKAGKPVAAKELFLVMHKHGQLPNLQTCAIILDGLFKCNFHSEAMSLFRELEKMNWDLNIIIYNIILDGMCSSGKLNDALELFSYLSSKGVKIDVVTYNIMIKGLCKEGLLDDAEDLLMKMEENGCPPNECTYNVFVQGLLRRYQISKSTKYLMFMKDKGFQADATTTKFLINYFSANKENRALEVFLQKFV

SEQ ID NO: 171313 - protein, 677 aa, Glycine max
  Coding DNA Sequence Number=SeqID_54535
  Gene Ontology: Mol. function=RNA-directed DNA polymerase activity; Cellular component=chromatin; Biological process=chromatin assembly or disassembly
  Pfam annotation: Domain name=rve; Domain location=405-559; Score=9.0; E_value=0.0011; Accession=PF00665.16; Description=Integrase core domain
  Pfam annotation: Domain name=zf-H2C2; Domain location=346-387; Score =18.4; E_value=0.0013; Accession=PF09337.1; Description=His(2)-Cys(2) zinc finger
  Pfam module annotation: Pfam domain module=rve::zf-H2C2; Domain location=405-559::346-387
MAFRIHHGHYEFKVMPFGCCNAPSSFQATMNLLFGPYLWQFIIVFFDDILIQVEYLGHIVSHKGVEPVAAKVATVQQWPIPRSTKALRSLLGLVGFYRRFIKNYATIAAPLVKVTTIDPFQWTTQAQTAFEHLKVALSTTPMLALSDYDGPFTVESDALGVGMGAILSQHDHPITFFSKPFSPKLLRASTYVRELCAITTAVKKLRQYLLGSSFTIITDHRSLKELLTQVIQTPEQHMYLAKLIGYDYDIQYRFGTSNQATDALSRLPGPQSTMHMTLSVLCLTFLEELPQQLNGNDDCSRQRRAILDFSVDHPGFSVTQDLVLYKGRIWLCRDLPIITTLLNKYHATPTGGHARVTKTLARLSENFHWQGIRDDVTRFVAQWLECQLTKYEAKKAVGLLCRLSVPHRPWEDLSLDFILGLPPYQGNTMILVVVDQFSKGIHLGMLPTTHTAHMVASLFLNIVVKLHGVPWSLVSDRDLLFISHFWQELFRLSGTLLRMSTGTIPYEITFGWKPFSFPEYIVGSSNIDTVDELLTDRDATFEAIRRKLVKMQESMKKFADTKRREVLERIDEVAYRLQLSDDIRIHPVFHCSVLKPFKGSPEQAQEVQLPPQVINGQPGLSPDKTLWEDWTQLCETHHLEDKVIFQGSGSDRISETVNKAPGTGNNKAPVTGNRGCK

SEQ ID NO: 171314 - protein, 120 aa, Glycine max
  Coding DNA Sequence Number=SeqID_54536
MVSLEEHEKGNGLEKPTIVDNDGKGGTFDSKGSFVSRPDNIRKGENFGVKVSARKSAGPKQENLVNQNGLPRYEKVKNLMREKLPRRGDGNGQISMDLECLGNGPSIGLNENNNTSTMRD

SEQ ID NO: 171315 - protein, 107 aa, Glycine max
  Coding DNA Sequence Number=SeqID_54537
MESKAMPLTLKFGEDPMSRCRKKVKNKESSEEGEANALVEGTQLISSVEVVVCYEDYNHEFFEGPWLIVDHYPHCPKVRVLKLPIELFNQQCLWRIGASIGTMLKVD

SEQ ID NO: 171316 - protein, 139 aa, Glycine max
  Coding DNA Sequence Number=SeqID_54538
MGGQSPKRAKKVNPKVVGRGKGKKDIVKWNLGTKQRETAAWVEVKVLRVGGDCCGGCFVVIGIPDQWMYDSIMFEEVDMDDQNEQECGVNEQHVFGTRNDVLQSGEYRCRKKDFVRRDIRTRKCGSPFKLRGKPVVGGQ

SEQ ID NO: 171317 - protein, 344 aa, Glycine max
  Coding DNA Sequence Number=SeqID_54539
  Gene Ontology: Mol. function=methyltransferase activity; Cellular component=nucleus; Biological process=regulation of transcription
  Homolog annotation: Hit_ID=Q2HTV3; Match level="QueryCoverage=98%, HitCoverage=99%, E-value=9e-93, Identity=53%"; Hit description=N-6 Adenine-specific DNA methylase; Homeodomain-related
  Pfam annotation: Domain name=Myb_DNA-binding; Domain location=14-61; Score=47.2; E_value=5.4e-11; Accession=PF00249.21; Description=Myb -like DNA-binding domain
  Pfam annotation: Domain name=Myb_DNA-binding; Domain location=67-112; Score=50.8; E_value=4.4e-12; Accession=PF00249.21; Description=Myb -like DNA-binding domain
  Pfam module annotation: Pfam domain module=Myb_DNA-binding::Myb_DNA -binding; Domain location=14-61::67-112
MGRSPCCDKNGLKKGPWTPEEDQKLFDYIQKHGYGNWRVLPKNAGLQRCGKSCRLRWTNYLRPDIKRGRFTLEEEETIIQLHSILGNKWSAIATRLPGRTDNEIKNYWNTHIRKRLLRMGMDPVTHRPRLDLLDLSSILSSSLYGSTQMNIQRLLGTHTVVNPEVLKLASSLFPSQQRENINMCAQNCEENQLCDPQIQSQIPHDLAQEALPFTHAQLVESNTMNTYPSIFHESGFQQHYSQLSDLHYNGIDHKSYVPQLPSYDYPPMSESSTYNNSYNNSNQNFSYASVLSTPSSSPTPLNSNSTFVKGSSSTEDETESYVSSNNLLRFEIPDMLRMNEYSYN

SEQ ID NO: 171318 - protein, 61 aa, Glycine max
  Coding DNA Sequence Number=SeqID_54540
  Homolog annotation: Hit_ID=Q2HTV0; Match level="QueryCoverage=93%, HitCoverage=4%, E-value=2e-17, Identity=81%"; Hit description=Zinc finger, RING-type; Transcription factor jumonji, jmjC; Zinc finger, C2H2-type
SSVHAVLEFVSPENVTEGIQLIDEVRLLPEDHKAKADLLEVKKMALHSMNTAIKEIHARTN

SEQ ID NO: 171319 - protein, 510 aa, Glycine max
  Coding DNA Sequence Number=SeqID_54541
  Gene Ontology: Mol. function=kinase activity; Cellular component =mitochondrion; Biological process=protein amino acid phosphorylation
  Homolog annotation: Hit_ID=Q2HTV1; Match level="QueryCoverage=99%, HitCoverage=81%, E-value=0.0, Identity=85%"; Hit description=Protein kinase-like
  Pfam annotation: Domain name=ABC1; Domain location=161-287; Score =129.8; E_value=7.4e-36; Accession=PF03109.7; Description=ABC1 family
MIAQAVSLALTRSYLLVPGFLAFASGKLALAQQNGADTEFYPSQNALYMHAQDGYGYMFAFVFIVVESLVLLVRAIYLAILFSPSILMAPLADYFGPEFRKMWLSVVHRTLEKAGPAFIKWGQWAATRPDLFPRDLCTKLAELQTKAPQHSFSYTKKTIERAFGRKISEIFENFEEVPVASGSIAQVHRASLKYRYPGQQAKPLVVAVKVRHPGVGESIRRDFAIINLVAKSSKFIHALNWLRLDESVQQFAVFMMSQVDLAREAAHLSRFIYNFRRSRDVSFPKPVYPLVHPAVLVETYENGESVSHYVDELQGHERIKSALAHIGTNALLKMLLVDNFIHADMHPGNILVRSKPHKRLFKSKPHVIFLDVGMTAELSGSDRVNLLEFFKAVAHRDGRTAAECTLRLSKQQNCPNPKAFVEEMEESFTFWGTPEGDLVHPAECMEQLLEKVRRHKVNVDGNVCTVLVTTLVLERKLDPGYDVMNTLQTLLLRADWAKSLSYTIDGLMAP

SEQ ID NO: 171320 - protein, 216 aa, Glycine max
  Coding DNA Sequence Number=SeqID_54542
  Gene Ontology: Mol. function=chromatin binding; Cellular component =chromatin; Biological process=chromatin assembly or disassembly
  Homolog annotation: Hit_ID=Q1SAV4; Match level="QueryCoverage=89%, HitCoverage=66%, E-value=9e-34, Identity=53%"; Hit description =Integrase, catalytic region
  Pfam annotation: Domain name=Chromo; Domain location=142-193; Score =13.5; E_value=0.025; Accession=PF00385.14; Description='chromo' (CHRromatin Organisation MOdifier
MSTAYHPQTHGQTEVMNCILEQYLRSFVHTQPANWFRYLTLAKWSYNTSLHSSSGFTPFEVIYGKPPPALPQYLRGTSTNEVVDSLISPRQAIHETLQRQLSKAHATMKKLADTKREITHHGPLPSSLGTWPLQIIAQKHVPRLLCLLDSKLDESTSPPTQLVLTQWLGQPPKDTTWERWSELRDTYNLEDKVVFEDRVLLAIICIKGPIQVGLNG

SEQ ID NO: 171321 - protein, 238 aa, Glycine max
  Coding DNA Sequence Number=SeqID_54543
  Gene Ontology: Mol. function=RNA-directed DNA polymerase activity; Cellular component=chromatin; Biological process=chromatin assembly or disassembly
MAFRTHQRHYEYRVMLFSLCNAPSTFQEAMNNLLTSFMRCFIVVFFDDILVYSDSLSSHIQHLETIFQMLLQGQFYLKRTKGLFVQTQLEYLGHIVSGKGVESEPSKIRAMVQWPTPTSSKELRAFLGLTGFYRKFIKNYASIVAPLTSLLCKDMCIWIVTSQSAFDQLKAAMTSAPVLALPNFVEPFTIETDASGIAMGAVLMQKGHPIAFFNKPFGPRLIHASTYCRSKLHDDESS

SEQ ID NO: 171322 - protein, 143 aa, Glycine max
  Coding DNA Sequence Number=SeqID_54544
  Homolog annotation: Hit_ID=Q1T2D5; Match level="QueryCoverage=46%, HitCoverage=6%, E-value=1e-11, Identity=55%"; Hit description=Chromo
  Subcellular localization annotation: CTP_CleavageSite=65; ConfidenceScore=5.04e-01
MGIWWKPCLRSSLENQEACPTSLSNSSIVRIEKQSRTVGSVLSRGVLKLAFLFRTSKSVDSGRVMLELVDQRFNGWYQVRKMMLWVGSGCGCEAQAIPPLAMNPKGPSSFVFSDYTKKQIPLLAMNPKGRYSFVSSDSTKEQT

SEQ ID NO: 171323 - protein, 123 aa, Glycine max
  Coding DNA Sequence Number=SeqID_54545
  Gene Ontology: Mol. function=RNA-directed DNA polymerase activity; Biological process=RNA-dependent DNA replication
  Homolog annotation: Hit_ID=Q2HS45; Match level="QueryCoverage=62%, HitCoverage=14%, E-value=2e-14, Identity=49%"; Hit description=RNA -directed DNA polymerase
MAQSRATDKEVETLQAILSLRSPLWKFWERNTFAQLGLSIYEKGIWRDGFSSSLWLQFGHASIKSVQSLIKEDFLQAKLGKNSSFTWRSIYTSRVMVKQGMRWRLGNKKEYKCLPRSMVEVHR

SEQ ID NO: 171324 - protein, 191 aa, Glycine max
  Coding DNA Sequence Number=SeqID_54546
  Gene Ontology: Mol. function=RNA-directed DNA polymerase activity; Cellular component=intracellular; Biological process=RNA-dependent DNA replication
MEVWVTQVSYFTPHRNVAVFDPPTDDMRCYVKLLHLTAIVQNQIINKILVDGGAAFNILPRSMLRKFCKSVEDLIPHNIVVSDFCGKPLDSERERPTVFLVISSQANFYMLLVREWIHKVGAVPSLVHQKLFFSNEDGKLEMVKANQSSYGIYVAFVSEGDQAMTRTASFEIKDLFYVNNKLGDEKDKFFC

SEQ ID NO: 171325 - protein, 430 aa, Glycine max
  Coding DNA Sequence Number=SeqID_54547
  Gene Ontology: Mol. function=RNA-directed DNA polymerase activity; Cellular component=mitochondrion; Biological process=RNA-dependent DNA replication
  Pfam annotation: Domain name=RnaseH; Domain location=167-295; Score= -21.1; E_value=0.0053; Accession=PF00075.14; Description=RNase H
MSSGLKKMKSQDPLEEINLGTKGNQKPTYVNMFGLNRELVEHRFPICEGKKLVKQTPRRFAPNVVEAIKAKIERVLKAKFIQTQGELLGFVIHQKGIEVDKNKANSILETSPPKNKKQLQSLLGKWTLALVEFSHTFVPLKAIKGQIVTDFLVDHSNVEILECYIGIKPWILYFEGSKHVNGARIGVILISPNNTLVKILFEIQPVCSNNEAGYETLIVGLETLLNLGAKHVLIRGDFELVINQLTHKFKYIKSNLQKYFSYATKLLAQFEWIEFEHVFREQNKEANDLAQIASSYELYKKSINGILLKCLVESEAYIVLTETHGEICGSHQAGGKMKWMLFRQGYYWPTILKDCINYAKSCEECQKHGPIQQVPASELHSITKPCPFQGWTLDLMRHFHPPSSKGHKYILVLVDYFTKWVQAILLKNID

SEQ ID NO: 171326 - protein, 126 aa, Glycine max
  Coding DNA Sequence Number=SeqID_54548
  Gene Ontology: Mol. function=RNA-directed DNA polymerase activity; Biological process=RNA-dependent DNA replication
  Homolog annotation: Hit_ID=Q1T0R3; Match level="QueryCoverage=53%, HitCoverage=41%, E-value=5e-10, Identity=39%"; Hit description =Hypothetical mitochondrial protein atmg00310
MEDVKKIPWVKWDTICLECGGLAIRDISFFDDVFLAKWKWRLMDAEGELWKEDVVERGKENQCGEKILERGGIWDGGGNGFYENAKVLVISKRSWSKSFFKRINVTRDGGILMTVLFILCVRHILS

SEQ ID NO: 171327 - protein, 102 aa, Glycine max
  Coding DNA Sequence Number=SeqID_54549
MISSVGNEKNMLNETNQNLKKELQSLIFDLEEKLKEQQKIEGSLRSEVETLKVQVAEKYALQSQLEEIEEKLAQTESRLNEEVGSVQAAASTMESQPFQVGR

SEQ ID NO: 171328 - protein, 446 aa, Glycine max
  Coding DNA Sequence Number=SeqID_54550
  Gene Ontology: Mol. function=RNA-directed DNA polymerase activity; Cellular component=exocyst; Biological process=RNA-dependent DNA replication
MGEWRSKSLTCSMFIEEMEVEDIPLVGMKYTWFRSNGQAKIRLDRFLVSNTWLDQWSRVLNCWFLHEGFAKFVEDEWGKINVHGWGAFVLKEKLKRIKEKMKEWNKLSFGHLQVRRLDFEEKMRILDLKYEGRRKWNFLNGLMVEGRPKLFGVPFKMINQQDNAFLIAPFEEEEVVKVVWYCDDNKSPTLDGFNFKFIKKFCHLVKANPQELDEFRPISLIGCKYKIISKILASRLKKVLNDVIDERWRAFIWGRNMLDGELVANEVVDEAKKMKKGCMIFKVDYEKAYNSISWFSLFHMMELLGDPLALFQYLIAAEDLSGWMRQAVVEGLFEGYKVRSLNVEVNQLQFADGTLFVGVSSTKNILVLKVILRCFELASNLKVNFHKSKFKGVNMLDECLMRYAFILNCNVRHIPFDYLGLKVWGNPRKERMWDGFLENVKKSLSK

SEQ ID NO: 171329 - protein, 325 aa, Glycine max
  Coding DNA Sequence Number=SeqID_54551
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-42, Identity=30%"; Hit description= UPI00006A17C9 related cluster
MPFAFTGLHVLTFRGQHLLAFRGLHALTLRGLHSLAFIGIHVLAFRGLHILACRRLHALAFRRLHALAFRRLHVLTIRGLHRAACPRLQRLHALAMRGLHVLTFRGLHVLDFRGLHALAITRLHVLTFRGLHVLTFIGVLAFRGLHVLTFRGLHVLAFKGLHALALRGLHALTFRGIHVLAFRGLHILTFRGLHTLTFRGLHVLAFRGLHVLIFRGLQDYMSSPFEGCTPFAFRGLHALTFRGLHVLPFIGQLILAFRGLHVLTFRGLHVLTFRGLHVLSLRGLHALAFRGLHVLTFRGQHILAFRGLHILAYRGLHSLAFRRLQ

SEQ ID NO: 171330 - protein, 318 aa, Glycine max
  Coding DNA Sequence Number=SeqID_54552
  Gene Ontology: Mol. function=prephenate dehydratase activity; Cellular component=cytoplasm; Biological process=aromatic amino acid family biosynthetic process
  Homolog annotation: Hit_ID=Q02286; Match level="QueryCoverage=68%, HitCoverage=56%, E-value=2e-99, Identity=84%"; Hit description=P -protein [Includes: Chorismate mutase (EC 5.4.99.5) (CM); Prephenate dehydratase (EC 4.2.1.51) (PDT)]
  Pfam annotation: Domain name=CM_2; Domain location=112-192; Score =104.2; E_value=3.9e-28; Accession=PF01817.11; Description=Chorismate mutase type II
  Pfam annotation: Domain name=PDT; Domain location=207-318; Score =115.8; E_value=1.3e-31; Accession=PF00800.9; Description=Prephenate dehydratase
  Pfam annotation: Domain name=Ribosomal_S30AE; Domain location=1-86; Score=132.5; E_value=1.2e-36; Accession=PF02482.9; Description=Sigma 54 modulation protein  S30EA ribosomal protein
  Pfam module annotation: Pfam domain module=CM_2::PDT::Ribosomal _S30AE; Domain location=112-192::207-318::1-86
MDITPAIRNHVEDRLTKLEKWQTQLINPHIVLSKEPQGFVADATITTPNGPLVASAKHDDMYTAVNELIAKLERQLNKVQHKGEARRCNASVKDIVPEVSSMNPENPLLALRDKISAVDARLLTLLAERRALAVEVAQAKLATHRPIRDVERERALLENLIALGKKHQLDAHYITRLFQLVIEDSVLTQQALLQKNLNHPHAHAPRIAFLGPKGSYSHLAARKYATRHFDSMVEMGCLKFHDIIQQVESGQADYAVMPIENTSSGSINDVYDLLQQTSLSIVGELTIPIEHCVLVSGNTDLQQIETVYSHPQPFQQCS

SEQ ID NO: 171331 - protein, 180 aa, Glycine max
  Coding DNA Sequence Number=SeqID_54553
  Gene Ontology: Mol. function=hydrolase activity, acting on glycosyl bonds; Biological process=peptidoglycan catabolic process
  Homolog annotation: Hit_ID=Q54419; Match level="QueryCoverage=98%, HitCoverage=100%, E-value=3e-86, Identity=87%"; Hit description=NucD protein
  Pfam annotation: Domain name=Phage_lysozyme; Domain location=62-168; Score=147.1; E_value=4.8e-41; Accession=PF00959.10; Description =Phage lysozyme
MRHHGGKFTMSAIVKRCSVAAVLAIAVLLPSFGELQTSEAGLRLIADLEGCRLSPYQCSAGVWTQGIGHTADVIPGKTIDERKAAVDLVDDIRRTERGMAACLPHTLSQQTYDAVIAFAFNVGISAACHSTLVALLQQRQWRQACDQLPRWIYVNGKKNKGLEQRRATERALCLQGIASS

SEQ ID NO: 171332 - protein, 48 aa, Glycine max
  Coding DNA Sequence Number=SeqID_54554
WDGRFRGFPSPDGVSPSLTVEESENGSGESAFLGGSFPREPYGSGIGR

SEQ ID NO: 171333 - protein, 43 aa, Glycine max
  Coding DNA Sequence Number=SeqID_54555
MGWHDMDLNGVCMVVLEDDVGVGEHNALDDKVGVATHENFLLI

SEQ ID NO: 171334 - protein, 135 aa, Glycine max
  Coding DNA Sequence Number=SeqID_54556
MSTEQYQSRLVIYREARNLKQKLYAKSNDINVFLGCSIVYLSISRRSKFRTEALSKIKRQKLFTRMSDCVSYDEDMTKSKGKDPLEGLGGPMTRARARKAKEALQQVLSILFEYKPKFQGEKSKVVSCIMAQMED

SEQ ID NO: 171335 - protein, 423 aa, Glycine max
  Coding DNA Sequence Number=SeqID_54557
  Gene Ontology: Mol. function=triacylglycerol lipase activity; Biological process=lipid metabolic process
  Homolog annotation: Hit_ID=O23522; Match level="QueryCoverage=96%, HitCoverage=66%, E-value=1e-112, Identity=52%"; Hit description =Triacylglycerol lipase like protein
  Pfam annotation: Domain name=Lipase_3; Domain location=260-408; Score= 167.2; E_value=4e-47; Accession=PF01764.16; Description=Lipase (class 3)
  Subcellular localization annotation: CTP_CleavageSite=76; ConfidenceScore=5.79e-01
MMQISSTIPAPNLHMFQTRRTSFRCRASPLNPTTSSSPQSIKSVSDSTRLHLSNLDNLLQKQSPTTQPKQQEELTLAATIQNNKTTTTEKKGKNVLEGLNLARLWPDMKATEEMSPRHLNRLQRLLSKTDEYSPRNTLGSLWREYHGSHDWKGMLDPLDENLRREVVRYGEFVQAAYHSFHSNPAMSAEEPPLPRHMVLPDRSYRITKSLYATSSIGLPKWVDDVAPDLGWMSQRSSWVGYVAVCDDRREIVRLGRRDIVISLRGTATCLEWVENMRAQLINIDSSSSSRGKPKVECGFLSLYKTRGSHVPSLKESVIEEVKRLMKLYQGETLSITITGHSLGAALALLVADDVSMCSTDVPPVAVFSFGGPRVGNRAFGDKLAAQNVKVLRIVNSQDVITKVPGMLVSEEVEKKLRNSKLGA

SEQ ID NO: 171336 - protein, 314 aa, Glycine max
  Coding DNA Sequence Number=SeqID_54558
  Gene Ontology: Mol. function=nucleic acid binding; Biological process= DNA integration
  Homolog annotation: Hit_ID=Q1T010; Match level="QueryCoverage=97%, HitCoverage=21%, E-value=1e-60, Identity=40%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=283-300; Score =30.3; E_value=6.9e-06; Accession=PF00098.13; Description=Zinc knuckle
MGSTNGNFPANLPILDGKNWNKWSVQMKVIFAYQEVQEVVDEGYPALVEGATKAQRAVHRENKKKDNKASFFIHQCIDNAHFEKIASAKTSHEAWKILEKCNEGADQWKKVRLQTLRRQYELMQMNMTEKVAEFFNRVITLTNSMKVAGETVTDQMIVEKILRTLIPKCDHVVVAIEESKNLATLKVEELQGSLEAYEHRMLERQSDRSQDQALQAQTWKRGGISGKKGNRGRGRSREYRSNHGSSGKQSQNNEENDQSESSSRRGGSQNWQGGKKKVDRRFLRCFNCNKLGHFSSECKAPADSRGKFSNEANL

SEQ ID NO: 171337 - protein, 380 aa, Glycine max
  Coding DNA Sequence Number=SeqID_54559
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=98%, HitCoverage=31%, E-value=1e-126, Identity=52%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MQNEGLDYSEVFAPVARMETIRLLVALASWRGWKLWQLDVKSAFLNGPLEEEVYITQPPGFELKGSEDKAPRAWNKRIDAFLSKTGFRKCSIEHGLYVKKSDSGGILLICLYVDDLLITGSSSTEIAEIKRCLSSEFEMTDLGKLSYFLVEANLKLGSCEQETKVDNTMFRQLVGCLRFLCHSRPEISFGVRLVNRYMKSPRQSHLVAAKRILRYLKGTLNHGVLFPTHLPNQKEDGILHLVAYSDSDWCGDRVDRRSTMGYVFFLGEAPFSWSSKKQDVMALSTCEAEYIAACSAACQGLWIQTLIQDLELKTKGAIKIMVDNKSAINLAKNPVSHGRSKHIETKYHFLRDQVSKEKIKLQHCGTDLQVADILTKPFED

SEQ ID NO: 171338 - protein, 378 aa, Glycine max
  Coding DNA Sequence Number=SeqID_54560
  Gene Ontology: Mol. function=binding; Cellular component=nucleus; Biological process=regulation of transcription
  Homolog annotation: Hit_ID=Q84ZM5; Match level="QueryCoverage=80%, HitCoverage=53%, E-value=1e-75, Identity=47%"; Hit description =Putative pentatricopeptide (PPR) repeat-containing protein
  Pfam annotation: Domain name=PPR; Domain location=116-150; Score =10.8; E_value=0.39; Accession=PF01535.11; Description=PPR repeat
  Pfam annotation: Domain name=PPR; Domain location=217-251; Score =50.8; E_value=4.5e-12; Accession=PF01535.11; Description=PPR repeat
  Pfam annotation: Domain name=PPR; Domain location=318-352; Score =47.6; E_value=4.1e-11; Accession=PF01535.11; Description=PPR repeat
  Pfam module annotation: Pfam domain module=PPR::PPR::PPR; Domain location=116-150::217-251::318-352
MFYLRLLRRKKLNTLSTSSVITLSDQPTVTLATPSHRHVSLHTHQNEFNDNNIIASNKLITFVLCGDIDSVVRVFKNMKVKSTVAWNSILAAFAKKSGNFEYVRQLFEKIPQPNTVSYNIMLACHWHHFGVHNALGLFDSMPVKDIASWSTMISGKMRLLECHGVWICGLWGFGEYFCAAPVRSVITWTDMITGYMKFGRVELAERLFQQMSMRILVTWNTMIAGYVKNGRAEDGLRLFRTMLETGVKPNALSLTSVLLGCSNLSALQLGKQVHQLVCKSPLSSDTTAGTLLFSMYSKCGDLKDARGLFVRIPRKDVVFWNAMISEYAQHGAGEKALCLFDEMKNRGMKPDWITFVAVLLACNHAGLVDLGSNILTQW

SEQ ID NO: 171339 - protein, 55 aa, Glycine max
  Coding DNA Sequence Number=SeqID_54561
MGSAPAGITGKLDNVQSDNTTIELMEQCRQALHLEVDLIIIHRKEYCARDSEKCA

SEQ ID NO: 171340 - protein, 195 aa, Glycine max
  Coding DNA Sequence Number=SeqID_54562
  Gene Ontology: Mol. function=transcription factor binding; Cellular component=intracellular; Biological process=regulation of transcription, DNA-dependent
  Homolog annotation: Hit_ID=O23594; Match level="QueryCoverage=99%, HitCoverage=89%, E-value=2e-93, Identity=90%"; Hit description=GTP -binding RAB1C like protein
  Pfam annotation: Domain name=Arf; Domain location=2-162; Score=-68.8; E_value=0.00018; Accession=PF00025.11; Description=ADP-ribosylation factor family
  Pfam annotation: Domain name=Miro; Domain location=11-117; Score =36.3; E_value=1e-07; Accession=PF08477.3; Description=Miro-like protein
  Pfam annotation: Domain name=Ras; Domain location=23-164; Score =274.2; E_value=2.6e-79; Accession=PF00071.12; Description=Ras family
  Pfam module annotation: Pfam domain module=Arf::Miro::Ras; Domain location=2-162::11-117::23-164
RLFVQAFADWRFWCRQVMSSPEDDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTANKVVSSETAKAFADEIGIPFMETSAKNATNVEQAFMAMAAEIKNRMASQPVNNARPPTVQIRGQPVNQKAGCCST

SEQ ID NO: 171341 - protein, 80 aa, Glycine max
  Coding DNA Sequence Number=SeqID_54563
  Homolog annotation: Hit_ID=Q9M4P3; Match level="QueryCoverage=99%, HitCoverage=78%, E-value=1e-12, Identity=56%"; Hit description=DYW10 protein
MISLPSIAEMYLVAESQSPQTLKFLNIQIGTTSGVALEVQMQLPTCHCHKRSRSFRSSPKSCKFKIRNITSQLHFLLQVI

SEQ ID NO: 171342 - protein, 84 aa, Glycine max
  Coding DNA Sequence Number=SeqID_54564
MFHSANSLASCGNNLSNNEAKPPRNVNNLHGDEDEDDDDDDDYLVSNSYIEESLEEDDSVDGISDSDDEVTDMIQQVRIVTQQK

SEQ ID NO: 171343 - protein, 157 aa, Glycine max
  Coding DNA Sequence Number=SeqID_54565
  Gene Ontology: Mol. function=calcium ion binding; Cellular component =flagellin-based flagellum; Biological process=ciliary or flagellar motility
  Homolog annotation: Hit_ID=Q9AXG2; Match level="QueryCoverage=84%, HitCoverage=71%, E-value=1e-29, Identity=52%"; Hit description =Regulator of gene silencing
  Pfam annotation: Domain name=efhand; Domain location=131-157; Score =29.4; E_value=1.2e-05; Accession=PF00036.22; Description=EF hand
  Pfam annotation: Domain name=efhand; Domain location=23-51; Score =28.2; E_value=2.9e-05; Accession=PF00036.22; Description=EF hand
  Pfam annotation: Domain name=efhand; Domain location=59-87; Score =21.1; E_value=0.004; Accession=PF00036.22; Description=EF hand
  Pfam annotation: Domain name=efhand; Domain location=95-123; Score =20.9; E_value=0.0047; Accession=PF00036.22; Description=EF hand
  Pfam module annotation: Pfam domain module=efhand::efhand::efhand::efh and; Domain location=131-157::23-51::59-87::95-123
MPKNLLFFALGRTRLYIMDKLSQYERLFNQFDENGDGKISASELWQCVEAMGGELSEKDAEAAVALMDSDGDGLVGFDDFLRFVEGGKEEEKEDGLKEAFKMYEMDGSGCITPRSLKRMLSRLGESRSIDECKVMIARFDLDGDGVLTFDEFKVMML

SEQ ID NO: 171344 - protein, 144 aa, Glycine max
  Coding DNA Sequence Number=SeqID_54566
MNHRRGYSAVVVVKESIYMIGGVKVCENIVDTEEYRRTERMAAMEPWRYELIKMNHFRGLSLGIVKLFSKQRHCNPSLPPCKLIFVLLLGCPLILECHLSQFSAPLGTRDDLVTNFSKFLPSRRGMLAGKELLEPRTLVIVKFK

SEQ ID NO: 171345 - protein, 139 aa, Glycine max
  Coding DNA Sequence Number=SeqID_54567
MESEGILENGCMWRVCNGRNIHVLWDKWIPNIPGEHILEDEEQYVKEDMMVHKIFNEEAGLWNNDLLDNLFSPPHSDLHQSNPENFEEEHKYKPGMIVSNSQGEVMDVATKFLESELGSKVRAVLERATGGVEKALLGV

SEQ ID NO: 171346 - protein, 92 aa, Glycine max
  Coding DNA Sequence Number=SeqID_54568
MTIANNIKTFIPKTENAKEFIRRKQGLRSRKSLSPLCKPPRESRLKIKAGKKFTKKHDKGKKQLKIIEALVQIQKKASKSNNCHFCGKAGHF

SEQ ID NO: 171347 - protein, 50 aa, Glycine max
  Coding DNA Sequence Number=SeqID_54569
MEKPRNVCKRKEEQRDYSTLYLEFCSVLYALHKANSSSKHKIQKLATILN

SEQ ID NO: 171348 - protein, 180 aa, Glycine max
  Coding DNA Sequence Number=SeqID_54570
  Gene Ontology: Mol. function=DNA binding; Biological process=DNA integration
  Homolog annotation: Hit_ID=Q1SKC8; Match level="QueryCoverage=81%, HitCoverage=35%, E-value=5e-42, Identity=56%"; Hit description =Integrase, catalytic region
MVYGKACHLPVEMEHKAYWALKFLDFDDVLSAKKRKLQLLELEEIRLNVYELSKLYKQKVKAYHDKKLLKKNFQPGQEVLLFNSRLNLFPVKLKSKWSGPFTIKEVKPYGAVELMDPQSNTPKRSWVVNSQRLKLYHGGSIESVDFVIVDTARIEEWKGVNFRNGVDHKFVGNLAGSDKS

SEQ ID NO: 171349 - protein, 241 aa, Glycine max
  Coding DNA Sequence Number=SeqID_54571
MWLVKPLSLDKCCPNCFYQVVRDRHVFGVSSKTCVAHAQYSCICVTKGVARIGDVVHKPVGLTKGKPWVLRALWRIDQGIVRLGFWAPCSCIHVTSWSGTHGVELLHMCHFMEWHILEMLWCALAYVSLVEWHVLEMWHALAYMSLHGVKHTRDVVVCSCIRVTHGVARTGDDSLRVDIGFDKLIGLTKGGPWVCAAHALAYMSLRGVACIGNMVHLGETWYPSKLDLDEYSNHSLSCLKC

SEQ ID NO: 171350 - protein, 258 aa, Glycine max
  Coding DNA Sequence Number=SeqID_54572
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=98%, HitCoverage=34%, E-value=1e-124, Identity=87%"; Hit description =Photosystem I P700 chlorophyll a apoprotein A1
  Pfam annotation: Domain name=PsaA_PsaB; Domain location=1-258; Score=- 109.2; E_value=0.00011; Accession=PF00223.9; Description=Photosystem I psaApsaB protein
MVKVILLTLGLVLRWFWPIVGQEILNGDVGGGFRGIQITSGFFQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAML

SEQ ID NO: 171351 - protein, 112 aa, Glycine max
  Coding DNA Sequence Number=SeqID_54573
MANHIIHSRDNGKITLESIESAIKNLEVQVGQLAKQLADRPSSSFTANTEKNLKEECKVVMTRSRMEIQADEGRAEEKVEGYKQQLAAEPALELVSDFVELEEVVEDEDDQQ

SEQ ID NO: 171352 - protein, 134 aa, Glycine max
  Coding DNA Sequence Number=SeqID_54574
MVDKAVGGRGLVIWSVFVVVDHWYMVTNSLMFIRSRQHFESTLHSQIKDFASETPQNVLGAAFVGLKWVIKEPSLLGLSKFQRLLVHASDSNLNDGLEVHPKQSPSVPVTTFNGVKPFHGKSSSISFSGLTHNL

SEQ ID NO: 171353 - protein, 161 aa, Glycine max
  Coding DNA Sequence Number=SeqID_54575
MKRMMESNTIATRAAAGADLTHPSATNQAHQAVPNMVGQEGEVLGSTSSPQMEYNRNAYPYGLPPNYTPPTMHENVHHAILVTFEGQQTQPAGGPCEEPREHAQDVVIPPKFKVLDFDRYKGTTCPKNHMKMYCWKMGAYSRDEKPLMHFFQDSLTRAVVI

SEQ ID NO: 171354 - protein, 163 aa, Glycine max
  Coding DNA Sequence Number=SeqID_54576
MVAGAGDNDCSCDDGHDICDENDYDCDGGHSDNRWDDAYYNIVEGSPHQDHKDSYKAGYDTGYQHGYENTKVGNALWVKTATEVSMRSFNGDFPPCRCSRRQRRRGNGKHHPLGNKPWKKELHHQECALDKNLEKDALMEEKKKRRGEHEIEGIKEGEKWNFE

SEQ ID NO: 171355 - protein, 195 aa, Glycine max
  Coding DNA Sequence Number=SeqID_54577
MASMMEAMLSMRRLIQVNAAASAVASIAAEADPVLSYATNHAHQLAPDMVGRGGDTLRSTGGLHLGYNRNAYPYGLPPPPNFTPPTMHNNMDHAVPITFKGQLPQPIGGVREEPRERRNLPFGGRETQGSQDASSKGGWRAESPPTFIRGKRQKIQNVWSTNFKCERFRSCFYARGRVFPSLLRILNCDEEIRPT

SEQ ID NO: 171356 - protein, 225 aa, Glycine max
  Coding DNA Sequence Number=SeqID_54578
MRDGEYPDFQEEVARRRWAPLVTPMAKFDPEIVMEFYANVWSTEEGVQDMRSWVRGQWIPFDADALNQFLGHPLILEKGMAPMRHPLDPKKSNKALGFPTMITGLCQFYRVPVTPSKVIRPPITRAFIKKYCTPRQAQGEEPQQQVADAPPPPQQSTSASLQSVEHYLRHVVCQQAANHQGQVWLHEYFYQYTLSQQGQGSTPFICPTSEQFGAAIAWPGDWPDA

SEQ ID NO: 171357 - protein, 1115 aa, Glycine max
  Coding DNA Sequence Number=SeqID_54579
  Homolog annotation: Hit_ID=UPI0000E4A594; Match level="QueryCoverage =58%, HitCoverage=90%, E-value=2e-17, Identity=22%"; Hit description =PREDICTED: similar to notch homolog
MGDIPLSLNRWPNQHPDIHHVQPSAIQTREFGSMWRYPRVIHTHISAIHTRESGGRRRYPSGYPYKHNSAIQNHDMRRYPRVIRTHSYATQTRELGGRRRYLSGYPYKKNSAFQTHESGGRRRYPSGYPYKHSSDMQTRERRYLSGYPYKHSSAIETRESGGRRRYLSGHPYKKGSAIQTRESGGRRIFSSGCPYKHSSSIQTRELGGRWSYLRVIRTHSSGNQTCDSGGRRRYPSGYPYKHSSAIHTRESGGKRRYPSGYPYKHSFAIQNHESGGRRQYLSGYLFKHSSVIQTHESGDRRRYPSGYPYKHSYTIQTHESGGRRRYLSGYPCKHSSAIQTRESGGRRRYPSGYPYKKGSTIQIRESGGRRIFPSGYPYKHSSSIQTRELGDRWRYPRVIHTHSSATQTCDSGGRRRYPSGFPYKHSYAIQTRESGCRPRYPSGYPYKHISAIQTRGSGGKWRYPSGHPYKHSSTIQTRESGVRRRYLSGYPQRYPSGYPYKHSSAILTRESGGRQRYLMVIRKHNYGIQTHESGGRKRYPSAYSYKHSFAILTRESRGRRRYPSRYPYKHNSAIQNHESGDRQRYPKGDLWQAVIPSGYSSKHSSATQTRESGGTQRYPSGYPYKHNYAIQTHNSSGKRRYPSGSMRRYPRVIRTHSSVVQTRESGGRLRYPGGYPYKIVLLSRPMNHVAGGDTRVAIRKNIVLQSRPAQIPEWSGGRRRYTSGYPYKHSSGINTRESGGRRRYLRVIRTHNSAIQTRQPEIPKGYPYTQFYYLDPSAIQTRVLGGRRRYMSGYPYKHSSVIQTRKSGGSRRYLSGYPYKHCSAIQTRESGGRKRYPRVIRTHNSAIQTRESGSMRRYPRTRESGGKLRYSSGYSYKHSSVIQTRESGGRRRLASDYPYKHSSAIQTHESGGNSAIQTRESGDRRRYPSGYPYKHISVIQTRKSGGRRRYLSGYPYKHCSTIQTHELSGRQRYPSGYPYKHNSATLARKSSSVQRYLRVIRSQNSDIPARESGSLRRYPDSLVVIRIQTILLSQPVSQVACGDTRGVIHAHNFGIMTREFDSMRRYFRVIRTHKSIIATQESGSMQRHLLVICALAFHYSKAVKVLLSSRDKQVQ

SEQ ID NO: 171358 - protein, 82 aa, Glycine max
  Coding DNA Sequence Number=SeqID_54580
MTCHRDSANYNGFTNGSLSHNYITSDAIHPRKGPITRAMAKRHQEDWARDAGVENFGKCTKSFSSSITRKSEYCFRRDFIAL

SEQ ID NO: 171359 - protein, 315 aa, Glycine max
  Coding DNA Sequence Number=SeqID_54581
  Gene Ontology: Mol. function=RNA-directed DNA polymerase activity; Cellular component=intracellular; Biological process=RNA-dependent DNA replication
RDVVTSGTTSVIGIRISSFTTRLGFDCTNNMVEYEACALGIEAAIDFNVKSFKAYTKKLAEFFDDVSFHHIPREENQMADPHKDLSYIEFKCRGKPAHCCLIEEEKDGEPWFFDIKQYVEIKEYPPEAFDNDKRALRRLEAERMILEVHEGSFGTHVNGHAMARKILRAGYYWLTMESDCCHHMRKSHKFQTFANNVNAPPMPLNVMAVPWPFSMWGIDVIGAIEPKVSNGHRFILVAINYFTKLVKAASYSSVTRNVVVRGQAADRYEPRASVPETGSFVIKKAFSGGALVLANMDDTELLSPVNADVIKRYYA

SEQ ID NO: 171360 - protein, 94 aa, Glycine max
  Coding DNA Sequence Number=SeqID_54582
  Subcellular localization annotation: CTP_CleavageSite=54; ConfidenceScore=5.20e-01
MAENKSKLASQLQHHFQPHSSTLRIATNNHPTECVTTYPSAGGRRVTREMRVPRKEYERSRHQRLFEENVGKTGKDVIYELERFGSCIYARGRY

SEQ ID NO: 171361 - protein, 217 aa, Glycine max
  Coding DNA Sequence Number=SeqID_54583
  Gene Ontology: Mol. function=RNA-directed DNA polymerase activity; Cellular component=intracellular; Biological process=RNA-dependent DNA replication
MAKVLINNGSSLNVMPKSMLEKLPFDASRLRPSSMVVQAFDGSHREVRGEIDLPVQIGPYTCQVTFQVMDISPTYSCLLGRPWIHSVGVVPLTLHQKLKFMVEGLLVIVSREEDLLVSCPSSMPYVEATEESLETAFQSFEMVSNASVESLPMCPHMPNAAIMPRPPVEEAPPCHLNKSFVSAGLRRKKEVAMVHDESPWGHPDWVQPCPPGFQLGN

SEQ ID NO: 171362 - protein, 310 aa, Glycine max
  Coding DNA Sequence Number=SeqID_54584
MQSPIVPPPFDKNLLLHEGKVVIGGNVADYPLKIFHEDVLGHPPPLTPPFCWTPLSSRRTSLSGRPPPERGSHCWPVLQPPRLFPWYWWAALASQGKGAGPLPDAMGVPWGFPIYGLHVDMLVIPVPVIDLKLAKIHHPLQGTTPASCRASKINLLEVMPSPKRLGRCDLHISTAFIVGPPWLASIARSSAPGSLRGTRRWHWGYTTSGREIGKFFSGSPPPKGRGWAGAGVEGGPLGGGVGALVSQPTLRREGDAGLTGASSKGGSVKGSGVVFTHEEGISTQRVCHKGRAFAPRYPRFVMRNSDLRSS

SEQ ID NO: 171363 - protein, 357 aa, Glycine max
  Coding DNA Sequence Number=SeqID_54585
MQKLGKVGVYCHIEIVVFPVYLMELMVASENTEVVIRTNTVLLILTRENTQVVIRKNTVLLILAFVSGGRRRYPSGYPYKHSSANPDPQKYRSGYLYKHSYANPDPNTQVVIRTNTVLLILTRESGDRQKCPRGYPYKHSYANPDPRESSADGDTEVVIRTNTILLVLTHEPVGRRRYPSGGDTQVVIRKNTILLILICESGGGDTQVIIRTNTVLLILTLESGGRRKYPSGYPYKHNSANPNPLQLLALESLTPIVASSVMKLPEEATSLPRQAELARVSWAASTSPQFVENGKLLEEATNSPGRAGRQPPPHFVYKKGKKAEFQGPLTSMLDSVKVLCRSSSVLRSFFGLQPISF

SEQ ID NO: 171364 - protein, 210 aa, Glycine max
  Coding DNA Sequence Number=SeqID_54586
  Gene Ontology: Mol. function=ribonuclease H activity; Cellular component=intracellular; Biological process=DNA integration
MMGEMCEEFKIQHHNSTPYQPKMNKTVEAANKNIKKIIQKMTVSYKDWHEMFPFALHGYRTSVRTSTGATPYSLVYGMEAVLSFEVEVPSQKILAESGLEESEWAQTRHDQLNLIEGKRLTAMSHGHLYQQRMKNAFDKKVRPRKFHEGDLVLKKVSHNVKDSRGKWAPNYEGPFVVKRAFSKGALVLTNMDGEELPSPVNSDLVKRYYA

SEQ ID NO: 171365 - protein, 689 aa, Glycine max
  Coding DNA Sequence Number=SeqID_54587
  Gene Ontology: Mol. function=protein-tyrosine kinase activity; Cellular component=extracellular region; Biological process=protein amino acid phosphorylation
  Homolog annotation: Hit_ID=Q69TY6; Match level="QueryCoverage=81%, HitCoverage=83%, E-value=9e-57, Identity=29%"; Hit description =Putative receptor protein kinase PERK1
  Pfam annotation: Domain name=LysM; Domain location=121-166; Score =3.8; E_value=0.23; Accession=PF01476.10; Description=LysM domain
  Pfam annotation: Domain name=LysM; Domain location=187-235; Score =21.0; E_value=0.0034; Accession=PF01476.10; Description=LysM domain
  Pfam annotation: Domain name=Pkinase; Domain location=372-656; Score =64.8; E_value=2.8e-16; Accession=PF00069.15; Description=Protein kinase domain
  Pfam annotation: Domain name=Pkinase_Tyr; Domain location=380-656; Score=16.4; E_value=1.8e-13; Accession=PF07714.7; Description =Protein tyrosine kinase
  Pfam module annotation: Pfam domain module=LysM::LysM::Pkinase::Pkinas e_Tyr; Domain location=121-166::187-235::372-656::380-656
MGTVEMIIAFHMKALVFFLWLFVPSLGKDLLSCETTSPDASGYHCIENVSQNQCETFALFLTNSYYSSLSNLTSYLGLNKFVIAQANGFSADTEFLSQDQPLLVPIHCKCIGGFSQAELTKTTVKGESFYGIAQSLEGLTTCKAIRDNNPGVSPWNLDDKVRLVVPLRCSCPFSSQVRPQPKLLLSYPVSEGDTISNLASKFNITKEAIVYANNISSQGLRTRSSLAPFTSILIPLNGKPIIGPLVKPKEPDSGNQTTSIPVTSPHKKSPMWKTELCIGLAGVALGVCIAFAAAFFFIRLKHKKEEENSCKEGDLELQYLNQSVRTTSTSDKKVSFEGSQDALDVKIVDALPRKLLLDTYTIEDVRKATEDFSSSNHIEGSVYHGRLNGKNMAIKGTKAEVVSKIDLGLFHDALHHHPNILRLLGTSMLEGEQQEESFLVFEYAKNGSLKDWLHGGLAIKNQFIASCYCFLTWSQRLRICLDVAGALQYMHHVMNPSYVHRNVKSRNIFLDEEFGAKIGNFGMAGCVENDTEDPQFYSTNPASWSLGYLAPEYVHQGVISPSVDIFAYGVVLLEVLSGQTPISRPNEKGEGSIWLTDKIRSILVSENVNELRDWIDSALGENYSFDAAVTLANIARACVEEDSSLRPSAREIVEKLSRLVEELPQGENDMLMCESSSKPLVKAVENNVE

SEQ ID NO: 171366 - protein, 186 aa, Glycine max
  Coding DNA Sequence Number=SeqID_54588
  Gene Ontology: Mol. function=ribulose-phosphate 3-epimerase activity; Cellular component=cytosol; Biological process=carbohydrate metabolic process
  Homolog annotation: Hit_ID=Q9SE42; Match level="QueryCoverage=96%, HitCoverage=67%, E-value=1e-65, Identity=71%"; Hit description =Ribulose-phosphate 3-epimerase, cytoplasmic isoform
  Pfam annotation: Domain name=Ribul_P_3_epim; Domain location=4-164; Score=98.6; E_value=1.8e-26; Accession=PF00834.9; Description =Ribulose-phosphate 3 epimerase family
MVTNPLDYVEPLAKAGASGFTFHVETSKAVKLCLGDLLVMGSNPETASLHMQGTGDNWEELIQRIKSHGMTPGVALKPGTPIEEVYPLVEAGNPVEMVLVMTVEPGFGGQKFMPEMMDKVRILRKKYPSLDIEVDGGLGPSTIDVAASAGANCIVAGSSVFGAPEPVQVISLLRNSVEKAQQTLIQ

SEQ ID NO: 171367 - protein, 300 aa, Glycine max
  Coding DNA Sequence Number=SeqID_54589
HRQWNKNLTRQMENHIDMELVKEFYSNPYDLEDRSPRQCKVRGNTIKFDAATLNSFLETPVGAPWKLLRNDLTTLAQTWSVISYSNLAPTSHTSDLNMDRARGVVSDSLTFKSLSLTINLAYIWKNYWNLEDPSITFPGSCKAKAWAPLDAPAPPPAPSLVGPSMSNNDQIVPMLQSIHHGLFLVMQSMQNLSQQQPIMSMQEYLEQEDEEAVEDTLEAQEAKKDTSAAEADVDTDYVTDGSLSEADWLSEAHPLSEEVSSLSEYKILENVESESSMFSVQPARPARMLSLLVLSASKPA

SEQ ID NO: 171368 - protein, 72 aa, Glycine max
  Coding DNA Sequence Number=SeqID_54590
MTSNTHCKEVSTVIFQGEIPTVQFVVNGTQYNMGYFLVDGCRNLPFGGRATRDSRDACSTKGIRAESPPTFI

SEQ ID NO: 171369 - protein, 55 aa, Glycine max
  Coding DNA Sequence Number=SeqID_54591
MLEIKKRSNAFNDHLLSKKESLDKKELRRSDFLIAIEEYVGAKGNTLVDHKKRKI

SEQ ID NO: 171370 - protein, 108 aa, Glycine max
  Coding DNA Sequence Number=SeqID_54592
MVGYTPSSFTDLVFASKRIEVGLKRGKLGHPALIKTGANEEDENEGETHAVAAIPIWPTITLAKVHQPPFLREYDLNATCACHGEALGRSIEHCRALKHKVQGLIDAG

SEQ ID NO: 171371 - protein, 103 aa, Glycine max
  Coding DNA Sequence Number=SeqID_54593
  Subcellular localization annotation: CTP_CleavageSite=64; ConfidenceScore=5.69e-01
MTLSSWQNKLNRPMATPPSFPPLPPPTEAASQSLSTLKRTRKATRLRSLATRPVGADRPMVHVDPATGKADGPHKKKLRTYLGIVARDKVDVTYENWKEVLAA

SEQ ID NO: 171372 - protein, 475 aa, Glycine max
  Coding DNA Sequence Number=SeqID_54594
  Gene Ontology: Mol. function=chitin binding; Cellular component =extracellular region; Biological process=chitin metabolic process
  Homolog annotation: Hit_ID=UPI00006A17C9; Match level="QueryCoverage =59%, HitCoverage=100%, E-value=4e-31, Identity=30%"; Hit description= UPI00006A17C9 related cluster
LHNLAFRGLPVLAFRGLRILTLGTRTLTFRGLHVLTFRGRHTLTFKGLHALAFRGLHVLTFRGLHVLTFRGLHVLTLGTRTLTFTGLHILAFRGRHTLTFRGLHALAFRGLNILTFRGLHALAFVGLHVLAFGGLHALTFRGLHVLLFRGLNALAFRGLHALTFRGLHTLAFRGLHILLFRGLHVLAFRGLDVLTFRGLRALTFRGLYVLPLKGLHVLAFGGLHALTFRGLHVLPFRVLHVLAFRGLHAVAFRGLHVVVLKGRHVLDFGELHAPSRLEGYASSLSASSFLLSAPGPPPPPDPGGGPTLQAQPEEEANAQLLCILGQDFTCAAAKRRVRIMHTNMTTLTQIWMTLLLSNISSSDHNADLPLRKHKLTPSGPGGVEQGPGVFSSGYGSLSILPGARPPQQGIAPARHLVDPEKSNRVLGFPALITGLCQFYGVPVAPNKVIRPPINWAFIKKYCTPQAGAGRDTTAA

SEQ ID NO: 171373 - protein, 49 aa, Glycine max
  Coding DNA Sequence Number=SeqID_54595
MAGKLTVIVAQRLPFRDAGAQITLIRPRQQRIAHRDLANLLAAINQLHA

SEQ ID NO: 171374 - protein, 687 aa, Glycine max
  Coding DNA Sequence Number=SeqID_54596
  Gene Ontology: Mol. function=electron carrier activity; Biological process=electron transport
  Homolog annotation: Hit_ID=UPI00005F72E0; Match level="QueryCoverage =75%, HitCoverage=83%, E-value=0.0, Identity=63%"; Hit description =COG3519: Uncharacterized protein conserved in bacteria
  Pfam annotation: Domain name=DUF879; Domain location=168-687; Score =582.2; E_value=4.9e-172; Accession=PF05947.2; Description=Bacterial protein of unknown function (DUF879)
  Pfam annotation: Domain name=GPW_gp25; Domain location=59-174; Score =71.2; E_value=3.3e-18; Accession=PF04965.4; Description=GPW  gp25 family
  Pfam module annotation: Pfam domain module=DUF879::GPW_gp25; Domain location=168-687::59-174
MSRDNSSHNDGYAQLHGGFRARKNRDALTARDKLQSSLLDRLTDNAPDKQSEASNTTLISHSTLRRHVLRDLQWLFNTINNEAQQDLSAFGEVQRSVWNFGVAPLAGQNISDIEWQDMQRKMTDAILHFEPRILPQGLQVRCVSDLKSLSLHNVLSIEIKGRLWLIMDSKLLDYYNRELAYLRELGAEFAARYPKVAGRLGMRGIEVADPYVERLMEGFAFLTSRVQLKMDAEFPRFSQRLLEMIAPSYLSPTPSMAIAQLTPDSRKGDISNGFHVPRGTMMESQHLKKSGVTCSYTTAHDVTLHPLRISDVSLGGVPGDLPLGELKLSGRGAASALRVRIACEGISSLSQLNVADLMLYLSGPDIQAQKLLELLMQHRVGIVLQSVEQKPLRQVLPDDSLQQEGFAPEQALLPDDLRNFDGYRLLQEYFAFPARFQFISLSQLAPFLRRCDNAQEFDIIILLDKADSALESVVDSSHLALHCTPVINLFPKTAERLKVSDSQHEYHLVVDNIRPLDYEVHSVQRLFATVEGKREEQLFRPFWSTFSGDDGDYGAYFSLRREQRTLSEQAQRYGTRTGYIGSEVFLSLVDEHHTPWRDDMRYLSADVLCTSRDLPLMLLQQEQGNFVMPDSIPVGQLKLCKGPTPPRPALAEGLSAWRLISHLQMNYLSLMDSSDGQGAAALRQLLS

SEQ ID NO: 171375 - protein, 127 aa, Glycine max
  Coding DNA Sequence Number=SeqID_54597
  Gene Ontology: Mol. function=methyltransferase activity; Cellular component=nucleus; Biological process=fatty acid biosynthetic process
  Homolog annotation: Hit_ID=Q5N8J5; Match level="QueryCoverage=97%, HitCoverage=32%, E-value=4e-19, Identity=39%"; Hit description=S -adenosyl-L-methionine:jasmonic acid carboxyl methyltransferase-like
  Pfam annotation: Domain name=Methyltransf_7; Domain location=1-127; Score=-134.8; E_value=5.1e-07; Accession=PF03492.6; Description=SAM dependent carboxyl methyltransferase
MHLYSFFYASNSGQGEVEQEKFDSYDVHFYAPSREEIEEEVRKEGSLKLERLEMFEMDKSHNEHGSDESYGTQVAVAVRAIQESMISHHFGEGILESLFQNFAKLVDEEMAKEDIRPISFVLVLRKI

SEQ ID NO: 171376 - protein, 240 aa, Glycine max
  Coding DNA Sequence Number=SeqID_54598
  Gene Ontology: Mol. function=methyltransferase activity; Cellular component=nucleus; Biological process=fatty acid biosynthetic process
  Homolog annotation: Hit_ID=Q5N8J5; Match level="QueryCoverage=93%, HitCoverage=60%, E-value=4e-58, Identity=50%"; Hit description=S -adenosyl-L-methionine:jasmonic acid carboxyl methyltransferase-like
  Pfam annotation: Domain name=Methyltransf_7; Domain location=11-240; Score=214.8; E_value=1.9e-61; Accession=PF03492.6; Description=SAM dependent carboxyl methyltransferase
KKESDKVKHIIIQTVEELYLATTPKSIGIADLGCSSGPNTLSIIKDIFQAIQGTSQRIMHHSTEFRVYFNDLPTNDFNSIFKALPEFQKLLRQDRKNGFPSIFMGGYPGSFYGRLFPNSYLHFVHSSFSLHWLSRVPPSLYDEHKRPLNKGCVYICESSPEVVSQAYYQQFQEDFSLFLRSRSEELVVGGRMVLIFLGRRGPEHVDRGNSFFWEILSRSFAILVSQAKNDLLDTTYVEVL

SEQ ID NO: 171377 - protein, 280 aa, Glycine max
  Coding DNA Sequence Number=SeqID_54599
  Homolog annotation: Hit_ID=UPI00006615CC; Match level="QueryCoverage =59%, HitCoverage=83%, E-value=4e-07, Identity=31%"; Hit description =Homolog of Oncorhynchus mykiss "Vitelline envelope protein alpha.
EENNLVRREWNKEEKQTSSRRGKAKAKGREKAETKEGGCEEQGRGREENEQSNLEDISYYERAKEAASEAAKERNKQANKEKYATRQKGQQCNLKIENETQDNGKKDYGGAKDTITTVDHITTPLDVKTNLKSEDMTQDNGQKGYGGAKGTIGSVDHITTPLAVKANLKSEDVTQDNDQKGYGGAKDTIGSVDHITTPLVVKANLKSEDVTQDNGHKGYGGAKDTIGYVDHITTPLAVKANLKSEDVTQDNGPKGYGGAKDTIGSVDHITTPLAVKANLK

SEQ ID NO: 171378 - protein, 519 aa, Glycine max
  Coding DNA Sequence Number=SeqID_54600
  Gene Ontology: Mol. function=metal ion binding; Cellular component =cytoplasm; Biological process=sperm axoneme assembly
  Homolog annotation: Hit_ID=Q4YV31; Match level="QueryCoverage=84%, HitCoverage=24%, E-value=6e-17, Identity=23%"; Hit description=MAEBL, putative
LASDRARSGNIVKDKEVEERRRGRESGGGVQHVRKFETKGEEKKRLGEEAELEGITRVVVERECNKEEKQRSMPRGNVEAQKARSMERTREEAKGREQTETKGQIMKGGGEEQGRRREENKQSNLEEISKYSEAQQKTMKAIEGAKERYERAQQEASEASKERNGQANEGAEEGRRESGGDVHGVAKFETKGEEKKDSVGKAELEGRTRVVVRRDWNKEEKQRCKPRWEVEVEKARPMEKTEEEARTEQAGTKGQIKKMTGSVWLQDLEKGISPDTSFLVRAFNFLCRAEAQEKVKERNERAKKAANEVAKERNKQTTKGKDVTREKGQQGKLKTENGTQDNAANEVAKERNKQTTKGKDDTIRSVDHITTPLAGKTKVTASTTAQYVEEKSAQAKNATVGSMEKTTEDAKGREKAGTKGQIKKGCDEEQGRTREKTGEENKQSNLEEISKHKAEAQQKAMNAIEGAKERYERAKTKTTSKASKERNVKANEGAEGGRREAESGGGVHHVAKFEEKKTS

SEQ ID NO: 171379 - protein, 55 aa, Glycine max
  Coding DNA Sequence Number=SeqID_54601
MVDGYDHGALDLFIVVAFVGVGIILGNCIVNFVEATHHSTANQHASRRKVDTIMK

SEQ ID NO: 171380 - protein, 257 aa, Glycine max
  Coding DNA Sequence Number=SeqID_54602
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9SIN2; Match level="QueryCoverage=92%, HitCoverage=65%, E-value=5e-92, Identity=63%"; Hit description =Expressed protein
  Pfam annotation: Domain name=DUF231; Domain location=197-257; Score= -51.5; E_value=0.002; Accession=PF03005.6; Description=Arabidopsis proteins of unknown function
MGLPLVHALFLTLFLLCLQTKAEDFGATRKLAGTCNLFSGKWVYDASNPLYDPSTCPFIDPQFNCQKHGRSDKLYQKYRWMPFSCPLPRFNGLNFLQRYSGKKIMFVGDSLSLNQFNSLACMLHAWVPKSRSTFSQRDALSKVAFEDYGLELYLYRTAYLVDLDREKVGRVLKLDSIKNGDSWMGMDVLVFNTWHWWTHTGSSQPWDYVQVNNKLFKDMNRFLAYYKGLTTWAKWVQRNVNPAKTKVFFLGISPVHY

SEQ ID NO: 171381 - protein, 120 aa, Glycine max
  Coding DNA Sequence Number=SeqID_54603
GDAPQASGAPPPPHQAGPDGSFDVEQYLRHLVRQQAANHRAHVQTHDCLYQLSLSMQSQGFASFSCPTPDQFRAEVAWPGDWPEAQAGEAPPGAPDDGEEAHEDEEMADLLDFLGGSGAT

SEQ ID NO: 171382 - protein, 154 aa, Glycine max
  Coding DNA Sequence Number=SeqID_54604
  Subcellular localization annotation: CTP_CleavageSite=22; ConfidenceScore=5.12e-01
MQLQQVEKSRNSLEVFGSPILSSRSKSSSFDKKLAKTSSSSWDVAPKIEETNFSAISGGNYNDVDSDASSNFNVNIDSEKKKNSLGIKIAAGIATVASALAISAIIIFLISRRNMKYQKKIFRKRMSIEMDGYRTMKFHFLTQNDVHLIMRNYV

SEQ ID NO: 171383 - protein, 77 aa, Glycine max
  Coding DNA Sequence Number=SeqID_54605
MNHLWNKRGYCMSRARCAMTFFHFTGSSRVVVESSGLEPNHNLAEPTVNFQANHDVPMVGTTVQHKGPINVIMSNPV

SEQ ID NO: 171384 - protein, 76 aa, Glycine max
  Coding DNA Sequence Number=SeqID_54606
  Subcellular localization annotation: CTP_CleavageSite=39; ConfidenceScore=5.75e-01
MAHTSSTINPRFLSPSSSHSPRPPPPPSPPPCTSFRQCRSPTGADSLLLLPRVLLVHAGECAAYTDEKTPPPSLTS

SEQ ID NO: 171385 - protein, 81 aa, Glycine max
  Coding DNA Sequence Number=SeqID_54607
MRQKATTLERTPQVTVDPPSPMVDLSYPQQAANPPTLVLEMPDDPATPVLRLTSTPPVTPVLQFTDEEDTQDQDTQQQDQS

SEQ ID NO: 171386 - protein, 48 aa, Glycine max
  Coding DNA Sequence Number=SeqID_54608
MYFKGQYPETQKNSLNYVALASQSFTAQQFIVHWLKLNINSTVAVQDL

SEQ ID NO: 171387 - protein, 50 aa, Glycine max
  Coding DNA Sequence Number=SeqID_54609
MTKNEMKLTGVVIMVMLVMGFVEADFNSPFVQIESNNAHGRAVYVVDSCL

SEQ ID NO: 171388 - protein, 66 aa, Glycine max
  Coding DNA Sequence Number=SeqID_54610
MTIEQAQEVALVCIKNKLKRLLKRLALTDPLKLLQEHNKGKGNFTKEKKHRVVTMLELNMRYPSHV

SEQ ID NO: 171389 - protein, 78 aa, Glycine max
  Coding DNA Sequence Number=SeqID_54611
  Gene Ontology: Mol. function=oxidoreductase activity; Cellular component=vacuole; Biological process=response to oxidative stress
  Homolog annotation: Hit_ID=P93551; Match level="QueryCoverage=79%, HitCoverage=20%, E-value=6e-16, Identity=60%"; Hit description =Peroxidase precursor
  Subcellular localization annotation: CTP_CleavageSite=19; ConfidenceScore=5.16e-01
MGHTWLGSLVIFMTISAVQAQLKTGFYSSSCPNAEATVRSTVESYFNKDPTIAPGLLRLHFHDCFVEVCYFDLHLSLT

SEQ ID NO: 171390 - protein, 197 aa, Glycine max
  Coding DNA Sequence Number=SeqID_54612
  Gene Ontology: Mol. function=oxidoreductase activity; Cellular component=vacuole; Biological process=hydrogen peroxide catabolic process
  Homolog annotation: Hit_ID=O80822; Match level="QueryCoverage=98%, HitCoverage=59%, E-value=8e-81, Identity=70%"; Hit description =Peroxidase 25 precursor
  Pfam annotation: Domain name=peroxidase; Domain location=1-154; Score= 93.9; E_value=5e-25; Accession=PF00141.13; Description=Peroxidase
MSDGPSWSVPTGRRDGRVSLSSQASNLPSPLDSISVQRKKFADKGMDDHDLVTLVGAHTIGQTECRFFSYRLYNFTTTGNSDPTIDQNFLGQLKTLCPNIGDGLRRVSLDKDSPAKFDVSFFKNVRDGNAVLESDQRLWGDSNTQSIVQSYAGNIRGLLGIRFDYEFRKAMVKLGGVEVKTGSQGEIRKVCSKVNRY

SEQ ID NO: 171391 - protein, 162 aa, Glycine max
  Coding DNA Sequence Number=SeqID_54613
MPLPLGGIQFGISVWLMLIAWVRVSLQDRVTLKRDQQSCLDENVVDDNSRLYEDWLKAKRLRKKKVQRKFLENKKDDFKSKSMKSFGRIVHWICMHFVLPRVGTFQRPFGVSLDGELVDNDVLSWDAKNVVALKLSPQPGMEKACMFSDEEEDQNKDFIKSS

SEQ ID NO: 171392 - protein, 46 aa, Glycine max
  Coding DNA Sequence Number=SeqID_54614
MEEESGDLALMQCFLSVKDLSLMYHLDTVNSHKGEKQDVRAVGGSC

SEQ ID NO: 171393 - protein, 57 aa, Glycine max
  Coding DNA Sequence Number=SeqID_54615
MRGYLMVTRTFRQPGENEPVDARRLTSSSAPFVVLTRELSQVTCGVTLWLPAPFVNQ

SEQ ID NO: 171394 - protein, 80 aa, Glycine max
  Coding DNA Sequence Number=SeqID_54616
MVIFSHGAAAEDKGEKERLHRQESALDKKLREEASMEEEDERERESGVTHVSTHTPPIAKFTPMPKYMKIQWEASLRTKE

SEQ ID NO: 171395 - protein, 102 aa, Glycine max
  Coding DNA Sequence Number=SeqID_54617
MDKLKRLREGSMSVEEYRQQTELLLLRVGLREEKRTSIARILSGLNMEVRDKVELLPYRDLDDLVQLCMTKDQGQGILGAAPSKPKDDKGKTIEKQPPKASM

SEQ ID NO: 171396 - protein, 63 aa, Glycine max
  Coding DNA Sequence Number=SeqID_54618
MDPQQKFLRKGWPSFGDNKLEEKKESKVLKFYVEFVFMGHGSCNNHVNCFEKYRSSCHGSSSV

SEQ ID NO: 171397 - protein, 287 aa, Glycine max
  Coding DNA Sequence Number=SeqID_54619
  Homolog annotation: Hit_ID=Q2HSX6; Match level="QueryCoverage=96%, HitCoverage=89%, E-value=1e-101, Identity=60%"; Hit description =Cyclin-like F-box
MDLTRMSEVCTFLRDRCRSDPLWELHMKQKWGGVIGDVAYKEWLWHITTPKEKGINQLNQHNNQNGSMGPFSGTWPMLYLRSYLEDCSYLNSSSLANSFMMALYFSLENGNFWFPAQIYRGLYFRDALVRYDSKTDNFQARQQNAGWKIMGNNIQWDKLRAPPVDTLPSVRYVSDCLQDLKPGDHIELQWKSSRDIPYDWWYAVIGHMESCNENENFCRCRYSETLIVEFEQYPLGSRMRRVKLLKNGDQCEESTGCYGGIRKLYSEEEIQRWENILSRGMAGTRVK

SEQ ID NO: 171398 - protein, 455 aa, Glycine max
  Coding DNA Sequence Number=SeqID_54620
  Gene Ontology: Cellular component=integral to membrane; Biological process=transport
  Homolog annotation: Hit_ID=Q6YZX7; Match level="QueryCoverage=90%, HitCoverage=91%, E-value=1e-147, Identity=63%"; Hit description =Auxin efflux carrier protein-like
  Pfam annotation: Domain name=Mem_trans; Domain location=15-435; Score= 430.0; E_value=3.3e-126; Accession=PF03547.8; Description=Membrane transport protein
MYENTMRSSGADLTAAMVPLLKLLCLTVIGLLLANPTMQFIPKATFKLLSKLVFALFLPCLIFTELGESITLENFVDWWFIPVNVLVSTALGCLLGFLVVIICHPPPELTRFTIIMTGFGNTGNLLLAVVGSVCHTKDNPFGKHCNTRGVAYVSLSQWVSVILVYTLVYHMMEPPMEYYEVVEEGAEIEQERTLNDISRPLLVEAEWPGIEEKETEHSKTPFIAGIFKSISGVSSSNIPELEVTAESGGTSSPKSIRCLAEPRVVRRIRIVAEQTPIQHILQPPTIASLLAIIIGTVPQLKAVFFGYDAPLSFITDSLEILAGAMVPSVMLILGGMLAEGPNESKLGLKTTIGITFARLLVLPVLGIGIVALSDKLNFLVENDAMFRFVLLLQYTTPSAILLGAIASLRGYAVSEASALLFWQHVFALFSFSFFTVFDWLDVFARLDDCCHCIVL

SEQ ID NO: 171399 - protein, 196 aa, Glycine max
  Coding DNA Sequence Number=SeqID_54621
MGEVEEVQEHMKADIEAMKVQMATMMEANMSMKEIMEVNAAVAKYERPHDVQIQNEHAFLPYGLPPNYTPPNVAYTPNENVNKSTPILIKSQQPQTNHAHVSQTMGETHEIPHHNLVDFEPCLRYATEGQAVGGIPLQNTLEGPQYRPQPQPLHSTPGINPHAMAEMGELDHLEERLRDIEGGEDYAFANLEELFL

SEQ ID NO: 171400 - protein, 34 aa, Glycine max
  Coding DNA Sequence Number=SeqID_54622
MAGFSKVVSQGADADQISISHSLVLGYGEFVPNS

SEQ ID NO: 171401 - protein, 145 aa, Glycine max
  Coding DNA Sequence Number=SeqID_54623
MTEKEMITIIVDTLPIFYYEKMVGYTPSNFTNLVFTSERIEVGLRSGKFDYPALMNEKAGAYREDEKEEGTHAMTAVPTWKNFPPAQQCHYLANISPSHYPPPNQPQRPSPNQPQSQSAAHPMPNTALNTNQSTNQGGNFPAKQH

SEQ ID NO: 171402 - protein, 103 aa, Glycine max
  Coding DNA Sequence Number=SeqID_54624
MARNRLRVVKNLGRKIWIEVKKIENGIVGIPRRHLEEKTKALADQGKWASFIDVLALLVFGVVLFPNMDGLVDLAAIDAFLTCHHSKESPVIAVLANAYDTFD

SEQ ID NO: 171403 - protein, 156 aa, Glycine max
  Coding DNA Sequence Number=SeqID_54625
  Homolog annotation: Hit_ID=Q1RTB4; Match level="QueryCoverage=60%, HitCoverage=21%, E-value=4e-09, Identity=35%"; Hit description=IMP dehydrogenase/GMP reductase
MERRKSRGFVSCEGFSNVPLMGTRGCINYNLVLAIRQLDYPMRGAPLEESITPFITWGFSDPNARILQRVHKAWRAVQKKDKELRGSRNGINVSYHKWLKAQMQELDWLLKVKVSSEEGAKIPEESEEVQALKVELERAQVVKEKFKTTSIKVWKE

SEQ ID NO: 171404 - protein, 77 aa, Glycine max
  Coding DNA Sequence Number=SeqID_54626
MAPKKLPAKRSRKDVARKGSSAAPQADVDFDRHRFWSEEHQQRFEAIKGVKASFMMMNQVDSSSFDDNKDDDKKPKE

SEQ ID NO: 171405 - protein, 573 aa, Glycine max
  Coding DNA Sequence Number=SeqID_54627
  Gene Ontology: Mol. function=ATPase activity, coupled to transmembrane movement of substances; Cellular component=integral to membrane; Biological process=transport
  Homolog annotation: Hit_ID=Q8ZRB4; Match level="QueryCoverage=65%, HitCoverage=63%, E-value=1e-153, Identity=72%"; Hit description =Putative ABC superfamily (Atp) transporter
  Pfam annotation: Domain name=ABC_tran; Domain location=172-356; Score= 199.6; E_value=7.1e-57; Accession=PF00005.17; Description=ABC transporter
AAFSSVNDQTQESLTSIRMIKAFGLEDHQSSQFADIASDTGRKNLHVARVDARFDPIIYIAVGFSNLLAIGGGGWMVWHGSLTLGQLTSFVMYLGLMIWPMLALAWMINIVERGSAAWSRIRALLAEAPAVEDGNQLLPAEAGVLQVAIRAFHYPASSAPVLSNVHFQLQPGQMLGLCGPTGCGKSTLLSLIQRHFDIDQGEICYHAIPLPQLRLDSWRSRLAVVSQTPFLFSDTVANNLALGRPEATQEEIERVAQMACVHDDILRLPQGYATEVGERGVMLSGGQKQRIAIARALLLNAEILILDDALSAVDGRTEHEILHNLRQWGKGRTLIISAHRLSALTEASEILVLQQGAVAQRGDHDTLAAQPGWTRQNREPTMAKSQRLWPTLKRLLAYGKPWRKSLWLAVGMLWIAAAAEVTGPVLLLAAGLHYFQALLFNRAAIGVVQQLRVDVMNAALRQPLSAFDTQPRCADWRDAGGDVCTRLAYGAGGAGDFPAGVNGDADLSALQHADCAPRALWRAHGRSQPIALSGADGDAAAGRLFAASAAQPVFCTDIVRSANAVQLCYAGRV

SEQ ID NO: 171406 - protein, 46 aa, Glycine max
  Coding DNA Sequence Number=SeqID_54628
MARVALGAQGFSDEECQAKGSRRKTSSAYLSRKRGLVMAHLFLAIL

SEQ ID NO: 171407 - protein, 145 aa, Glycine max
  Coding DNA Sequence Number=SeqID_54629
MPISPCRCISWDRAHKTPSGPEEVQQGPGVSSSGYGPLDRTHKTPSGPEEVQQGPGVSNSDYGPLSVLQGAHSPSEESHPQRHSVDPEKSNRGLGFPALVTGLRSPTGCLFPPARSHHHDIGKDCACKTPSGPEEVQQGLGVVKL

SEQ ID NO: 171408 - protein, 274 aa, Glycine max
  Coding DNA Sequence Number=SeqID_54630
MTRRLLAGSLAFECRIMHYLIVRILLPRSSNLAQVYEEDLIIMWVFLTGRQIDWVHLVRYRMHKALQSNAPLSYPHLITLFLQHFNVPLDSEPFVKVKRSFSIGANVVSSFGYRKERDGSWVKKDAPVQAAEDRSPSPHSERDDSSSLMHSILDRLDGLHTFVGERFDSLDSHIDAMDARFAGMDTRIIKLEKDDSHHQKGGDYGSNDFQDYFDDAKESRVKQVPKNQESKSFKNQVSRFKIQEQSSFKNLDSRTIKIKIQDSIFKNQEKTQSR

SEQ ID NO: 171409 - protein, 71 aa, Glycine max
  Coding DNA Sequence Number=SeqID_54631
MANGYTQVIIRTKTTSVDPDPCARWQADIPQVVIRTKTTFVDPDPCVRGQADIPKRTYPSDCPYKYNICRS

SEQ ID NO: 171410 - protein, 151 aa, Glycine max
  Coding DNA Sequence Number=SeqID_54632
  Gene Ontology: Mol. function=unspecific monooxygenase activity
  Homolog annotation: Hit_ID=O04892; Match level="QueryCoverage=53%, HitCoverage=15%, E-value=2e-20, Identity=64%"; Hit description =Cytochrome P450 like_TBP
MSRRARRSLQNPGREPGRSGRRCRSWCLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGDPTV

SEQ ID NO: 171411 - protein, 85 aa, Glycine max
  Coding DNA Sequence Number=SeqID_54633
MCPLSFRNNKLGGKRAETDSAPFIIQEQRVEWNNKLGGKRAETDSTPFVIRGQFRWQGGSLAEWCFARTKLVSYLYFPFISNKRQ

SEQ ID NO: 171412 - protein, 323 aa, Glycine max
  Coding DNA Sequence Number=SeqID_54634
MSSRKRKSIGARPTAQYDTRRFHSFEAWTRYSDNELGRHILAERKVEIYHTELDEFKAELERRNFHKRLTNLADSSIDLALVKEFYANLYSPEGPSPKQVRIRGRVIRIDADSLNTFLETPVVLAEGESLPAYFRYCRMPTDIREIEAALCIPNRGSVLNAEGHPGKILRKDLTTLAQELSSMARSRLWPSLNSFRLGFPTLIKALCRSRGVASDSPIFERLSPIINLAYIRKNCWNHADLTVTIRGARRARARPAEAPSTSAAPPPARTSAASSTPSSADFQRLEAMLRSIHQGQIFLLQSLQLVAPLDSIPSVEQFNERVA

SEQ ID NO: 171413 - protein, 102 aa, Glycine max
  Coding DNA Sequence Number=SeqID_54635
  Subcellular localization annotation: CTP_CleavageSite=16; ConfidenceScore=5.23e-01
MLVATPRVFLSWKTHPASLASPYRRRVVSYPNFVRGPLLDDMRPFFGPCEHPGPLGPLRIFLQKAVASGGSNLARLGELGGNHLPYFAINRGGSEKEKGSAP

SEQ ID NO: 171414 - protein, 182 aa, Glycine max
  Coding DNA Sequence Number=SeqID_54636
TSVIVEEGESLCAYSRFALLRPDPQELAAKLCVPGRGFELNADGKPLKILWKNITTLAQTWSVLSFSNLIPTSHTSDVTLDKAIPIYGIIMKMDMNAGYLISHQISLTTQDDTSRLAFPTLITTLCKARRVQSGSRSLESLSLTINLAYIKKNCWNLDDPIVTFRGPKKARGKRYEALSTAP

SEQ ID NO: 171415 - protein, 77 aa, Glycine max
  Coding DNA Sequence Number=SeqID_54637
  Gene Ontology: Mol. function=transition metal ion binding; Cellular component=cytoplasm; Biological process=fucose metabolic process
MYKCLRCEYQRYKVKDDDECSSDKNSKKRPQTKVLWYLPIILRFKHMFANGDDANDLTWHANGRNCDGMLRHPTDSS

SEQ ID NO: 171416 - protein, 111 aa, Glycine max
  Coding DNA Sequence Number=SeqID_54638
VMARSLDKIKSIDGSKETLKLSVRISYLWFIGMPNKSEQAEMVFVASDGDEIHVVCKQDQLKECVLGDIPFRKYRFARFADVVDGQFERGLLVDVIGVVEEVFGKFQEKVE

SEQ ID NO: 171417 - protein, 47 aa, Glycine max
  Coding DNA Sequence Number=SeqID_54639
MTLKDRGASAAPKRNAAFRQWHRLASNRSGEPWRDQKKRAATAGAAR

SEQ ID NO: 171418 - protein, 354 aa, Glycine max
  Coding DNA Sequence Number=SeqID_54640
  Gene Ontology: Mol. function=oxidoreductase activity, acting on the CH-OH group of donors, NAD or NADP as acceptor; Cellular component =cytoplasm; Biological process=lignin biosynthetic process
  Homolog annotation: Hit_ID=Q13NX7; Match level="QueryCoverage=93%, HitCoverage=95%, E-value=1e-147, Identity=76%"; Hit description=Zinc- containing alcohol dehydrogenase superfamily
  Pfam annotation: Domain name=ADH_N; Domain location=28-145; Score =125.9; E_value=1.2e-34; Accession=PF08240.2; Description=Alcohol dehydrogenase GroES-like domain
  Pfam annotation: Domain name=ADH_zinc_N; Domain location=175-310; Score=130.2; E_value=5.6e-36; Accession=PF00107.16; Description=Zinc- binding dehydrogenase
  Pfam module annotation: Pfam domain module=ADH_N::ADH_zinc_N; Domain location=28-145::175-310
MNITHAYAAQDAKAKLAPFDYKPRELRAHDVQIEVLYCGVCHSDLHQARNEWRNTVFPVVPGHEIVGRVTAVGAHTHKYKVGDLVGVGCMVDSCRSCPSCQEGLEQYCENGFVGTYNGQDRETGAITYGGYSTSMVVDESFVLRVPENLHLAGVAPLLCAGITTYSPLRHWNVGPGKKVGIVGLGGLGHMGVKIAHAMGAHVVLFTTSPSKIEDGKRLGADEVVISKDADQMAQHTNSFDFILNTVAAQHDLNPFIALLKRDGNMTLVGAPEHDHPAPQVFNLILKRRSIAGSLIGGIAETQEMLDFCGKHGITSDIELIAMNQINDAYERMLKSDVKYRFVIDINTLREESAA

SEQ ID NO: 171419 - protein, 125 aa, Glycine max
  Coding DNA Sequence Number=SeqID_54641
MGSNTFLSLKIPVNEKHETGVFKAVAKTMDTSRLPSRTLAIPASLVKKGSKGLKILVWHKPIKLVEHISFMYIRFNQDFVGFDGCLLDPETKSKGRAKWSFFKISDIHSPRLASSSHGLIRFLQP

SEQ ID NO: 171420 - protein, 101 aa, Glycine max
  Coding DNA Sequence Number=SeqID_54642
MTSRTTMPSPWRFSRALPLPRHHVPLRAEIELEEAGLASFEPEETTTNNTNKMLTTMGNESDYENQSMLGRAGMPQYDSYGEGIIVIDHNELPYYLSLIEC

SEQ ID NO: 171421 - protein, 323 aa, Glycine max
  Coding DNA Sequence Number=SeqID_54643
  Homolog annotation: Hit_ID=Q9FGR6; Match level="QueryCoverage=31%, HitCoverage=30%, E-value=9e-44, Identity=73%"; Hit description =Arabidopsis thaliana genomic DNA, chromosome 5, TAC clone:K6A12
MNSEQDLEQGGSWGAGDEHEDVVGGRVHVWRAPGLDGEAVAAGSEDEVVAGGHVGLVEREGLVGVVDLEDPVGAGAHVEHENVVHAEEEVAEAGVAATVLECERVVDGIKYAERMRYSAESNEGMKGKLKGIVLLRATQSLSQSQKYPRNDSSARQPSIFYNFHFHSVDFAVPPIMEVPDNSEATVPYNSPSLAGTVNWGTATVVGVFAGMLYGGSKEAAASVDAEVMLKLGSTEDKREQYRLMRDAMEKRFIRVTRGSIVGGVRLGMFTAAFYGIRNLLAEKRGVHDVFNDVGAGSATASAFGLISKKSYTYCTFYIVTWAG

SEQ ID NO: 171422 - protein, 297 aa, Glycine max
  Coding DNA Sequence Number=SeqID_54644
  Homolog annotation: Hit_ID=Q9FGR6; Match level="QueryCoverage=75%, HitCoverage=66%, E-value=1e-100, Identity=68%"; Hit description =Arabidopsis thaliana genomic DNA, chromosome 5, TAC clone:K6A12
MPSLLSALYLILSAYLIPLCLSHPNTCRSYCGNITIDYPFALQYGCGHPGFRDLLFCMNDVLMFHVSSGSYRVLEIDYAYQALTLHEPHMSTCDNLVLGTRGNGFSVEPWRAPYMNPAADNVFMLIACSPRSPLFQGFPGKHLPCRNVSGMGCEDYYACPAWEMLGHKRLGSASFFGSGPPECCAVPYEAIRGINLTKLECEGYSSAYSVAPLKVDGPGGWSYGIRVRYSVQGNDEFCGACEATAGTCGYGSDGIRQLAYRQEQGLYVRGIIDVCASVGDNQPDFKSVVYYVRLGHE

SEQ ID NO: 171423 - protein, 203 aa, Glycine max
  Coding DNA Sequence Number=SeqID_54645
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=97%, HitCoverage=60%, E-value=1e-37, Identity=43%"; Hit description=MRNA, complete cds, clone: RAFL21-92-C23
MHGCYQHLKKASGDKVGNVDGDAEQGIYDASTPPQGSNPSNHEKGLGAPQEHLVRQPASTWGYIFQILFQMIAGAVMLTDCVFWFIIVPFLTIKDYNINLLIISMHTINAVFLIGDTALNSLRFPWFRIGYFCMWTITYVLFQWIVHAIVKLWWPYPFLDLSSPYAPLCASKLLFHGIAAYSVLWHIRFDNEAEAQRVVDAVP

SEQ ID NO: 171424 - protein, 572 aa, Glycine max
  Coding DNA Sequence Number=SeqID_54646
  Gene Ontology: Mol. function=protein serine/threonine kinase activity; Cellular component=integral to membrane; Biological process=protein amino acid phosphorylation
  Homolog annotation: Hit_ID=Q5VQM7; Match level="QueryCoverage=95%, HitCoverage=57%, E-value=1e-142, Identity=41%"; Hit description =Putative receptor-like protein kinase INRPK1
  Pfam annotation: Domain name=LRRNT_2; Domain location=28-68; Score =54.0; E_value=5e-13; Accession=PF08263.3; Description=Leucine rich repeat N-terminal domain
  Pfam annotation: Domain name=LRR_1; Domain location=120-142; Score =12.8; E_value=1.2; Accession=PF00560.23; Description=Leucine Rich Repeat
  Pfam annotation: Domain name=LRR_1; Domain location=144-166; Score =15.6; E_value=0.18; Accession=PF00560.23; Description=Leucine Rich Repeat
  Pfam annotation: Domain name=LRR_1; Domain location=168-190; Score =11.8; E_value=1.8; Accession=PF00560.23; Description=Leucine Rich Repeat
  Pfam annotation: Domain name=LRR_1; Domain location=192-215; Score =8.3; E_value=7.9; Accession=PF00560.23; Description=Leucine Rich Repeat
  Pfam annotation: Domain name=LRR_1; Domain location=217-239; Score =7.9; E_value=9.5; Accession=PF00560.23; Description=Leucine Rich Repeat
  Pfam annotation: Domain name=LRR_1; Domain location=241-263; Score =4.6; E_value=39; Accession=PF00560.23; Description=Leucine Rich Repeat
  Pfam annotation: Domain name=LRR_1; Domain location=265-287; Score =15.0; E_value=0.28; Accession=PF00560.23; Description=Leucine Rich Repeat
  Pfam annotation: Domain name=LRR_1; Domain location=289-311; Score =13.8; E_value=0.61; Accession=PF00560.23; Description=Leucine Rich Repeat
  Pfam annotation: Domain name=LRR_1; Domain location=313-335; Score =9.8; E_value=4.2; Accession=PF00560.23; Description=Leucine Rich Repeat
  Pfam annotation: Domain name=LRR_1; Domain location=337-359; Score =14.2; E_value=0.47; Accession=PF00560.23; Description=Leucine Rich Repeat
  Pfam annotation: Domain name=LRR_1; Domain location=361-383; Score =16.9; E_value=0.075; Accession=PF00560.23; Description=Leucine Rich Repeat
  Pfam annotation: Domain name=LRR_1; Domain location=385-407; Score =16.3; E_value=0.11; Accession=PF00560.23; Description=Leucine Rich Repeat
  Pfam annotation: Domain name=LRR_1; Domain location=409-431; Score =12.9; E_value=1.1; Accession=PF00560.23; Description=Leucine Rich Repeat
  Pfam annotation: Domain name=LRR_1; Domain location=433-455; Score =8.8; E_value=6.6; Accession=PF00560.23; Description=Leucine Rich Repeat
  Pfam annotation: Domain name=LRR_1; Domain location=457-479; Score =10.9; E_value=2.6; Accession=PF00560.23; Description=Leucine Rich Repeat
  Pfam annotation: Domain name=LRR_1; Domain location=481-503; Score =15.8; E_value=0.15; Accession=PF00560.23; Description=Leucine Rich Repeat
  Pfam annotation: Domain name=LRR_1; Domain location=505-527; Score =11.3; E_value=2.2; Accession=PF00560.23; Description=Leucine Rich Repeat
  Pfam annotation: Domain name=LRR_1; Domain location=529-551; Score =12.7; E_value=1.2; Accession=PF00560.23; Description=Leucine Rich Repeat
  Pfam annotation: Domain name=LRR_1; Domain location=553-572; Score =7.6; E_value=11; Accession=PF00560.23; Description=Leucine Rich Repeat
  Pfam annotation: Domain name=LRR_1; Domain location=72-94; Score=1.9; E_value=1.3e+02; Accession=PF00560.23; Description=Leucine Rich Repeat
  Pfam annotation: Domain name=LRR_1; Domain location=96-118; Score =12.2; E_value=1.5; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1; Domain location=...
  Pfam module annotation: Domain location=28-68::120-142::144-166::168 -190::192-215::217-239::241-263::265-287::289-311::313-335::337 -359::361-383::385-407::409-431::433-455::457-479::481-503::505 -527::529-551::553-572::72-94::96-118
MPVNPWTLFFLCISLLLLPFHFLLAAAVNQQGEALLSWKRTLNGSLEVLSNWDPVQDTPCSWYGVSCNFKNEVVQLDLRYVDLLGRLPTNFTSLLSLTSLIFTGTNLTGSIPKEIGELVELGYLDLSDNALSGEIPSELCYLPKLEELHLNSNDLVGSIPVAIGNLTKLQKLILYDNQLGGKIPGTIGNLKSLQVIRAGGNKNLEGLLPQEIGNCSSLVMLGLAETSLSGSLPPTLGLLKNLETIAIYTSLLSGEIPPELGYCTGLQNIYLYENSLTGSIPSKLGNLKNLENLLLWQNNLVGTIPPEIGNCEMLSVIDVSMNSLTGSIPKTFGNLTSLQELQLSVNQISGEIPGELGKCQQLTHVELDNNLITGTIPSELGNLANLTLLFLWHNKLQGSIPSSLSNCQNLEAIDLSQNGLMGPIPKGIFQLKNLNKLLLLSNNLSGKIPSEIGNCSSLIRFRANDNNITGSIPSQIGNLNNLNFLDLGNNRISGVIPVEISGCRNLAFLDVHSNFLAGNLPESLSRLNSLQFLDASDNMIEGTLNPTLGELAALSKLVLAKNRISGSIPSQL

SEQ ID NO: 171425 - protein, 112 aa, Glycine max
  Coding DNA Sequence Number=SeqID_54647
MLSWLVRGFKWRHDLKVWLLPLLVVVLIATTIFNGRPLHLYQSHEVDTTMVTREKGRQNNLMTLYDTLFTQVRINMRVKVLDETNGRREWGQSGDKFMIVVWFVLVVVTRVC

SEQ ID NO: 171426 - protein, 99 aa, Glycine max
  Coding DNA Sequence Number=SeqID_54648
MVSCEKCHPSVATWWIGNNLPILIYETTSFSFYRVPSLIKGEAPENEFNAKVLDLLHQWSPSILEVQWQQNGEGRKMIGDATSRRRSVKHKLTTIGSHG

SEQ ID NO: 171427 - protein, 91 aa, Glycine max
  Coding DNA Sequence Number=SeqID_54649
  Gene Ontology: Mol. function=RNA-directed DNA polymerase activity; Cellular component=chromatin; Biological process=RNA-dependent DNA replication
MVKKATGKWRMCVDYTDLNKACPKDAYPFPNIDKLVDGACGFKLLSFLEGYSGDNQIKMYPHDQEKTTFIATEAKFCYKLYSNPNVLGERV

SEQ ID NO: 171428 - protein, 59 aa, Glycine max
  Coding DNA Sequence Number=SeqID_54650
MTKLKIQMNTLKSTLCRGKNYNLNGYRGKGRGARKGGFIGGYASGCNNKNQQATNEGNP

SEQ ID NO: 171429 - protein, 123 aa, Glycine max
  Coding DNA Sequence Number=SeqID_54651
MESPISICDTEIPLQMQSIDAFTASYVKSLHSLRATAQETARCQVQLDEVKSKLRETEDDFVKALAVKTRKEAKRMALMDAIASAKARVEDLNASIQEQRTKKQEYAAFISQQSLGNTPPSLS

SEQ ID NO: 171430 - protein, 140 aa, Glycine max
  Coding DNA Sequence Number=SeqID_54652
MKRRTDDFIGNRDVPGAPPLVEVPARLPLVVAPGSLPLLVAPGREALLVAPGRQTRPPLSHRPVQSSHVSRSGGTRSSATNIGIASGQIIMCAGLRRQVCFLCWSQTSNESLSIIWHTVLAREGNIVNLSGMKSSSLALI

SEQ ID NO: 171431 - protein, 105 aa, Glycine max
  Coding DNA Sequence Number=SeqID_54653
MAPKKLSAKRSRRDAAAEGTSAIPEFDSCRNLPFCGRARRGSRVDKSGALAPTYPPSKRKSNLRSSLLRVNQAILFTWKVIILRRWTLKMIHLLVIFVDELDFAS

SEQ ID NO: 171432 - protein, 87 aa, Glycine max
  Coding DNA Sequence Number=SeqID_54654
  Gene Ontology: Mol. function=ribonuclease H activity
  Homolog annotation: Hit_ID=Q1RYI2; Match level="QueryCoverage=84%, HitCoverage=11%, E-value=6e-13, Identity=45%"; Hit description =Ribonuclease H
MAWRNLFKPKNVGELGLRMAKDVNRAFIMKCGWELCTKRDFLWVQIICSKYDYGESIFPHIDQNRTRSNLWKGNCEIASFSESAWVC

SEQ ID NO: 171433 - protein, 185 aa, Glycine max
  Coding DNA Sequence Number=SeqID_54655
  Gene Ontology: Mol. function=RNA-directed DNA polymerase activity; Biological process=RNA-dependent DNA replication
MFAIGKLTNVLQSVIPHWEGPKRTQVLRWKMASNALLTNDQRLARHLNMDATCLRCKGIYENIDHIFRFCLTSKVVWYFLFPASKHKEFFHKDTNAWMLQNIKGTNLVKGRSWCLIFGISIDIIWQNRNQSIFEGLISHPSDRVKHILAKVEVVHEILKQSMKFNSPGRIVKHKGGVRWNSPPHG

SEQ ID NO: 171434 - protein, 416 aa, Glycine max
  Coding DNA Sequence Number=SeqID_54656
  Gene Ontology: Cellular component=nucleus
  Homolog annotation: Hit_ID=Q1SKF0; Match level="QueryCoverage=83%, HitCoverage=95%, E-value=2e-45, Identity=63%"; Hit description =FKBP12-like protein
  Subcellular localization annotation: CTP_CleavageSite=49; ConfidenceScore=5.07e-01
MASPPHFDDVSPNIFHPSPLAFSRAICLTFSISSQTQDFDFGGGFSGTQSGNKRPSPDYDEDEYENDPFGHKKAKSKAEEAASGVTTGMILSLRESLQNCKDMLATCQNELEAAKSEIQKWHSSFQNEPFISAGTTPAPKSVINYLQALKSSEESLREQLEKAKKKEAAFIVTFAKREQEIAELKCAAMQALLRLRFVMRLKFWHNGVAAIRSYGGYLASPGAAVKLCLGDLLVMGSNPETASLHMQGASPGAAVKLCLGDLLVMGSNPETASLHMQGFVMTLLLTLGTDPAGIFFANARRLLLDPAVHEEFTRLKDKKVKELQDNIAAVNFTPQSKMGKMLMAKCRTLQEENEEIGNQASEGKVLMLQDKLEEKDQEIQRLKDELQPKSLVVEDEKTDPASNRNYDETIPTEAAK

SEQ ID NO: 171435 - protein, 344 aa, Glycine max
  Coding DNA Sequence Number=SeqID_54657
  Gene Ontology: Mol. function=oxidoreductase activity; Cellular component=endoplasmic reticulum; Biological process=metabolic process
  Homolog annotation: Hit_ID=Q1SKE5; Match level="QueryCoverage=99%, HitCoverage=99%, E-value=1e-150, Identity=79%"; Hit description =Short-chain dehydrogenase/reductase SDR
  Pfam annotation: Domain name=adh_short; Domain location=58-239; Score= -9.5; E_value=2.3e-05; Accession=PF00106.15; Description=short chain dehydrogenase
MKATLRYLAGLAGPSGFGSNSTAEQVTEDCCSLLPSNLTALITALPSDLPEADQHECGATSGIGAETARVLAKRGVRVVIGARDLRKAKEVREKIQKESPHAEVILLEIDLSSFASVQRFCSEFLALELPLNILINNAGMYSQNLEFSEEKIEMTFATNYLGHFLLTKMLLEKIIDTAKKTGIQGRIINVSSVIHSWVKRSCFSFNDMLCGKNYNGTRAYAQSKLATILHVKEVARQLKERNANVTINAVHPGIVKTGIIRAHKGLITDSLFFIASKLLKSISQGASTTCYVALSGQTDGMSGKYFTDCNESNCSSLANDESEARKLWNDTHALLHKRLRQATN

SEQ ID NO: 171436 - protein, 772 aa, Glycine max
  Coding DNA Sequence Number=SeqID_54658
  Gene Ontology: Mol. function=transferase activity, transferring glycosyl groups; Cellular component=cytoplasm; Biological process =carbohydrate metabolic process
  Homolog annotation: Hit_ID=Q1S4K2; Match level="QueryCoverage=97%, HitCoverage=97%, E-value=0.0, Identity=70%"; Hit description =Raffinose synthase
  Pfam annotation: Domain name=Raffinose_syn; Domain location=22-757; Score=1552.3; E_value=0; Accession=PF05691.3; Description=Raffinose synthase or seed imbibition protein Sip1
  Subcellular localization annotation: CTP_CleavageSite=66; ConfidenceScore=5.13e-01
MAPSLTAKQEAALLNANPHLSIKLQSSTFFANNHPILTQVPPNITTTTPPPHDASTTPAGCFVGFSADEARSRHVISLGKLRGIRFTSIFRFKLWWSTHWSGSNGRDVENETQMMILQNDAVEGRPYVLLLPLLEGPFRASLQPGLHDDVDICMESGSARVTKSRFRTSVYMHVHDDPFTLIDEALKVIRVYLGTFRLMEEKTVPGIIDKFGWCTWDAFYLNVHPEGVREGIKGLVEGGCPPGLVLIDDGWQTFCRDDETVSDGGSLNCSVPGEQMLNRLIKFEENGKFKEYKCGREGNKGMGAFVRELKEEFSGLEYVYVWHAFCGYWGGVRPKVPGMPEATVVPTKLSPGAEMTMTDQAVVKIMEIGVGLVPPHRAHELYEGLHSHLESVGIDGVKIDVTHILEMLSEEYGGRVELAKAYYKALTASVRKHFKGNGVISSMQQCNDFMFLGTETISLGRVGDDFWCTDPAGDPNGTYWLQGCHMVHCAYNSLWMGNFIHPDWDMFQSDHACAEFHAASRAISGGPIYVSDSVGKHNFKLLKKLVLPDGSILRCQHYALPTRDCLFVDPLHDGKTMLKIWNLNKCSGVLGLFNCQGGGWCPVTRRNKSSSDYSHSVTCFASPQDIEWGKGKHPVCIKGVDVFAVYMFKDDKLKLLKYTESVEVSLEPFSCELLTVSPVVILPRKSIQFAPIGLVNMLNSGGSIMSLEFDQQENLARIGVRGHGEMRVFASEKPESVKIDGESVEFDYVDRTVRLQVSWPCSSRLSVVEYLF

SEQ ID NO: 171437 - protein, 194 aa, Glycine max
  Coding DNA Sequence Number=SeqID_54659
  Gene Ontology: Mol. function=histone-lysine N-methyltransferase activity; Cellular component=nucleus; Biological process =multicellular organismal development
  Homolog annotation: Hit_ID=Q4VPE8; Match level="QueryCoverage=83%, HitCoverage=91%, E-value=5e-69, Identity=79%"; Hit description =Lateral organ boundaries-like 3
  Pfam annotation: Domain name=DUF260; Domain location=10-110; Score =233.3; E_value=5.1e-67; Accession=PF03195.5; Description=Protein of unknown function DUF260
MASSSSYNSPCAACKFLRRKCMPGCIFAPYFPPEEPQKFANVHKIFGASNVTKLLNELLPHQREDAVNSLAYEAEARVRDPVYGCVGAISFLQRQVQRLQKELDAANADLLRYSYTDITPTSLSVPPGLASFHQVPQRQFSARFGNEASGFYRHQSAATAFSFPYALPWTDTSSEDISEGAGAGGARELGSLFL

SEQ ID NO: 171438 - protein, 298 aa, Glycine max
  Coding DNA Sequence Number=SeqID_54660
  Gene Ontology: Mol. function=transcription factor activity; Biological process=regulation of transcription, DNA-dependent
  Homolog annotation: Hit_ID=Q98E29; Match level="QueryCoverage=99%, HitCoverage=98%, E-value=7e-59, Identity=40%"; Hit description =Transcriptional regulator
  Pfam annotation: Domain name=HTH_1; Domain location=12-69; Score =52.9; E_value=1.1e-12; Accession=PF00126.17; Description=Bacterial regulatory helix-turn-helix protein, lysR family
  Pfam annotation: Domain name=LysR_substrate; Domain location=94-297; Score=37.3; E_value=5.4e-08; Accession=PF03466.10; Description=LysR substrate binding domain
  Pfam module annotation: Pfam domain module=HTH_1::LysR_substrate; Domain location=12-69::94-297
MDIKRADLPLLISLDILLEEKNVTKAAQRLNISQPALSTQLARLRVLFEDPLLVPAEVGRGMVLTERALNLQHKLRASINELKFAVNFKSSFDPLTSRRKFTIATNDSVFTILGLPVLKKVLSLNNPGLQISFVSVFGVNVKEDLEKGHIDLYIGDINKMPDSLKVRYLMKDSFIMAQKKGHARGTKKPTLNEYCQLSHVIVSAKGDLSSSIDHLLSEQSQTRNIVASVPSYNQIALVLTNSDCVATLPKQLLEKYQDTLDLIELPFAIPAFELGMAWHAKSQEDEAMVWLRQQFVSV

SEQ ID NO: 171439 - protein, 91 aa, Glycine max
  Coding DNA Sequence Number=SeqID_54661
  Gene Ontology: Mol. function=transporter activity; Cellular component= integral to membrane; Biological process=transport
  Homolog annotation: Hit_ID=Q2P4H6; Match level="QueryCoverage=92%, HitCoverage=20%, E-value=1e-17, Identity=58%"; Hit description=MFS transporter
MSNHSSPQIPLSKARQNLIIFALSIGAFAIGLSEFCSMGLLLEISRGLGVSESQVGASISIYALGVVVGAPLLAIFGAGLKRKNLLLVLAF

SEQ ID NO: 171440 - protein, 196 aa, Glycine max
  Coding DNA Sequence Number=SeqID_54662
MAKQIGVTCGTDQESIIDKIWAMENRDRKEEMKREQIDNTMCQAIWGDTDVSWEMQLALNTTGGLLCLWSEKSFKVERKKGWAYPEEGVEDRLITEFNDWIVDLKVVEPPCVGRKYTWFRPNGTTKSKLAITFVSTEWFTKWPTSTVEAIPSKIILMMPKNQESSKFQRIKSQASFKNQDQDSRIIKIKIKDSRFK

SEQ ID NO: 171441 - protein, 69 aa, Glycine max
  Coding DNA Sequence Number=SeqID_54663
GVSLSETYALSEQHLLSETSACLTSQENLEENLLRMHVPNAPSACPASHLSLLTLSAPDALSQNSLTHD

SEQ ID NO: 171442 - protein, 390 aa, Glycine max
  Coding DNA Sequence Number=SeqID_54664
  Gene Ontology: Mol. function=histone deacetylase activity; Cellular component=nucleus; Biological process=histone deacetylation
  Homolog annotation: Hit_ID=Q1S4J3; Match level="QueryCoverage=71%, HitCoverage=59%, E-value=1e-135, Identity=80%"; Hit description =Histone deacetylase superfamily
  Pfam annotation: Domain name=Hist_deacetyl; Domain location=1-258; Score=188.6; E_value=1.5e-53; Accession=PF00850.10; Description =Histone deacetylase family
MKHGHPSPLPCPMFDTHPCQCPIPTRHSYYVLYCGHYRCPRVGVVSVSVSVSVSLSLIALVALFGTRYKYMLGQTNYILGCSYDLVYLPRLLSLGCADLNFSDSTRVLYVDIDVHHGDGVEEAFYTTDRVMTVSFHKFGDFFPGTGHVKDIGVGSGKNYAVNVPLNDGMDDESFRSLFRTIIQKVMEVYQPEAVVLQCGADSLSGDRLGCFNLSVRGHADCLRFLRSFNVPLMVLGGGGYTIRNVARCWCYETAVAVGVEPDNKLPYNEYYEYFGPDYTLYVDPSNMENLNTPKDMEKIRNTLLEQISQLPHAPGVPFQTTPPTLQLPEEAEEDMDRRPKLRKWDGEDYDSDPDEGGKANSKFPNVTAHMRDITDEMEEEKPEVHPSSCC

SEQ ID NO: 171443 - protein, 54 aa, Glycine max
  Coding DNA Sequence Number=SeqID_54665
MFVLNNALKGFDDTPQSKSKATVRWIVVKTKRKYCMRVLCHAPDVNYNLRKFQE

SEQ ID NO: 171444 - protein, 294 aa, Glycine max
  Coding DNA Sequence Number=SeqID_54666
  Gene Ontology: Mol. function=protein binding; Cellular component =integral to membrane; Biological process=protein amino acid phosphorylation
  Homolog annotation: Hit_ID=Q9SN91; Match level="QueryCoverage=75%, HitCoverage=64%, E-value=2e-43, Identity=34%"; Hit description =Leucine rich repeat-like protein
  Pfam annotation: Domain name=LRR_1; Domain location=100-122; Score =1.7; E_value=1.3e+02; Accession=PF00560.23; Description=Leucine Rich Repeat
  Pfam annotation: Domain name=LRR_1; Domain location=124-146; Score =18.0; E_value=0.034; Accession=PF00560.23; Description=Leucine Rich Repeat
  Pfam annotation: Domain name=LRR_1; Domain location=148-170; Score =18.8; E_value=0.02; Accession=PF00560.23; Description=Leucine Rich Repeat
  Pfam annotation: Domain name=LRR_1; Domain location=27-49; Score =15.7; E_value=0.17; Accession=PF00560.23; Description=Leucine Rich Repeat
  Pfam annotation: Domain name=LRR_1; Domain location=3-25; Score=11.6; E_value=2; Accession=PF00560.23; Description=Leucine Rich Repeat
  Pfam annotation: Domain name=LRR_1; Domain location=51-73; Score =12.9; E_value=1.1; Accession=PF00560.23; Description=Leucine Rich Repeat
  Pfam annotation: Domain name=LRR_1; Domain location=75-97; Score =14.6; E_value=0.36; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=100-122::124-146::148 -170::27-49::3-25::51-73::75-97
LQELGELDLSYNNFRGKIPSELGNCSKLLKLSLHHNNLSGEIPQEIGNLTSLNVLNLQRNSFSGIIPPTIQRCTKLYELRLSENLLTGAIPVELGGLAELQVILDLSKNLFTGEIPPSLGNLMKLERLNLSFNQLEGKVPPSLGRLTSLHVLNLSNNHLEGQIPSIFSGFPLSSFLNNNGLCGPPLSSCSESTAQGKMQLSNTQVAVIIVAIVFTSTVICLVMLYIMLRIWCNWRKVAISSAEGGGTVAHKTRNGEYWNMNSFGFIPSPDKQNSAATTTSFYNLKMETMENTSM

SEQ ID NO: 171445 - protein, 622 aa, Glycine max
  Coding DNA Sequence Number=SeqID_54667
  Gene Ontology: Mol. function=protein binding; Cellular component =integral to membrane; Biological process=protein amino acid phosphorylation
  Homolog annotation: Hit_ID=Q9SN91; Match level="QueryCoverage=98%, HitCoverage=67%, E-value=1e-121, Identity=36%"; Hit description =Leucine rich repeat-like protein
  Pfam annotation: Domain name=LRRNT_2; Domain location=27-66; Score =34.6; E_value=3.4e-07; Accession=PF08263.3; Description=Leucine rich repeat N-terminal domain
  Pfam annotation: Domain name=LRR_1; Domain location=119-141; Score =15.5; E_value=0.2; Accession=PF00560.23; Description=Leucine Rich Repeat
  Pfam annotation: Domain name=LRR_1; Domain location=143-165; Score =16.0; E_value=0.14; Accession=PF00560.23; Description=Leucine Rich Repeat
  Pfam annotation: Domain name=LRR_1; Domain location=167-189; Score =12.5; E_value=1.3; Accession=PF00560.23; Description=Leucine Rich Repeat
  Pfam annotation: Domain name=LRR_1; Domain location=191-213; Score =10.1; E_value=3.7; Accession=PF00560.23; Description=Leucine Rich Repeat
  Pfam annotation: Domain name=LRR_1; Domain location=215-237; Score =6.0; E_value=22; Accession=PF00560.23; Description=Leucine Rich Repeat
  Pfam annotation: Domain name=LRR_1; Domain location=239-261; Score =17.4; E_value=0.051; Accession=PF00560.23; Description=Leucine Rich Repeat
  Pfam annotation: Domain name=LRR_1; Domain location=263-285; Score =12.3; E_value=1.4; Accession=PF00560.23; Description=Leucine Rich Repeat
  Pfam annotation: Domain name=LRR_1; Domain location=287-310; Score =12.9; E_value=1.1; Accession=PF00560.23; Description=Leucine Rich Repeat
  Pfam annotation: Domain name=LRR_1; Domain location=311-330; Score =15.2; E_value=0.23; Accession=PF00560.23; Description=Leucine Rich Repeat
  Pfam annotation: Domain name=LRR_1; Domain location=336-358; Score =10.4; E_value=3.2; Accession=PF00560.23; Description=Leucine Rich Repeat
  Pfam annotation: Domain name=LRR_1; Domain location=360-382; Score =17.6; E_value=0.046; Accession=PF00560.23; Description=Leucine Rich Repeat
  Pfam annotation: Domain name=LRR_1; Domain location=384-406; Score =13.3; E_value=0.88; Accession=PF00560.23; Description=Leucine Rich Repeat
  Pfam annotation: Domain name=LRR_1; Domain location=408-430; Score =10.1; E_value=3.6; Accession=PF00560.23; Description=Leucine Rich Repeat
  Pfam annotation: Domain name=LRR_1; Domain location=432-454; Score =14.3; E_value=0.45; Accession=PF00560.23; Description=Leucine Rich Repeat
  Pfam annotation: Domain name=LRR_1; Domain location=456-478; Score =11.9; E_value=1.7; Accession=PF00560.23; Description=Leucine Rich Repeat
  Pfam annotation: Domain name=LRR_1; Domain location=480-502; Score =10.1; E_value=3.7; Accession=PF00560.23; Description=Leucine Rich Repeat
  Pfam annotation: Domain name=LRR_1; Domain location=504-526; Score =13.3; E_value=0.9; Accession=PF00560.23; Description=Leucine Rich Repeat
  Pfam annotation: Domain name=LRR_1; Domain location=528-550; Score =13.8; E_value=0.62; Accession=PF00560.23; Description=Leucine Rich Repeat
  Pfam annotation: Domain name=LRR_1; Domain location=552-573; Score =8.7; E_value=6.7; Accession=PF00560.23; Description=Leucine Rich Repeat
  Pfam annotation: Domain name=LRR_1; Domain location=575-597; Score =15.5; E_value=0.2; Accession=PF00560.23; Description=Leucine Rich Repeat
  Pfam annotation: Domain name=LRR_1; Domain location=599-621; Score =16.6; E_value=0.092; Accession=PF00560.23; Description=Leucine Rich Repeat
  Pfam annotation: Domain name=LRR_1; Domain location=71-93; Score=8.7; E_value=6.8; Accession=PF00560.23; Description=Leucine Rich Repeat
  Pfam annotation: Domain name=LRR_1; Domain location=95-117; Score =21.0; E_value=0.0043; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1; Domain ...
  Pfam module annotation: Pfam domain module=location=27-66::119 -141::143-165::167-189::191-213::215-237::239-261::263-285::287 -310::311-330::336-358::360-382::384-406::408-430::432-454::456 -478::480-502::504-526::528-550:...
  Pfam module annotation: =:552-573::575-597::599-621::71-93::95-117
MGSIWMCHFFLLLSILGTTFIATTANNATDSYWLHRIKSELVDPFGALSNWSSTTQVCNWNGITCAVDQEHIIGLNLSGSGISGSISAELSHFTSLRTLDLSSNSLSGSIPSELGQLQNLRILQLHSNDLSGNIPSEIGNLRKLQVLRIGDNMLTGEIPPSVANMSELTVLTLGYCHLNGSIPFGIGKLKHLISLDLQMNSLSGPIPEEIQGCEELQNFAASNNMLEGDLPSSMGSLKSLKILNLVNNSLSGSIPTALSHLSNLTYLNLLGNKLHGEIPSELNSLIQLQKLDLSKNNLSGSIPLLNVKLQSLETLVLSDNALTGSIPSNFCLRGSKLQQLFLARNMLSGKFPLELLNCSSIQQLDLSDNSFEGELPSSLDKLQNLTDLVLNNNSFVGSLPPEIGNISSLESLFLFGNFFKGKIPLEIGRLQRLSSIYLYDNQISGPIPRELTNCTSLKEVDFFGNHFTGPIPETIGKLKGLVVLHLRQNDLSGPIPPSMGYCKSLQILALADNMLSGSIPPTFSYLSELTKITLYNNSFEGPIPHSLSSLKSLKIINFSHNKFSGSFFPLTGSNSLTLLDLTNNSFSGPIPSTLTNSRNLSRLRLGENYLTGSIPSEFGHLT

SEQ ID NO: 171446 - protein, 333 aa, Glycine max
  Coding DNA Sequence Number=SeqID_54668
LRLPQFVNKQSVAHLTISDQDKSYGHLLGVPKLRARLQKPQTALFVGSEDHSQISCLQRTPKDIFPIGNSCFHISGKNGRKPVVSFCNRPFNRDNEVISSNSKRTRISISSLMVPYVLVASFLYPQLILPEVIPKTSGNSSLTIFLLLFFTEATFYYGVAVFLLMLDRLMRPKQLDLSANNSNTLSLQLEQRMSFDIALVVPRLVSIAIPLVTMGLTWPWTGPVVPATIFPYLVGIVVQFKYEQIARYWKSPSWVAIPFIFHAYRLHQIHRAAKFLTVISFQVKKGYSKLPVARGSLSTTTNAFRILIVIWIWSFSSFLMRFLTSASASTTKQ

SEQ ID NO: 171447 - protein, 101 aa, Glycine max
  Coding DNA Sequence Number=SeqID_54669
MAVLISPLEIRFLLSSFPRNESPMNYSCKRKRECTGYNWKIRRLGETLEKQLQKGEKRERVWSEVERGRSAGVRSDGFRIGEEEKGSFARERNKRAERRNS

SEQ ID NO: 171448 - protein, 392 aa, Glycine max
  Coding DNA Sequence Number=SeqID_54670
  Subcellular localization annotation: CTP_CleavageSite=65; ConfidenceScore=5.66e-01
MAAIIDCSSSSPFGYFQLNTNPKVRTSLSLSLSFISKLSVVLTLRYDEAFLANTVFLLRLSQFVNQQNAAHLTSKDKSYGHIFGVPKLRSRLQTPQTALVVGSEDHSHISGLQRATKDTFQIGNSSFHISGNDGKPAVSFCNRPFSRDNEVISSDSEWIRNTLSWFIGPVVLVASFCFPLICLPKMISNIFGSTVSKALLLSFSQEAIFYCGVAVFLLLLDHLMRPKQLDPSANKSDTLSLQLGKEYFYSIASMMIRQLGITIPMVTLGLTWPWNGHVIPVTLAPYMVGVFVQSAFEMLALYWKSPSWPAIPFIFHVYRLHQIHKATLSLTFLLYDLAEAEKVYSKLPLTPSTWLGLTTVLQILLVIWIWSFSSFLVKFIRSASSTKSDADA

SEQ ID NO: 171449 - protein, 68 aa, Glycine max
  Coding DNA Sequence Number=SeqID_54671
MGWGEVSLLLDLFFMLMILQGCDTLESLKFIAAAIASSLHCSLSSSPPIQSKKGTYSFVQKLIPDKDV

SEQ ID NO: 171450 - protein, 251 aa, Glycine max
  Coding DNA Sequence Number=SeqID_54672
MPSFTSGSLFLYKIACQQVAKGKKKDLFFFYRFQHNRLDILKVIYFLNIEFSKRHWRITLELNRGPAPGTMVVNTGMVIGIREKFRLAPSANWNNLPDCEIRILPSLETILFELGKIILGDEVLPPSFMSIEKHVTDDTNFTCELPSISCENNNLTLNTLKKQLEVETFVELNANGEHPLLLHYKDCGDSEIGRVVIQAAKERKYKTISIIDDKPVTLDIIEELKALGGDIVPESHTKTWYGRGPKAVDIV

SEQ ID NO: 171451 - protein, 63 aa, Glycine max
  Coding DNA Sequence Number=SeqID_54673
MASFLFAHNLIEILLTKFLYRCCCQWRVEGGLNRDLGSWISGAVSIWSRLGWRRGGHASLQLE

SEQ ID NO: 171452 - protein, 83 aa, Glycine max
  Coding DNA Sequence Number=SeqID_54674
  Subcellular localization annotation: CTP_CleavageSite=29; ConfidenceScore=5.41e-01
MTTTPPPQPRPNTHRTRNPTAQISIQTLSCKIYSSSTALTSSLSLDLKLQNLLPHATDNSNDTETSSTRFLSSCAQTRMTPSF

SEQ ID NO: 171453 - protein, 283 aa, Glycine max
  Coding DNA Sequence Number=SeqID_54675
  Homolog annotation: Hit_ID=UPI00005DC2A7; Match level="QueryCoverage =47%, HitCoverage=51%, E-value=2e-47, Identity=64%"; Hit description =transporter
  Pfam annotation: Domain name=CRAL_TRIO; Domain location=47-213; Score= -8.3; E_value=5.6e-05; Accession=PF00650.10; Description=CRALTRIO domain
MGDGCVPAKKTLRLSVIKESTSVNIDPGQHPPEFNSKVVKDALQTGKGYVHDFLDINGQPVLVVVGSKHIPQALDPADDERLCVFLIEKALSKFPTGKEQILTIVDLRGFSTENADLKFLTFLFDIFYYYYPKRLAQVLFVDAPFVFKPIWQLVKPMLKSYASLEVFAFRRVSLLVVADHAFSTSEFVVEGSCLRPFPLGSGLYAALSSLSSAPRFYFTGHSAQLLLGRIPSGRNTEETSSYSEKTGLVFSMRGAKFHIQFIASVLAFHLNMLTNIYCTSGTN

SEQ ID NO: 171454 - protein, 90 aa, Glycine max
  Coding DNA Sequence Number=SeqID_54676
MAHKICISHFGYAAIVSGLILGNSMRRRITPWLWIVEALEHALEPLIVWAEHLVPREMQGKTPVFVLATAELRRLPREEASRVLGDVEAV

SEQ ID NO: 171455 - protein, 189 aa, Glycine max
  Coding DNA Sequence Number=SeqID_54677
  Homolog annotation: Hit_ID=Q2L3D7; Match level="QueryCoverage=73%, HitCoverage=35%, E-value=4e-16, Identity=35%"; Hit description=ETEA -like (Expressed in T-cells and eosinophils in atopic dermatitis) protein
MPSTVRDHGIVRRMASLPRSIMGGISRAMGDGMGFIGRGRRRNQHTNIPLQPQDHHVPQPHEERAKQEEKIRADRRLREEQDAAYLAALQIDKREERVQKLAEAHNNRNYGKLINNSMNVTKQNSKVNEFNKEKGDKGVASKGSESQPTQILIRFPNGERREHTFLYTNKIQSIFSYIDSLGLPGIGNC

SEQ ID NO: 171456 - protein, 77 aa, Glycine max
  Coding DNA Sequence Number=SeqID_54678
  Subcellular localization annotation: CTP_CleavageSite=55; ConfidenceScore=5.21e-01
MSIGFNDEIWAISAHQWAKRASTAKQSFSALSAIEESGRVSSSRSRAKHEISALSATVVFSQAQRMTGTKLKSTYSH

SEQ ID NO: 171457 - protein, 535 aa, Glycine max
  Coding DNA Sequence Number=SeqID_54679
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=80%, HitCoverage=80%, E-value=1e-174, Identity=68%"; Hit description =Putative carboxyl-terminal proteinase
  Pfam annotation: Domain name=DUF239; Domain location=270-494; Score =356.5; E_value=4.2e-104; Accession=PF03080.5; Description =Arabidopsis proteins of unknown function
MKKGYSVSLTKQQHKKEPFFAVHHTRKQHQCIQANHDATEETSSQQNQYSLKLALSSTSQNTTLLLPAFVTLLLLVTSIGTAFSHPTIVSNSSSPLPPALSHSNANNQTLRPAAVLQKLRRIRTHLDKINKPAVKTIKAFSFALLSVTMTPPLHFPSTDSSPDGDLIDCVLSHQQPAFDHPQLKGQRPLDPPERPKGHTNGETVVESFQLWTDSGEACPEGTVPIRRTTEQDFLRASSVRRFGRKPRNVRRDSTGIGHEHAVVSVNGDQYFGAKASINVWTPSVTDPYEFSLSQIWVIAGSFGNDLNTIEAGWQACPMSIYTCPKIHIHLFFLVLNIVKVLKKVSPELYGDNYPRFFTYWTTDAYQATGCYNLLCSGFVQTNNRIAIGAAISPRSIYNGRQFDIGLMVWKDPKHGHWWLEFGSGLLVGYWPAYLFSHLRNHASMVQFGGEIVNSRSRGYHTGTQMGSGHFAGEGFRKAAYFRNLQVVDWDNNLLPLSNIHQLADHSNCYDIRVGSNNVWGTYFYYGGPGRNVRCP

SEQ ID NO: 171458 - protein, 448 aa, Glycine max
  Coding DNA Sequence Number=SeqID_54680
  Gene Ontology: Mol. function=protein serine/threonine kinase activity; Cellular component=cell surface; Biological process =protein amino acid phosphorylation
  Homolog annotation: Hit_ID=Q1RVK5; Match level="QueryCoverage=99%, HitCoverage=100%, E-value=0.0, Identity=77%"; Hit description =Protein kinase
  Pfam annotation: Domain name=Pkinase; Domain location=105-387; Score =159.7; E_value=7.7e-45; Accession=PF00069.15; Description=Protein kinase domain
  Pfam annotation: Domain name=Pkinase_Tyr; Domain location=105-387; Score=79.8; E_value=8.7e-21; Accession=PF07714.7; Description =Protein tyrosine kinase
  Pfam module annotation: Pfam domain module=Pkinase::Pkinase_Tyr; Domain location=105-387::105-387
MEDRKANTISVISVIALIILIIVARVSLKLSRAFFLICGASIAVILAVFSCALIRHRYNHRRRLLESQLKTEGRELRIEYSFLRKVAGVPTKYRFKELEEATDGFQALLGKGSSASVFKGILNDGTSVAVKRIDGEERGEKEFRSEVAAIASVHHVNLVRMFGYCNAPTAPRYLVYEYIPNGSLDCWIFPLRENHTRKGGCLPWNLRQKVAIDVARGLSYLHHDCRRRVLHLDVKPENILLDENYKALVADFGLSTLVGKDVSQVMTTMRGTRGYLAPEWLLERGVSEKTDVYSYGMVLLEIIGGRRNVSRVEDPRDRTKKKWEFFPKIVNEKVREGKFMEIVDRRLVERGSVVEESEVTRLVYIALWCIQEKPRLRPSMAQVVDMLEGRVRVDEPPGSRMILVDLLAVDEDPADHRNLARLLTSVSSHVDCTSTYSLGTTNTILSGR

SEQ ID NO: 171459 - protein, 757 aa, Glycine max
  Coding DNA Sequence Number=SeqID_54681
  Gene Ontology: Mol. function=transferase activity
  Homolog annotation: Hit_ID=Q1RVK0; Match level="QueryCoverage=99%, HitCoverage=100%, E-value=0.0, Identity=60%"; Hit description =Protein prenyltransferase
  Subcellular localization annotation: CTP_CleavageSite=59; ConfidenceScore=5.81e-01
MRFVITKNPINLLNSQGSLVLFRVPSVARNFLHPSSSKWTPRSSNPLRFSFSSLRVSVSCASSSSTVYGGWDDLGSSDAPGESNALRNFLVSIGIDDRKNVFVFLLGLVCALAISRVKVSSIVILPASALVFAVGFSVGFFRTGTFGEVRAGGSKRREKEENSNSKLSSEKLRSLVEFFDELDVVVDSLKSDVQSAIRDNKIRVGDFYGYVEVTDKIKISAKNARNVVRALIDNEDNHKNGRRKKQVGESGHQILQSFSSLFGENLFSSNSTKVRENVKQEAVDRTLDQTRGSGNVPLVEDRALNLVDDRMGNSKLDLDTSQDSSTNSVLDMNRNGRIRTTPEGENVGLVDIRRSTNKFFDDKEYSDRNKGLRFTNNHSFSLKMDSSSITDMWESQNSLLDSESFKVRTKHMESESSFLREQLLDGGHETFRSAHYKREGGSNRSQYNDDTVNYDDNHHLADDLSAHENESSTKISDDMMFDRYLAEATDLLKQAKEFIKGRQGEEQAEIMLYRSANLLSKAVELKPMSLLAVGQLGNTYLLHGELKLKISRELRTLLSGSIQPSSVKHTRILKGLRNKVNCKEEVVPFLIDVCEECEELLVEAGRKYRLALSVDSNDVRALYNWGLALSFRGQLIADIGPGAAFEAERVFLAAIDKFDAMLLKGNVYAPDGATREYYADRFSIKVYSLLSVPWTVRILKVIEHQRSRLRPGSSKEKVKLLQQAKRLYEDALDMNSNNVQVKDALSSCLAELNYRQF

SEQ ID NO: 171460 - protein, 214 aa, Glycine max
  Coding DNA Sequence Number=SeqID_54682
  Gene Ontology: Mol. function=binding; Cellular component=nucleus; Biological process=protein kinase C activation
  Homolog annotation: Hit_ID=Q1RWK6; Match level="QueryCoverage=99%, HitCoverage=52%, E-value=9e-83, Identity=49%"; Hit description =Pancreatic ribonuclease; Tetratricopeptide-like helical
MNPLAKVKSTKGSTSRKNAQERYIIGLYVFFSNHELKQHQGFLVQTQVAITTNHSILQNHIFFLNPIKQLTRGVNFTTLGIQINECINKLKILTKPAISNPRKDPFPHLKRPQMATSGKNTQHRALIRRHVSLPHACKASQGFLKATTLDIPSNHGIHETTSLAGISSKRRRASSAWPSETYPVIIAVKDTATLRVILSNIKHASRNSPTWEYM

SEQ ID NO: 171461 - protein, 163 aa, Glycine max
  Coding DNA Sequence Number=SeqID_54683
MNLRPLGPLVRMAAVIFGGVATLNLASAATIKVLRFASEKKREKVALPCWVCRGKGFYICKLCNGNATISWSPMFDPIAVNPCVCPTCEEDNCTLLTTCMVGSVLLQIPPFETDVLAEGDFGHFDKTLTGISSKPKHYSHQEFQHQKKKGMGTLQSDRLDSSS

SEQ ID NO: 171462 - protein, 490 aa, Glycine max
  Coding DNA Sequence Number=SeqID_54684
  Gene Ontology: Mol. function=protein serine/threonine kinase activity; Cellular component=cytoplasm; Biological process=protein amino acid phosphorylation
  Homolog annotation: Hit_ID=Q1RWL0; Match level="QueryCoverage=95%, HitCoverage=97%, E-value=0.0, Identity=74%"; Hit description=Protein kinase
  Pfam annotation: Domain name=Pkinase; Domain location=98-439; Score =201.9; E_value=1.5e-57; Accession=PF00069.15; Description=Protein kinase domain
  Pfam annotation: Domain name=Pkinase_Tyr; Domain location=98-428; Score=-40.8; E_value=5.8e-10; Accession=PF07714.7; Description =Protein tyrosine kinase
  Pfam module annotation: Pfam domain module=Pkinase::Pkinase_Tyr; Domain location=98-439::98-428
  Subcellular localization annotation: CTP_CleavageSite=61; ConfidenceScore=5.70e-01
MLSAAPSMNTNTSVITAITTTRDEPDYDSSSSSITVPESSRSWMTNLSFGSRRRRSSVSVCSSTAESPHAKPHKANHAAWEAMRRLRRDKGQVGLDHFRLLRRLGSGDIGNVYLCQIRNPIVGLPQCFYAMKVVDREALAIRKKLQRAEMEKEILAMLDHPFLPTLYTEFDASHYSCLLMEFCPGGDLYAARQRQPGKRFSIASSKFYAAETLLALEYLHMMGIVYRDLKPENVLVREDGHIMLTDFDLSLKCDVVPKLLRSKTRLERSIKSTKRSMPACTAPMQPVLSCFLSSSRKKKKATVTTVIRENVEVEENDPELVAEPIDAKSKSFVGTHEYLAPEVILGQGHGSAVDWWTFGVFLYEMLYGRTPFKGENNEKTLVNILKQPLAFPRIVVGTSKEFEEMVNVQDLISKLLVKNPSKRIGSLMGSVEIKRHEFFKGVNWALIRAVRPPEVPSEMNKLRSRVLLPKLSKTDRDQPYQLRSHHFEYF

SEQ ID NO: 171463 - protein, 756 aa, Glycine max
  Coding DNA Sequence Number=SeqID_54685
  Homolog annotation: Hit_ID=Q1RT83; Match level="QueryCoverage=48%, HitCoverage=96%, E-value=1e-154, Identity=75%"; Hit description =Isopentenyl-diphosphate delta-isomerase, type 1
  Pfam annotation: Domain name=NUDIX; Domain location=522-648; Score =75.0; E_value=2.3e-19; Accession=PF00293.18; Description=NUDIX domain
  Pfam annotation: Domain name=NUDIX-like; Domain location=363-483; Score=38.9; E_value=1.7e-08; Accession=PF09296.1; Description=NADH pyrophosphatase-like rudimentary
  Pfam annotation: Domain name=zf-CCCH; Domain location=145-171; Score =28.7; E_value=2.1e-05; Accession=PF00642.15; Description=Zinc finger C-x8-C-x5-C-x3-H type (and similar)
  Pfam annotation: Domain name=zf-CCCH; Domain location=228-254; Score =49.2; E_value=1.3e-11; Accession=PF00642.15; Description=Zinc finger C-x8-C-x5-C-x3-H type (and similar)
  Pfam annotation: Domain name=zf-CCCH; Domain location=84-109; Score =35.8; E_value=1.5e-07; Accession=PF00642.15; Description=Zinc finger C-x8-C-x5-C-x3-H type (and similar)
  Pfam annotation: Domain name=zf-NADH-PPase; Domain location=485-518; Score=43.2; E_value=8.6e-10; Accession=PF09297.1; Description=NADH pyrophosphatase zinc ribbon domai
  Pfam module annotation: Pfam domain module=NUDIX::NUDIX-like::zf -CCCH::zf-CCCH::zf-CCCH::zf-NADH-PPase; Domain location=522-648::363 -483::145-171::228-254::84-109::485-518
MSFSDHIPSFMMSPPSFSTDTDAIEVRLQFPMNNESLEPHSPQDRPPSFKRARTCDNSLSNAMACPPRMIQHPAVNKGTSHIFFKTRICAKFRVGACRNGENCNFAHGLEDMRQPPPNWQELVGLRGEERPPMAGDWDDDQKIIHKMKLCKKYYNGEECPYGDKCSFLHEDPARFRDDSVRYRESTSISIGTNGSPKSYGDASNNLESNRAVNTGLNVFRGNVKSTYWKTKLCIKFETTGHCPFGDDCHFAHGQAELQVPGGRTEAETAGVNPISTKATIPTLPRATSVSSNDAPPSHRASVPPANEKERDKKYLLKWKGHKKINRIYGDWLDDLPLVHNLPALEALNARISLNNTHSSPSPSFKVLPFRNGRPLASSSAGTGDSPPIWDLGWLGLDDLRGIFENSGAQLSVDLLVYLNSSSEDDAVYWAIDVSDKVPELGSNNAAGLCFVELRTLMVATDWSDLQLMGNLAIAGHAKALLEWHNFSRFCGHCGEKTVPMEAGRRKKCSNDSCKKRIYPRVDPVVIMLVIDRENDRALLAKRPMRIARLYTCLSGFTEPGESLEEAVRRETWEETGIEVGEVVYHSSQPWPVAPNSIPCQLMVGFFAYAKSLEITVDKTELEDAQWFSREDVRKALTFAKYKQAQRTAAEKVEQMCKGLEKNRSLASDLNVESADEQHASIVVPGPFAIAYHLISSWAFSDQNVVNDHLLSVMVSCCFFDNLAIDLNLVVLPEFLRIPLCKDSVESLLDVPSWRGG

SEQ ID NO: 171464 - protein, 318 aa, Glycine max
  Coding DNA Sequence Number=SeqID_54686
  Gene Ontology: Mol. function=racemase and epimerase activity, acting on amino acids and derivatives; Biological process=metabolic process
  Homolog annotation: Hit_ID=Q1RT82; Match level="QueryCoverage=95%, HitCoverage=96%, E-value=1e-125, Identity=72%"; Hit description =Asp/Glu racemase
  Pfam annotation: Domain name=Asp_Glu_race; Domain location=58-302; Score=-47.0; E_value=0.085; Accession=PF01177.12; Description =AspGluHydantoin racemase
  Subcellular localization annotation: CTP_CleavageSite=26; ConfidenceScore=5.36e-01
MSVQTMNHPPFLTGDAFRKRTQTRCRGRANSSTALQLSSDESGNYAEPCTSLLSQPNTIGVIGGVSLLSTLIFLEKLACWGSRNGKECPPFVVSSDPALSKMLSLRGPLPSARTRFDRIKLNQDLVIENLRCKRNFLQQSGARGLAMPCHLSHAWHSEISEDSSLPFLHVGDCVAMELKNAKLKPIHAAGIVRIGLLTTDSNFVASYYQERLQSQGFEVVLLDKATEEHVLVPAMEALYRKDIEGARNLLRIAIHVLLVRAVNLVLLASDDLLGVLPHNDPLLRKCIDPMDALARSTIHWAETMVKNFSFVTAPFLDR

SEQ ID NO: 171465 - protein, 134 aa, Glycine max
  Coding DNA Sequence Number=SeqID_54687
  Gene Ontology: Mol. function=zinc ion binding; Cellular component =intracellular
  Homolog annotation: Hit_ID=Q1RWK5; Match level="QueryCoverage=74%, HitCoverage=79%, E-value=2e-49, Identity=76%"; Hit description=Zinc finger, RanBP2-type
  Pfam annotation: Domain name=zf-RanBP; Domain location=4-33; Score =20.6; E_value=0.0027; Accession=PF00641.9; Description=Zn-finger in Ran binding protein and others
  Pfam annotation: Domain name=zf-RanBP; Domain location=48-76; Score =20.6; E_value=0.0028; Accession=PF00641.9; Description=Zn-finger in Ran binding protein and others
  Pfam module annotation: Pfam domain module=zf-RanBP::zf-RanBP; Domain location=4-33::48-76
MSWSGGDWMCGVCEHINFKKREACQSCGYPKYGGHDPSTYRYNKTEALAGDWFCNCGAHNYASRSSCYRCGAIKDYYSSGEYGSDTFPPGWKNGDWLCPRLRRNFRRPGMSIISPNIFLLQTTFHLTFSTSSSR

SEQ ID NO: 171466 - protein, 272 aa, Glycine max
  Coding DNA Sequence Number=SeqID_54688
  Gene Ontology: Mol. function=cytochrome-b5 reductase activity; Cellular component=mitochondrial intermembrane space; Biological process=electron transport
  Homolog annotation: Hit_ID=Q1RT78; Match level="QueryCoverage=96%, HitCoverage=65%, E-value=1e-91, Identity=77%"; Hit description =Flavoprotein pyridine nucleotide cytochrome reductase
  Pfam annotation: Domain name=FAD_binding_6; Domain location=34-108; Score=36.6; E_value=8.4e-08; Accession=PF00970.14; Description =Oxidoreductase FAD-binding domain
  Pfam annotation: Domain name=NAD_binding_1; Domain location=117-244; Score=107.7; E_value=3.5e-29; Accession=PF00175.11; Description =Oxidoreductase NAD-binding domain
  Pfam annotation: Domain name=NAD_binding_6; Domain location=113-247; Score=-36.4; E_value=0.079; Accession=PF08030.2; Description=Ferric reductase NAD binding domain
  Pfam module annotation: Pfam domain module=FAD_binding_6::NAD_binding_ 1::NAD_binding_6; Domain location=34-108::117-244::113-247
MWSQIICITAGLHWDKMLKENQNLSYARFICFFSALIFLFATDSLSMINQYSFSECLLRYTPISDPESNGYFDLLIKVYPEGKMSQHFASLKPGDVVEVKGPIEKLRYTPNMKKHIGMIAGGTGITPMLQVIEAILRNPDDKTQISLLYANVSPDDILLKQKLDILATSHPNLKIFYTVDNPTKNWRGGAGYISKDVVVKGLPSPSDDTLILGGGGQRLDKGGSCPEFRRMVCGPPGMMKAISGEKAKDWTQGEVSGILKEAGYTEQMVYKF

SEQ ID NO: 171467 - protein, 385 aa, Glycine max
  Coding DNA Sequence Number=SeqID_54689
  Gene Ontology: Mol. function=calpain activity; Cellular component =intracellular; Biological process=proteolysis
  Homolog annotation: Hit_ID=Q1S657; Match level="QueryCoverage=95%, HitCoverage=94%, E-value=4e-49, Identity=34%"; Hit description =Peptidase S26A, signal peptidase I; Cyclin-like F-box; F-box protein interaction domain; ...
  Homolog annotation: Hit description=Galactose oxidase, central
  Pfam annotation: Domain name=F-box; Domain location=10-57; Score =26.0; E_value=0.00013; Accession=PF00646.23; Description=F-box domain
  Pfam annotation: Domain name=FBA_1; Domain location=223-380; Score= -49.3; E_value=0.039; Accession=PF07734.3; Description=F-box associated
  Pfam module annotation: Pfam domain module=F-box::FBA_1; Domain location=10-57::223-380
MAMVVGGLPRAAPVLAEDLSVEILSWLPVKVLIRFKCVSKTWNSLIFHPMLVKLHLERSSKNTHTLLKFIDIKCENYYAYPWGAFCSIRSLLENPSSTIDDGCHYFKKDCYFYVGSCNGLVCLHDYSSDEQWVRFWNPATRIMSEDSPHLRLHSGCYNAGPNSVEWFLGFGYDDWSDTYKVVVILSNTKTHEMEVSVHCMGDTDTCWRNILTCPWFLILGQVGRFVSGSINWITCGSTVNGFLVFSCDLKNETCRYLSAPDAPFEIPIALPSLGVLKGCLCASFNQKSHFVVWIMREFGVETSWTQLLNVSYQHLQLNPIHGYINITILYVSEDEDVFFLASHQDAEFILYDQRNNRISRTGDFNNCHKSSASSYDYVPSLVLPY

SEQ ID NO: 171468 - protein, 631 aa, Glycine max
  Coding DNA Sequence Number=SeqID_54690
  Homolog annotation: Hit_ID=Q1RT73; Match level="QueryCoverage=99%, HitCoverage=99%, E-value=0.0, Identity=75%"; Hit description=IMP dehydrogenase/GMP reductase
MDDGMQLQISLDKLPIKRLDSIEENGIERFPLDVDYDEKRLSLIRRIDFAWAVEKDEEKKKKKQKSSKETSAPWQWQGMVENLQLAHQELSVIIDLINTVEANDAVTVASMTRPKLLPNEALSDLAVSAATKLQCYRHVGKYFKQSAKAFEQQVAREARFYGALIRLQQNWKVKRQRQAAIVPGNEGFTFDLLDNSYDQAAIIRSLSMSTVRVNHDAAGMLAINVSPDLCHSLQFGFVGAQSDDTWRKSNENKSHFSGEHNLGEMGEESLSDEECVKKTNSLLREVHEAIFNEQVFDLVNREAFNTVAGVSVTGIRENYLQLSLGQGTSVYLTLVSNSQDHSTVEDELNDNVENAILPLESSDGMKREAKQNTSKKGQFSNSICYEIYIQQIFHEHIFGKGDEKAISSGNRLSGVQARDGSSLLGHFFKSLAHRIFSTKVLAELENVVCKVPYLQLISNPTWNSRASSWTLYMEVPQSILRGSQTKTSDYYEKNAAKRQFWTKVVVNDDCINVKAEAACLLLQVASQIINWLYQEAMMVGIKVNRDFLCLSLELKQGETLGLVASVDPEDSEECISWWLVMEDSFAEEQKLHMSITDGASEYRKFLGHLSLDLLYATLIDLVGLCSGGGGQ

SEQ ID NO: 171469 - protein, 91 aa, Glycine max
  Coding DNA Sequence Number=SeqID_54691
MWEFCKKRLKKGKKECSDEEHGRINPLIIQLCTRETSVHTSPEMGGAVGMVVWRGGDLLECAAKKRCWRDGSRLKQVEDRERDAAAAGDRR

SEQ ID NO: 171470 - protein, 380 aa, Glycine max
  Coding DNA Sequence Number=SeqID_54692
  Gene Ontology: Mol. function=binding; Cellular component =intracellular; Biological process=protein kinase C activation
  Homolog annotation: Hit_ID=Q1RWK6; Match level="QueryCoverage=99%, HitCoverage=68%, E-value=1e-174, Identity=56%"; Hit description =Pancreatic ribonuclease; Tetratricopeptide-like helical
  Pfam annotation: Domain name=PPR; Domain location=145-179; Score=2.7; E_value=3.6; Accession=PF01535.11; Description=PPR repeat
  Pfam annotation: Domain name=PPR; Domain location=181-215; Score =10.8; E_value=0.39; Accession=PF01535.11; Description=PPR repeat
  Pfam annotation: Domain name=PPR; Domain location=92-126; Score=8.9; E_value=0.65; Accession=PF01535.11; Description=PPR repeat
  Pfam module annotation: Pfam domain module=PPR::PPR::PPR; Domain location=145-179::181-215::92-126
MGKWIFSWVRDRGLGKNLQLVNALVDLYSNLYEEALVLFELMIREKNVKPNDVTFLGVLPACASLGALDLGKWVHAYIDKNLKGTDNVNNVSLWTSIIDMYAKCGCVEVAEQVFRSIELAMNGHAERALGLFKEMINEGFQPDDITFVGVLSACTQAGLVDLGHRYFSSMNKDYGISPKLQHYGCMIDLLARSGKFDEAKVLMGNMEMEPDGAIWGSLLNARRVHGQVEFGEYVAERLFELEPENSGAFVLLSNIYAGAGRWDDVARIRTKLNDKGMKKVDRLLEETGFVPDTSEVLYDMDEEWKEGALNQHSEKLAIAFGLISTKPGTTIRIVKNLRVCPNCHSATKLISKIFNREIIARDRNRFHHFKDGFCSCNDCW

SEQ ID NO: 171471 - protein, 175 aa, Glycine max
  Coding DNA Sequence Number=SeqID_54693
  Gene Ontology: Mol. function=zinc ion binding; Cellular component =intracellular
  Homolog annotation: Hit_ID=Q1RWK5; Match level="QueryCoverage=87%, HitCoverage=97%, E-value=7e-56, Identity=73%"; Hit description=Zinc finger, RanBP2-type
  Pfam annotation: Domain name=zf-RanBP; Domain location=4-33; Score =20.6; E_value=0.0027; Accession=PF00641.9; Description=Zn-finger in Ran binding protein and others
  Pfam annotation: Domain name=zf-RanBP; Domain location=48-76; Score =28.8; E_value=1.9e-05; Accession=PF00641.9; Description=Zn-finger in Ran binding protein and others
  Pfam module annotation: Pfam domain module=zf-RanBP::zf-RanBP; Domain location=4-33::48-76
MSWSGGDWMCGVCEHINFKKREACQSCGYPKYGGPDPSTYRYNRTEALAGDWFCNCGAHNFASRSNCFRCGSMKDDYSSGYGNNSGGYGSDTFPPGWKTGDWLCPRERGLFSVLHIGMYSDTIRKKDMDVECITMPAGQNAIYAKCQGIMVVQTETRNFTRPAISLISPLASFFS

SEQ ID NO: 171472 - protein, 203 aa, Glycine max
  Coding DNA Sequence Number=SeqID_54694
  Homolog annotation: Hit_ID=Q8RV44; Match level="QueryCoverage=40%, HitCoverage=40%, E-value=4e-13, Identity=43%"; Hit description =Dynein light chain-like protein
MANQDKQHKRGFMYIYKGGTGNQRKKELEHGVGQEKKSNSRSWLNRISRTRIFNDGHRDLDIGTRGEGEFVEARKSMSCLDLGTPAGGYVEGRKSVSFIEAAASPAAAIGSIVEEGRKSVSHIEKNFAVEGMVEARKSVSHIETLSSVIAYLQVKVLVSDMPTFMQVHAFRCARRTYDSLEKFSAKLIAHNIKKSLSYGLVGA

SEQ ID NO: 171473 - protein, 119 aa, Glycine max
  Coding DNA Sequence Number=SeqID_54695
MTELQRSVTSFRRQGSSGLVWDDKFIAGIENQNKQESGDDGSSPSLQRSRSAGAPPYRTVNVAPQAMDPPSPKLATCGFCALFRKPVSAKPNKSKRRTSVWDCWCLAFAAEVKQVEKMK

SEQ ID NO: 171474 - protein, 211 aa, Glycine max
  Coding DNA Sequence Number=SeqID_54696
  Gene Ontology: Mol. function=binding; Cellular component =mitochondrial inner membrane; Biological process=transport
  Homolog annotation: Hit_ID=Q1RYX7; Match level="QueryCoverage=99%, HitCoverage=65%, E-value=6e-78, Identity=51%"; Hit description =Adenine nucleotide translocator 1
  Pfam annotation: Domain name=Mito_carr; Domain location=118-209; Score=116.7; E_value=6.9e-32; Accession=PF00153.17; Description =Mitochondrial carrier protein
  Pfam annotation: Domain name=Mito_carr; Domain location=24-112; Score= 118.6; E_value=1.8e-32; Accession=PF00153.17; Description =Mitochondrial carrier protein
  Pfam module annotation: Pfam domain module=Mito_carr::Mito_carr; Domain location=118-209::24-112
MQLFAYDTVKKQLSPKPGEQPIIPIPPSSIAGAVAGVSSTLCTYPLELLKTRLTVQRGVYKNLLDAFVRIVQEEGPAELYRGLAPSLIGVIPYAATNYFAYDTLRKAYKKAFKKEEIGNVMTLLIGSAAGAISSSATFPLEVARKHMQAGALNGRQYGNMLHALVSILEKEGVGGLYRGLGPSCLKLVPAAGISFMCYEACKRILVENEQD

SEQ ID NO: 171475 - protein, 62 aa, Glycine max
  Coding DNA Sequence Number=SeqID_54697
MIFIYTTILVWSARRFSFALWPIWSFLTLPLLFTLFMACMVVIPCLIFGTLRPQYYDELRTD

SEQ ID NO: 171476 - protein, 118 aa, Glycine max
  Coding DNA Sequence Number=SeqID_54698
MLHDESISFDICITAITVNDDDFSFGAIVDVNLFSVGCCANVVEAIGDHRYMFVHGFRFGSGFGGCRKVEAAKQLVPGVLKIIPTSNEDDVELSSRAMVVGVSVVVVVVVTTSKRQWA

SEQ ID NO: 171477 - protein, 610 aa, Glycine max
  Coding DNA Sequence Number=SeqID_54699
  Gene Ontology: Mol. function=ATP-dependent helicase activity; Cellular component=nucleus; Biological process=translation
  Homolog annotation: Hit_ID=Q1RT70; Match level="QueryCoverage=90%, HitCoverage=85%, E-value=0.0, Identity=67%"; Hit description =Helicase, C-terminal
  Pfam annotation: Domain name=DEAD; Domain location=115-300; Score =227.0; E_value=4.1e-65; Accession=PF00270.19; Description=DEADDEAH box helicase
  Pfam annotation: Domain name=Helicase_C; Domain location=374-450; Score=129.4; E_value=1e-35; Accession=PF00271.21; Description =Helicase conserved C-terminal domain
  Pfam annotation: Domain name=ResIII; Domain location=111-295; Score= -23.4; E_value=0.0042; Accession=PF04851.6; Description=Type III restriction enzyme, res subunit
  Pfam module annotation: Pfam domain module=DEAD::Helicase_C::ResIII; Domain location=115-300::374-450::111-295
  Subcellular localization annotation: CTP_CleavageSite=35; ConfidenceScore=5.45e-01
MLWSYASHYVPPQHRTNSFQTLTDDSTSRGGARPRDGGRGGSGSRGFSRPRIPSNRLPVEEPQDGSDAINFDAYESVPVEASGKDVPPPVNTFNEADLDEGLKRNIDRCKYVKPTPVQRHAIPIASAGRDLMACAQTGSGKTAAFCFPIISGILKGRSLSGFSSMPARGAAVAYPTALILSPTRELSCQIRDEANKYAHQTGVKVVVAYGGAPITQQLRLMEKGVDILVATPGRLVDIIERERVSLTKIKYLALDEADRMLDMGFEHQIRKIVEQMQMPSPGIRQTLLFSATFPNDIQKLASDFLSNYIFLSVGRVGSSTELIVQKIELVQDMDKRDHLINHLRRQKVHGANGKHALTLVFVETKRGADVLEGWLLRSGFSAVAIHGDKVQMERERALRSFKSGLTPILVATDVASRGLDIPHVAHVINFDLPRDIDNYVHRIGRTGRAGKSGLATAFFSDKNSPIAKALIGLLQEANQEVPSWLNQYATEGSSSGGGGRGYEAQRYRSGSYGGHDFRNVTEPEVQNYNCYNTNGNAVQFVESYTADDASYVDTSYDIQNSNIDCSFECLHIASSGSYNHTDSCELNGGGGRVEEDGPRGYASIVATGWD

SEQ ID NO: 171478 - protein, 122 aa, Glycine max
  Coding DNA Sequence Number=SeqID_54700
MDPKDNKNHVLWTNVWLAAIRTIWDQRNNLVFNGGQILCKMELVELIKFRAWQWNKAKVKDLHASLYEWSSNSYQYEAAVTFLWKKGEGFIWGDLANLEGVKIPQLWLCTCTCAGWNLIGYR

SEQ ID NO: 171479 - protein, 559 aa, Glycine max
  Coding DNA Sequence Number=SeqID_54701
  Gene Ontology: Mol. function=transporter activity; Cellular component= integral to membrane; Biological process=response to jasmonic acid stimulus
  Homolog annotation: Hit_ID=Q9SZY4; Match level="QueryCoverage=92%, HitCoverage=89%, E-value=0.0, Identity=69%"; Hit description=Nitrate transporter
  Pfam annotation: Domain name=MFS_1; Domain location=16-497; Score =26.9; E_value=1.9e-05; Accession=PF07690.6; Description=Major Facilitator Superfamily
  Pfam annotation: Domain name=PTR2; Domain location=78-481; Score =392.8; E_value=5e-115; Accession=PF00854.12; Description=POT family
  Pfam module annotation: Pfam domain module=MFS_1::PTR2; Domain location=16-497::78-481
MIAYEEGDKPSGILTKAWIEIVERLSTMGIAVNLVTYMISIMHLPSSTAANTVTDFMGTSFLLCLLGGFLADSFLGRYKTIGIFASIQTLGTATLAISTKLPGLRPPPCHANSDSCKQANGFQMGILYLSLYLIALGTGGLKSSVSGFGSDQFDEKDEKEKSQMAYFFNRFFFFISFGTLAAVTVLVYLQDEVSRSLAYGICSVSMIIAIIVFLSGTKRYRYKRSLGSPIVHIFQVIAASIKKRKMQLPYNVGSLYEDTPEASRIEHTEQFRFLEKAAIVAEDDFETNLCGSGPNPWKLCSLTRVEEVKMMVRLLPVWATTIIFWTIYAQLITFSVEQASTMERNIGSFQIPAGSVTVFFVAAILITLAVYDRLIMPLWKKWNGKPGFTDLQRIAIGLVFSIFGMAAASVCERKRLSVAKSVSGGNQATTTLPISVFLLIPQFFLVGSGEAFIYTGQLDFFITRSPKGMKTMSTGLFLTTLSLGFFFSSFLVSVVKKVTGTRDGQGWLADSINKGRLDLFYALLTILSFFGSNLRNLNNQLLCKWGQLMGPQQRKSAEG

SEQ ID NO: 171480 - protein, 564 aa, Glycine max
  Coding DNA Sequence Number=SeqID_54702
  Gene Ontology: Mol. function=hydrolase activity, acting on carbon -nitrogen (but not peptide) bonds, in linear amides; Biological process=beta-lactam antibiotic catabolic process
  Homolog annotation: Hit_ID=Q7MD66; Match level="QueryCoverage=55%, HitCoverage=59%, E-value=3e-55, Identity=39%"; Hit description =Putative N-acyl-D-glutamate deacylase protein
  Pfam annotation: Domain name=Amidohydro_3; Domain location=2-277; Score=-93.9; E_value=0.094; Accession=PF07969.2; Description =Amidohydrolase family
  Pfam annotation: Domain name=Beta-lactamase; Domain location=317-561; Score=131.2; E_value=2.8e-36; Accession=PF00144.14; Description=Beta -lactamase
  Pfam annotation: Domain name=D-aminoacyl_C; Domain location=280-324; Score=18.2; E_value=0.0027; Accession=PF07908.2; Description=D -aminoacylase, C-terminal region
  Pfam module annotation: Pfam domain module=Amidohydro_3::Beta -lactamase::D-aminoacyl_C; Domain location=2-277::317-561::280-324
LGIGVLMGYAPRSDPQEYLDLARLAAAAHAPTFTHVRELIEADPRTPIDGSEELVRAAAETGAAMHHCHVNSTSLRHVDRVLALLDRSRAAGSRVTVEAYPYGAGSTAIGAFFLAPEKLAGLGITPTSLVLVDTGERIADEARLREIRATDPGATCIATFLDEADPFDRAHLHRALAYPDSIVASDAMPISWPGLDGTPTVYEQREWPLPVGGQTHPRTAGTFAKSLRLMVLDSGAWSWVEAFRRCSYLPARVLDEVASGMRRKGHLSVGADADIVVIDPSTLTDRATYADPTRPSRGIRELYVHGDAVVHAGEIDLQHVLDATAAELGVPGAIVGVVDGDREIVATTGVAAVDTGAAVTERTLFQIGSTSKTFTGTVAMHLIESGALGLDTRVVDILPEFRLGDAAALEALRIRHLLTHSGGFLGDADEAPGWGDDALARNMRGYAQLPQFFAPGTIASYSNAGIRLLGRVIEVVTGETFEQAVQRIVLDPLGMAETFFFPWDIIAHPHAVGHVAADDGTVTRLRQWPLTRDIAPEGGIVSSVGDQLAYARFHLRGESPAAPP

SEQ ID NO: 171481 - protein, 41 aa, Glycine max
  Coding DNA Sequence Number=SeqID_54703
MAHKSYVFMFGEIVMSTHDVNLHPWVFYKDVQEGRNVNLHL

SEQ ID NO: 171482 - protein, 444 aa, Glycine max
  Coding DNA Sequence Number=SeqID_54704
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=86%, HitCoverage=81%, E-value=1e-141, Identity=63%"; Hit description =Glycosylation enzyme-like protein
  Pfam annotation: Domain name=Branch; Domain location=76-323; Score =371.7; E_value=1.2e-108; Accession=PF02485.11; Description=Core-2I -Branching enzyme
  Subcellular localization annotation: CTP_CleavageSite=63; ConfidenceScore=5.06e-01
METNNKQQQQKKKWFMPLVLSLLLSTLLILFSIFVSSDSSSLLYLYRTRGRLEEPRFVESKLRLSATSSSDSVPRIAYLISGSMGDGDTLKRTLKALYHPRNQYAVHLDLEASSQERLELANFVKNDPLFAEVGNVRMIVKANLVTYRGPTMVTNTLHAAAILLKEGGLWDWFINLSASDYPLITQDDRLVPLSLSFVVARGGGGGGIPDLLHTLSSIPRHLNFIEHTSDIGWKEDQRAKPVIIDPALYSVNKSDLFWVTEKRNVPTAYKLFTGSAWMMLSRQFVEYLLWGWDNLPRIVLMYYANFLSSPEGYFHTVICNSEEFRNTTVNHDLHFISWDNPPKQHPHFLTIDNYEQMVDSNAPFARKFGRNEPLLDKIDNELLRRNEHGYVPGRWFDQANPNITKPYSAIRNITELKPGPGAERLKRLINGLLSSEDFHTKQCS

SEQ ID NO: 171483 - protein, 947 aa, Glycine max
  Coding DNA Sequence Number=SeqID_54705
  Gene Ontology: Mol. function=RNA-directed DNA polymerase activity; Cellular component=chromatin; Biological process=chromatin assembly or disassembly
  Pfam annotation: Domain name=Chromo; Domain location=865-916; Score =24.2; E_value=0.00047; Accession=PF00385.14; Description='chromo' (CHRromatin Organisation MOdifier
  Pfam module annotation: Pfam domain module=Chromo::RVT_1; Domain location=865-916::135-304
MPEHNTRQSATERLEEAVQTLSQAHSAMNDELESILDRLSVLAIPAAPTTPTSQPNQHHHHLKLEIPRFDGQDPLGWIFKISQFFDHLFMRVIVDLITKFAHLFSEPTSLPPFRHISHHIHLHPHTSPINVKPYRYPYYQKAELEKQDGTWRCCVDYRALNAITVKDRFPMPTIDELLDELGHARWFSKLDLYQGFHQIRVAEEDIHKTAFRTHHGHYEFRVLPFGLCNAPATFQATMNELLKPFLRRFTAVFFDDILIYSPSLPAHVQHLTAVFNTLSEGEFYLRRTKCLFARRTLQYLGHIVSDKSIAPDPDKIQAMLSWPTPSTVSELRGFLGLTGFYRRFIRGYASIASPLTSLLRTDVFQWNSDAQAAFVQLQQAMTQAPVLAPPDFTATFILETDASGTAMGAVLIQRAHPIAFHSKVFCDRLRTNHKSLRDLMNQTIQTPEQQTYLTKLLGYDYDIEYKFGATNIVADALSRIPTQGTLFSLSLPNFDFLDQLRQSLHSSQSYTTLLQDILQHPDLHPGYTTNRDMIFLHKKLWLPSDCSFIPALMDEFHSTPIGGHLGFAKTLHRIQENFYWPSMRQDIRRFIAHCTTCLQTKYETKKPVGLLHPLPIPATPWEELSLDFICGLPPSHGHSTILVIVDRFSKGIHLGALPAHYTAHSVATLFFNLVCKLHGLPRSLPITRKRTAKPKFSIGWSNSIFGPSRMTTPTPGRASYPLPSGPITPQSTQAPVEAVDTLLANHQHIRSVLQTRLRKAQDNMKKAADTHRREVSYSPGDWVYVRLRPYRQSSLAPGYCKLSKRYFGPFKIQERIGPVAYRLELPPHSRIHPVFHVSLLKLHPGETPTTPGFLPETTKGNDPIVAPLTILDWKLDASTSPPSRQVLVQWNGLSPEDSTWEDWNDLAAAYVLEDKDIFPPGGIDSKRTKNSRPKRIPIKPTHLKDYV

SEQ ID NO: 171484 - protein, 408 aa, Glycine max
  Coding DNA Sequence Number=SeqID_54706
  Gene Ontology: Mol. function=protein serine/threonine kinase activity; Cellular component=cell surface; Biological process =protein amino acid phosphorylation
  Homolog annotation: Hit_ID=Q5MJV5; Match level="QueryCoverage=53%, HitCoverage=87%, E-value=9e-53, Identity=44%"; Hit description =Avr9/Cf-9 rapidly elicited protein 256
  Pfam annotation: Domain name=B_lectin; Domain location=24-129; Score =64.4; E_value=3.8e-16; Accession=PF01453.15; Description=D-mannose binding lectin
  Pfam annotation: Domain name=Pkinase; Domain location=127-391; Score =30.2; E_value=2.3e-10; Accession=PF00069.15; Description=Protein kinase domain
  Pfam annotation: Domain name=Pkinase_Tyr; Domain location=167-391; Score=-24.3; E_value=5.6e-11; Accession=PF07714.7; Description =Protein tyrosine kinase
  Pfam module annotation: Pfam domain module=B_lectin::Pkinase::Pkinase_ Tyr; Domain location=24-129::127-391::167-391
MGRPPCRSNGFADGIWLISGSPPEKTIVWNANRDNPPLPSSSKLNLTGTGLRLFTNGNESQDLIPNLTAVTCASMLDSGNIVLYSNDTETVVWQSFDHPTDTMLGVQNLTNSDTLVSSVSRFDHSSGRFFFIMQADANLVAYPMHHQISPQDAYWASKTAGSSFQQLSLDILLLQLNWRCRVSVFLNDITTIARTHHRNLVKLIGFCINGSGKLPVYEYISNGSLASFLFNDEKHISRRDTLKIALDIARGVLYLHEECEVRIIHCNINPRNILMDGAWTAKISDFGLARLLKSDHSRMRKEDDGTSKYLTPEWQKDAPVSVKLDIYSFGMVLLEIVCRRSSIDSGQLNKLVKENEDVEWRILERMVKVGLWCVQDNPPLCPSIKNVILMLEGLKDIPVPPSPAHLAK

SEQ ID NO: 171485 - protein, 132 aa, Glycine max
  Coding DNA Sequence Number=SeqID_54707
  Gene Ontology: Mol. function=oxidoreductase activity; Cellular component=vacuole; Biological process=response to oxidative stress
  Homolog annotation: Hit_ID=P93551; Match level="QueryCoverage=89%, HitCoverage=77%, E-value=5e-22, Identity=65%"; Hit description =Peroxidase precursor
  Pfam annotation: Domain name=peroxidase; Domain location=37-132; Score=-87.5; E_value=0.014; Accession=PF00141.13; Description =Peroxidase
MDAILGYLIILVMTSAVQAQLKAGFYSTPCPNAEAIVGSTVVSHFSKDLTIAPGLLRLHFHDCFVQTECRFFSYRLYNFTTSGSPDPTINVAFLAQLQALCPKNGDGLRRVALDKDSQAKFDVSFFKNVRDV

SEQ ID NO: 171486 - protein, 118 aa, Glycine max
  Coding DNA Sequence Number=SeqID_54708
MEKQKLKQLLLSHPSTLHFLPFQPAAMLKGKLKLPAPDKVRRVFPDQLGSLVAGFDEKGHGIEGSEFKLESGKELKPIQPGELGFHIGSDDDDDKETKIWQRFCHSGFSVEEVVITPR

SEQ ID NO: 171487 - protein, 95 aa, Glycine max
  Coding DNA Sequence Number=SeqID_54709
MATRRGHWWLWVVEEKMLGFSAIIHGEHNFSCAKRDNSHPAQFPLGLEFRLRERSRIVILKIPTVKPWEHGLGTNLKVIQRLMNPRSWFNRNKSR

SEQ ID NO: 171488 - protein, 137 aa, Glycine max
  Coding DNA Sequence Number=SeqID_54710
MVSPWIGEEKLKWFCFDFLYIHLPFSLSAFSKGDKFGKVAKNCQHCRLSCYDLCYLSSSHDLWGKQLKVNRQKKYANLKEGSSPESALAFQFSLIILLNLRQSKHIWKGYEELSSTKRHKDNDVDGQLRRHEISHED

SEQ ID NO: 171489 - protein, 68 aa, Glycine max
  Coding DNA Sequence Number=SeqID_54711
MVLGDHAWMKERAWSSSQLENAIRKIIMAARTTGNTKSKGIPGGEGTPIKSGPNTSMATMIKNITMEP

SEQ ID NO: 171490 - protein, 44 aa, Glycine max
  Coding DNA Sequence Number=SeqID_54712
MTMYGESPRNLCVEEVLEYVEIKPETFKGNEFEHIDTRCGRNQF

SEQ ID NO: 171491 - protein, 39 aa, Glycine max
  Coding DNA Sequence Number=SeqID_54713
MDTQHYPSYIDACWSDGSTAAIQNPSLGPSQAQNYTAMV

SEQ ID NO: 171492 - protein, 75 aa, Glycine max
  Coding DNA Sequence Number=SeqID_54714
WAKRASTTKRSFNALSVTEESGRASISRSCAKREGGAKRNDNKGPGKRILQHTTVPISGKELWRQQEEQLLQKYL

SEQ ID NO: 171493 - protein, 193 aa, Glycine max
  Coding DNA Sequence Number=SeqID_54715
MINQISPSDSLSLTTLVLHKDNHTDILDLLRVNAVPCRIAFERGKERHFCFLAISAGTSGWLVLAEELPMKKLYGVIRVAAPLAGCNPRIDDKHPRWLHLRIRPSSLPVLDPAKFNPNRKLKTKAFVDGRWTLAFRDEESCKSALSMILEEINFLSDEVHRRLKPLLNLETALDLSGPEEDSSSHSTTPPNSV

SEQ ID NO: 171494 - protein, 203 aa, Glycine max
  Coding DNA Sequence Number=SeqID_54716
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q1SYW8; Match level="QueryCoverage=87%, HitCoverage=21%, E-value=1e-80, Identity=86%"; Hit description=Cof protein; ATPase, E1-E2 type
  Pfam annotation: Domain name=HMA; Domain location=9-73; Score=15.4; E_ value=0.035; Accession=PF00403.16; Description=Heavy-metal-associated domain
MVENIKRSSFEVLGMCCATEEALVERILKPLRGVKDVSVIVPTRTVTVVHDVLLISESQIADALNAARLEASLRLQGETDNEKKWPDLTTMVCGLLLALSFLKYAYQPLGWLALGSVVIGFPKVLLRAIASIKALTLNINILVLLAVCGTAALQDFWEAGIIIFLFSIAQWLETRATHKVGDITFPFLIDSLLHFLTSVSLPT

SEQ ID NO: 171495 - protein, 216 aa, Glycine max
  Coding DNA Sequence Number=SeqID_54717
  Gene Ontology: Mol. function=protein serine/threonine kinase activity; Cellular component=beta-catenin destruction complex; Biological process=protein amino acid phosphorylation
  Homolog annotation: Hit_ID=Q1SPP5; Match level="QueryCoverage=98%, HitCoverage=50%, E-value=2e-88, Identity=77%"; Hit description =Protein kinase
  Pfam annotation: Domain name=Pkinase; Domain location=1-214; Score =114.4; E_value=3.3e-31; Accession=PF00069.15; Description=Protein kinase domain
  Pfam annotation: Domain name=Pkinase_Tyr; Domain location=1-213; Score=-72.9; E_value=5.4e-08; Accession=PF07714.7; Description =Protein tyrosine kinase
  Pfam module annotation: Pfam domain module=Pkinase::Pkinase_Tyr; Domain location=1-214::1-213
MAKCLETGEPVAIKKVLLDKRYKNRELQLMHLMDHPNVISLKHRFFSTTSADELFLNLVMEYVPESMYRVSKFYSNTNQSMPLIYVKLYMHQIFRGLAYIHTVPGGCHKDLKPQNILVDPLTHQVKICDFGSAKVLVKGEANISHICSLFYRAPELMFGATEYTTSIDIWSAGCVLAELLLGQPLLPGENALDQLVEIIKVQLVLPRVDHLDFMNI

SEQ ID NO: 171496 - protein, 316 aa, Glycine max
  Coding DNA Sequence Number=SeqID_54718
  Gene Ontology: Mol. function=transcription factor activity; Cellular component=intracellular; Biological process=regulation of transcription, DNA-dependent
  Homolog annotation: Hit_ID=UPI00005F8E52; Match level="QueryCoverage =99%, HitCoverage=99%, E-value=1e-116, Identity=68%"; Hit description= COG1609: Transcriptional regulators
  Pfam annotation: Domain name=LacI; Domain location=2-27; Score=39.9; E_value=8.6e-09; Accession=PF00356.11; Description=Bacterial regulatory proteins, lacI f
  Pfam annotation: Domain name=Peripla_BP_1; Domain location=59-312; Score=-63.6; E_value=0.021; Accession=PF00532.11; Description =Periplasmic binding proteins and sugar b
  Pfam module annotation: Pfam domain module=LacI::Peripla_BP_1; Domain location=2-27::59-312
  Subcellular localization annotation: CTP_CleavageSite=29; ConfidenceScore=5.26e-01
MSTINDVSRLAGVSKATVSRVLSGSRGVKEASRQAVLQAAETLNYRPNMIAQSLLSQSTGCIGVICAQDNINQTTSYLYALEKQLSQHQKHLLLRFANNRGDVLSALDELTCGLCDDVLIIGARFPLQIERPDVVLIDCLESDGENSIQFDHAFAAETACHYLINQGRRQIALIHPQGSGFADQVLLGYKHALEKNFLPFNRNLVFLDCASSSVAVQELMNNATTLNFNALLVSDELQAQRVVPQLQAFNRAVPEKVMVFSLAGSLQMPGIPTIPAIEYSMDAMASRIVNWLIGKSPQPGGSLLRGDLIIPERWGK

SEQ ID NO: 171497 - protein, 96 aa, Glycine max
  Coding DNA Sequence Number=SeqID_54719
  Homolog annotation: Hit_ID=Q5PC60; Match level="QueryCoverage=91%, HitCoverage=93%, E-value=8e-10, Identity=37%"; Hit description =Uncharacterized protein yicS
MKACWMLCLVTALSASAAWAESPLQSLQFEQQKQQVLKAVKEKCAPASTLSDTDFANKILASKDNQSYVREATLAKERNNQKGYLAAIDKIRCPEK

SEQ ID NO: 171498 - protein, 81 aa, Glycine max
  Coding DNA Sequence Number=SeqID_54720
  Gene Ontology: Mol. function=GTPase activity
  Homolog annotation: Hit_ID=Q1SQ91; Match level="QueryCoverage=59%, HitCoverage=7%, E-value=8e-18, Identity=91%"; Hit description =Dynamin central region; Dynamin; Dynamin GTPase effector
MGEGTFRFGLDHATPKPEPNEAKHVAPIVSSYNERIRPVLDAVENLRRLNITKEGIQLPTIVVVGDQSSGKSSNTYKYAVV

SEQ ID NO: 171499 - protein, 46 aa, Glycine max
  Coding DNA Sequence Number=SeqID_54721
MEPLQALDTSSDDTDAQSDIVGPAKMSQLSNYDDFNVIKQRNTWIG

SEQ ID NO: 171500 - protein, 107 aa, Glycine max
  Coding DNA Sequence Number=SeqID_54722
  Gene Ontology: Mol. function=phospholipase D activity; Cellular component=membrane; Biological process=phosphatidylcholine metabolic process
  Homolog annotation: Hit_ID=Q1RUP7; Match level="QueryCoverage=85%, HitCoverage=10%, E-value=2e-33, Identity=68%"; Hit description=C2
MYRSRTQTDPDRFVVQDSYFPVWHGGSVMLYQEAHVPDSMLSEVELEDWVVFEHGKCWEDICHAILEAHDLVYIVDWSIYHKVKLVREPTKPLPSSGNFNLGELLKS

SEQ ID NO: 171501 - protein, 102 aa, Glycine max
  Coding DNA Sequence Number=SeqID_54723
MDFAQADYNALYVQNGPTSFPSKIDCYHKCELECLPLFITGAVYIGCVAACFHDKCKKKPMDVVYNCISRCALTKSTEINNDDHDPATNVVDSCFEECQNEK

SEQ ID NO: 171502 - protein, 126 aa, Glycine max
  Coding DNA Sequence Number=SeqID_54724
MAKNQMKAIALVMILTIIMDFAQAHYNVFSAQNRPTSLSSWPPHDDCHAKCEQECLPHTLNPTMFLLCITACFHGKCGDKSNNDVVNNCISGCVLTKSTHINNDVRDPATYATYVVDSCSKECQNE

SEQ ID NO: 171503 - protein, 90 aa, Glycine max
  Coding DNA Sequence Number=SeqID_54725
MSKEFRKDFVILIGETLILHVNTTGSQQVHVSTMTKHIVHPYIMSMHGMSTFRHPPLVSPSSLAKHVSARSVSPSPLAKHACHMGFSTSA

SEQ ID NO: 171504 - protein, 1051 aa, Glycine max
  Coding DNA Sequence Number=SeqID_54726
  Gene Ontology: Mol. function=protein binding; Biological process =protein metabolic process
  Homolog annotation: Hit_ID=Q9LU73; Match level="QueryCoverage=96%, HitCoverage=96%, E-value=1e-175, Identity=40%"; Hit description =Arabidopsis thaliana genomic DNA, chromosome 5, P1 clone:MUL3
  Subcellular localization annotation: CTP_CleavageSite=48; ConfidenceScore=5.24e-01
MRSGACTLQQTLTAEAASVLKHSLGLARRRGHAQVTPLHVAATLLTLRASSLRRACLKSQPQTQTHSHHPLQCRALELCFNVALNRLPTTPGPLLHTQPSLSNALIAALKRAQAHQRRGCIEQQQQQQQPPLLTIKVELEQLIISILDDPSVSRVMREAGFSSTVVKSNIEDTSSSAPSVFYNSSGGGVFSSPGSPSPSEKNNVFRQNHFLAAYTSNEFSSTSPNSSLLLKKASVFPIIESPPPSSSKEDIKVVFDVLLRKKKRNTVIVGDSLALTEGLVGELMGKLERGEVPDELKSTHFIKFQLASPVSLRFMKRDEVEMSLSALKRKVDSVVVSGGGGAIFYVGDLKWTVELGTSEKEEGGDVCGYNYYYNPVDHLVAEIGKLFCDSNNTTKVWLLATASYQTYMRCQMRQPPLETQWSLQAVPVPSGGLGLSLHASSVHDSKMTISQNPSNMMETKLFSSKKEEQDKLNCCEECASSYEKEAQLFKPGQKKLLPSWLQSHTTEAHQKDELAQLKRKWNRLCHCLHQSKQPQNHWSNTLHGNYHSSNGNKIYHYNSSYPWWPNQGTSVFTDSSSISFADSPPKPAYSSNNNIVPRFRRQQSCTIEFNFSDVTQKKPSTTALDSLKGMEGNNSSEVKITLALGNSTFGGGSGQTVENIITTTDRTLRRAHICKLLQENVPWQSETIPSIAEALVDSKSAKQSSTTWLLLQGTDSIGKTRLARAIAESVFGSVDFLLHLDMLKNNNKENSADIVAGALKSHEKVVVLIESLDFADAQFRKFLADGFETAKFGNLSMNEKSSGQAIFILTNGDTRSNEEKKTNNSVMKLVLQISETKPSLESSSPSLGQKRRAEVLDLFTNVKSPRVEEKEEGKKVFSRHSSFNNLDLNMKADEEEDDDGSSPISSDLTRETVVDQLELIENRFEFNEGPEREREREVTQMFLSRIKESFEEVYDDDNGDGVVVNFTVEERVIEEIGVGFGNFTNSMFEKWLKDIFQSSLLQTVVNFGDGGKERGIGFTLCWGGKGDRKSDSDGFMGSCLPKNVQVNYFMD

SEQ ID NO: 171505 - protein, 138 aa, Glycine max
  Coding DNA Sequence Number=SeqID_54727
  Gene Ontology: Mol. function=transcription factor activity; Cellular component=nucleus; Biological process=regulation of transcription, DNA-dependent
  Homolog annotation: Hit_ID=Q9LTC5; Match level="QueryCoverage=88%, HitCoverage=89%, E-value=1e-26, Identity=51%"; Hit description =Nicotiana EREBP-3-like protein
  Pfam annotation: Domain name=AP2; Domain location=20-85; Score=147.0; E_value=5e-41; Accession=PF00847.10; Description=AP2 domain
SKQKKGMEEHQKGKLQGKEEVRFRGVRRRPWGKYAAEIRDPSKQGSRLWLGTFDTAEEAARAYDRAAFNLRGHLAILNFPSEYYSQIRGSPPYPPHLATPSSSSHASESTSSAAQQRHVFEIPCLDDKVLEDLLGLSE

SEQ ID NO: 171506 - protein, 147 aa, Glycine max
  Coding DNA Sequence Number=SeqID_54728
  Gene Ontology: Mol. function=transcription factor activity; Cellular component=nucleus; Biological process=regulation of transcription, DNA-dependent
  Homolog annotation: Hit_ID=Q9LSX0; Match level="QueryCoverage=52%, HitCoverage=56%, E-value=5e-15, Identity=53%"; Hit description =Nicotiana EREBP-3 like
  Pfam annotation: Domain name=AP2; Domain location=16-81; Score=146.2; E_value=8.9e-41; Accession=PF00847.10; Description=AP2 domain
MDEEGSRGRAKEDAGDVRYRGVRRRPWGKFAAEIRDSTRQGQRVWLGTFNTAEEAARAYDRAAYTMRGPFAILNFPDEYPVTAAGATNAATYSSASSSSSLASSSRHADVEARGRSEQGREVFEFEYLDDKLLEELLDCENKKKRGP

SEQ ID NO: 171507 - protein, 124 aa, Glycine max
  Coding DNA Sequence Number=SeqID_54729
  Gene Ontology: Mol. function=oxidoreductase activity; Cellular component=transcription factor TFIID complex; Biological process =electron transport
  Homolog annotation: Hit_ID=Q1T227; Match level="QueryCoverage=95%, HitCoverage=32%, E-value=4e-46, Identity=74%"; Hit description=AAA ATPase
VCDELEDVMEAGGNIVDYHGCVFFPERWFNCVVVLQTDNTILYDRLSRSGFIIIAYFPRICDRGYKDSKLSNNIECEIFQVLLKESYSEEKVIAMKSDNIEDISRNDATLTDWVRNWSLPSQTS

SEQ ID NO: 171508 - protein, 323 aa, Glycine max
  Coding DNA Sequence Number=SeqID_54730
  Gene Ontology: Mol. function=metal ion binding; Cellular component =integral to membrane; Biological process=ubiquitin cycle
  Homolog annotation: Hit_ID=Q9LSW9; Match level="QueryCoverage=87%, HitCoverage=78%, E-value=1e-73, Identity=53%"; Hit description=RING -H2 finger protein ATL5K
  Pfam annotation: Domain name=C1_4; Domain location=82-126; Score= -7.0; E_value=0.017; Accession=PF07975.2; Description=TFIIH C1-like domain
  Pfam annotation: Domain name=PHD; Domain location=82-127; Score=0.9; E_value=0.046; Accession=PF00628.19; Description=PHD-finger
  Pfam annotation: Domain name=zf-C3HC4; Domain location=83-124; Score =32.6; E_value=1.4e-06; Accession=PF00097.15; Description=Zinc finger, C3HC4 type (RING finger)
  Pfam module annotation: Pfam domain module=C1_4::PHD::zf-C3HC4; Domain location=82-126::82-127::83-124
MATAFLLVSYYIFVIKCCLNWHRIDVLRRFSPSRRREDPPPTYSPATDTRGLDEALIRLIPVTQYKAQQGDDRDFGERRFCECAVCLNEFQEDEKLRVIPNCSHVFHIDCIDVWLQSNANCPLCRTSISLTSRFHIDQLLTLRPSSSSYPHDQTPPRENLIGGDEDFVVIELGSDHDRSQNLQERGNALELPTCPISPSSPRKLLEHRNVQKKKAMKLQKVTSMGDECIDIRAKDDQFFSVQPIRRSFSMDSSGDRRFYLAVQEALRNQNWQVNEVNSIEGCSGIGSRAKSPPSRPCARKHGQGLQDLLHTSGTREMPHLCQK

SEQ ID NO: 171509 - protein, 47 aa, Glycine max
  Coding DNA Sequence Number=SeqID_54731
MKSCRDWVTLSEVDGDEETVANCGALLHKLGLMHEISDGLNTSLKDH

SEQ ID NO: 171510 - protein, 111 aa, Glycine max
  Coding DNA Sequence Number=SeqID_54732
MTSVAVMKAQRPLHGMQMGEIAMECFAIRPIPPRERRLMVYIRILQKNDIDVYLSPLIEDLTKLWNEGVVVFDGYLSYPNFVRGLLFDGMQPLFDRFEVLGTLCCTIRQVP

SEQ ID NO: 171511 - protein, 82 aa, Glycine max
  Coding DNA Sequence Number=SeqID_54733
MEKTSGVATNVYLRKMLEKPKRQRSAYFENEGSRVVYARENEGPVEKSKRQSWLKTKKKITDGRKMKMKTCKARMNPYGCIE

SEQ ID NO: 171512 - protein, 269 aa, Glycine max
  Coding DNA Sequence Number=SeqID_54734
MHARARVMSEVEEVQEWMKADMEAMKEKMATMVEAMMSMKKIMEVNAVVVAVTSAVAEVDPTPSSGLNQINHPTSNMVGQGGKELGSTGDPYFVQVQNKQAFSPYGLPPNYPPPNVAHALVENVNNFTPILIESQQSQTDHAHVPQPMGETHEVPHHNLADFEPHLRYATEGQVVSGVPLPNTLEGPQFRPPPQPLHFMAGRIPLAMAEKGKLDHIEERLKAIEGGGDHAFADMAELYLVLDIIIPPKFKTPDFDKYKETTCPKNHLKM

SEQ ID NO: 171513 - protein, 204 aa, Glycine max
  Coding DNA Sequence Number=SeqID_54735
MACGEHHGYPLSLFSRLLQSPFHPEIIKFDGMQRPSWSSAFIIFKTILVSFAFQRQSSPLVCGDNHGHPLSLFSRLLKSPLPSRDNQVCWHVETIMVILYISKMTMSSKGENAFIYISKTTMHLHFKDDNVFSHFMSSKGNNAFICISKMTMSSKGDNVFSHFMLSKGDCHNLPSDVGTKRPLRWAKGASSIEGKRAESPPTFI

SEQ ID NO: 171514 - protein, 57 aa, Glycine max
  Coding DNA Sequence Number=SeqID_54736
MRSWCREGIGGVDRIGLRHWILETVRLREGKRGVSVVTNEKEVETLIPKMRSSKVVF

SEQ ID NO: 171515 - protein, 153 aa, Glycine max
  Coding DNA Sequence Number=SeqID_54737
MTTTKSESPAHQEKKGEKMKNSAENKKEEEVELKPSKKKEQHYYPVSKPPSAPTLQDSFNISHSHHSFSEGDLQKAAASYSLSSLSDGAIKVVKDEKNDKSLVVAVMDVEEDAEDADGVNKKEAFSVLAGDRRKKLRRGSSTNNLYLSYYDSS

SEQ ID NO: 171516 - protein, 34 aa, Glycine max
  Coding DNA Sequence Number=SeqID_54738
IQKVVGNLKHEIAVESKGYYYSKVEKLTFYDYYT

SEQ ID NO: 171517 - protein, 118 aa, Glycine max
  Coding DNA Sequence Number=SeqID_54739
MGKQWRHFKSDLTMKWAPTTGKGSVDDTVCQKYDISKEKWTQFCQSHRDPSWEDSLEEQASQGSFVAHGRQDVLTVAIGRLEHPRRICVARVGVMIKQYFGPTLRTFRSSFSMCGVPK

SEQ ID NO: 171518 - protein, 177 aa, Glycine max
  Coding DNA Sequence Number=SeqID_54740
  Homolog annotation: Hit_ID=Q9AVH2; Match level="QueryCoverage=47%, HitCoverage=41%, E-value=1e-39, Identity=70%"; Hit description =Putative senescence-associated protein
MARHKAGKNEREPTNGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPC

SEQ ID NO: 171519 - protein, 53 aa, Glycine max
  Coding DNA Sequence Number=SeqID_54741
MEVNESSGEKAKKTWVGLVSVMGELGNGEKEKRESEARDKSKTKDHNKNGMKY

SEQ ID NO: 171520 - protein, 116 aa, Glycine max
  Coding DNA Sequence Number=SeqID_54742
MGADPPLESIMFGVTCGVDIPSSCSRQCQILCQNPLGWKSHANLLCFRANLHPSSSRSSDRKSSIVMEMSLKGSKKEYTVASNDMFVTPWSVFVARFKLMGYTVEGEGGIEGRMNE

SEQ ID NO: 171521 - protein, 38 aa, Glycine max
  Coding DNA Sequence Number=SeqID_54743
MKTLAKSISQKGSLNPELNKMLPGVSEPNNPAFHAKLV

SEQ ID NO: 171522 - protein, 106 aa, Glycine max
  Coding DNA Sequence Number=SeqID_54744
  Gene Ontology: Cellular component=integral to membrane
  Homolog annotation: Hit_ID=Q5Z9R9; Match level="QueryCoverage=96%, HitCoverage=21%, E-value=1e-22, Identity=48%"; Hit description =Putative amino acid transporter
MKFSLSFFRLVWRSIFVVLVTILAMAMPFFNEMLALLGAMGFYPLTIYFPVEMYIARKKIKRGAKRWLGLKTLSLVFMLLSMAIACAAIHGMNQALRKYKFFMYKE

SEQ ID NO: 171523 - protein, 81 aa, Glycine max
  Coding DNA Sequence Number=SeqID_54745
MDKIPFNLPHTIYINILKNMKTLGGVDDIHYATLINKILWEHQAMKVDIRRNMPNPPVDKDTSNKGGKRTWLESWLMKTKL

SEQ ID NO: 171524 - protein, 140 aa, Glycine max
  Coding DNA Sequence Number=SeqID_54746
MTKIEDKGPLGFLRKRKEEPVVPQKPNQTMIPSSLEKKRKTIVGLKSLTPKETIKILSSEGFNAIVALDAPSLMRSTYPNLVTMSPQLLANGTTTTTYPSPEEAEEKQKQASNHPFMKASKPTPRMRISDMDPSKENPTP

SEQ ID NO: 171525 - protein, 64 aa, Glycine max
  Coding DNA Sequence Number=SeqID_54747
MIPKVNDPQSLNEYRPISLVGYYEKAYDSVCWEFLLYMMRRMGFYAKWVSWIERCLKLPQSQSL

SEQ ID NO: 171526 - protein, 71 aa, Glycine max
  Coding DNA Sequence Number=SeqID_54748
MQLSVHAGYMPVHCRCWADPTQPYQIIYCKSAAATNAETEQQHDPAPAPSSNDRQQHDPAKQQPAAPRMAA

SEQ ID NO: 171527 - protein, 50 aa, Glycine max
  Coding DNA Sequence Number=SeqID_54749
MTAVNMEKDTVSFNMPFNDRQIAIDVRCFYLRNQGLYTRLMKEEVRQGTN

SEQ ID NO: 171528 - protein, 386 aa, Glycine max
  Coding DNA Sequence Number=SeqID_54750
  Gene Ontology: Mol. function=porin activity; Cellular component =integral to membrane
  Homolog annotation: Hit_ID=Q8LIZ0; Match level="QueryCoverage=99%, HitCoverage=48%, E-value=1e-129, Identity=58%"; Hit description =Putative nucleoporin Nup75
  Pfam annotation: Domain name=Nucleopor_Nup85; Domain location=2-386; Score=116.6; E_value=7e-32; Accession=PF07575.3; Description=Nup85 Nucleoporin
MPRMRPESVGKLGECYKSKPDFIKAWEKWRSQITKLDCSRFWIQCDNQQTREGLRNLLQIMLGNTESLCMATCYWIELYISHFLYIRPFTMGIESMYNLAQKCIQLKPRSSTHRLSVLMIGILEENTEVVLAECSREFGPWLVAHAIELLTAGSEQAEILLHEERYNLGGISIVELHRLVYAQILSSHALTWQTESKDETDVSYTGFSMSKRPKQPMPNESFFYEIAPIYLTSCMKQGMGLLENLLYRQSAQHNDVLLKNIEICRLYELDHISSNIMKIAGVHHWKHGHKGAGVFWLQQAQDASCLDKIAQQLFDSVGKSISDESFKQWEGMIELLGSESKPAGGLEFLHKYRDFKKSLQKVSSGKSTDAARQAVGSLILVLHTPL

SEQ ID NO: 171529 - protein, 125 aa, Glycine max
  Coding DNA Sequence Number=SeqID_54751
  Gene Ontology: Mol. function=RNA-directed DNA polymerase activity; Cellular component=mitochondrion; Biological process=RNA-dependent DNA replication
  Homolog annotation: Hit_ID=Q1SRI1; Match level="QueryCoverage=92%, HitCoverage=25%, E-value=1e-23, Identity=34%"; Hit description=RNA -directed DNA polymerase
MTDRWKTEAASCLNCSLLAIPFVYQGIPIGANPRRIPKKVTEKLVSIQRRFLWGGDIDQNKIAWIKWEIVCLPKDKGGLGIKDLNTFNIALLGKWRWNLFQHEGQLWARVLESKYGGWRGLDEAH

SEQ ID NO: 171530 - protein, 570 aa, Glycine max
  Coding DNA Sequence Number=SeqID_54752
  Homolog annotation: Hit_ID=O48768; Match level="QueryCoverage=89%, HitCoverage=91%, E-value=1e-148, Identity=51%"; Hit description =Expressed protein
MYILVDNRPWLSDLGSRGVHIWQLMVTKSRLSPFAYSKSRRERKEGKEVCPQSSSSKPKKFMRWFSLIEAVMLSRKKVLLPVKNLRNSLQLSSELHRTLYGFIVFEVAWTSVRGINYYNELQTDTSLAIEAKLMKRWEFDSIAQAADCMSSWFSGTPSEKLLLKEHLDSASGDTFYDASEDFSGTVSVDDGDDNVCRILTVEDSLGTKVGVYSDDTEETTDMLHTPPPSGPNKRRKLMNFFSAGVEVGSYSAAEIDNSLDYSQTFSCVSDDTVETTQDDTVEATQYSDVLLSFRFNDHDLPFKFREVIVSDLRLLTLLEAGLPSWVIFLQSYPVLCNLYRPWMCPLARLLYFLISFVTVLIGFYDLYKNVPVLKATASRICGPLLDWIETWEMVSRVKYLGTMLFLHNFQKAVRWFLAFTHTMRSFFSFLVQPLVESLVEIFGFLLPSFKFLFELAESIFSVIWLVVDTSFDIVGNVLELLFSPFWFVLNVVWSIATCILYPLFWVLWEFLYAPVRLVLFAASSEATVSASEVSMWRTLWNDLFSQIFRALKSILYGFVAFFTACNRHRL

SEQ ID NO: 171531 - protein, 275 aa, Glycine max
  Coding DNA Sequence Number=SeqID_54753
  Gene Ontology: Mol. function=RNA-directed DNA polymerase activity; Cellular component=intracellular; Biological process=RNA-dependent DNA replication
  Homolog annotation: Hit_ID=Q2HTK5; Match level="QueryCoverage=81%, HitCoverage=90%, E-value=3e-27, Identity=31%"; Hit description=H+ -transporting two-sector ATPase, alpha/beta subunit, central region
MERNHLQQNILDYLISCQQNHLIQHMGGNKEADWEWNFSWRRPLFDNEIPMAVDFLQHIESKPIQIHRRDEWVWTADSSGQYTTKSAYKMMRGGDIDGTQDRAFEELWKLKVPIRYAVFAWRLLRDRLPTKSNLLRRQVKIVGRTCPFCRSAEEEAGHLFFHCSKIIHIWWESLSWVNNVGVFPQDPRQHFLQHGSIAADGLRINRWKCWWLAVTWTIWKKRNDILFSNDSFDNSKMMDEAALLMWTWLRNLEKDFATHFNQWSSNLREGFCNSF

SEQ ID NO: 171532 - protein, 126 aa, Glycine max
  Coding DNA Sequence Number=SeqID_54754
MGTGMGTYFLISARIGVEVGDRLPSRGRGGKCNTRPCFTPLPCLVSLFFVYYTICLPQLLNGDTFQSPNPLFFETKRGLTLEAFENKNPPTPLSSTIGPSMQYFILIPTSSEPWNVERYDFSYSSN

SEQ ID NO: 171533 - protein, 128 aa, Glycine max
  Coding DNA Sequence Number=SeqID_54755
MAAEWRRKRERRRHFKEKMTLEEAHHHRKPWIKAWRKKEMNEGRGREEHKILCSKRALKSKPEIYPKAHENPKAFSCISGLIFLESSIQCPCRVGLHQFVLVGLKKKCLGLHRLIVNNGTEDNIMVEK

SEQ ID NO: 171534 - protein, 69 aa, Glycine max
  Coding DNA Sequence Number=SeqID_54756
MLLKGSLSEPDWLSEAHLLSEEASSLSEHKTLEDVKSECSNLESRTKTKRVRLFHVRNPSLSKLMVQEH

SEQ ID NO: 171535 - protein, 69 aa, Glycine max
  Coding DNA Sequence Number=SeqID_54757
MAPYCRFIMAACMAPAGVGISPVGLEDEKHCLVTSSQNKQCEIKIVRGKATCGQIVFLAQSYAGFMTSR

SEQ ID NO: 171536 - protein, 215 aa, Glycine max
  Coding DNA Sequence Number=SeqID_54758
PRSTHTYAKEKEISSLRAIITNPNLFRRSLTVRLPGGNIPHILIGIFLRILLTIFLNEPPDSSLGKLPTNFLCRYCIILYSQAQEETPVAFDPNNKNVRFRWLPGVHLHQEIMVGSHSSAMPRICRDFQVTLVENMTTNSVPYPQETTSQRTYPRYHSIRPSQTLRIGASTPFSQRIYFIVIVGPDCNGTKRRQKVNQKNRRKLGREVEDLKALS

SEQ ID NO: 171537 - protein, 60 aa, Glycine max
  Coding DNA Sequence Number=SeqID_54759
MVKGGGVMKGKGREEGKRVGCWKSRRIGRSNNFRSSSFSVQPSENQKLWLIDSTSLVSRF

SEQ ID NO: 171538 - protein, 190 aa, Glycine max
  Coding DNA Sequence Number=SeqID_54760
  Gene Ontology: Mol. function=hydrolase activity
  Homolog annotation: Hit_ID=Q1RU20; Match level="QueryCoverage=62%, HitCoverage=18%, E-value=5e-19, Identity=35%"; Hit description =Ovarian tumour, otubain
MEFKRVDTQDAVKDMLWSHPYSIKLLNSFPTMLIFDITYKMNKYILLLLEIVGVTSIDMTSSVAFAYLQPKRKENFEWALRKNVRAKWKMHVSKTEKWETMMDAWAGLVQSLDEELYEQCLKCFANLCVATYPSAGGRREGSRVRLPRKENARSRHQLLFEENVKKTGKLWSTKFNRERFGSCFYAQERY

SEQ ID NO: 171539 - protein, 1095 aa, Glycine max
  Coding DNA Sequence Number=SeqID_54761
  Gene Ontology: Mol. function=nucleic acid binding; Cellular component= oxygen evolving complex; Biological process=DNA integration
  Homolog annotation: Hit_ID=Q1SEJ7; Match level="QueryCoverage=96%, HitCoverage=98%, E-value=0.0, Identity=56%"; Hit description =Integrase, catalytic region; Zinc finger, CCHC-type; Peptidase aspartic, catalytic
  Pfam annotation: Domain name=STAT_int; Domain location=93-189; Score=- 30.3; E_value=0.074; Accession=PF02865.8; Description=STAT protein, protein interaction dom
  Pfam annotation: Domain name=rve; Domain location=413-576; Score =176.1; E_value=8.5e-50; Accession=PF00665.16; Description=Integrase core domain
  Pfam module annotation: Pfam domain module=RVT_2::STAT_int::rve; Domain location=688-888::93-189::413-576
MENLCVRFNGKNYAAWEFQFKMFVKGKGIWGHVDGSSSKPTTMAELAAWETLDAQSISWLLGSIEPLMTCGTISTAFSIKTIPQNAFSWNWTANYSQANFSIQEYYSCFLNLWAEHSAILHVAVLKTSLATVQEVYEVTKRDQFLMKLRPEFEAVCAALLNRHPFPSLDVCVGELLQEEQRLLTQAALSRDSSISIAIAVAYTAQDKGKGRDTRQRGHIITDCPTRPPRRQVQPFHAANSMTKTPTSVPTNADALTLEKVQQMVLSALSALGIQASNHMIGTSEHLKNVRTYNGTQNIQIADGNTLSITAVGDITPSFRHVSRKVITTGPKVGILFPLQFTLPRLLSFNCTGVTNKYEDWHKKLGHPNSVVLSHLLKNRFLSNKITIPGSSFNCSVCKLAKSKILPFPSNAHRADKCFDIIHSDVWGISPILSHAKYKYFVIFIDDYSRFTWIYFLRSKDQVFSMFKTFLAYIANQFHTSIKILRTDSGGKYISAEFQTYLQQQGIISQRSCPYTPQQNGVAERKNRHLLDVTQALLLQASVPSHFWVEALTTAVYLINCLPSQVLGLDSPFFRLYNIQPRYDDLHPFGCVCFVHLPPLERHKLGAQSVQCAFMGYGYVYTRRPLVPPLPDSEPSPERTPIAPRRSSCISRPLDRYGYSPTSLTATLSSIPIPTCYSQAVKDVCWVKAMQEELQALQENYTWDIVPCPPNDEPFGCKWVYSIKLNSDGSFHRYKARLVALGNKQEYGVDYDETFALVAKMTTIRTVLSIVASKGWSLHQMDVKNVFLHGDLAEDIYMTHPQAGIVLLLIYVDDMVITGSDHVSIQHLKRQLQASFHMMDLGNLNYFLGLKVNSHPKCLFLHQHKYTNDLISLAGLQSAAPVDTPHEVNVKFLRDEGDILPNPLLYRQLVGSLNYLTITRPDISFAVQQVTQFMHTPCHLHLVTVRRIIHYLKGWCMFLGSSLISWKSKKQARVSKSSTESEYRAMSLACSEIIWLSGLLAELGFPQTEATPLYADNTSATQIAANPVFHERTKHIEVDCHSIREALDNHIVSLPHITSQLQLADIFTKAVPRPRHQFLNNKLMLLDHPHQFEGGC

SEQ ID NO: 171540 - protein, 350 aa, Glycine max
  Coding DNA Sequence Number=SeqID_54762
MGHLKDLMSATDAAMSPRRSLEQDMYSEQSDQDEKESLYDDYAIANGPDSTKSFSIDQTSRSSLDVQNINASSHNSSKDCWELVLAKTVTAPIETSPKLANGFHPSVTLFDQASVPQDKYNPFLDDTTIVAPPVTTSDNFIDVFDFDVAPTFKATTQTFYAQDLVVTTFSDQSSNSIANPDVIFGDMYPNETTNEATFRAQGSSAKNNMIVPLNSNTKTSDNMITTPSFQSQCSFKNASLPTFQMHKSNLDAIMEAPTLISPQNPNLSILPIHFQAHNLYASTIPPTFSAKDCNETTLAASIEDDPFGPWPSTNTNEQTLNNVSMQEDTLSRQQQLWLEQQQKIISKHLT

SEQ ID NO: 171541 - protein, 76 aa, Glycine max
  Coding DNA Sequence Number=SeqID_54763
  Subcellular localization annotation: CTP_CleavageSite=29; ConfidenceScore=5.06e-01
MSGNSSNNNNISKRISVLSSHFARSSPIMASEKQAALAVTPSDADAPTIFDKIINKEIPSTVVYEDDKFEWKSWLS

SEQ ID NO: 171542 - protein, 294 aa, Glycine max
  Coding DNA Sequence Number=SeqID_54764
  Gene Ontology: Mol. function=phospholipid binding; Cellular component= coated pit; Biological process=endocytosis
  Homolog annotation: Hit_ID=Q9ZVN6; Match level="QueryCoverage=100%, HitCoverage=47%, E-value=1e-106, Identity=63%"; Hit description =Putative clathrin assembly protein At1g05020
  Pfam annotation: Domain name=ANTH; Domain location=26-293; Score =266.5; E_value=5.4e-77; Accession=PF07651.6; Description=ANTH domain
  Pfam annotation: Domain name=ENTH; Domain location=26-147; Score= -29.7; E_value=0.012; Accession=PF01417.11; Description=ENTH domain
  Pfam module annotation: Pfam domain module=ANTH::ENTH; Domain location=26-293::26-147
MPSKLRNAIGAVKDQTSISLAKVTNAANLEVTILKATNHDKNPIEERHVNEILNIVSSNKVYAAACAHYIGKRIGKTRNWVVALKCLMIVLRIFQDGDPYFPREVFHAMKRGAKILNLSNFKDNSNSSSWDYTAFIRTFALYLDERLDCFLTGKLQRRFTYHNQFHERNQKNKLSNEPGIKDMKPTMVLDRISHWQRLLDRAIGSRPTGLARTNRLVQISLYAIVRESFDLYRDISDGLAVVLDSFFNLPFLASAATFNACVKSYKQFDELSTFYSFCASIGVGRSYDYPRVAK

SEQ ID NO: 171543 - protein, 94 aa, Glycine max
  Coding DNA Sequence Number=SeqID_54765
  Homolog annotation: Hit_ID=Q8H6Q8; Match level="QueryCoverage=89%, HitCoverage=2%, E-value=4e-15, Identity=45%"; Hit description=CTV.20
MGIDVVVLMCLRDIRHNKFKDSLIGTVETSLGQGPTYFNCYPSKMVSLMDRNILDSLFLNIHFHDLHMKESSIPATLIYRIQYKVMNTCASRVL

SEQ ID NO: 171544 - protein, 79 aa, Glycine max
  Coding DNA Sequence Number=SeqID_54766
MAVPPKKNQQEDEGTWTRKRRKNTNAQGGRRKGSDDVRNVNSDAAQLATPSIMWLICDCGSQTQMDSILQTQPITCYYK

SEQ ID NO: 171545 - protein, 79 aa, Glycine max
  Coding DNA Sequence Number=SeqID_54767
VKLERSSSGGGCGEGEGEVIFVWLFRFLIVERTKGGAKANWVRWFCSLKGEKKMKERTTKNRGNNSAEMEHLEHSMASI

SEQ ID NO: 171546 - protein, 84 aa, Glycine max
  Coding DNA Sequence Number=SeqID_54768
LSARLALSSYSLTRAKCDVEIRKPFLSLICTELKGEPRGLFTTQSVNFRERKAEQGAKFSSFREISEFLRVCEIPRGGGDIPTP

SEQ ID NO: 171547 - protein, 75 aa, Glycine max
  Coding DNA Sequence Number=SeqID_54769
  Subcellular localization annotation: CTP_CleavageSite=52; ConfidenceScore=5.38e-01
DSESGSRRRYLMVIRTFRHPRGTNSTVLLSSSGNIQARRRARFFSTEQGRSSAMAEGSSAGGDIGRTNDVPLERN

SEQ ID NO: 171548 - protein, 452 aa, Glycine max
  Coding DNA Sequence Number=SeqID_54770
  Gene Ontology: Mol. function=lyase activity
  Homolog annotation: Hit_ID=Q1S8G7; Match level="QueryCoverage=66%, HitCoverage=59%, E-value=5e-33, Identity=37%"; Hit description =Cyclin-like F-box; FBD
  Pfam annotation: Domain name=F-box; Domain location=21-68; Score =29.3; E_value=1.4e-05; Accession=PF00646.23; Description=F-box domain
  Pfam annotation: Domain name=FBD; Domain location=366-417; Score =32.6; E_value=1.4e-06; Accession=PF08387.1; Description=FBD
  Pfam module annotation: Pfam domain module=F-box::FBD; Domain location=21-68::366-417
MDSMRRRCINKRLKPNPEGQDFISNLPDFIIGLILSLLPTKDAFRTSVLSKRWINLWMFITAVEIKDKEQLSRKKIRKIPFYKFVNKVLLHLESSSIQSFSLSLSQSYRHCRVDKWINDILINLRVKELYINSKQNLSISCHTLLESPSLEVLMLNMNWYSITLPTFVCLSSLTVLKFSKITVTCDPFKSQMLTLNFPVLREYLTEDCNWSNVKGVTLEVPLLEVLSIKYSRFPISKESNTVIKFCAPCLAKFYYYGLLLPDTNSLDLSIGHIAYAHIDICPFIYMGSAEQMALIACELLKKFNNNVECLTFQWPEIVAPAKLPTFRMLSCLELGYLTGEVLLNFLRNTPFLKTLVILKGIYQFDEELSNPDNVPSCFMSNLQVVNFGALNGKKHELRLAKFIMDNAKELQRVSFSAARNMHRSKFEKVKKKIISFKKSVSVAVIDFLPLHN

SEQ ID NO: 171549 - protein, 104 aa, Glycine max
  Coding DNA Sequence Number=SeqID_54771
MTQLGQPEEVAAVRLGPTGRHPVPASCAVLLYESPGDRRSNHLTGCDRNPERLAETRDQCRKTQGPARLIWGLEGWRTPASTSQREVRIMIAGAGMLLSSNVIP

SEQ ID NO: 171550 - protein, 174 aa, Glycine max
  Coding DNA Sequence Number=SeqID_54772
  Gene Ontology: Mol. function=transmembrane receptor activity; Cellular component=membrane; Biological process=defense response
  Homolog annotation: Hit_ID=Q5JBT4; Match level="QueryCoverage=85%, HitCoverage=14%, E-value=3e-34, Identity=48%"; Hit description =Candidate disease-resistance protein SR1
MLSNQELHEAGQTKFWFPGATIPEWFNNQSRGHSSSFWFRNEFPVNVLCLLLARVERIDVDDIFMPAVFINGKLHKNPSRGTKVRKVKLDYTYLFDLKSALELNDISEVALEKERNQVEITYAGLIETSLVKATGTHVFRQDDIRYDDPYYGKRKLEHDLNSCESRVGNKAFYV

SEQ ID NO: 171551 - protein, 564 aa, Glycine max
  Coding DNA Sequence Number=SeqID_54773
  Gene Ontology: Mol. function=signal transducer activity; Cellular component=membrane; Biological process=signal transduction
  Homolog annotation: Hit_ID=Q13H86; Match level="QueryCoverage=32%, HitCoverage=47%, E-value=3e-77, Identity=79%"; Hit description =Putative acyl-CoA dehydrogenase
HQEDRHALGLARDLVQRRGPGQQDHQVGMLHPRDPDLLAVDDVAVAAAHGGGLDLGGVGAGGGFGHAHGLQAQLAGGDARQVFALLRLGTMPQQGAHVVHLAVAGAGIAAAAVDFLHDDRGFGQAQARAAVFLRDQRGQPAGLGQGAHEGVGIAAFFIDLAEIFGGELGAQVADGFADVLVGVGGLRHGVGCDVDNEREFGTGSNVPQGAAPANSQFINTGFLFAKAHLCDRRSSCGERGCVAMQQTDGYAEKSQGDDGGFRHSGGVCGAVCAGRGGRHLRAARKPRRHRGAGPRQHRARQRPVGHDQPPVPGARRADRRQNRHGRRTGGGARPVAEAGRRAAETGGGQPGAAARQCRHQRAGRAAVRPDAGGVCRLCRPDPGADVQGDQGLERHRGQPAGRQGAAGVRRGLRQAGRGLPGLRAPAGPGGGGRRQPDHAAGDAGGRGRARLRAGAGGADPAGRAPTHPAPVERGRRALRPHRRRRPDRQYRRPWRQRDRRAVFGHAPHADRPVGGGGVGAPWRRGNPYGLGRDRRRRRRHVGPHRAPGRVVAGSGGQHDAAGAH

SEQ ID NO: 171552 - protein, 39 aa, Glycine max
  Coding DNA Sequence Number=SeqID_54774
MDTSKPYTGAMVMTKDNDWYLKALHWGNEGAPCMSLKRT

SEQ ID NO: 171553 - protein, 133 aa, Glycine max
  Coding DNA Sequence Number=SeqID_54775
SFMTNGIELFGYCESLVGLMGTRAERNEEKATVVPGDMSRGSGDLGDVRWGAIAQNQAWPILTQPGHSQSVRTCDGLKIETGHSVASGNRLPMGVWETLEGNERCRFRGTIRLTATSLVHPEQPARTLQQPVE

SEQ ID NO: 171554 - protein, 51 aa, Glycine max
  Coding DNA Sequence Number=SeqID_54776
MLQCLRYFSQLKHDIKIPNCENARRWAVNVVLKFHDDPTVNESEIIIFLRQ

SEQ ID NO: 171555 - protein, 105 aa, Glycine max
  Coding DNA Sequence Number=SeqID_54777
  Subcellular localization annotation: CTP_CleavageSite=44; ConfidenceScore=5.36e-01
MRRKSKGSVVTLSVKFRNLTKTKRKYCYTIRPLGPSRFFLQKAVASGGSNLARQGELGGKLLPYFAINRGRNEEGRGSTFLALRILLKLLRKIVSVKKIQAEALP

SEQ ID NO: 171556 - protein, 120 aa, Glycine max
  Coding DNA Sequence Number=SeqID_54778
  Gene Ontology: Mol. function=protein binding; Cellular component =lateral element; Biological process=DNA metabolic process
  Homolog annotation: Hit_ID=Q8S8B4; Match level="QueryCoverage=92%, HitCoverage=9%, E-value=2e-53, Identity=87%"; Hit description =Putative chromosome associated protein
  Pfam annotation: Domain name=SMC_N; Domain location=1-115; Score= -25.5; E_value=8e-10; Accession=PF02463.9; Description=RecFRecNSMC N terminal domain
GANGSGKTNFFHAIRFVLSDLFQNLRGEDRQALLHEGAGHQVLSAFVEIVFDNSDNRIPVDKEEVRLRRTIGFKKDEYFLDGKHITKTEVMNLLESAGFSRSNPYYVVQQGKVLADGDSA

SEQ ID NO: 171557 - protein, 95 aa, Glycine max
  Coding DNA Sequence Number=SeqID_54779
  Gene Ontology: Mol. function=RNA-directed DNA polymerase activity; Biological process=RNA-dependent DNA replication
MLNYTTWLVSKIDPIKYIIEKPAATGWISRWQVLLSEFDILYVTQKAIKKSVLAYYLAQQPINDYQPMHPEFPDEHIVTLFEEEVEEEDRNKCIE

SEQ ID NO: 171558 - protein, 178 aa, Glycine max
  Coding DNA Sequence Number=SeqID_54780
  Homolog annotation: Hit_ID=Q39887; Match level="QueryCoverage=85%, HitCoverage=87%, E-value=2e-13, Identity=38%"; Hit description =Proline-rich protein
  Pfam annotation: Domain name=Extensin_1; Domain location=110-119; Score=7.6; E_value=0.95; Accession=PF02095.6; Description=Extensin -like protein repeat
  Pfam annotation: Domain name=Extensin_1; Domain location=121-130; Score=5.6; E_value=4.3; Accession=PF02095.6; Description=Extensin -like protein repeat
  Pfam annotation: Domain name=Extensin_1; Domain location=132-141; Score=5.2; E_value=5.5; Accession=PF02095.6; Description=Extensin -like protein repeat
  Pfam annotation: Domain name=Extensin_1; Domain location=143-152; Score=5.2; E_value=5.5; Accession=PF02095.6; Description=Extensin -like protein repeat
  Pfam annotation: Domain name=Extensin_1; Domain location=154-163; Score=5.2; E_value=5.5; Accession=PF02095.6; Description=Extensin -like protein repeat
  Pfam annotation: Domain name=Extensin_1; Domain location=33-42; Score= 5.4; E_value=4.9; Accession=PF02095.6; Description=Extensin-like protein repeat
  Pfam annotation: Domain name=Extensin_1; Domain location=56-65; Score= 3.7; E_value=17; Accession=PF02095.6; Description=Extensin-like protein repeat
  Pfam annotation: Domain name=Extensin_1; Domain location=66-75; Score= 9.1; E_value=0.33; Accession=PF02095.6; Description=Extensin-like protein repeat
  Pfam annotation: Domain name=Extensin_1; Domain location=77-86; Score= 9.1; E_value=0.33; Accession=PF02095.6; Description=Extensin-like protein repeat
  Pfam annotation: Domain name=Extensin_1; Domain location=88-97; Score= 9.1; E_value=0.33; Accession=PF02095.6; Description=Extensin-like protein repeat
  Pfam annotation: Domain name=Extensin_1; Domain location=99-108; Score=9.1; E_value=0.33; Accession=PF02095.6; Description=Extensin -like protein repeat
  Pfam module annotation: Pfam domain module=Extensin_1::Extensin _1::Extensin_1::Extensin_1::Extensin_1::Extensin_1::Extensin _1::Extensin_1::Extensin_1::Extensin_1::Extensin_1; Domain location =110-119::121-130::132-141::...
  Pfam module annotation: Domain location=143-152::154-163::33-42::56 -65::66-75::77-86::88-97::99-108
MTCVHSLVLFLFGVVILTTPVLANFFPPIYEPPPIEKPPIYEPPPSYEPPPTENPPPLYKPPFYPPPVYQPPYEKPPPVYQPPYEKPPPVYQPPYEKPPPVYQPPYEKPPPVYQPPNEKPPPEYQPPNEKPPPEYEPPHEKPPPEYEPPHEKPPPEYEPPHEKPPPEYQCTATRSLHQ

SEQ ID NO: 171559 - protein, 79 aa, Glycine max
  Coding DNA Sequence Number=SeqID_54781
MTFEAAKEIAEKIDSLEEQASQGSFVPHGCQDLLTVAIGRPEHPSCVRAIGASVTIKQYFGSAPRTSHIPPWLPKNSSS

SEQ ID NO: 171560 - protein, 122 aa, Glycine max
  Coding DNA Sequence Number=SeqID_54782
MATPLGSPPPPPPPPPPPTRTVVHVDLAIGKADGPHKKKLRTYLGIVARHKVNVTYQTSKQVPAAQKDLIWEDIQTEFDIPEATNSRTKKKILQTVKERWRQFKSDLRRKWALAADNDSKEK

SEQ ID NO: 171561 - protein, 128 aa, Glycine max
  Coding DNA Sequence Number=SeqID_54783
MEKSDKMNFKEKKEKKGYITWEDNVLNYSSDSEKKIISLGIMMKDYENGEKQSRYIDSNFSKHMACIKVYSYFSPRKVNMRFMETTNKGHLINNLNNYWKLKLKMEVGSWKWKLLEVELEMKLLEVES

SEQ ID NO: 171562 - protein, 267 aa, Glycine max
  Coding DNA Sequence Number=SeqID_54784
  Homolog annotation: Hit_ID=Q1T493; Match level="QueryCoverage=58%, HitCoverage=29%, E-value=6e-15, Identity=29%"; Hit description =Nucleic acid-binding, OB-fold, subgroup
  Pfam annotation: Domain name=Rep_fac-A_C; Domain location=67-197; Score=-50.6; E_value=0.0034; Accession=PF08646.1; Description =Replication factor-A C terminal domain
MTSCWKFNNLERDLGIEVRSILAPIGQGSSQVSGSSQLSSKDVFLSKTEVKNISEINASSEEFVRVTVAKITTIVMDNYSWCYPACGQCYKKADMQTVPFTCLYGKENDQPVLRYRVEVMVSHKGEQTKFLIWDREYAQLIGQSVDEVNRLKIEDGDVDLNASPQALDRLLGCFLAFKVKVQPRFRNFVVLKYSDELELINVVLDMIPDSEQSLSITADHDRSMLASSEPTEFESNFAYRSINILSSNLCLLPGDHDPLPRDSTDTN

SEQ ID NO: 171563 - protein, 111 aa, Glycine max
  Coding DNA Sequence Number=SeqID_54785
CLYSPLLSFKSISPWDKKYRDRSYCRSPYASRSRNRIHTPPLLGFAKNCLWREKYASHEALQNGGFNPFSFSLTFGNSIRAIRGKIEESQKIARDAAIAVGRHVIPLRGKG

SEQ ID NO: 171564 - protein, 220 aa, Glycine max
  Coding DNA Sequence Number=SeqID_54786
MAHDQGWEQELSPNNQYEEERTPNLESVFEEFMSNHASAKANQNSMKNHEIHFCKNYSIENFQGGHELQPYYQNEAERGSNLDKLLMQFMETTKSTQQALQSVEIQVEAQEKSPVKEHESREKNEEKDEEQAQQQWEKYSIVENQQENILQSNNLPRQLIDKKGRQGEHEETLSTILSLITNTFLEIIWNFIPDYMKFMKFLAKRRNFKEDVFFVTFMPP

SEQ ID NO: 171565 - protein, 87 aa, Glycine max
  Coding DNA Sequence Number=SeqID_54787
MDSLKQSWYIDSDCSKHMAGDASKFIYISPKDSEYMTYGDNNKGFDDDKKNSLDNDCHHQKGGECQANNIKKKIRPQTISLVDWFLP

SEQ ID NO: 171566 - protein, 125 aa, Glycine max
  Coding DNA Sequence Number=SeqID_54788
  Subcellular localization annotation: CTP_CleavageSite=45; ConfidenceScore=5.31e-01
MSVRVGVYPSPNLLRFSLNSTKLAMSSSFRPKPLLGLYPSLNITRATINAALDERGYTGGDSMSQPTLQREGDARLTGASSKEGKHAELPPTFIRGKRRKKPEKAWSTNFKCQRFGSCIYARGRY

SEQ ID NO: 171567 - protein, 300 aa, Glycine max
  Coding DNA Sequence Number=SeqID_54789
  Gene Ontology: Mol. function=chitin binding; Cellular component =extracellular region; Biological process=chitin metabolic process
  Homolog annotation: Hit_ID=UPI000044A8F0; Match level="QueryCoverage =63%, HitCoverage=99%, E-value=5e-27, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HVLAIRGLHAFTFRGLHVLAIRGLHALTFRLLHVLAIRGLYALTFRGLHVLAIRGQHALTFRGLHVLAIRGLHILAIRGLHTLTIGGLDALAFRGLHVLTFRGLHALAFRGLHVLAFRGLHALDLRGLHTLAFRGLHVLLFRGLDVLTFRRLHALPLRELHVLAFGGLHAVPFRDLHAVVFKGRHVLDFEGLHASSHLEGYGGRAHKTPSGPGEVQQGPRVSSSGYGPLDHARKSPSGPGEVQQGLQVSSSDYGPLDRARKTPNGLGEVQQGLGVSSSDYGPLSVLRSACHPQQGHQAPY

SEQ ID NO: 171568 - protein, 304 aa, Glycine max
  Coding DNA Sequence Number=SeqID_54790
  Gene Ontology: Mol. function=DNA binding
  Homolog annotation: Hit_ID=Q1S0F5; Match level="QueryCoverage=59%, HitCoverage=34%, E-value=1e-17, Identity=34%"; Hit description=IMP dehydrogenase/GMP reductase
MGWSEYRGSTWRRKRKLWRIKGFVDLAAIDAFLAYHHSKESPVVAVLANAYDTFDRRCEKSGARIVCCTPALYVWLASHLFRHESRLVYPLQGHRMCAEKWKAIWEQLLASMVGASINWFPQWKEGRVGVLSLYEGFSNIPLMGARGCINYNPVLAIRQLGYPMRGALSEESTTPFIARGFGDPNARIFQRVQKAWSAVQMKDKELRGSSNGIIGGYHKWLRAQMQELDWLPKLKTSSEEEAETPEESEEVEALKVELDRAQAVKEKFKMTAIKVWKECDELKDINVANAEALERETKRARKEE

SEQ ID NO: 171569 - protein, 149 aa, Glycine max
  Coding DNA Sequence Number=SeqID_54791
MSKIEEVQEQLKADMDAMKEQTTTMMETIMSMRKMMEVNTDAVAATSAAIEVDATNPSGVNQSKHPFPPYGLPPNYTPPNVAHVPNENIDHSTPIPLRANNLSLGMHMLLNPWGRHMKYPETTCWPTSSLTPDMPPRGKHLVAYPSQTP

SEQ ID NO: 171570 - protein, 92 aa, Glycine max
  Coding DNA Sequence Number=SeqID_54792
MMERKNFDHLEERLRAIEGWGDYPFVDMAELCLVPDIIIPSKFKVPDFNKYKGTTCPKNHLKMYCRKMGAYAKDEKLLMHFFQESLTGAAIT

SEQ ID NO: 171571 - protein, 105 aa, Glycine max
  Coding DNA Sequence Number=SeqID_54793
MHFYTINHFPAYGNLSGYNVKGHRACPIREEDISYIQLKYEKNVCNSVIGTLLNIQGKTKDGLNTCQDLAKMGIEPSYIQGLMKGDEFLSEFAPCQSPTRILFKY

SEQ ID NO: 171572 - protein, 65 aa, Glycine max
  Coding DNA Sequence Number=SeqID_54794
MSQNFTNFLTMGAKYLEVVKRGSHPNSGWSPDEIRSLGGETQNDHNLSLRATGHDRLWMAKRCTE

SEQ ID NO: 171573 - protein, 108 aa, Glycine max
  Coding DNA Sequence Number=SeqID_54795
  Homolog annotation: Hit_ID=Q1RUD8; Match level="QueryCoverage=89%, HitCoverage=20%, E-value=3e-10, Identity=33%"; Hit description=IMP dehydrogenase/GMP reductase
MGTNQTGKRFYQVKIKGLDITNIKELGWLMGPLQMQAFRKAYGKILDFTIAEISTEAIASLAQYYDQPLRCFTFGDFQLVPTVEEFEEILGCPFGGSNRIFSPGSFPP

SEQ ID NO: 171574 - protein, 254 aa, Glycine max
  Coding DNA Sequence Number=SeqID_54796
  Gene Ontology: Mol. function=RNA-directed DNA polymerase activity; Biological process=RNA-dependent DNA replication
  Homolog annotation: Hit_ID=Q8H6Q8; Match level="QueryCoverage=50%, HitCoverage=43%, E-value=2e-30, Identity=52%"; Hit description=CTV.20
AVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSVNGDIPYESLSYGQLISYVQKVALKICQDDKIQRQLAKEKAQTKRDLAGKMLQRLELGFAISYPLAMALDKMQDKCLQRYTLHSLGLMIGSKLLWKSLVSLSFVTLAFTRLITLYHAFIGSEIPKIPTQCSEVPSLCHQIPMEGMEEV

SEQ ID NO: 171575 - protein, 131 aa, Glycine max
  Coding DNA Sequence Number=SeqID_54797
MQSSKRDVYLEAYLNGLDNYLKGIINSALKELNDTPQPKSKAGARWIVLNIKHKYIHHLKLSKIWEFCKIHSDIQSKEPPLVAIPPGPLSSVESASDADMTSSRDPPQGVGPHHPLESQEPPQQAQEVAPL

SEQ ID NO: 171576 - protein, 76 aa, Glycine max
  Coding DNA Sequence Number=SeqID_54798
MDRSALVLLGLSLLPDRIDQLPYYKDHTADPHWQTDLLLVTGACGIELRREQREKGARKSPPTDKRFGTSPATITS

SEQ ID NO: 171577 - protein, 145 aa, Glycine max
  Coding DNA Sequence Number=SeqID_54799
MWFIVLYDHVFSIGFLLTSKNLFRAVNLVGLRFTGCYRSHAYNHLKKHVRCLKHIHHWISHTTMPEKTLGCQVGNLVATNSEGETSETIPCDPFSLNRPHHGPLCNWIAEVLDIIYTQFLGFPGNTSHPIPEVSELKNFFRIRLL

SEQ ID NO: 171578 - protein, 104 aa, Glycine max
  Coding DNA Sequence Number=SeqID_54800
MLDPMLAAWYWKSIQEEAILKFAKAFDHIAFMGAQSVFFSRFLNIILPEVVSYIKFKSKHGVDDPYGVVVVAKSSCKTLAKEKEALERQLRDKKIVVNRTSKAT

SEQ ID NO: 171579 - protein, 184 aa, Glycine max
  Coding DNA Sequence Number=SeqID_54801
  Homolog annotation: Hit_ID=P22195; Match level="QueryCoverage=32%, HitCoverage=19%, E-value=4e-14, Identity=63%"; Hit description =Cationic peroxidase 1 precursor
MSDTMSRTSCPKILELLKALKLQDPRCRIRCPGHLARKYWTYKSVISLTDYCAIFRKKDRSHPAQEVAAQIRSLLYKHEGCTSSVPSPGLKSYFILIVIVPQPLGLMQGHQKPEFFLLVCSVTHSFIEEKSAGANVNSLRGFEVIDDIKTKVEAACPGVVSCVDILAIAACDSVVAISLINMNK

SEQ ID NO: 171580 - protein, 142 aa, Glycine max
  Coding DNA Sequence Number=SeqID_54802
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=56%, HitCoverage=10%, E-value=9e-33, Identity=81%"; Hit description =Digalactosyldiacylglycerol synthase 1, chloroplast precursor
MCYAQLQLNKENNGQKASVDKGKLIAKSASMPNLIELVDGGLAFPHYCLTGNQFLRLCAGAIPGTRDYDNQHYKDLHLLPPPLNKLVGQPNTSAQDQITAHNKRKFQHQDKTCILSLMGLLWLNKKYTKFIQTSRLLIYSWY

SEQ ID NO: 171581 - protein, 68 aa, Glycine max
  Coding DNA Sequence Number=SeqID_54803
  Gene Ontology: Biological process=biosynthetic process
  Homolog annotation: Hit_ID=Q6DW76; Match level="QueryCoverage=86%, HitCoverage=7%, E-value=1e-15, Identity=70%"; Hit description =Digalactosyldiacylglycerol synthase 1, chloroplast precursor
MRNWSHKAKGYKELLDLLAKHKADLHGFKLDVFPNGEDANQVQSAGKRLDLNLNFQKGRDHAVDSLHG

SEQ ID NO: 171582 - protein, 64 aa, Glycine max
  Coding DNA Sequence Number=SeqID_54804
MARGRRQTSGDWKDNRVHCSSRSHPAPPHQCRYIELRIGDYVRVPFIGIKAVLTPFPSSFFLLP

SEQ ID NO: 171583 - protein, 296 aa, Glycine max
  Coding DNA Sequence Number=SeqID_54805
  Gene Ontology: Mol. function=electron carrier activity; Cellular component=mitochondrial matrix; Biological process=electron transport
  Homolog annotation: Hit_ID=Q8LFE0; Match level="QueryCoverage=84%, HitCoverage=100%, E-value=1e-109, Identity=77%"; Hit description =Electron transfer flavoprotein beta-subunit-like
  Pfam annotation: Domain name=ETF; Domain location=68-258; Score =222.2; E_value=1.2e-63; Accession=PF01012.11; Description=Electron transfer flavoprotein domain
MIKPGKGTSSEQRCATGRKGFLEAHALFFWFCYTAKHRERHSTMTMKIMVAIKRVVDYAVKIRVKGDKTGVVTHNVKMSMNPFCEIALEEALRIRESGLASEVVAVTMGPSQSVDTLRTGLAMGADRGIHVESTASLYPLSVAKILRKLVEIEKPGLLILGKQAIDDDCNQTGQMIAGLLNWPQGTFASKVVLDKEKQVATVDREVDDGIETVCLNLPAVITTDLRLNQPRYATLPNIMKAKSKPIKKFTPEELNVEIKSDLEIVQVTEPPKRKAGVILSSVDELIDKLKHEANVI

SEQ ID NO: 171584 - protein, 72 aa, Glycine max
  Coding DNA Sequence Number=SeqID_54806
MPELMILGGISGVHIISSVVKFRDYLNAFSRLIKDQKDFKPYLLMVLVQVGLSILYLITKASFNHGMSPCKS

SEQ ID NO: 171585 - protein, 265 aa, Glycine max
  Coding DNA Sequence Number=SeqID_54807
  Gene Ontology: Mol. function=carboxypeptidase activity; Cellular component=membrane; Biological process=auxin mediated signaling pathway
  Homolog annotation: Hit_ID=Q10RR0; Match level="QueryCoverage=93%, HitCoverage=66%, E-value=2e-68, Identity=50%"; Hit description =Integral membrane protein DUF6 containing protein, expressed
  Pfam annotation: Domain name=DUF6; Domain location=26-159; Score =36.9; E_value=6.9e-08; Accession=PF00892.11; Description=Integral membrane protein DUF6
MEQKRCSFVTKCRDFKPHLLMVLVQFGYSFLYLITNASFDHGMNPFVYVTYRHILAAVLMFPFAYFLERNARPKLTFSLFMEIFVLSLLGVSLTINMHFASLKYTNPTFIVAMLNTIPTLTFVIAVAFRFELLDLRNSRGIAKVLGTLISLAGALIIALYKGNLMRNLWRPLIHIPGKSAAINESWLKGSLLTVLSCVTWSICVIGEIQAATLKRYPAQLSLVTWMSFVGAAQSAVFTVIVEHNRSAWTIGLNIDLWSTIYGVKY

SEQ ID NO: 171586 - protein, 104 aa, Glycine max
  Coding DNA Sequence Number=SeqID_54808
MAFWNYGWTLVDADNNQASSCCATRSLKTLDLFPLTTTIINEDCTTPPKTLDLFPLITTRINEDCTTPPNLLLKEINLYIGNHARMFQLPRLLSLVRGTYGCTM

SEQ ID NO: 171587 - protein, 77 aa, Glycine max
  Coding DNA Sequence Number=SeqID_54809
MGTKGDRGRFMVCIELSANTRKITTCTLYFGGHEETKNFQEKRREEKARRARHQPLPLLIVARLFKFSPNIDSLCSA

SEQ ID NO: 171588 - protein, 251 aa, Glycine max
  Coding DNA Sequence Number=SeqID_54810
  Gene Ontology: Mol. function=microtubule motor activity; Cellular component=microtubule associated complex; Biological process =microtubule-based movement
  Homolog annotation: Hit_ID=Q2HVG9; Match level="QueryCoverage=99%, HitCoverage=100%, E-value=1e-102, Identity=74%"; Hit description=4/1 protein
MAATSDEEMESLLSAFDQIYEDAKSGISEMQLLQSNYNAEFKMRESLQISSNALKRENDSLTKLYSESLKNLADQLDYRTKCLNLKEELERANNEVLLKEHGHRKDVELLKREYEQKIVCLEAQVKESVHEKATYEATVNQLHGDLAAHKSHMQVLAMRLDQIHDEVELKYNSEVQDLRVCLAVEQEEKNDLNRKIQNLEKELLICKAKLVDQQQEMTSNWHVETLKQKIMKLRKENEVLKRKFSHSQESK

SEQ ID NO: 171589 - protein, 115 aa, Glycine max
  Coding DNA Sequence Number=SeqID_54811
  Gene Ontology: Mol. function=RNA-directed DNA polymerase activity; Biological process=RNA-dependent DNA replication
  Homolog annotation: Hit_ID=Q1S4N5; Match level="QueryCoverage=62%, HitCoverage=14%, E-value=4e-11, Identity=49%"; Hit description =Peptidase M, neutral zinc metallopeptidases, zinc-binding site
MATEELTAERLAKGSTEIGPDQAQEEQSIKPFVQWHLVNDKDVLRREAISYFKKLFQENCQGDPSCVEGDNIPRIEQGPFEDLLKPVSFDEVKVALFSMSPCTALGPDGFQPIFH

SEQ ID NO: 171590 - protein, 81 aa, Glycine max
  Coding DNA Sequence Number=SeqID_54812
  Homolog annotation: Hit_ID=Q8L7R5; Match level="QueryCoverage=52%, HitCoverage=28%, E-value=7e-09, Identity=69%"; Hit description =Ethylene responsive element binding protein, putative
MKTNQQQTVLQQNHTERDKRMKKFQKSRILNYQKAVKLKKLGVVAMEAIDPAAKTNCDILRAKPRTVPGVPGKSFIFLSKS

SEQ ID NO: 171591 - protein, 354 aa, Glycine max
  Coding DNA Sequence Number=SeqID_54813
  Gene Ontology: Mol. function=carboxypeptidase activity; Cellular component=membrane; Biological process=auxin mediated signaling pathway
  Homolog annotation: Hit_ID=Q10RR0; Match level="QueryCoverage=97%, HitCoverage=93%, E-value=1e-110, Identity=55%"; Hit description =Integral membrane protein DUF6 containing protein, expressed
  Pfam annotation: Domain name=DUF6; Domain location=198-327; Score =52.2; E_value=1.7e-12; Accession=PF00892.11; Description=Integral membrane protein DUF6
  Pfam annotation: Domain name=DUF6; Domain location=26-159; Score =34.5; E_value=3.6e-07; Accession=PF00892.11; Description=Integral membrane protein DUF6
  Pfam annotation: Domain name=TPT; Domain location=189-327; Score= -8.0; E_value=0.0016; Accession=PF03151.7; Description=Triose -phosphate Transporter family
  Pfam module annotation: Pfam domain module=DUF6::DUF6::TPT; Domain location=198-327::26-159::189-327
MAQKKASHVLVCKELKPHLLMVLVQVGYTFLYFITEASFNHGMSPYVYVTYRHIVAAVVMFPFAYFLERNARPKLTFALFMEIFVLSLLGVSVTLNMYFASLKYTNPTFVASMINTIASLTFIIAVALRFEVLDLRNPRGIAKVIGTIISLAGVLIMTLYKGPVMRNLWHPLIHIPGKSAAINEDWLKGSILTVSSCVTWSLWYIMQASTLKRYPAQLSLTTWMSFVGAAQSAAFTVIVEHNSSAWTIGLNVDLWSTIYGGVVVAGLIIYIQLWCTEKKGPVFVTVFNPLSTILVAILAYFVFGEKLYLGSIIGAIIVIIGLYFLLWGKEGDQEVYMKTKDKSQCSTVDPECRI

SEQ ID NO: 171592 - protein, 49 aa, Glycine max
  Coding DNA Sequence Number=SeqID_54814
MATASGYINARNCCYRNRGQGLAVYVFDFQAGNITGQCGQGTSPDGNIG

SEQ ID NO: 171593 - protein, 83 aa, Glycine max
  Coding DNA Sequence Number=SeqID_54815
MHGGTASQTGEFVAGEAQPTLQATCAGYVLQEREAWRRGKNSPLVQASCSFGEVLNLICIILHYTMYSSYVLWIAILNTRFRC

SEQ ID NO: 171594 - protein, 91 aa, Glycine max
  Coding DNA Sequence Number=SeqID_54816
GLVDLVTIDAFLADHHSKESSVIPVWADAYDTFNLRCEKSSARIVYCTPALYVWLARASKKLFAKMARKATAGEGSSSAPQAEIEFDGHYF

SEQ ID NO: 171595 - protein, 155 aa, Glycine max
  Coding DNA Sequence Number=SeqID_54817
MAMSVARLKKDEIQRLKKEIDSVWRPAMELHELETSAVLKNLLEDRERMPALLVFFDGTAFNNIVEEFKNFTTHIAHVLPVFDDGGSTAKIVVCPRDWRNLIVLGDNGFFLCYIYQGGNTIFFEVAVDGTLAIVDGLRWGGSTTMDGPKLILKLL

SEQ ID NO: 171596 - protein, 432 aa, Glycine max
  Coding DNA Sequence Number=SeqID_54818
  Homolog annotation: Hit_ID=Q9FH24; Match level="QueryCoverage=74%, HitCoverage=98%, E-value=6e-34, Identity=29%"; Hit description =Arabidopsis thaliana genomic DNA, chromosome 5, TAC clone:K20J1
MQIEVMISFVVVPSHVATEVIIEKKNATDGGVHGCRVVGSEPMMSEWRSKKKGGEREGKCPMEDLSSKGGGSRRGMAWFVSSCALYLIHFQVSAPRASGVGGGRVGGACDNEISDGMQCMNHPHNNSNNNPGGICAFCLQDKLRNLLSSSPPLSSSSSPSPSFTPPPPPSVKTDHDHNTRSRLPFLVPKKNNNKKPSSYTNISSSANIIFKRSKSTATPKRNQFLEEKDFSPRKRNGFWSFLYPSSSKEAKSFGPNGKYRGKCLGKKSDHVIIVEEDKCLSSSSSSSSKVSRSRSVGCGSRSFSSDFFERISSGLGDCTLRRVESQREGGKPKLAASANTMNHCMKERVRCGGIFSGFVMNSSSSTTSSSSWVSSSVDDGRGRSWGWAFASPMRAFTTKGSPPSSSSKRDASDKNNATPNLSAIPTLLTVRG

SEQ ID NO: 171597 - protein, 91 aa, Glycine max
  Coding DNA Sequence Number=SeqID_54819
MFRILDANPWRETSKPVYVLTQKENQLCTMKTRRNRSEVERELGLLFSKGSKWSSGIGNQSKQVRGGTTNKFQMLVEDVREGVLCKLGCKL

SEQ ID NO: 171598 - protein, 114 aa, Glycine max
  Coding DNA Sequence Number=SeqID_54820
MDEFDVQVAWLGAQPSHSGGGGTSAAQEPTLEEPPAEGEDELTPPEPFYFDVDAHMAQEEGTSTDQILEPSLAPVLEETQPSTPVTEPEQPIHDSSVALALDLNEDQPQDEHGI

SEQ ID NO: 171599 - protein, 74 aa, Glycine max
  Coding DNA Sequence Number=SeqID_54821
MKVKHMRYTTITLDSSLHAMWYHFSVKNLVGCLGVHDRTCLTMGLQEHSNWMTPKAYTPKSPSGPLPLDSVRLK

SEQ ID NO: 171600 - protein, 193 aa, Glycine max
  Coding DNA Sequence Number=SeqID_54822
VDPEVDFFPTWVIDNILTIPIKQFDYHDVLVWRFTVDGVYSGKSSYQLALNKEENAAKGSSEGCGDGWKIWSSNAIPHSIIERVPNSLPLPPRTLQIQSRTRTGFGVIFRDENVYVLVPVAKFMKEEFDVHLTVVSAIIVIGVRQLTVGSAIIVIVRGKVQPYVLSPGATIVLTLGKELKEADRASCSKFLHL

SEQ ID NO: 171601 - protein, 200 aa, Glycine max
  Coding DNA Sequence Number=SeqID_54823
MNAQMHQFDGLARGRGIEVECWMVVCMACCGQSYLDCQKWCGGCGVLFVVAAESAFSAIIEVVVYELHRLYRIQNILMKNMEATRGAQQNPKLNFDLERPAKEDMAEADSDGVLDVINETEIELTLRPLSYKRKKVETPLTSDLAHSLSFSSTGSSLINKTRLKTRHSSYSAAEELSGGLIGLVHVRHLTAGCQSGIRSS

SEQ ID NO: 171602 - protein, 393 aa, Glycine max
  Coding DNA Sequence Number=SeqID_54824
  Homolog annotation: Hit_ID=Q01H26; Match level="QueryCoverage=11%, HitCoverage=50%, E-value=5e-12, Identity=65%"; Hit description=[Z] KOG3430 Dynein light chain type 1
  Pfam annotation: Domain name=Dynein_light; Domain location=82-140; Score=21.3; E_value=9.3e-06; Accession=PF01221.9; Description=Dynein light chain type 1
MSEDAKKNIAGALTARPNSDDQKLSPLPSPAPAVPPKKVIIKSADMIPDMQKEAVDIAVAVSFDNFLLFFCGSSFWILFLGLVVLAALCHKVLTILRIIQAFEKYNVEKDVAEQIKKEFDKRHGPTWHCIVGRNFGYKNDGEKGSVSIPGEGIPGGAMVRTKKGGEDEEVKRLEVLVVPICLERKALNWFQWWEVWTERIAWFMFKRALMGVWMIPKHFIGEPTSGSYKPLSDLRSNHQRIIKRYRPQRRVGPVNNRTTLGNKWISPNDLKEMSGTRSCNCRNSSFKKTTDKELEGLGDIKASFKVHVIRINVNGEEVEIKGDPSLSRTVAKATLKELKRGNESYYVVLGMLTLYDLDLLRTVEGLEGVSWRNMQSFFKKPLNYLLLEDVIMQ

SEQ ID NO: 171603 - protein, 86 aa, Glycine max
  Coding DNA Sequence Number=SeqID_54825
  Gene Ontology: Mol. function=RNA-directed DNA polymerase activity; Biological process=RNA-dependent DNA replication
  Subcellular localization annotation: CTP_CleavageSite=51; ConfidenceScore=5.03e-01
MEAFQVLKKAMTGLLTLSMPNFSMPFEIETNALGFGIGAVLMQQGRSLVFSSQAVSERMQMKSIAKMEALFVGGWAILSLIVIKEA

SEQ ID NO: 171604 - protein, 205 aa, Glycine max
  Coding DNA Sequence Number=SeqID_54826
  Gene Ontology: Mol. function=ATPase activity, coupled to transmembrane movement of substances; Cellular component=integral to membrane; Biological process=transport
  Homolog annotation: Hit_ID=Q1RSS5; Match level="QueryCoverage=53%, HitCoverage=7%, E-value=7e-41, Identity=77%"; Hit description=ABC transporter, transmembrane region, type 1
  Pfam annotation: Domain name=ABC_tran; Domain location=61-162; Score=- 55.7; E_value=0.015; Accession=PF00005.17; Description=ABC transporter
MVFVEKIQQLTNIPSEPTWNIRHHLPPSNWPVEGNVDIKDLQVRYHLNTPLVLKGISISGGEKVGVVGRTGSEKSTLIQVFFRLVEPSRGKITIDGIEIFALGLHDLRSRGRTTKGYANRLWNQNPILLDHVLLLEHVDAILALHISVMAWMTSWQCFKPCGSYENPREWGHEKKIPHDGIWEHEGMMGIEDAKGKVVGGWGARE

SEQ ID NO: 171605 - protein, 583 aa, Glycine max
  Coding DNA Sequence Number=SeqID_54827
  Gene Ontology: Mol. function=RNA-directed DNA polymerase activity; Biological process=RNA-dependent DNA replication
MDRMKLFNGSNLLDVVDLIDSGEMHHRVRKDGDAKPFVEGRRGGRALIIVNVYPTCDLVENMRLWEELLRQKGSYNDNIWCMVGDFNVVRSLEERRGIVGQRVGCSRETEEFNTFLDTMELGDIPMIGRKFTWYKAGGLARSILDRMVVLSSWLDLWPSSSQFILNRDISGLCPLVLKHKIINWGPKPFKVLNARLKERDFTKFVHQVYVFGNLDALCGKLSKEIKELDIKGNTGSLSLEEEEHRKNLMEEFWKVSKRQESLLLQNSSRARWLKEGGDSTCYFHKVVKWRRSNNIQGIVKERRWVDDPMVVKEVVKAFIMERFKEHGDKSPIPNGYNFSFIKHFWDLLKGDIVAMMHDFHSCGKLPRGVNASFIALIRKVDNPQGLGEYRPISLIGCLIREAVMNNLFVLMEVGDGSMKVVLLQFTDDTLFFGVTLVGNVLTLKSILRYFEIMAGDESQLFQEGVGANDKEVEGEAQFMGTQYHCELAKKFSLGVGGAEGRKLAWPCSLWAKVNMAKYKKANRTLVENERGWFHRDVAQKLADEADILFWEDALCGKGRIGGVSGLSGGWGDLVGRRKFWDCC

SEQ ID NO: 171606 - protein, 76 aa, Glycine max
  Coding DNA Sequence Number=SeqID_54828
  Gene Ontology: Mol. function=transcription regulator activity; Cellular component=nucleus; Biological process=regulation of transcription
  Homolog annotation: Hit_ID=Q1T454; Match level="QueryCoverage=67%, HitCoverage=21%, E-value=3e-19, Identity=92%"; Hit description=Helix- loop-helix DNA-binding
MGEKTVVVSLTCSKRTDTMVKLCEVFESLKLKIITANITSFSGRLLKTVFIECGTPIANSIRLFRAFMRALTRNSE

SEQ ID NO: 171607 - protein, 162 aa, Glycine max
  Coding DNA Sequence Number=SeqID_54829
  Pfam annotation: Domain name=DUF581; Domain location=51-90; Score =19.5; E_value=7.6e-05; Accession=PF04570.5; Description=Protein of unknown function (DUF581)
  Subcellular localization annotation: CTP_CleavageSite=44; ConfidenceScore=5.74e-01
MVGLSVVLEAQKGSVSKKTPQVINKTTMLSSCSSSSNNKHSSSSAAAAVSSVSLSQHSPFQEAAKFLDQCFLCRKRLLPGKDIYMYKLKVCFLGSVLEHECASEEGTGLSVAWSAGASRFSWMRKRLLVSRKTSVVLLLLPQQQIDTVVLHFCLYMMNEVMT

SEQ ID NO: 171608 - protein, 57 aa, Glycine max
  Coding DNA Sequence Number=SeqID_54830
MVAEYAKGLCLLAALAENTCMTEIRWTIGCDSMMLLTSEPGLCFQSFGTRACHAWSD

SEQ ID NO: 171609 - protein, 262 aa, Glycine max
  Coding DNA Sequence Number=SeqID_54831
  Gene Ontology: Mol. function=DNA ligase (ATP) activity; Cellular component=intracellular; Biological process=DNA recombination
  Homolog annotation: Hit_ID=Q1T453; Match level="QueryCoverage=90%, HitCoverage=35%, E-value=2e-53, Identity=47%"; Hit description=ATP -dependent DNA ligase; BRCT
MVLVWLVLLIERKIDAREAESHPKITRRLLQFKPWGIEETTAEDCEVDLGLEAHLSGDNVEEQKISFSDKGIQQRSVKAVCEDSMALVSQEKGGKKKEKDLQAVVPKNDSHDIRPIEQEIDTSAGSLDFYKKRSEPQETEECENVQVAEIGENFEQNKADKQEDLNDNEHERMLVPEIEMSDRHNEQSNEVTEKLEISDYPLQAMLFDMIPSLATQKVKQPMNRSVREEKLPETSNAEAEPMITKKKKVSYKDVASELLKGW

SEQ ID NO: 171610 - protein, 521 aa, Glycine max
  Coding DNA Sequence Number=SeqID_54832
  Gene Ontology: Mol. function=drug transporter activity; Cellular component=membrane; Biological process=multidrug transport
  Homolog annotation: Hit_ID=Q1S7F1; Match level="QueryCoverage=93%, HitCoverage=81%, E-value=1e-111, Identity=41%"; Hit description =Multi antimicrobial extrusion protein MatE
  Pfam annotation: Domain name=MatE; Domain location=282-444; Score =146.6; E_value=6.8e-41; Accession=PF01554.9; Description=MatE
  Pfam annotation: Domain name=MatE; Domain location=30-190; Score =109.5; E_value=9.8e-30; Accession=PF01554.9; Description=MatE
  Pfam module annotation: Pfam domain module=MatE::MatE; Domain location=282-444::30-190
MVAEEKSQKTYPPTAEVVDELKRMGDIGVPIAAMSLVGYIKNMVLVVCMGRLGSLELAGGALAIGFTNITGFSVLSGLAMGMEPLCTQAFGSRNFSLVSLTLQRTIIMLLVASLPISLLWLKLEPLMLWLHQNPEITKVASVYCFFSIPDLIANSLLHPIRIYLRSKGTTWPLLWCTLLSILIHIPIVAFFTFKLHLGVPGIAMSAFVANFNTLFFLLSYMLYMRVSKGSLSMPLLLSSTCQLPSPSPQQQQQQHHHQDQTSLKTTTLGKEWGMLIRFSIQSCLGVCLEWWWYEFMTILAGYLHNPRVALATAGIVIQTTSLMYTLPTALSASVSTRVGNELGAGQPERARLSTIVAIGMSLASSILGLLWTTIGRNRWGRVFTSDSEVLELTMSVLPIIGVCELANCPQTTSCGILRGSARPGVGAGINFYSFYLVGAPVAIVMAFVWKLGLVGLCYGLLAAQIACAVSILVVVYNTDWERESLKAKSLVGIYKSSCDDQHHGDQTVKCEEGVVFLNEKE

SEQ ID NO: 171611 - protein, 295 aa, Glycine max
  Coding DNA Sequence Number=SeqID_54833
  Gene Ontology: Mol. function=DNA ligase (ATP) activity; Cellular component=intracellular; Biological process=DNA recombination
  Homolog annotation: Hit_ID=Q0PCF8; Match level="QueryCoverage=89%, HitCoverage=20%, E-value=5e-96, Identity=63%"; Hit description=DNA ligase IV
  Pfam annotation: Domain name=DNA_ligase_A_C; Domain location=95-173; Score=50.7; E_value=5e-12; Accession=PF04679.6; Description=ATP dependent DNA ligase C terminal region
MTESVRKPPITEVYPIKRKSEPCWSFIAHNVDGVERFFIKTIENRDEGIVLKDHSSKWEPSDCSGKWLKLKPEYIQAGSDLDVLIIGGCYGSGRRGGEVARFLVGLAERPSPNTHPKRFISFCRVGTGLSDDELDAVVTKQKPYFRKYEYPKKMPPSFYQVTNHSKERPDMWVDSPEKLIIRSITSDIRTIESESRIDRVRYGKPWYECFDVQSFIELVHSSNGTTQRDTEYGSKQDSKPKRLKSSTRGEKKNLSIVPSHLIQTDVSSVKGGSLIFSNMMFCILENLATYQLSTN

SEQ ID NO: 171612 - protein, 108 aa, Glycine max
  Coding DNA Sequence Number=SeqID_54834
  Gene Ontology: Mol. function=DNA ligase (ATP) activity; Biological process=DNA recombination
  Homolog annotation: Hit_ID=Q1T452; Match level="QueryCoverage=75%, HitCoverage=24%, E-value=2e-36, Identity=90%"; Hit description=ATP -dependent DNA ligase
MKWIIMIILKDLKLGISEKSIFHEFHPDAEVLFKVTCDLKLVCEKLRDRNQRHKRQDIEVGKAVCPQLAKRVANATEAWKNVCFAKPFIQSLMPQPNHWSILFLSMTR

SEQ ID NO: 171613 - protein, 134 aa, Glycine max
  Coding DNA Sequence Number=SeqID_54835
  Subcellular localization annotation: CTP_CleavageSite=90; ConfidenceScore=5.03e-01
MAFSGYASQGCQQNISRMSRKFPTSGILIIYASILISSIYVSILISSSSTSNVFYGHSQRFDTTFNTPSFVYNLSPSSSYHRLSLPTQMRDMIYENEEEDDDNNNINNNEDDDHVSNNNIITLIILDQEEIEII

SEQ ID NO: 171614 - protein, 80 aa, Glycine max
  Coding DNA Sequence Number=SeqID_54836
MALLRRVEWCLSTEKEEEGNFHQRRCCVEANRQLDREKVEDRRWDKDAKDIRGITDLTLPRRFPIVPNDVNCQQVPTVSM

SEQ ID NO: 171615 - protein, 519 aa, Glycine max
  Coding DNA Sequence Number=SeqID_54837
  Homolog annotation: Hit_ID=O22159; Match level="QueryCoverage=38%, HitCoverage=38%, E-value=2e-13, Identity=30%"; Hit description =Expressed protein
  Pfam annotation: Domain name=DUF247; Domain location=27-509; Score =90.4; E_value=5.6e-24; Accession=PF03140.6; Description=Plant protein of unknown function
MGGEAENSGLNQWVHSLSIILGCLDHKKAEACSITLVPEQLRRSKEEAYTPHVVSVGPLHKGKRTDLLYMEEIKLRCMLYLLYRCKNVDINKLDQVLLNCGKAMLKLDEIVRGSYNVDDLKLNRNDLAKIMVLDGCFLLELLISGSPELNEKLESQLDGLSSGIEVIQREKVLSDLIMLENQIPLIVLGKLFTTLFPENLTKDDNDGIRLIREHALSILGYDYSTLGSSYSSELKGFHFLELVHSFIDKEKEQDKATKQNANAAVENNEVNNASAIDIPTDKVAKQNANASVENNASAIGTRSKKDANTSHGQRKLSRCATRLEAAGIKIKPPEGVTSESRRASEARFDLKITFSKEKGILEIPQLHITETTEAKWRNLIAWESLICSVHDLKLLKDRHVIEVHESMSNEDLMNMLRKITEGVPDAEIDHEIDMDSWFRQVINELNSYPTTVDRARKTRKVLGHIFRRVLTWIWYKCRGAYGLLRRDYMPNGWRVIAVLAAATALTLTAIQTHYAIHRN

SEQ ID NO: 171616 - protein, 72 aa, Glycine max
  Coding DNA Sequence Number=SeqID_54838
MGMSPPPLEPQNHSQTHLMLSRWLPFHAQFYMDSSGALSGMSPHSANMHSSSFFQILPCTQPKECCAQQMAH

SEQ ID NO: 171617 - protein, 156 aa, Glycine max
  Coding DNA Sequence Number=SeqID_54839
MKLHHYPLQLLRLPFFHCVHRGVPMIGKWVNPYVWTILWKCKSSSINQALYLVLKGYTLLDGVPRDATMIGACGVSVATCPSRASEGEAHGCAFKKEERCAESPPMFICGKRRENRRKPVKIKILSLGVIFTFEEGRQKRSFCSYVPSIKEEIRST

SEQ ID NO: 171618 - protein, 92 aa, Glycine max
  Coding DNA Sequence Number=SeqID_54840
MHEQRLAINSWGSGLDGGGCMNDNQFMGLRIRFDGRGCTNSARHSWGSGLDGGGCMNGNQFMGLRIRFDDRGCMNSARQSIRGASDSMVEDA

SEQ ID NO: 171619 - protein, 141 aa, Glycine max
  Coding DNA Sequence Number=SeqID_54841
MRLVWRLASYLSWVLSENYPLYDRALVIDYQLCVIDYIVLPATDSTVPRLCNSFLGTGNRLPERKSLEKDMLTMRSRYGTHCMIAMAVQLIHDRVVMECLEGVWETLKGNERCRFRGTIRLTATSLVHPEQPARTLQQPVE

SEQ ID NO: 171620 - protein, 514 aa, Glycine max
  Coding DNA Sequence Number=SeqID_54842
  Gene Ontology: Mol. function=phospholipid binding; Cellular component= coated pit; Biological process=endocytosis
  Homolog annotation: Hit_ID=Q1T445; Match level="QueryCoverage=99%, HitCoverage=85%, E-value=1e-180, Identity=65%"; Hit description =Carbamoyl-phosphate synthase L chain, ATP-binding; ANTH
  Pfam annotation: Domain name=ANTH; Domain location=1-228; Score =242.2; E_value=1.1e-69; Accession=PF07651.6; Description=ANTH domain
MKCQVAIKTLIVIHRTLREGDPTFREEILNYSRRGHILHISNFKDDSSPLAWDCSAWVRVYALFLEERLECFRVLKYDIESERLTKASPAVNKAHSRTRLLDSNDLLEQLPALQQLLYRLIGCQPEGCAYRNHLVQYALALVLKESFKIYCALNDGIINLVDMFFDMTRHDAVKALNIYKRAGQQAENLADFYDYCKGLDLARNFQFPTLRQPPPSFLATMEEYIKEAPQTGHVNKRLEYQENDESSKEESESNESAEPQANEEQAEEVNGEESVEEEEEKPKQEEEAESPPFISTDDGIDDLLGLNEINPKVMELEESNAMALAIVPSGGNNPNNLALSNIDGTIGWELSLVTAPSNHSSQAPDRRMAGGFDKLLLDSLYEDENARRQLQLQNAGYGHGGTMDIHNNPFDHYNQHDPFAMSNNIAPPPSVQMALMSQQQQQQQMVFQQQQMMYQQPQQHNNNMMMVPHQQQQPYNQFPHQMQNSGSHNPFGDPLPVPNYNHSSMPQRGNYNLI

SEQ ID NO: 171621 - protein, 714 aa, Glycine max
  Coding DNA Sequence Number=SeqID_54843
  Gene Ontology: Mol. function=sequence-specific DNA binding; Cellular component=nucleus; Biological process=regulation of transcription, DNA-dependent
  Homolog annotation: Hit_ID=Q1T448; Match level="QueryCoverage=88%, HitCoverage=94%, E-value=0.0, Identity=59%"; Hit description=Zinc finger, RING-type; Zinc finger, FYVE/PHD-type; Homeodomain- related
  Pfam annotation: Domain name=Homeobox; Domain location=490-546; Score= 17.6; E_value=7.2e-05; Accession=PF00046.19; Description=Homeobox domain
  Pfam annotation: Domain name=PHD; Domain location=234-289; Score =60.7; E_value=4.7e-15; Accession=PF00628.19; Description=PHD-finger
  Pfam module annotation: Pfam domain module=Homeobox::PHD; Domain location=490-546::234-289
MRDVDSLNSEGSGKSSYSQEQTMSKLVSSKFKTSSTKCQEKKHKVKLKSHKHRAGTNKSKKTVTDSSIKAPLEDSSNKKVIIRKYRHKTDGKSSRMLSSTKLEGGKNSHSSGIEGNDVDGEEKIKKHKRRKKKRQRNNMDVDDASRLRRRTRYLLIKMKLEQNLIDAYSGEGWKGQSREKIRPEKELLRAKKQILKCKLNIRDAIRQLDSLSSVGSIEDSAIAPDGSVYHENIFCANCKLHEAFPDNDIILCDGTCNRAFHQRCLNPPLDTENIPPGDQGWFCKFCECKIEILEATNAHLGTQFSLDSTWQDVFKEEASMPDGDIALLNPEEEWPSDDPEDDDYNPEKKEDSHSIDIEGDDGNASNDSTSSSSLWSLNGECPPVDEGVSHEYYSVNSCIDSNESGEIACGPRQRKAVDYKKLYDEMFGKDAPPCEQVSEDEDWGPGKRKRREKESDAVNTLMTLHESENKHSNNEKNDTTREGSSGIQIRRSCFRIPVDAVEKLRQAFAENELPPRSVKDSLSKELGLDPEKVSKWFKNARYLALKTRRYQSEGEQLQSFTSKISTDSISQIVEKDELLKSTVSKITVIHSQKDGKNITGKEKNNLSDSLLKKRQQQEIPPPLERENGNKDSMEVSNDVKLKKMLKKRKRGVNIIFEGDSQAAELEFERLSKVKRKLDSMKQKLNEVQNCRAKGSNEPSIIYVPTAQLREKVEK

SEQ ID NO: 171622 - protein, 308 aa, Glycine max
  Coding DNA Sequence Number=SeqID_54844
MAKTRCVEKVCHIRMNILYRHCNNHHHTVTVIAAKTTVVVTVVGGHGGDHSNSNDGSNSDNGHGGGDGDHNSCDENDHDDNGHGECENNDNDAFSFLLESKRGFQTESNKVFFGVRENINKPCELSTSVPNCDEFESEEFDCQSMLDEEIEEGIDSIMGGGGGRVEEDDVNRAASCHGGDGEKFGCVRALRRDDTKWWNFCVVDMLQISPRMKHAAAEDLVPATAMATTTEKTKTKNKKSKKVVKKLTEELSEVAVSKGLRLKLNYDGVRSAWSNRGSPFADGSPGNDVTLRCSSLARDLNKSKRKKV

SEQ ID NO: 171623 - protein, 74 aa, Glycine max
  Coding DNA Sequence Number=SeqID_54845
MAPQSTAGKASGLKELLQRYLHLPHPKETSEENESTDGEDTDIEINGPDGTNGTVKVKVLTFSENVAHSEDEEG

SEQ ID NO: 171624 - protein, 136 aa, Glycine max
  Coding DNA Sequence Number=SeqID_54846
  Homolog annotation: Hit_ID=Q7X9S5; Match level="QueryCoverage=55%, HitCoverage=84%, E-value=1e-26, Identity=68%"; Hit description=Fiber protein Fb15
MESVMLLSVLLGVEEVAALVGESDEVGEDHAAVADMEDGIRGTGFNVLGMVIVEASLNRFLDVAQGQHRLHVLRDLAHPLPLDLVVESPQRHCCERANEQTLDFAITLLCLMEIGKLGIMGFYAPNRAVTCIQPNY

SEQ ID NO: 171625 - protein, 908 aa, Glycine max
  Coding DNA Sequence Number=SeqID_54847
  Gene Ontology: Mol. function=Rab GTPase activator activity; Cellular component=intracellular; Biological process=regulation of Rab GTPase activity
  Homolog annotation: Hit_ID=Q84Z87; Match level="QueryCoverage=97%, HitCoverage=99%, E-value=1e-163, Identity=41%"; Hit description =Putative microtubule-associated protein
  Pfam annotation: Domain name=TBC; Domain location=82-300; Score= -65.0; E_value=0.006; Accession=PF00566.9; Description=TBC domain
  Subcellular localization annotation: CTP_CleavageSite=61; ConfidenceScore=5.37e-01
MPPALSDPLSVTPASSDAVLQRSAPPENRRFGDLRGLQWRINLGVLPSSSSTSIDDLRRVTANCRRRYASLRRRLLVEPHVPKDGANSRNLVIDNPLSQNPDSTWGRFFRNAELERMVDQDLSRLYPEHGSYFQTPGCQSMLRRILLLWCLRHPECGYRQGMHELLAPLLYVLQVDLEHLSEVRKLYEDHFTDRFDGLLYQENDLSYSFDFKKSPELMEDEFGSHGNAVKVNSLEELDPEIQTIVLLSDAYGAEGELGIVLSEKFVEHDAYCMFDALMSGAHGSVAMADFFSSSPVSGSHSGVPPVIEASAALYYLLSLVDSSLHSHLFELGVEPQYFSLRWLRVLFGREFSLANLLIIWDEIFASENSSLEKGADDCEFRILSSPRGAFISAMAVAMLLHLRSSLLATENPTRCLQRLLNFPEDINIEKLLEKAKSLQALALSVDISSSSLLFLGFHYQSKSIYTTSVTLPSESVSPKTPLNLLPDSYWEEKWRVAHKAEELRQDSLEKQVPTRKKGWTEKVKFSLRRAKSDPPLSRIQSGKHFRRSLLEDLRKALGSEEDAEKMQPDETLRQHDNPSEAVEVQQEDSVCSGDSNYLSDDRSPSGNSGSEEDLSIYSDPTSPQNEVNDHEITSAKSSVTSNSSLDECNETSGTSSPFPISDPPENISQTSQCNTENYECSETSHTSPNDPHLLISDLPENISQTSQCNTENSECNETSHTSPNDPPLLISNPPKNISQTSQCNTENSECNETSVICPNDPLLPISDPPKNKPPTSGCNSFEEAGNTVNPPKDKKQNKLQWFWPFGRNNVEVISEKAAGAAEAANRGSIQKNTPQPASSAVNEPCSSVSCSGESVDKNVMGTLKNIGQSMLDHIQIIESVFQQDRKGQVTAMTALKELRKISNLLSEM

SEQ ID NO: 171626 - protein, 136 aa, Glycine max
  Coding DNA Sequence Number=SeqID_54848
  Gene Ontology: Mol. function=nucleic acid binding; Biological process= transport
MKQYSLLKRRLQTFHWGRWLSPWTKYGGQLLVAVARDANDQYFPLAFAVVEIETKESWKWFLTLLFGDIGDLETNRWVLISDRQKGLINAFEELDDKIEHRFYLRHMYENFKKIFRGEVVPRDLVMTVSKATYMEA

SEQ ID NO: 171627 - protein, 77 aa, Glycine max
  Coding DNA Sequence Number=SeqID_54849
MTLRWCRWHDNVGGVYAREEVFGRRKVVGNKIWRWRWHATSEEAGGVGVQPDLVVKGWHSSVMTTMVIDGNGGACGC

SEQ ID NO: 171628 - protein, 98 aa, Glycine max
  Coding DNA Sequence Number=SeqID_54850
  Homolog annotation: Hit_ID=Q9FJP0; Match level="QueryCoverage=98%, HitCoverage=36%, E-value=2e-08, Identity=33%"; Hit description =Genomic DNA, chromosome 5, P1 clone:MQN23
MTNDIGREGINILSFAIASAITVVVVGSKNELIIEINTRAAPFGVVKVLVGTWIRRRQWRHVSMETRKSGLEVNLLERIEKLDEDLRSFVTVVRVLSR

SEQ ID NO: 171629 - protein, 662 aa, Glycine max
  Coding DNA Sequence Number=SeqID_54851
  Homolog annotation: Hit_ID=Q2R124; Match level="QueryCoverage=97%, HitCoverage=69%, E-value=1e-137, Identity=42%"; Hit description=Pg1, putative, expressed
  Pfam annotation: Domain name=DUF1399; Domain location=94-240; Score =265.5; E_value=1.1e-76; Accession=PF07173.3; Description=Protein of unknown function (DUF1399)
METEQELEWAEAQNMVFLSEDLVATAKQQLLFLAEVDRNRCLYDGPVLHRANYRYKYCWLPLLAKHAESHVTQDPFVVPLDCEWIWHCHRLNPVRYKTDCMELYGRILGDRNVVSSTQGTSKEESEKLWETMYPSEPYELDLNNDSMQNFAENFLEAKQSSTDYDLISAVKRQTTFFYQVSRPYWNDDTFLEGAVARYKGFLHLIKRNRERHVSCFCVPTYDIDLIWHSHQLHPVSYCNDLVAIMGTILEHNDMDSDRTKGQKLDAGFSETTTQWEETFGSRYWKAGAMYSGSPPSPITVDKYKIDAIHKISAPSNKTNQNVIQLPQKMLVQVMLEIVDVRNLPLGHTGKLLVSFNKKQEDVLFNTKKQLCISSESQGKQVAVFQCESNGELVLELISRPSFNFRGVRPAKVLGKTSINLGDLQDVASKLPKEKWLDLTSTVNWSKPIGIRIGLSLTPPVSAPYELHFVSMYPFKGSYFSFLLPRKFQQTKCWTNVVDEAGNEIIHIQKGNLSNEKTKSSINKEVIGRTASGETHLLAELKGTMWSMMNSDWMLQIKKTSAEDHKRVFELTGTRKVIIFPGRKLEYGTRYYRNEKGNCFMTAVEFSGTHPYGKAVALMDLANGFLEIKEEWLVLPALLSAFVLSNNFPDFSNETEKANGTNA

SEQ ID NO: 171630 - protein, 85 aa, Glycine max
  Coding DNA Sequence Number=SeqID_54852
MSETGTLLFEAVPVLHSYKPILTIVDNEELLSSASFACFSFSPCGHCSNMMTVLLQTWQTKDKSPLLHFMLPAQDLGGGLWRLGW

SEQ ID NO: 171631 - protein, 95 aa, Glycine max
  Coding DNA Sequence Number=SeqID_54853
MWDIVRDEFGSLDENEILEVANLFLDEPELEIMFFNDDEFLRSIKKKGEETLMFIAYSDIAPSVFNILSPCVVDAVTFSFMICEQWCVCNEGHGQ

SEQ ID NO: 171632 - protein, 226 aa, Glycine max
  Coding DNA Sequence Number=SeqID_54854
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=99%, HitCoverage=50%, E-value=1e-104, Identity=78%"; Hit description =Ser/Thr protein kinase
  Pfam annotation: Domain name=NAF; Domain location=86-147; Score =112.2; E_value=1.5e-30; Accession=PF03822.5; Description=NAF domain
MIEKAQFSCPPSFPVGAKSLIHTMLDPNPERRITIEQIRNDEWFQKEYVPVSLIEYEDVNLDDVNAAFDNDEDQRTNQQCENDDMGPLTLNAFDMIILSQGLNLATLFDRGQDSMKYETRFISQKPPKVILSSMEVVAQSMGFKTHIRNYKMRIESISTNKASYFSVILEVFEIAPTFFMVDIQKAAGDAGEYLKFYKNFSSNLEDIMWKPPHETSKLRNSKTKGQ

SEQ ID NO: 171633 - protein, 324 aa, Glycine max
  Coding DNA Sequence Number=SeqID_54855
  Gene Ontology: Cellular component=protein complex
  Homolog annotation: Hit_ID=Q9M330; Match level="QueryCoverage=98%, HitCoverage=99%, E-value=3e-69, Identity=46%"; Hit description =Probable proteasome inhibitor
  Pfam annotation: Domain name=PI31_Prot_Reg; Domain location=197-286; Score=0.5; E_value=0.059; Accession=PF08577.1; Description=PI31 proteasome regulator
MASEKLVLAVIRAARPTFRNQNDKIAFAVHSSFLTSGYVLTATGPQALSDNAFSDPSNDEVSVDHWNELNDEYAFVYANPEKGSEKVLVKCLVMNDKLLVHAFTQGSSEPLSLEIDVGDYAGEDGVSNYSQQFKNLDKLVKKIDGDILSKLDGSAKASSSSRSSETSNRTRQEIPDPVAGFGEPGGPPTQFIFPSVPIGSGSDLVPGPAAGVFPSRGGHGIGGSMLVAGPNDPRWFGGVGGIGGDPAFPGGLPHALGAKAREGKVPSSCSEAMGVPPGARFDPYGPPGVPGFEPNRFARNPRRPGYDTHPDWQHFRRDADSDYI

SEQ ID NO: 171634 - protein, 147 aa, Glycine max
  Coding DNA Sequence Number=SeqID_54856
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=97%, HitCoverage=32%, E-value=7e-75, Identity=93%"; Hit description =Ser/Thr protein kinase
  Pfam annotation: Domain name=Pkinase; Domain location=2-143; Score =51.5; E_value=2.8e-12; Accession=PF00069.15; Description=Protein kinase domain
  Pfam annotation: Domain name=Pkinase_Tyr; Domain location=1-147; Score=-129.2; E_value=0.00015; Accession=PF07714.7; Description =Protein tyrosine kinase
  Pfam module annotation: Pfam domain module=Pkinase::Pkinase_Tyr; Domain location=2-143::1-147
MVLASRTKIYIILEFITGGELFDKIVSHGRLSEAESRRYFQQLIDGVDFCHSKGVYHRDLKPENLLLDSQGNIKISDFGLSAFPEQGVSLLRTTCGTPNYVAPEVLSHKGYNGAPADVWSCGVILYVLLAGYLPFDELDLTTLYSKA

SEQ ID NO: 171635 - protein, 825 aa, Glycine max
  Coding DNA Sequence Number=SeqID_54857
  Gene Ontology: Mol. function=identical protein binding; Cellular component=cell wall; Biological process=negative regulation of enzyme activity
  Homolog annotation: Hit_ID=O64481; Match level="QueryCoverage=97%, HitCoverage=97%, E-value=0.0, Identity=75%"; Hit description =Subtilisin-like serine protease
  Pfam annotation: Domain name=DUF1034; Domain location=707-825; Score =115.2; E_value=1.9e-31; Accession=PF06280.2; Description=Domain of Unknown Function (DUF1034)
  Pfam annotation: Domain name=PA; Domain location=399-512; Score=60.0; E_value=7.9e-15; Accession=PF02225.12; Description=PA domain
  Pfam annotation: Domain name=Peptidase_S8; Domain location=146-673; Score=101.8; E_value=2.1e-27; Accession=PF00082.12; Description =Subtilase family
  Pfam annotation: Domain name=Subtilisin_N; Domain location=25-136; Score=55.7; E_value=1.5e-13; Accession=PF05922.7; Description =Subtilisin N-terminal Region
  Pfam module annotation: Pfam domain module=DUF1034::PA::Peptidase _S8::Subtilisin_N; Domain location=707-825::399-512::146-673::25-136
MRLLEFGCVFLVVLLFGLVKFGKAEVYIVTVEGEPVISYKGGIDGFEATAVESDDDDDDEKLDSTSEVVTSYARHLEKRHDMLLGLLFERGTYNKLYSYRHLINGFAVHLSPEQAETLRHAPGVKSVERDWKVKRLTTHTPQFLGLPTGVWPTGGGYERAGEDIVIGFVDSGIYPHHPSFTTHNTEPYGPVSRYRGKCEVDPDTKKSFCNGKIVGAQHFAQAAIAAGAFNPSIDFDSPLDGDGHGSHTASIAAGRNGIPVRMHGHEFGKASGMAPRARIAVYKALYRLFGGFIADVVAAIDQAVHDGVDILSLSVGPNSPPSNTKTTFLNPFDATLLGAVKAGVFVAQAAGNGGPFPKSLVSYSPWIATVAAAIDDRRYKNHLILGNGKILAGLGLSPSTRLNQTYTLVAATDVLLDSSATKYSPTDCQRPQLLNKNLIKGNILLCGYSFNFVIGSASIKQVSETAKALGAAGFVLCVENVSPGTKFDPVPVGIPGILITDASKSKELIDYYNISTPRDWTGRVKTFEGTGKIEDGLMPILHKSAPQVAIFSARGPNIKDFIFQEADLLKPDILAPGSLIWAAWSLNGTDEPNYAGEGFAMISGTSMAAPHIAGIAALIKQKHPHWSPAAIKSALMTTSTTLDRAGNPILAQLYSETEAMKLVKATPFDYGSGHVNPQAALDPGLIFDAGYEDYLGFLCTTPGIDVNEIKNYTNSPCNNTMGHPSNLNTPSITISHLVRTQIVTRTVTNVADEEETYVISGRMQPAVAIEVNPPAMTIKAGASRRFTVTLTVRSVTGTYSFGEVLMKGSRGHKVRIPVLANGYSR

SEQ ID NO: 171636 - protein, 338 aa, Glycine max
  Coding DNA Sequence Number=SeqID_54858
  Gene Ontology: Mol. function=binding; Cellular component=nucleus; Biological process=protein amino acid phosphorylation
  Homolog annotation: Hit_ID=Q2R497; Match level="QueryCoverage=99%, HitCoverage=64%, E-value=1e-104, Identity=35%"; Hit description =PPR986-12, putative, expressed
  Pfam annotation: Domain name=PPR; Domain location=118-152; Score =32.9; E_value=1.2e-06; Accession=PF01535.11; Description=PPR repeat
  Pfam annotation: Domain name=PPR; Domain location=17-51; Score=29.5; E_value=1.2e-05; Accession=PF01535.11; Description=PPR repeat
  Pfam annotation: Domain name=PPR; Domain location=188-222; Score=9.5; E_value=0.56; Accession=PF01535.11; Description=PPR repeat
  Pfam annotation: Domain name=PPR; Domain location=300-334; Score =10.0; E_value=0.49; Accession=PF01535.11; Description=PPR repeat
  Pfam module annotation: Pfam domain module=PPR::PPR::PPR::PPR; Domain location=118-152::17-51::188-222::300-334
MEDARRVFENMPRRNVVAWTTLMVGFVQNSQPKHAIHVFQEMLYAGSYPSIYTLSAVLHACSSLQSLKLGDQFHAYIIKYHLDFDTSVGSALCSLYSKCGRLEDALKAFSRIREKNVISWTSAVSACGDNGAPVKGLRLFVEMISEDIKPNEFTLTSALSQCCEIPSLELGTQVCSLCIKFGYESNLRVRNSLLYLYLKSGFIVEAHRFFNRMDDVSMVTWNAMIAGHAQMMELTKDNLSACQRGSEALKIFSKLNQSGMKPDLFTLSSVLSVCSRMLAIEQGEQIHAQTIKTGFLSDVIVSTSLISMYNKCGSIERASKAFLEMSTRTMIAWTSMIT

SEQ ID NO: 171637 - protein, 325 aa, Glycine max
  Coding DNA Sequence Number=SeqID_54859
  Gene Ontology: Mol. function=protein binding; Biological process =ubiquitin cycle
MAAYIQILKEAKPIHISTSRNVVRSSYSALKFEDSGDSIEPPFEHKPAVEAFAVLGEVIDPPPLVPLGGTAVPERQFPDPLGGEADHVAGAAEDLELGRLTEGAEHFRRHAGGLVPAEVVEVEAEDEDGGAGGVEGEGGLEAADHEDEIAVAATDEAGPIEDIEDVPPLVAVGGEFEPGGGVAVAVEGGELREDHDAVLGVDEDRAVAGPGGAEVGEDAESAGERVTTDEGLGVGVGVVVGPEVEEAEGGGDGERGVEGEEVEGEGCGGGCGGPGAGGVDGSWRGPGGTKVLRAAAGRILTLSGISLFPSVAACRISAGGCPPLD

SEQ ID NO: 171638 - protein, 108 aa, Glycine max
  Coding DNA Sequence Number=SeqID_54860
MAGAGDGGGDYHQLDGPQRLLLDAMTTQMRRLLNRNNEELYGRMEDLENQLNQNTGRHYSGNRVGNVGPRQHRMEGQNIIEGVKLNVPPFKGRSDPDAYLDWEMKIEH

SEQ ID NO: 171639 - protein, 106 aa, Glycine max
  Coding DNA Sequence Number=SeqID_54861
  Gene Ontology: Mol. function=cysteine-type peptidase activity; Cellular component=cytoplasm; Biological process=fucose metabolic process
MQRGSQSEPFDVEMRDRLEDMIRDLGQRVFSASTCPYAKKILCPMGMEYQKIHACPIDCILYKHEFEEMHKFPRCGVSQYKVKDDDECNSDENSKKGPPAKVLWYL

SEQ ID NO: 171640 - protein, 106 aa, Glycine max
  Coding DNA Sequence Number=SeqID_54862
MIEGGDECAYNNKRGPLRAKGHLGVVAARPGELKLNPEAVSSPRRASPLALKLFGGPGKPNAGLGELGSRKNKEKTLLPSFLGIFCLPDRNIEWFLALNCNWHSTP

SEQ ID NO: 171641 - protein, 81 aa, Glycine max
  Coding DNA Sequence Number=SeqID_54863
MSQNFMDYATIPSLTSGMLRNFTDCAIMLPFNSRHVAELHGLPNDGCQVPRSGQAKAYIPSVKILRFSSLSNLSAIVAKAS

SEQ ID NO: 171642 - protein, 89 aa, Glycine max
  Coding DNA Sequence Number=SeqID_54864
  Gene Ontology: Mol. function=calcium ion binding
  Homolog annotation: Hit_ID=O82062; Match level="QueryCoverage=95%, HitCoverage=28%, E-value=1e-15, Identity=53%"; Hit description=39 kDa EF-Hand containing protein
VFNNIVDPALSQAGPALDKPAAQETFLEEFKKVALSVVDFLKEKPVIVAHSENTFDGRDVELSFRESAERSQRKNIKGLSAGGVEDILL

SEQ ID NO: 171643 - protein, 70 aa, Glycine max
  Coding DNA Sequence Number=SeqID_54865
LLFSLKWCLLSLSSFSIPLPFIFQEAKESIDEEDPRPTSSNGAYIKKYHEEFKSPVIGPECPVYEHPPRP

SEQ ID NO: 171644 - protein, 264 aa, Glycine max
  Coding DNA Sequence Number=SeqID_54866
MPTNIREIEAALCIPDRGFVLNAEGHPRKILRKDLTTLSQVWSVLSYSNLASTSHTSDLTVDRARLIFDLVSQLDMNVRALISGHITSMAQSNSSRLRFPALITALCRSRGVASDSLVFERLSPVINLAYIRKNYWNPDDLTFTIRGARRARARPAEAPSFHIYSSSSNTLQLVEPPDSIPSIEQFNEWVAWPGTQPPLHKEDEGPTAQVPQQMEDESSETSTPEPLIRRKTVVEKQEAAATSEKSLEATPKPPAPVADTTSPQ

SEQ ID NO: 171645 - protein, 134 aa, Glycine max
  Coding DNA Sequence Number=SeqID_54867
MGAKDMSLIHKQNKNLDPVNDLVHTHLGPVLVQMVNPKKDAGLALVQMAQAEKTCPVLTWKALMEAVESPVGIRLLGCRGLTPSQRRRLDSWPGHLLNKIIQAHHRPLLGHILQALHDQELALIQALYHIHDRI

SEQ ID NO: 171646 - protein, 486 aa, Glycine max
  Coding DNA Sequence Number=SeqID_54868
  Gene Ontology: Mol. function=oxidoreductase activity; Cellular component=integral to membrane; Biological process=electron transport
  Homolog annotation: Hit_ID=Q75LK7; Match level="QueryCoverage=88%, HitCoverage=75%, E-value=1e-150, Identity=62%"; Hit description =Putative cytochrome P450
  Pfam annotation: Domain name=p450; Domain location=36-482; Score =178.9; E_value=1.3e-50; Accession=PF00067.12; Description=Cytochrome P450
MELIMLLLSLVLSLLVLSVILLLYVTRSPKAMEGIPGSLGWPIVGESFSFLSDFSSPSGIFSFMNKRQKRYGKVFKSFVLGRFTVFMTGREASKILLTGKDGIVSLNLFYTGQQVLGPTSLLQTTGEAHKRLRRLIGEPLSIDGLKKYFHFINTQAMETLDQWDGRKVLFTLKVIGHMIMSLEPSGEEQEKFRSNFKIISSSFASLPFKLPGTAFHRGIKARDRMYEMLDSTISRRRSGQEFQQDFLGSLVMKHSKEDGEEDENKLTDKQLKDNILTLLVAGHDTTTAALTWLIKFLGENPLVLEQLREEHRQIVANRKSGTDLTWAEVNNMPYTAKVISETLRRATILPWFSRKASQDFEIDGMAIQNGQIWLYNVFVCVCYKIKKGWSVNLDVVSIHHDPEVFQDPEKFDPSRFDETLRPFSFLGFGSGPRMCPGMNLAKLEICVFIHHLVNRYKWRHLEKDNSVQPTLVRMPKNKYPIIVEAL

SEQ ID NO: 171647 - protein, 91 aa, Glycine max
  Coding DNA Sequence Number=SeqID_54869
MSCSASSKFRDLRSGHVRRERVVPWRHSRPSNSIIVAFLAQPHCNPIVDGGRRGGALGMVVERWSMHTMQRWDKGVRHNVMVGGCRVCKGV

SEQ ID NO: 171648 - protein, 399 aa, Glycine max
  Coding DNA Sequence Number=SeqID_54870
  Gene Ontology: Mol. function=transferase activity, transferring hexosyl groups; Cellular component=mitochondrion; Biological process= metabolic process
  Homolog annotation: Hit_ID=Q2HUM7; Match level="QueryCoverage=99%, HitCoverage=86%, E-value=1e-103, Identity=34%"; Hit description =Tetratricopeptide-like helical
  Pfam annotation: Domain name=PPR; Domain location=150-184; Score =37.4; E_value=5e-08; Accession=PF01535.11; Description=PPR repeat
  Pfam annotation: Domain name=PPR; Domain location=185-219; Score =29.2; E_value=1.4e-05; Accession=PF01535.11; Description=PPR repeat
  Pfam annotation: Domain name=PPR; Domain location=220-254; Score =23.2; E_value=0.0009; Accession=PF01535.11; Description=PPR repeat
  Pfam annotation: Domain name=PPR; Domain location=24-57; Score=35.6; E_value=1.7e-07; Accession=PF01535.11; Description=PPR repeat
  Pfam annotation: Domain name=PPR; Domain location=58-92; Score=36.0; E_value=1.3e-07; Accession=PF01535.11; Description=PPR repeat
  Pfam module annotation: Pfam domain module=PPR::PPR::PPR::PPR::PPR; Domain location=150-184::185-219::220-254::24-57::58-92
MGAFEDVYALYKGMPEMDLVPNSVTYCTMIDGYCKVGRIDEALEVFDEFRKTSILSLACYNTIINGLCKNGMTEMAIEALLELNHEGLELDPVTFLASTLKIFIKESRALDAYRLVTETQDHLPVMEGFLLDAEHVYRKMVLKGFQPKAQVYNSLLDGISKFGQLEKAFELLNDMETKYIEPDSLTISAVINCYCQKGNMHGALEFYYKFKRKDMSPDFFGFLYLIRGLCTKGRMEEARSVLREMLQSKNVVELINTVNKEVDTESISDFLATLCEQGRVQEAVTVLNQIACLLFPVQRLSTYYQGFHKQQKIYEWKDFGSISSSILPSSCQSSLNLGSCDDKDVRNLITSNGGYMTRSQLHGFDFYYSRMAPLCAKGELQKANQSAKEFLSDLTESMN

SEQ ID NO: 171649 - protein, 392 aa, Glycine max
  Coding DNA Sequence Number=SeqID_54871
  Gene Ontology: Mol. function=oxysterol binding; Cellular component =integral to membrane; Biological process=steroid metabolic process
  Homolog annotation: Hit_ID=Q2HUM5; Match level="QueryCoverage=92%, HitCoverage=99%, E-value=1e-152, Identity=69%"; Hit description =Oxysterol-binding protein
  Pfam annotation: Domain name=Oxysterol_BP; Domain location=1-391; Score=-13.2; E_value=1.9e-08; Accession=PF01237.9; Description =Oxysterol-binding protein
MNLVAPNLILNPLIKGNNAVLGVEVQEQESETNIVLTKPFSLGNGNESDSELPPQFNFPKSQLQCYGESIYSSTSDLLSRCNTGQSPLERLIFVVAWSISTTRPAIFGVAPYNPTLGETHHVSKGNLNVLLEQAHAFTFCYMLNVASHHPPVSALHATDEKENIEIIWCQYPVPKFNGTSVEAQVHGKRQLKLINHGETYEMNSPHLLIKILPVPGIDWVGNVNIKCIETGLVAELCYTSQSFFGFGGSKRLIKGKIIDSSSLKILHEVNGHWDSTVTLKETRSGEIRVIYDAKEVISGLQAPTLKDAESVWLTESALIWSELSQAILSKDWEKAREAKKAVEERQRELLRERESKGETWVPKHFILSQSKEGIWDCSPIQKWVPASPIVTL

SEQ ID NO: 171650 - protein, 66 aa, Glycine max
  Coding DNA Sequence Number=SeqID_54872
MSHTMQRDCIASDERIKKLRMLVAALRKEAQFKDEVHKAQQEELKRLREKTILSGNYPPYGRRSSL

SEQ ID NO: 171651 - protein, 135 aa, Glycine max
  Coding DNA Sequence Number=SeqID_54873
  Gene Ontology: Mol. function=transferase activity
  Homolog annotation: Hit_ID=Q2HVN0; Match level="QueryCoverage=79%, HitCoverage=22%, E-value=6e-10, Identity=36%"; Hit description =Transferase
MSLQIDQLPMILYGCPIVTSGTFLMCPISGRLSFTKSGRMEVDCNAKGVTLLEAKTTKTFGDYGDFSPSESTEELVPKVDYTQPIEEIPLLLLLQLTTRFHGGECLAIGVVISHSLTNATGIIHFMIDHRWAKLT

SEQ ID NO: 171652 - protein, 446 aa, Glycine max
  Coding DNA Sequence Number=SeqID_54874
  Gene Ontology: Mol. function=pepsin A activity; Cellular component =endoplasmic reticulum; Biological process=proteolysis
  Homolog annotation: Hit_ID=Q2HUN7; Match level="QueryCoverage=34%, HitCoverage=70%, E-value=2e-51, Identity=61%"; Hit description =Peptidase M, neutral zinc metallopeptidases, zinc-binding site; Peptidase aspartic, catalytic
  Pfam annotation: Domain name=Asp; Domain location=104-439; Score= -97.9; E_value=8e-08; Accession=PF00026.14; Description=Eukaryotic aspartyl protease
  Subcellular localization annotation: CTP_CleavageSite=27; ConfidenceScore=5.22e-01
MAFAYKPLHLLLLLSFSTCCFSSTSTVSSAKPRRLVSKLIHPGSVHHPHYKPNETAKDRMELDIEHSAARLAYIQARIEGSLVYNNDYTASVSPSLTGRTILVNLSIGQPSIPQLVVMDTGSDILWIMCNPCTNCDNHLGLLFDPSMSSTFSPLCKTPCGFKGCKCDPIPFTISYVDNSSASGTFGRDILVFETTDEGTSQISDVIIGCGHNIGFNSDPGYNGILGLNNGPNSLATQIGRKFSYCIGNLADPYYNYNQLRLGEGADLEGYSTPFEVYHGFYYVTMEGISVGEKRLDIALETFEMKRNGTGGVILDSGTTITYLVDSAHKLLYNEVRNLLKWSFRQVIFENAPWKLCYYGIISRDLVGFPVVTFHFVDGADLALDTGSFFSQRDDIFCMTVSPASILNTTISPSVIGLLAQQSYNVGYDLVNQFVYFQRIDCELLSG

SEQ ID NO: 171653 - protein, 449 aa, Glycine max
  Coding DNA Sequence Number=SeqID_54875
  Gene Ontology: Mol. function=pepsin A activity; Cellular component =cellulose and pectin-containing cell wall; Biological process =proteolysis
  Homolog annotation: Hit_ID=Q2HUN7; Match level="QueryCoverage=36%, HitCoverage=76%, E-value=4e-51, Identity=56%"; Hit description =Peptidase M, neutral zinc metallopeptidases, zinc-binding site; Peptidase aspartic, catalytic
  Pfam annotation: Domain name=Asp; Domain location=102-441; Score= -94.9; E_value=5.2e-08; Accession=PF00026.14; Description=Eukaryotic aspartyl protease
MTFAHEPLHLLLLLSLSTCCFSSTSTISSVKPQRLVSKLIHPGSVHHPHYKPNETAKDRMELDIQHSAARFAYIQARIEGSLVSNNEYKARVSPSLTGRTIMANISIGQPPIPQLVVMDTGSDILWVMCTPCTNCDNHLGLLFDPSMSSTFSPLCKTPCDFKGCSRCDPIPFTVTYADNSTASGMFGRDTVVFETTDEGTSRIPDVLFGCGHNIGQDTDPGHNGILGLNNGPDSLATKIGQKFSYCIGDLADPYYNYHQLILGEGADLEGYSTPFEVHNGFYYVTMEGISVGEKRLDIAPETFEMKKNRTGGVIIDTGSTITFLVDSVHRLLSKEVRNLLGWSFRQTTIEKSPWMQCFYGSISRDLVGFPVVTFHFADGADLALDSGSFFNQLNDNVFCMTVGPVSSLNLKSKPSLIGLLAQQSYSVGYDLVNQFVYFQRIDCELLSGG

SEQ ID NO: 171654 - protein, 94 aa, Glycine max
  Coding DNA Sequence Number=SeqID_54876
MINANFDASIKIGKGMGFGLVFRNHKGEVLASATRLEDQCYSPQIAEYLAFKWSIQMANQLLLQNDCRDMTTHIDTVALVHTKKIGNIVADSLA

SEQ ID NO: 171655 - protein, 372 aa, Glycine max
  Coding DNA Sequence Number=SeqID_54877
  Gene Ontology: Mol. function=oxidoreductase activity; Cellular component=integral to membrane; Biological process=electron transport
  Homolog annotation: Hit_ID=Q75LK7; Match level="QueryCoverage=90%, HitCoverage=64%, E-value=1e-110, Identity=57%"; Hit description =Putative cytochrome P450
  Pfam annotation: Domain name=p450; Domain location=1-364; Score=27.4; E_value=3.2e-12; Accession=PF00067.12; Description=Cytochrome P450
MTGREASKILLTGKDGIVTLNLFYTGQQVLGPTSLLQTTGEAHKRLRRLIGEPLSIDGLKKYFHFINTQAMETLDQWERRKVLFTLKVIGHMIMSLDPSGEEQEKFRSNFKIISSSFSSFPLKLPGTAFHHGIKARDRMYEMLDSTISRRRSGQEFQQDFLGSLVMKHRKEDGEEDENKLTDQQLKDNILTLLVAGHDTTTAALTWLIKFLDENPIVLEKLREEHRRIIENRKSGTNLTWSEVNNMSYTAKVISETLRRATILPWFSRKASQDFEIDGYKVRKGWSINLDVVSIHHDPEEPLRPFSFLGFGSGPRMCPGMNLAKLEISVFIHHLINKYTWRTLEEENSVQPTVVRMPKNKYPIIVEALKSNE

SEQ ID NO: 171656 - protein, 245 aa, Glycine max
  Coding DNA Sequence Number=SeqID_54878
  Subcellular localization annotation: CTP_CleavageSite=61; ConfidenceScore=5.07e-01
MEPKFIGDHFTTMILKKMSESGSHHRRSHSDSFVCFLANFNISKPPSLLSLPSLITLDVVPMVMDSDEFDEQKRSIETPIPRHHRSLSAHSYLFNKPCSELEREFQMLKTKVTYLTELHTMLQSGGKLFVGKSNPDSIRGNATQYGSMQHILKCQKKKKATNLSMSRMMQRKKARIDEEIKEITMDYEALKEKSRLIDDSIRAQISVLQTVAPGHPLLDVLLDQFGMPPSPSEQPFHGQNHNLQK

SEQ ID NO: 171657 - protein, 105 aa, Glycine max
  Coding DNA Sequence Number=SeqID_54879
MISRGYSHQGEKGLFGLRRRLAQTGEAFEDTTQKIDGSTKLGIWQEVADSDEERTTTLEQHMYAMLVHMAGLDHQYSGSYPKSSTPKHPHYQDYMDNYFLDDNET

SEQ ID NO: 171658 - protein, 75 aa, Glycine max
  Coding DNA Sequence Number=SeqID_54880
MSRRQYPKKISYLPRQVILGSKALPLPLHARHLSIHHSTSTSTSTISHSSKLMHMSNPLNKIIYKKERQRDNSNG

SEQ ID NO: 171659 - protein, 233 aa, Glycine max
  Coding DNA Sequence Number=SeqID_54881
  Gene Ontology: Mol. function=protein dimerization activity; Cellular component=nucleus; Biological process=regulation of transcription, DNA-dependent
  Homolog annotation: Hit_ID=Q0GPF5; Match level="QueryCoverage=94%, HitCoverage=67%, E-value=9e-73, Identity=70%"; Hit description=BZIP transcription factor bZIP131
  Pfam annotation: Domain name=bZIP_1; Domain location=169-233; Score =21.2; E_value=0.00072; Accession=PF00170.11; Description=bZIP transcription factor
  Pfam annotation: Domain name=bZIP_2; Domain location=169-223; Score =25.4; E_value=0.0002; Accession=PF07716.5; Description=Basic region leucine zipper
  Pfam module annotation: Pfam domain module=bZIP_1::bZIP_2; Domain location=169-233::169-223
MNQKFIGKPPATVDLDRMPERGSHHRRSHSDTSFRFAANFDDLLLFDPSDFDISGLPSPLPLPSPVSAGLVPMSVDSDESGKQPRPAGASAGGHLRSLSVDSDFFDGLGFGGDERGAGKGGGGERRVGHHRHSNSMDGSSTTSFEADSAMIMDGVKKAMAPDKLAELALMDPKRAKRILANRQSAARSKERKIRYTSELERKVQTLQTEATNLSAQLTMLQCLMEPPNTLTMM

SEQ ID NO: 171660 - protein, 180 aa, Glycine max
  Coding DNA Sequence Number=SeqID_54882
  Gene Ontology: Mol. function=molecular_function; Cellular component =membrane; Biological process=auxin mediated signaling pathway
  Homolog annotation: Hit_ID=Q10RR0; Match level="QueryCoverage=82%, HitCoverage=51%, E-value=1e-30, Identity=38%"; Hit description =Integral membrane protein DUF6 containing protein, expressed
MAQKRVSHVLVCRELKPHLLMVIVQVGYTFLYFITEASFNHGMSPHVYVTYRHILAAAMMFPFAYFLERNARPKLTFALFMEIFVLSLLGFEVLDLRNPRGIAKVIGTMISLAGVLIMTLYKGPVMRNLWHPLIHIPGKSAAINEDWFSPKLSQNCLTWELLVLASFFLISYACLWPSNA

SEQ ID NO: 171661 - protein, 83 aa, Glycine max
  Coding DNA Sequence Number=SeqID_54883
  Gene Ontology: Mol. function=electron carrier activity; Cellular component=intracellular; Biological process=electron transport
  Homolog annotation: Hit_ID=Q8LFE0; Match level="QueryCoverage=91%, HitCoverage=30%, E-value=4e-27, Identity=75%"; Hit description =Electron transfer flavoprotein beta-subunit-like
MYLDSRLLHTDLRLNQPRYATLPNIMKAKSKPIKKFTPEELNVEIKSDLEIVQVTEPPKRKAGVILSSVDELIDKLKHEANVI

SEQ ID NO: 171662 - protein, 70 aa, Glycine max
  Coding DNA Sequence Number=SeqID_54884
MGWWIHCGRGGRVCNGRGKRVAPLGKGNEGGAWGKRSCVGRRKEKKGWARLRGRWTRVGGSREGKRGRFT

SEQ ID NO: 171663 - protein, 104 aa, Glycine max
  Coding DNA Sequence Number=SeqID_54885
MSGFTRDSPQISASPHQLDLAPYASEPYNAQWNTLGLLHDKHTLRSSRILGEMEAFSLHNSFLGWCFWFVPKVVFIIGSAAVGKDKVCHWLSNDIVGLVGNLAI

SEQ ID NO: 171664 - protein, 186 aa, Glycine max
  Coding DNA Sequence Number=SeqID_54886
  Homolog annotation: Hit_ID=Q1RX51; Match level="QueryCoverage=40%, HitCoverage=8%, E-value=2e-07, Identity=42%"; Hit description=Zinc finger, CCHC-type
MRPRGTNGRMIINPDFFSTHAQETLCCVLYHKKNIPNLSRKWRPQVIALRAIKNLDSMTLEELVGILKVHEQELSQDEGTKKGKSLARMVQRPKSNLVSKEPSSKALVCKKPGHFKSKCLDFEKSKDKRKKFFKSNKKSLMSTWEDLDNSSFDEDSEEEANLCLMPDVSTSKAEPTLDASSDDEDH

SEQ ID NO: 171665 - protein, 287 aa, Glycine max
  Coding DNA Sequence Number=SeqID_54887
  Gene Ontology: Mol. function=nucleic acid binding; Cellular component= chromatin; Biological process=DNA integration
MSELDESFAEMKIKDIVKSAGKIVRNKARLVAKGYSQQEGIDYTKTFAPVARLEAIHILLSFSTHHGMMLYQMDIKSTFLNGLIKEEVYVKQPHGFESYIYPYHVFKLNKALYGLKQAPRAWYEKLISFLTENGFIRGKVDTNLLHKDYGSQFLIVQIYVDDIIFSATNDSLCKDFPSLCREKKDYRLPGYYDADFPEDRVDRKSTSEGSHFGGWLVSWTNKKHGIIALSIAEAEYISATSCCSQLLWIKHQLEDYNLFKSEISTLCDNTAAIDLSKKYHHAFTCET

SEQ ID NO: 171666 - protein, 164 aa, Glycine max
  Coding DNA Sequence Number=SeqID_54888
KKDSSEVNNRKSPLEAQNKARLLAEYYDKTKSPSGSDLDFEALFSGKTDEVNEELCNKGLAKACMNLFGLKMMKYTPGLLTKPEKIASKKIQPHPELIALSKKIINMGEPEGYTVLGSYYYTLGLKEKAFKTWDEGEKNGSLKSGTTKALIEFQEELEKEAAKE

SEQ ID NO: 171667 - protein, 65 aa, Glycine max
  Coding DNA Sequence Number=SeqID_54889
MTINSWGSELDGGGRTNSARQSIRGAPDSMRKAINSWGFGLYGGGRTNNTRQSIRGAPDSMVEDA

SEQ ID NO: 171668 - protein, 98 aa, Glycine max
  Coding DNA Sequence Number=SeqID_54890
DGFGGVGGGLGVEGVESSASVVVVNVDFMDGGGTKKVKVCGERFWRVGMDERVCMKRLLSREEVLLLRVVEDGASEMEECMIESSHACCFCLGSEIVE

SEQ ID NO: 171669 - protein, 101 aa, Glycine max
  Coding DNA Sequence Number=SeqID_54891
MTASACFGTAYHDGDCNVVLREEKTTQTVVDGGESGQHVVVVVLVVLPHVDLAILVGGDDCVVVVVEGDGFGGVGGGLGVEGVESSASVVVVNVDFMDGGG

SEQ ID NO: 171670 - protein, 207 aa, Glycine max
  Coding DNA Sequence Number=SeqID_54892
  Gene Ontology: Mol. function=protein serine/threonine kinase activity; Cellular component=flagellin-based flagellum; Biological process=protein amino acid phosphorylation
  Homolog annotation: Hit_ID=Q6KC54; Match level="QueryCoverage=60%, HitCoverage=23%, E-value=3e-44, Identity=68%"; Hit description =Calcium-dependent protein kinase 8
  Pfam annotation: Domain name=efhand; Domain location=29-57; Score =29.4; E_value=1.2e-05; Accession=PF00036.22; Description=EF hand
  Pfam annotation: Domain name=efhand; Domain location=65-93; Score =40.5; E_value=5.8e-09; Accession=PF00036.22; Description=EF hand
  Pfam module annotation: Pfam domain module=efhand::efhand; Domain location=29-57::65-93
ADVDGNGVLDYGEFVAVTIHLQRMENDEHFRKAFMYFDKDGSGYIELGELEKALTDESGDTDTAVLNDIMREVDTDRDGRISYEEFVAMMKTGTDWRKASRQYSRERFKSLSINLMKDGSLQLHDDISGQAVVIRALLVHQSLKDAMNGETNLDVKMEDKDKKILLDKAHSTIILSLGDKVLRQVSKEKTVAEIWSKFEDLYMTKSL

SEQ ID NO: 171671 - protein, 1093 aa, Glycine max
  Coding DNA Sequence Number=SeqID_54893
  Gene Ontology: Mol. function=nucleic acid binding; Cellular component= intracellular; Biological process=DNA integration
  Pfam annotation: Domain name=rve; Domain location=374-506; Score =58.9; E_value=1.6e-14; Accession=PF00665.16; Description=Integrase core domain
  Pfam module annotation: Pfam domain module=RVT_2::rve; Domain location=677-850::374-506
ALDDEIFPRIASATTSKMTWDTLKQEYLGGKKVITVRLQSLRREFETALMTDKESVQEYLSRVSTVVQQMRSYGETMTNEHVVGKVLRSLTNKYDHVVAAIEESKDMADYTFDELMGSLQAHEERLNRNGEKKEEKAFHVKGESSNKEKTGQFSGRGRGRAGSRGRPGHKEASCWKKEEDEQKGDQKSNFVENEQKLFLAQRAADNDAGGDVWYIDSGCSNHMSSAKSMFRELNESLKSKVRLGDEKQLEVEGRGMIAIKTEQGNTKLLYDVQYVPNLAHYLLSVGQLLNSGYSVLFENDFCLICDKKSKEVVVKIVMGRNRMFPLDLSGNGLKLLSSKDMVQGLPKIGELELCEGCLYGKQSKRSFPSGRAWRASESLELLYADLCGPIQTISLGGSKYFLLIIDDYNRMSWVYFLKAKSEAFENFKIFKAMQGIRRELTAPYTLEQNRVAERKNMTVVEMAKSMLKARGVPNNFWCEAIATAVYILNVSPTKAVMNMTPFEVWRGEKPSISHLRVFSCSTYALVDLRSKLDDKSVKCVFIGYAAQSKAYRLYNPLTSKIMVSRNVVFDENAGWNWEQRESCDSIQQKIVGTDSSGEDSIVPTNDQQSPSPPTTPSSSNHSSSSSSCPSSSSSSNDSAPRRYRTLADLYANCDFALMAADPTSFNEAKDEVERQDAMKEEIKSIQKNETWKLVDLPKEKNVIELKWVFRTKFNTDGSIQKHKARLVAKGYAQQEGIDFEETFSPVARFETVRVVLALAAQWKLDVFQLDVKSAFLNGDLQEEVFVEQPLGFVKDGEGGKVYKLQKALYGLKQAPRACSSQKLLNEFKASMMEQFEMTDLGLLQTPMNPNEKLQKEDGTRKADEKLFRSLVGGLNYLTHTRPDIAHDVSMVSRYMHSPTKQQLGVAKRILKYVAGSTCFGILYEHISEFKLVGYIDSDWAGSLDDRKSTLGSVFSFDSGAITWSSKKQDIVALSSSEAEYVAASAAARQAVWLRKLLKDLCCEQEGATEVWCDNRSAIAMTRNPAFHARTKHIEVQHHFIRKLVLEETIALRFCSTNVQNADLFSKALAQAKYQFFMEKIGMYEFELRGGVAT

SEQ ID NO: 171672 - protein, 321 aa, Glycine max
  Coding DNA Sequence Number=SeqID_54894
  Gene Ontology: Mol. function=nucleic acid binding; Cellular component= intracellular; Biological process=ubiquitin-dependent protein catabolic process
  Homolog annotation: Hit_ID=Q10RB2; Match level="QueryCoverage=100%, HitCoverage=19%, E-value=2e-48, Identity=39%"; Hit description =Ubiquitin carboxyl-terminal hydrolase family protein, expressed
  Pfam annotation: Domain name=DUF627; Domain location=62-184; Score =24.5; E_value=6.4e-09; Accession=PF04781.3; Description=Protein of unknown function (DUF627)
MGHKKRNPAPRSKQSLAAATANGGATSPDADTACNVSDHNPRKIELATLQSEGSDYSTIKLECERALTTLRRGNHTKAMKQLKEICAREEGSPHAAFVNRVHSLMCFKTATVITDPSSKQRHLRNALESARRAVELMPNSVEYAHFRATVMLEAASEGKDYEEVVHECERGLAIENPSDPAKETLQDESEQKASSLEERIAHVQNELRQLIQKSNIASLSSWMKNLSNGEERFRLIPIRRTPEDPMEVRLVQTRRPNEIKKVTKTPEERRKEIEVRVAAARLIQKNSESPQSANEGDRDDRQLDSSAGSGQRIGDRRRHGN

SEQ ID NO: 171673 - protein, 93 aa, Glycine max
  Coding DNA Sequence Number=SeqID_54895
MTVWNTTFFGLWNDQKVKQNILERMQEASWSLEHKEVTIQDCKASTSLVGWRHDGKFGEVWRWHWVVAVVMFGCNDGVGWRWSVVVMEVWRES

SEQ ID NO: 171674 - protein, 68 aa, Glycine max
  Coding DNA Sequence Number=SeqID_54896
MEENKNKVVLGIQRMEAPQFTVAQNLPCSTFQHSDARYQTLWALLSHPVTLNAFVIIIPRQNLLLLKP

SEQ ID NO: 171675 - protein, 1189 aa, Glycine max
  Coding DNA Sequence Number=SeqID_54897
  Gene Ontology: Mol. function=nucleic acid binding; Cellular component= intracellular; Biological process=ubiquitin-dependent protein catabolic process
  Homolog annotation: Hit_ID=Q10RB2; Match level="QueryCoverage=99%, HitCoverage=74%, E-value=0.0, Identity=37%"; Hit description =Ubiquitin carboxyl-terminal hydrolase family protein, expressed
  Pfam annotation: Domain name=DUF629; Domain location=7-450; Score= -49.7; E_value=1.4e-06; Accession=PF04780.3; Description=Protein of unknown function (DUF629)
  Pfam annotation: Domain name=UCH; Domain location=853-1185; Score =2.2; E_value=1.3e-06; Accession=PF00443.19; Description=Ubiquitin carboxyl-terminal hydrolase
  Pfam module annotation: Pfam domain module=DUF629::UCH; Domain location=7-450::853-1185
MGSLSPQMQRLLPHNVDSEWIEMILNCSWKPLDILAAVRMLYNKAKFKSSSLPEDLYLDHHALDYNDCFKDASSSYIEKESSGDSLPNCSVECNNHYKIIENDVREGVEDQLSMANPIIDCWPVSDDPERAKLLGKIHAIFETLIKHKCLAASHLNKVIQFTMGEIQGLAAGSQLLNHGVDQTPMCMCFLGATQLKTIFQFLQEISHACGLARNADKGGSPTNDLLNISQGPEIKDKIVLDGDASCLLLDECLLQTQVTAGTVQGTVLDDVTTPSSPDGISCYNDALLSWIFSCSPIGDQLTSWLRTREDKLNKGKEIVQLLEKEFYHLQGLCEKKGERVSYEEALQTVEDLCLEEGKKRETVGEFVQRSYESVLRKRREELIESENDMMYVSNRFELDAISNVLQEAEARNVNQFGYEETYAGVTSQLCDLESGEEDEWRMKDYLHQMDGCIENAIQKLKEHLSIELSKIDARIIRSVTEMQQLEFKLGPISANDYRAILVPLVKSYLRALLDDLAEKDAREKSDAVSEALLAEIALDSKKAVKGGSESTRHVEKTKDKKKNKDHRKARDLKVASGHAQFSLGSTTPDSNLVAPESDFPDNEVVAMNDDDLEQLEEEFRRKIELEEEEKKLEETLEFQRRIENEAKQKHLAEQQKKSSGLYLEGVVDKLQDSETKVDADPPDAHEHVGVLVQDQLVKENGSRSNLDAGLPNGVVPENGLDRRAGKKHKRKNSSRQVDGKFEPVSSGQENIEDTHTDYHLREQFKLNSNQDVNNVWQNNGSKVMGELQVEDAEEERFQADLKMAILLSDTYQARGNLHSVSSLRMPQRASSQEDSVDCLPVEDSTDNVNGATLLGTGLKNEVGEYNCFLNVIIQSLWHLRRFRVEFLGRSRSEHDHVGNPCVVCALYEIFTALDTASKDSRREAVAPTSLRIALSNLYPHSNFFQEAQMNDASEVLSVIFDCLHRSFICGSSVSDAESAESNCMGSWDCANGSCIAHSLFGMNIFEQMNCYHCGLESRHMKYTSFFHNINASALRTMKDTFAESSFDKLLNLVEMNHQLACDLEAGGCGKLNHIHHFLSTPPHVFMTVLGWQNTSESADDITETLAALSTKIDTSVLYCGLDPKCVHNLVSVVCYYGQHYHCFAYSHDHEQWIMYDDKTVKVIGGWADVLTMCERGHLQPQVLFFEAVN

SEQ ID NO: 171676 - protein, 169 aa, Glycine max
  Coding DNA Sequence Number=SeqID_54898
  Gene Ontology: Mol. function=structural constituent of ribosome; Cellular component=small ribosomal subunit; Biological process =translation
  Homolog annotation: Hit_ID=Q1S3R3; Match level="QueryCoverage=52%, HitCoverage=67%, E-value=1e-36, Identity=87%"; Hit description =Ribosomal protein S12, bacterial and chloroplast form
  Pfam annotation: Domain name=Ribosomal_S12; Domain location=39-157; Score=143.2; E_value=6.8e-40; Accession=PF00164.15; Description =Ribosomal protein S12
MGTNPLLLLSCFGFLALEILTGCFILVQGNTIAVMGSFIGLKQVRRIVEECMMNKMHPVYNIKSGSKGDLSVNFSTITPKKPNSALRKVARVRLTFGFEITAYIPGIDHNLQEHSVVLVRGGRVKDLPGVTYHIVRGTLDAVGVKDRQQGRSSANPNLILQVGENLTPT

SEQ ID NO: 171677 - protein, 53 aa, Glycine max
  Coding DNA Sequence Number=SeqID_54899
  Gene Ontology: Mol. function=metal ion binding
  Homolog annotation: Hit_ID=Q8LJR1; Match level="QueryCoverage=98%, HitCoverage=13%, E-value=4e-13, Identity=62%"; Hit description =Putative zinc finger protein
MLDALLAEERYSDELSGQTQVILCNDCEKNGEAPFQWLYHRCPSCGSYNTRVL

SEQ ID NO: 171678 - protein, 130 aa, Glycine max
  Coding DNA Sequence Number=SeqID_54900
  Gene Ontology: Mol. function=transcription factor activity; Cellular component=nucleus; Biological process=regulation of transcription, DNA-dependent
  Homolog annotation: Hit_ID=Q9LSX0; Match level="QueryCoverage=97%, HitCoverage=84%, E-value=2e-20, Identity=43%"; Hit description =Nicotiana EREBP-3 like
  Pfam annotation: Domain name=AP2; Domain location=16-81; Score=148.5; E_value=1.8e-41; Accession=PF00847.10; Description=AP2 domain
MDEEGSRGRAKEDAGDVRYRGVRRRPWGKFAAEIRDSTRQGQRVWLGTFNTAEEAARAYDRAAYAMRGPFAILNFPDEYPMTAGGATNAATYSSAASSSSSASSSRHANVEARGRSEQGREVFEFEYLDD

SEQ ID NO: 171679 - protein, 593 aa, Glycine max
  Coding DNA Sequence Number=SeqID_54901
  Gene Ontology: Mol. function=aminoacyl-tRNA ligase activity
  Homolog annotation: Hit_ID=Q2PF39; Match level="QueryCoverage=99%, HitCoverage=76%, E-value=0.0, Identity=61%"; Hit description =Aminoacyl-tRNA synthetase
MALTRDTWITVLCRKLRDWWHWVADGDLPIVASHGVEIEEYKSLDPGVRVVILKALCDIRVEQEDIRSYIDNSIKHGVQLSTFRKERIGGDSHGISYWYEDDPIIGHRLYREKRKTEVVQMKKGKPRGSQVLSNTSYQWEAVATNFDEFEDVSEKLFSSKNRTEASMGKKLKIDMLPEIEKVHKKKEKLLKKQHRQALLLENYLVVDGLGPGRSLRDRKPVTYTFDDYDRSINEAIKVTKYALISFLSLSCICGEGDGLVIFIRLFRVLMAYVSVSSIFRQKQPSPECMPRRESVAKAEALSNGKYGPPHATQDRNFGIPSPESSDSDDDKEDNETDNLDRSNRQRRRPKRYSEREFVEAVSDNEADFDSDDDIVGEAVYDEEYLKKRKQKRMSSSSSEGDEEYQWDEYNVEDEEEEDDDDDDDSLSISEDSDKPRKVKQLQLHGRTRRETKLRSVGEIQSGLRRSKRATKNRINYRQCEVSESETEFIKSEKSNSSADHSDPNENGEYMMESEDSDDSDNEEQEMKVDDPVTYPAVEENEQNQPPEKLSSPGQEEVESSTGKRRFLDLNELAPSTGFDDGPNTIMKDEDNDY

SEQ ID NO: 171680 - protein, 536 aa, Glycine max
  Coding DNA Sequence Number=SeqID_54902
  Homolog annotation: Hit_ID=Q9LV14; Match level="QueryCoverage=99%, HitCoverage=100%, E-value=2e-38, Identity=48%"; Hit description =Arabidopsis thaliana genomic DNA, chromosome 5, P1 clone:MRG21
  Pfam annotation: Domain name=Extensin_2; Domain location=99-464; Score=-132.2; E_value=0.038; Accession=PF04554.4; Description =Extensin-like region
MKTTKGGKVMNPTDAYRKELRKKELKRNKKERKKVREVGILKKDPDQLKKQIDNLEMMKADGALDKARKHKKRQLQDTLNLVIKKRREYEDKMREKGETPVMFSHLGPPRRRTTAEEEERVKHPKPEDSVYYHPTLNPTGAPPPGKPPMFKSSIGPRIPLSGAASSSATDLENDVLTVPPPPPPPPLPDGSSASSADGAVLSASLPLPPPPPMPPKPATAVPTSLPPPPLPPPPPGPPPKEQVANRTLPPPPPPLQQSQPPPPGTSGGEGRNQSAFALIDDSPSKEPGQLPPPPPPSQVPPKAGAIQSDGAVLSTENKNSLSSQEIPKMVAGHPPPRQQPPVPGPTLIPSLQPDVLLPGISRFPPPPPPPDMRPSLSVTGLHAQAPPPGMMVPLMPRPPYGPPPGPPPMMRPPLPPGPPPNFQEEDHIATRPPPPPPKPSYVKSAASTVVKRPLAQHTPELTAMVPASVRVRREAAMSKTKPKPAVSTSRAVSGTSGPTIVKSESVSLSSAPKTQSIDDSYTAFLEDMKALGALDG

SEQ ID NO: 171681 - protein, 255 aa, Glycine max
  Coding DNA Sequence Number=SeqID_54903
  Gene Ontology: Mol. function=transferase activity
  Homolog annotation: Hit_ID=Q1T1H8; Match level="QueryCoverage=78%, HitCoverage=65%, E-value=3e-76, Identity=70%"; Hit description =Glutathione S-transferase, C-terminal-like
MATEPSESTQRNTLVVRKPCFGLPTGCPQCLSAYIFLKLSQVPFNLDYHPNYPDSDQIPYFEDGDSVTYNNEKEGIIECLKRNVGGDLDSEVSSLPDWIPTKVMATTWLADALEYELWVGCDGSSAYSIYYSDLPWPIGKVLFWKKAYWVKQKHGISEENVEVKEEEIYGRANSAYDALSTWLGEQNYLFENRPSSLDAIFLAHALVVLQALPKILSKKGPRAPGLQVLPSWIREEGGFNICSITPESQEAVSKM

SEQ ID NO: 171682 - protein, 197 aa, Glycine max
  Coding DNA Sequence Number=SeqID_54904
  Gene Ontology: Mol. function=protein binding
  Homolog annotation: Hit_ID=Q9LSW2; Match level="QueryCoverage=95%, HitCoverage=26%, E-value=5e-48, Identity=54%"; Hit description=Actin- like protein
MAYKKEGELDAVAVVHSYAEKVPAVSHKTRLSALNVPPMGLFYPTLLTPDVYPPPPRTWFHDYEDMLEDTWHIDFSRRSDMPDTFYPNVNGGLPMWESYPVFSTKPKKEEKVGLAEAITNCILSTGRIDIQRKLFCSIQLELTHFSGIDWWGGFDKWLSCSSRRKLMDESTILLSLRVLHAIPPNEAIDTVEVCVQI

SEQ ID NO: 171683 - protein, 96 aa, Glycine max
  Coding DNA Sequence Number=SeqID_54905
MPSIIHSSNPMSQSSQRSEAESRQAELYCSPLLPANKPRRRVERRHPPPLAVGIISDADRAKTAARAAAEGAGEGHLVVQEVAASCGSLLLRARSN

SEQ ID NO: 171684 - protein, 199 aa, Glycine max
  Coding DNA Sequence Number=SeqID_54906
  Gene Ontology: Mol. function=protein binding; Cellular component =cytoskeleton
  Homolog annotation: Hit_ID=Q9LSW2; Match level="QueryCoverage=82%, HitCoverage=28%, E-value=3e-43, Identity=54%"; Hit description=Actin- like protein
MTFNVPDVQMGRVDGHNPHIRKDLPLTWTNVYEEATNSSVSLETSSKDETGQFLDPKEGTHSKEPNASERKFKEFICGEEALRISPTEPYCFCHPIRRGHLNISQYYSMQQVLEDLHTIWDWILIEKLHIPHNERNMYSAVLVMPETFDNREIKEILSLVLQELRFGSAVVHQMDTGIIGKPHSQGVGSVPQDWYQACW

SEQ ID NO: 171685 - protein, 109 aa, Glycine max
  Coding DNA Sequence Number=SeqID_54907
  Gene Ontology: Mol. function=protein binding
  Homolog annotation: Hit_ID=Q9LSW2; Match level="QueryCoverage=84%, HitCoverage=15%, E-value=2e-26, Identity=63%"; Hit description=Actin- like protein
MDYLKSALPSQIMSERGSNLVVINPGSANVRIGLASQDTPFNIPHCIARHTKQIPNFTVIDQMLNSMVTTTQLIEREKAYDFIAPLLKIPFLDEGPGNSFPRKTFFGSV

SEQ ID NO: 171686 - protein, 71 aa, Glycine max
  Coding DNA Sequence Number=SeqID_54908
MARSRIVSGHGQKSRQVNGRNQPRYIGTDASGARVTTDRSLPLPGAKQAEKVVVGQPSILCVRSFFYYCLF

SEQ ID NO: 171687 - protein, 788 aa, Glycine max
  Coding DNA Sequence Number=SeqID_54909
  Gene Ontology: Mol. function=actin binding; Cellular component =phragmoplast; Biological process=actin cytoskeleton organization and biogenesis
  Homolog annotation: Hit_ID=Q9SE97; Match level="QueryCoverage=58%, HitCoverage=42%, E-value=1e-174, Identity=71%"; Hit description =Formin-like protein AHF1
  Pfam annotation: Domain name=FH2; Domain location=331-735; Score =574.2; E_value=1.3e-169; Accession=PF02181.13; Description=Formin Homology 2 Domain
  Subcellular localization annotation: CTP_CleavageSite=57; ConfidenceScore=5.72e-01
SESSTSSFSSSSSASPDRSHSISLSPPVSISPRRSLPKSPENTITHHSSPPEEAAIRSSASSSTLSSPSPVFGQHVPSSPSMSSTPERRECQSPSLSPLSLSPKKSQTPDGESVPGLVVLEKTQSFGSSKSKNESGSPRLSNASSIGKSSAFSLPSPDKGMTLHHGLDQSPTISDVSDRYRHSPLSSLHLSPTLLSSPERELNSQPQPQPPPSRKNWEIPDLLTPIGEAPNFSAPQRKQWEIPVLSVPIAPSSSVLAPPPPPPPPPPPPPLAVPRQRKQWEMPSPLTPVDQPVSRPPPLTPPSRPFVLQTPNTKVSPVELPPASSQNFEEGSEETSKPKLKPLHWDKVRASSDREMVWDQLRSSSFKLNEEMIETLFVVNTPNPKPKDTTPRSVLAPQNQEDRVLDPKKSQNIAILLRALNVTIEEVCEALLEGVTDTLGTELLESLLKMAPSKEEERKLKEHKDDSPTKLGPAEKFLKAVLDVPFAFKRVEAMLYIANFESEVEYLRKSFQTLEAKQNPTACEELRNSRMFLKLLEAVLKTGNRMNVGTNRGDAHAFKLDTLLKLVDVKGADGKTTLLHFVVQEIIRTEGARPSSTNPTPSANSNDDAKCRRLGLQVVSSLSSDLANVKKAAAMDSEVLSSEVSKLSKGIAHIAEVVQLDEAGGSDESSQKFRESMNKFMRMAEEEILKVQAQESVALSLVKEITEYFHGNLSKEEAHPFRIFMVVRDFLTVLDRVCKEVGMINERTMVSSAHRFPVPVNPMLPQPLPGLVGKRQYNSSDDDDSSSP

SEQ ID NO: 171688 - protein, 682 aa, Glycine max
  Coding DNA Sequence Number=SeqID_54910
  Gene Ontology: Mol. function=protein-tyrosine kinase activity; Cellular component=integral to membrane; Biological process=protein amino acid phosphorylation
  Homolog annotation: Hit_ID=Q9AXB6; Match level="QueryCoverage=98%, HitCoverage=98%, E-value=1e-160, Identity=45%"; Hit description =Phytochrome / protein kinase-like
  Pfam annotation: Domain name=DUF1221; Domain location=21-236; Score =426.7; E_value=3.2e-125; Accession=PF06760.2; Description=Protein of unknown function (DUF1221)
  Pfam annotation: Domain name=Pkinase; Domain location=237-504; Score =67.4; E_value=4.6e-17; Accession=PF00069.15; Description=Protein kinase domain
  Pfam annotation: Domain name=Pkinase_Tyr; Domain location=254-504; Score=51.8; E_value=1.2e-15; Accession=PF07714.7; Description =Protein tyrosine kinase
  Pfam module annotation: Pfam domain module=DUF1221::Pkinase::Pkinase _Tyr; Domain location=21-236::237-504::254-504
MEQFRQLGEALGGLKSVMVFRESIQINHRQCCLLLDVFTFAYECIADEIIQNLKFEEKNGKWKILEQPLREIHKIFREGEAYIRHCMETKDWWAKSIVMSHNNDCVEFHIHNLLCCMPVVIEAIESAGETSGWDQEEMQRKRLINSDKYRKEYRDMRLFQWKFGKQYLITQDFCRRYDTVWKEDRWFLYNKIHEKKVEGISKYEKKLIDLLLRNLERSESLVGKLLPSSILVGSKDYQVRRRMGNASQYKEISWLGESFVIRHFSGDIEALEPEIIELLSLSHPNIMDSLCGFTDEEKKECFLVMELMSKTLSTHIKEIHGPRKRIPFLLHVAIDLMLQIARGMEYLHSKKVYHGELNPSSILVRPRGTSQEGYLHAKVMGFGLTSVKDLTQKGNTNQNGTPPFIWYSPEVLEEQDHSGGEANSKYTEKSDVYSFGMVCFELLTGKVPFEDSHLQGEKMSRNIRAGERPLFPPNSPKYVINLTKRCWHIDPHQRPSFATICRVLRYIKRFLALNPGYSNQPEPPVPPVDYCDIESVLLRKFPSWGGSESPSVPITPFQMFAYQAIEREKVSTGCKDNSESGSDASACGDELVTSGDEPFPSTVERKSLLGHDILNRRIQLTRKSLDLKLTKQPGTPKGRLARPPQMSPRTRTLRITSDNHMISSPRAIRRVSPGHVSDSELS

SEQ ID NO: 171689 - protein, 525 aa, Glycine max
  Coding DNA Sequence Number=SeqID_54911
  Gene Ontology: Mol. function=protein kinase activity; Cellular component=nucleus; Biological process=protein amino acid phosphorylation
  Homolog annotation: Hit_ID=Q9SYX2; Match level="QueryCoverage=71%, HitCoverage=39%, E-value=1e-139, Identity=60%"; Hit description =Phytochrome A supressor spa1
  Pfam annotation: Domain name=WD40; Domain location=235-273; Score =8.0; E_value=4.3; Accession=PF00400.22; Description=WD domain, G -beta repeat
  Pfam annotation: Domain name=WD40; Domain location=284-323; Score =12.5; E_value=1.3; Accession=PF00400.22; Description=WD domain, G -beta repeat
  Pfam annotation: Domain name=WD40; Domain location=327-366; Score =34.7; E_value=3.1e-07; Accession=PF00400.22; Description=WD domain, G-beta repeat
  Pfam annotation: Domain name=WD40; Domain location=379-416; Score =28.3; E_value=2.6e-05; Accession=PF00400.22; Description=WD domain, G-beta repeat
  Pfam annotation: Domain name=WD40; Domain location=428-466; Score =7.6; E_value=4.7; Accession=PF00400.22; Description=WD domain, G -beta repeat
  Pfam module annotation: Pfam domain module=WD40::WD40::WD40::WD40::WD4 0; Domain location=235-273::284-323::327-366::379-416::428-466
  Subcellular localization annotation: CTP_CleavageSite=48; ConfidenceScore=5.05e-01
MALSSKKLDQVSICVNVTRKQLLITAFCLVSFVKSMLCRMILESEVMRESEESNSVDDVGISDDEAETEQLLDFLILIKEAKKKREAKLEEELNLLNEDIKEVEKSYSFVTDSVFPLVQMNNPEVRGDNLYFQDPSGSDISRSIRRSFGDEERFMSNLNQLENSYFSMRFRVLPKEASSVSSNEKNVMESRWRLPQVENVNKESRRIQSSVGCVGSFFEGLCKFARYSKFEECGRLRNRDLLSSANVMCALSFDRDEDHIAAGGVSKKIKIFDLNAIASDSVDIQYPVIEMSNKSKLSCVCWNTYIKNHLASTDYDGAVQMWDADTGQPLSQYMEHQKRAWSVHFSLSDPKMFASGSDDCSVKLWTDYKVYGYDLRHTRIPWCTLAGHGKAVSYVKFIDSEAVVSASTDNSLKLWDLNKTSSSGLSSDACAMTFKGHSNEKNFVGLSVLDGYIACGSESNEVYCYHKSLPVPIATHKFESIDHISGHLNSGDNNGQFVSSVCWRKKSNMLVAANSVGIVKLLQMV

SEQ ID NO: 171690 - protein, 305 aa, Glycine max
  Coding DNA Sequence Number=SeqID_54912
MATANGGTGAEKHKRKTNDPFLKQGGHQLMPRSPRLCTPIRKEWPESFPNDNVIGNEDNGLNRYITSLAGSGPPGTSFCSSIDSEHIVEELPVRNYKNPNYLTIESKYNRLSREIVPKVEEQIPLRLSKGLKGIDSEFWGLKSLPGKSVNHDSLNVSEGRSNMGKAIISNNAHLISSITQSTSSAYNYPQLIVKQTKKGKGIICEDLNQSFSTGGALNSQEDEKPAFAAKFQSETLVRSNVDENKPLLEGTFLSGSKGLNLREWLKSEGHKVNKSGRIRIFKQEKAFGTEHLCLPEFEYKATKAL

SEQ ID NO: 171691 - protein, 241 aa, Glycine max
  Coding DNA Sequence Number=SeqID_54913
  Gene Ontology: Mol. function=transcription regulator activity; Cellular component=mitochondrial inner membrane; Biological process =regulation of transcription
  Homolog annotation: Hit_ID=Q6I583; Match level="QueryCoverage=88%, HitCoverage=92%, E-value=1e-91, Identity=59%"; Hit description =Putative peroxisomal Ca-dependent solute carrier
  Pfam annotation: Domain name=Mito_carr; Domain location=143-236; Score=85.7; E_value=1.5e-22; Accession=PF00153.17; Description =Mitochondrial carrier protein
  Pfam annotation: Domain name=Mito_carr; Domain location=40-131; Score= 127.4; E_value=3.9e-35; Accession=PF00153.17; Description =Mitochondrial carrier protein
  Pfam module annotation: Pfam domain module=Mito_carr::Mito_carr; Domain location=143-236::40-131
MASENVKTGDSAVTTIVNLAEEAKLAREGVVKAPSYALASICKSLVAGGVAGGVSRTAVAPLERLKILLQVQNPHNIKYNGTVQGLKYIWRTEGFRGLFKGNGTNCARIVPNSAVKFFSYEQASKGILHLYKQQTGNEDAQLTPLLRLGAGACAGIIAMSATYPMDMVRGRITVQTEASPYQYRGMFHALSTVLREEGARALYKGWLPSVIGVMMIMLMILKMDYNKCKHALITIFMGIGN

SEQ ID NO: 171692 - protein, 229 aa, Glycine max
  Coding DNA Sequence Number=SeqID_54914
  Gene Ontology: Mol. function=RNA binding
  Homolog annotation: Hit_ID=Q9M6S0; Match level="QueryCoverage=100%, HitCoverage=23%, E-value=3e-62, Identity=56%"; Hit description =Pumilio domain-containing protein PPD1
MATESLIRISEAGGKWPSHKEAAAFGSSSRNMATEDLGILLKGHRFQGGGKDAAPNRSGSAPPSIEGSFLAIENLLPQHNTAQNASFANLSSTTQNCESEEQLRADPAYLAYYNSNVNLNPRLSPPLTSWENRHLGRHIGSFRNNWRMSSADDSGKSSVHLTQRTLSTHKEESEDDSAQQPYDDELVKASGIWRRPDATSLASQHKNMVDLIQEDFPRTMSPVYNKSLS

SEQ ID NO: 171693 - protein, 710 aa, Glycine max
  Coding DNA Sequence Number=SeqID_54915
  Gene Ontology: Mol. function=RNA binding; Cellular component=external side of mitochondrial outer membrane; Biological process=mRNA catabolic process, deadenylation-dependent decay
  Homolog annotation: Hit_ID=Q9SVZ7; Match level="QueryCoverage=88%, HitCoverage=72%, E-value=1e-166, Identity=47%"; Hit description =Pumilio-like protein
  Pfam annotation: Domain name=PUF; Domain location=420-454; Score =42.8; E_value=1.2e-09; Accession=PF00806.9; Description=Pumilio -family RNA binding repeat
  Pfam annotation: Domain name=PUF; Domain location=456-490; Score =29.2; E_value=1.4e-05; Accession=PF00806.9; Description=Pumilio -family RNA binding repeat
  Pfam annotation: Domain name=PUF; Domain location=492-526; Score =34.2; E_value=4.6e-07; Accession=PF00806.9; Description=Pumilio -family RNA binding repeat
  Pfam annotation: Domain name=PUF; Domain location=528-563; Score =41.4; E_value=3.1e-09; Accession=PF00806.9; Description=Pumilio -family RNA binding repeat
  Pfam annotation: Domain name=PUF; Domain location=565-599; Score =35.7; E_value=1.6e-07; Accession=PF00806.9; Description=Pumilio -family RNA binding repeat
  Pfam annotation: Domain name=PUF; Domain location=601-635; Score =44.8; E_value=2.9e-10; Accession=PF00806.9; Description=Pumilio -family RNA binding repeat
  Pfam annotation: Domain name=PUF; Domain location=643-677; Score =34.0; E_value=5.3e-07; Accession=PF00806.9; Description=Pumilio -family RNA binding repeat
  Pfam module annotation: Pfam domain module=PUF::PUF::PUF::PUF::PUF::PU F::PUF; Domain location=420-454::456-490::492-526::528-563::565 -599::601-635::643-677
ADDIRVSSSVDTHAPVASSSSLESTGSIGVTDLDIATVEYQLKALGVSNAPNSESLSYKEKWKTGYQNNLMQRQGFQQQNNPYDVPSANSQNVNSVYAGREQFPFNSNKFSNVQPLLQSSGFTPPLYATAAAYMSSANPFYTNMQASGIYTPQYVGGYTVNPTAFPPYVTAYPPHGAVPLVIDGATSSSYTPLTPGVSIGGNISHGAEMVQTNKYLGQFGFPPQPSFGDPMYMQYHQQPFVEGYGISGHFDPLAPRASGVSQISPYDSQKRPSTGAYLDDKKLPDQRTAANMTSRRGGVSIPSYFGHMPNMGFVMQHPSSPLPSPVLSGYPEGSPGLPGVRNEINLSPASGRNGGIISGWQVQRSFDSAHDPKIVNFLEDLKSGKSRRFELSDIIGHIVEFRQQKLESCSVEEKTLVFKEVLPHASKLMTDVFGNYVIQKFFEYGSPEQRRELADRLVGQILPLSLQMYGCRVIQKALEVIELEQKAQLVHELDGNVMRCVRDQNGNHVIQKCIESIPTKKISFILSAFRGQVATLSMHPYGCRVMQRVLEHCTDESQCQFIVDEILESVCALAQDQYGNYVTQHVLERGKPQERSQIINKLSGHIVQLSQHKFASNVVEKCLEYGDTTERELLVAEIFGHDEKCDNLLTMMKDQFANYVVQKVIDICSENQRAMLLSHVRIHAHALKKYTYGKHIVARLEHQFGGVYIG

SEQ ID NO: 171694 - protein, 249 aa, Glycine max
  Coding DNA Sequence Number=SeqID_54916
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q2UPL9; Match level="QueryCoverage=74%, HitCoverage=25%, E-value=3e-39, Identity=44%"; Hit description =Uncharacterized conserved protein
  Pfam annotation: Domain name=DUF1253; Domain location=7-246; Score= -34.0; E_value=1e-13; Accession=PF06862.2; Description=Protein of unknown function (DUF1253)
MTAATHNFQLKFLAVDSLLLLLLINMIHLIVLYCIFLEQECKINNSVNVEHMDRFSTKFGSEEHKGNTENDDESENAKPQKSSKATDFQILFGGNNEDDFMIGIKFTRKTIKLFSDFHTSDIIIASALCLVNKIEEAGSNKEKDVDFLSSIEVLIIDHADVISMQNWSHVHTVIEHLNRLPSKQLGTDVMRIRPWYLDDHARFYRQTIILGLYSNPDVNASFNHQCLNYEGKLKLPLHYSGGWHLILTD

SEQ ID NO: 171695 - protein, 108 aa, Glycine max
  Coding DNA Sequence Number=SeqID_54917
  Homolog annotation: Hit_ID=Q49RB3; Match level="QueryCoverage=55%, HitCoverage=56%, E-value=5e-34, Identity=93%"; Hit description=Gip1 -like protein
MALQTLRASALNWHKEGSNKNVGKRQLKLNKLKLKGTWVLLPWSSSCCSKGTQLYYHNTPGAHTGMSCSTSDRKTCRACGIGSGYISSSIVMGILVISDSKKRIRDAP

SEQ ID NO: 171696 - protein, 38 aa, Glycine max
  Coding DNA Sequence Number=SeqID_54918
MTKISTFGAYSSSSNPETSIEDVEAGTSSPIVRPIGNK

SEQ ID NO: 171697 - protein, 110 aa, Glycine max
  Coding DNA Sequence Number=SeqID_54919
MALNEKLGASGNEKEQLTSDDGVGVILRRTVARELRLEFRGGGEGAEARVPRRRQGRFFKPLKAMSVTLPRKGSMYSVYLIRRKLAWITSLNLSRCETASKPLDIFLSSI

SEQ ID NO: 171698 - protein, 107 aa, Glycine max
  Coding DNA Sequence Number=SeqID_54920
  Homolog annotation: Hit_ID=Q10F11; Match level="QueryCoverage=82%, HitCoverage=22%, E-value=2e-14, Identity=45%"; Hit description =Vegetatible incompatibility protein HET-E-1, putative, expressed
  Pfam annotation: Domain name=WD40; Domain location=55-94; Score=20.0; E_value=0.0086; Accession=PF00400.22; Description=WD domain, G-beta repeat
MSGHVAPPIYEYNDEVISDEFFLDESDILHELSMDDEDLPDVDDDSETEHVEEVDDAIDTFKSHNGELYAVACSPTDATLVATGGGDDRGFLWKIGEKGDWVSELQG

SEQ ID NO: 171699 - protein, 64 aa, Glycine max
  Coding DNA Sequence Number=SeqID_54921
MALNEKLGASGNEKEQLTSDDGVGVILRRTAARELRLEFRGGGEGGRKLAWITSLSLLPVQDSF

SEQ ID NO: 171700 - protein, 203 aa, Glycine max
  Coding DNA Sequence Number=SeqID_54922
  Gene Ontology: Mol. function=DNA binding; Cellular component=nucleus; Biological process=regulation of transcription
  Homolog annotation: Hit_ID=Q1SMW7; Match level="QueryCoverage=46%, HitCoverage=30%, E-value=4e-26, Identity=56%"; Hit description =Homeobox domain, ZF-HD class; ZF-HD homeobox protein Cys/His-rich dimerisation region; Homeodomain-related
  Pfam annotation: Domain name=Homeobox; Domain location=75-135; Score=- 9.9; E_value=0.054; Accession=PF00046.19; Description=Homeobox domain
  Subcellular localization annotation: CTP_CleavageSite=40; ConfidenceScore=5.23e-01
MRRLRLPPQLPPPRAGGAPHRLHHHAPTRSPNSASPPPISSSYYPSAPHMLLALSAGLAAPPESTAAPAAAPTRKRFRTKFSQEQKEKMHKFAEKVGWKIQKRDEDLIHEICNEVGVDRSVLKVWMHNNKNTFAKKDNNNIVTSNDINITTKNNISTDNDANGSDVKVFENPNNDGGEDRAEDPSSNHYDGVNVVGANGSSSS

SEQ ID NO: 171701 - protein, 207 aa, Glycine max
  Coding DNA Sequence Number=SeqID_54923
  Gene Ontology: Mol. function=heparin binding; Cellular component =nucleus; Biological process=cell motility
  Homolog annotation: Hit_ID=Q10F11; Match level="QueryCoverage=61%, HitCoverage=53%, E-value=2e-32, Identity=39%"; Hit description =Vegetatible incompatibility protein HET-E-1, putative, expressed
  Pfam annotation: Domain name=WD40; Domain location=138-176; Score =40.1; E_value=7.4e-09; Accession=PF00400.22; Description=WD domain, G-beta repeat
  Pfam annotation: Domain name=WD40; Domain location=56-94; Score=23.9; E_value=0.00057; Accession=PF00400.22; Description=WD domain, G-beta repeat
  Pfam annotation: Domain name=WD40; Domain location=97-134; Score =29.7; E_value=1e-05; Accession=PF00400.22; Description=WD domain, G -beta repeat
  Pfam module annotation: Pfam domain module=WD40::WD40::WD40; Domain location=138-176::56-94::97-134
MITSNVSCYYLSIKQIFARLLLAHYWSRCPNIKTSITYPLSQLFHLSLEFFVKGSEHVIDFVASHPDSIECVGFSPSDSLAAIGGMDQRLVIWDIQHFLSRATCDHEGGVTCMTWVGSSCVATGCVDGIVRLWDIRSGECVEKFRGHSDAIQSLSVSANGDYIVSVSLDHTARVFEVRMFQQSDLQVSKEANKEVSKTWIHAYANTC

SEQ ID NO: 171702 - protein, 71 aa, Glycine max
  Coding DNA Sequence Number=SeqID_54924
MGHLWLMCIREERKKRMERIGKGPNSIQEEKDLVGGVRNIIGQVAQRVGAMGFWNHEENDKGEGLESVRGI

SEQ ID NO: 171703 - protein, 123 aa, Glycine max
  Coding DNA Sequence Number=SeqID_54925
  Homolog annotation: Hit_ID=P82772; Match level="QueryCoverage=83%, HitCoverage=84%, E-value=2e-09, Identity=33%"; Hit description =Putative low-molecular-weight cysteine-rich protein LCR58 precursor
  Pfam annotation: Domain name=SLR1-BP; Domain location=2-69; Score= -8.1; E_value=0.007; Accession=PF07333.3; Description=S locus-related glycoprotein 1 binding
MAKLSLYATLLLLCTSGIMMDMVASDRCKEDVGACTADCNSRCVTRFQGGFGECMTINGVNDCWCYYDCTPKRCTGGTGEVGACDNTQCDLDCGHKYPGKGATGLCYSVGDPMYDTCQCTYYC

SEQ ID NO: 171704 - protein, 114 aa, Glycine max
  Coding DNA Sequence Number=SeqID_54926
MWRGIHEDDLHDGGVPFLVWVETTTHARICFVMEDDEKMSLLVSWRFKYNYHFSARKKGSESVRGNQKMRIERVLSRERMVGGSRGAAKLKYPGQNRKKARTREIGLRIIPRKA

SEQ ID NO: 171705 - protein, 183 aa, Glycine max
  Coding DNA Sequence Number=SeqID_54927
  Pfam annotation: Domain name=FBD; Domain location=100-150; Score =40.4; E_value=6.1e-09; Accession=PF08387.1; Description=FBD
MASQILSNNHLLFQPFYNLKHLELHTGFNKSDVPGLTCLFKSSPTLDTLILKIIHEYRIERKLAHIYKALHNLSKFVDFPLDQEWNRDLWDMTITEGEQYWESQIRTLESFLQHLKVVKIHGFLDYENEVALAKFLLKHGKALEEMILHTGHCNARDTLRRQKIRSQMMGFSWASSNAKVAFQ

SEQ ID NO: 171706 - protein, 122 aa, Glycine max
  Coding DNA Sequence Number=SeqID_54928
MSLTRDINSYTPIQYFCAPPPWTIHHRASAAIARPDHHHFPFSDHIRPKTTIKTRSAAKQIWVRCSDLASGSSESGMNIHRSCICFFLSLGAKEEEEEAKVVIPVVCGPSSAVARLASSLIA

SEQ ID NO: 171707 - protein, 159 aa, Glycine max
  Coding DNA Sequence Number=SeqID_54929
  Homolog annotation: Hit_ID=Q1T530; Match level="QueryCoverage=35%, HitCoverage=38%, E-value=8e-09, Identity=51%"; Hit description =Cyclin-like F-box
  Pfam annotation: Domain name=F-box; Domain location=24-71; Score =32.3; E_value=1.7e-06; Accession=PF00646.23; Description=F-box domain
METRSAKRKKMAQIVENDAKAATDRISDLPDAVLHQILFLLPIKCVAQMSILSKRWKFLWSTFPDLDFTTLNPFQISSQSVKFLEFEKPRQPLDSSRMDFITQVLSIRDKHSDIRFLCFRARLSFSRLNSLIRRAIRHNVRELDIGASTVCTDDYFNFP

SEQ ID NO: 171708 - protein, 248 aa, Glycine max
  Coding DNA Sequence Number=SeqID_54930
  Homolog annotation: Hit_ID=Q1T1F7; Match level="QueryCoverage=60%, HitCoverage=32%, E-value=2e-13, Identity=42%"; Hit description=IMP dehydrogenase/GMP reductase
  Pfam annotation: Domain name=DUF1723; Domain location=134-183; Score =50.5; E_value=5.6e-12; Accession=PF08330.1; Description=Protein of unknown function (DUF1723)
LCNPKYIFKLSCPIRDSLIRSNINQSGIDFQIDLHYFRSFFLCERRAVVEEGQEIYKAPEHFAVDDVKMLCLVVDLRTNQSLLNMLIMWLDRGELKLVAHERKLRDLPPFPHKEIMRLVEDLGLLPLTECSYETPDKGLFSAFVERWHHETNTFHFPIGEMTIIFDDVSSLLHILIIGDFYSYSHTSKEVVIALLMELLGVNKEDAFLETKQCIGGHLGDAGFINTKQLNGYATLMQAWIYEHFPTIG

SEQ ID NO: 171709 - protein, 698 aa, Glycine max
  Coding DNA Sequence Number=SeqID_54931
  Gene Ontology: Mol. function=nucleic acid binding; Cellular component= nuclear pore; Biological process=DNA integration
  Homolog annotation: Hit_ID=Q1T2W1; Match level="QueryCoverage=56%, HitCoverage=67%, E-value=2e-87, Identity=39%"; Hit description =Integrase, catalytic region; Asp/Glu racemase
MVMMSCGHIIDLYHLSYFHLSYLTKNNYYTSTDPKHHIFPDIQDSEGLFDPVARRVVVSRDVIFEEEKRWDWDGKQIAVDIKWDEERQPPTWMGDYVSGEGLSDDEVHMALMVSTDPLCFEEAVKSANWRLAMDNEIKSIEKNQTWRLTELPAGAKRIGVKWVYKTKYNEHGKIDKYKARLVAKGMGTVRMIIALAAHKNWWIFQLDVKSVFLHGELSEDVYVEQPRGYKKEGSEHLVYNKQTLFTKRSREGKIIIVSVYVDDLIFTDNCEFMMSEFKNSMLREFDMSDLGKMSLMYLTATRPDMMFVTSLISRFMAKPSQTHLQVAKRALRYLKGTVNYGIHYKKGGNGELLAFTDIDYAEDVEDRKSMSEAEFVAAAVCACQGVWMKRILEELGQSHEGCINIMCDNSSTIKLSKNPVMHGHSIDVRFHFLRNLSKEGTIELVHCGSQDQVADIMTKPLKLEVFQMLRNQRNITGPNKPRIPKQFNNLPHLVLPRLRNEKKARATWPDDALHLGGEPCREQCLVESRGEGEVERAVEERQIVRIGAADERRGLEDLDSGDIVDPEAAERGDLVAGAGGDAEDAGVVVVVGGSGGEEEGEEVVAEEEGEGEDLGGPEARGLNAQGALLGGDVGARGGEVARGFGEAEVRLPGRVVGDTRVGRAEEEEEEREGGYCDGYEREALEESVDEYVFSSLRF

SEQ ID NO: 171710 - protein, 170 aa, Glycine max
  Coding DNA Sequence Number=SeqID_54932
PVVVVVVKLGGGGGGGDETSGGGGDETGGGGGGGGVLESEGAGDIEGGGGDGDGELEGAGAGETGDGGDNGDGELDGGDGDETGDGESEGEAAGEAGGGGSDDNGDLEGEGDGESEGEGSREMGDGDGNDNGELKGESVATAGANHGKEKEVKGEDKGKTLGTHFPNSFS

SEQ ID NO: 171711 - protein, 101 aa, Glycine max
  Coding DNA Sequence Number=SeqID_54933
AHESDQAQAPLTVLNPFEHKTQTGVQLNDDQNSDHKVAVSGAIEESSSSEEEKNGEAKAAEAPQIRRIGKHHSSDKSVAGGGVIIGGLVTAIFAAVFCYIR

SEQ ID NO: 171712 - protein, 43 aa, Glycine max
  Coding DNA Sequence Number=SeqID_54934
MEPITSEFKDVAVLIVADDGSGHGANRGGRVAGLDASLRSPVR

SEQ ID NO: 171713 - protein, 57 aa, Glycine max
  Coding DNA Sequence Number=SeqID_54935
MGVFSDGDLREANNGDLTVKERTRVKLKDKGVRVTIRHSNGPGWSTFSKNYTRSLYL

SEQ ID NO: 171714 - protein, 335 aa, Glycine max
  Coding DNA Sequence Number=SeqID_54936
  Gene Ontology: Mol. function=transcription factor activity; Cellular component=nucleus; Biological process=regulation of transcription, DNA-dependent
  Homolog annotation: Hit_ID=Q4QY92; Match level="QueryCoverage=53%, HitCoverage=85%, E-value=2e-73, Identity=78%"; Hit description=DREBa transcription factor
  Pfam annotation: Domain name=AP2; Domain location=188-252; Score =122.8; E_value=9.8e-34; Accession=PF00847.10; Description=AP2 domain
MCYVGKATKIFIFIVTVLVVVGIVFGFSLMRRNHHHNNAAKCSDAACNNISPPLSPITTLPADSNPYPPPPPPPPPPPPPQSTPPPSYPAYPIPDGYGDETINSNPSGIGYGYGNMLRSGVRNWGDNTGTRPAPLAYMQSLADTLAKWKEYNAWLESNNEAEKPVRKVPAKGSKKGCMKGKGGPENLRCNYRGVRQRTWGKWVAEIREPNRGSRLWLGTFPTAISAALAYDEAAMAMYGFCARLNFPNVQVSTFSEEPSRNSPAAAYQSRNSPSAKESGSALVILERSECMMLWNNSGGDAAEDDGMEDLSLSLSVKHEEGEDESGTSSSYLSLS

SEQ ID NO: 171715 - protein, 40 aa, Glycine max
  Coding DNA Sequence Number=SeqID_54937
MKLKSDLSLSFERIAWNQRAEKTKKSPSGVTRNPWVAHNR

SEQ ID NO: 171716 - protein, 77 aa, Glycine max
  Coding DNA Sequence Number=SeqID_54938
  Subcellular localization annotation: CTP_CleavageSite=32; ConfidenceScore=5.21e-01
MMYPHCDVILCSIQPPLPLSFLIHFSRIAALRTMSLSTTMVTPLTMMWRVKSMTMRIHDGLHIVHRWRMKSITMKIR

SEQ ID NO: 171717 - protein, 168 aa, Glycine max
  Coding DNA Sequence Number=SeqID_54939
  Gene Ontology: Mol. function=binding; Biological process=thiamin biosynthetic process
  Homolog annotation: Hit_ID=Q2QYR0; Match level="QueryCoverage=58%, HitCoverage=14%, E-value=4e-25, Identity=55%"; Hit description =Pentatricopeptide, putative, expressed
MVHQFFVGDTSHEQSDDIYAKLKDLNEQLKKAGYKPDTSLVLYDVEEEIKEKMLWDHSERLALAFALINTGPGTTIRITKNLRVCGDCHTMCFFVHPSSHGQRNIFTNQMLPKYIVYLIIVTTEMEKLKNGRILEYQRHVKNNRGVRRERGRMTYSYRLKNGVKGELK

SEQ ID NO: 171718 - protein, 531 aa, Glycine max
  Coding DNA Sequence Number=SeqID_54940
  Gene Ontology: Mol. function=methyltransferase activity; Cellular component=intracellular; Biological process=protein amino acid phosphorylation
  Homolog annotation: Hit_ID=Q9LTV8; Match level="QueryCoverage=94%, HitCoverage=71%, E-value=8e-92, Identity=37%"; Hit description =Selenium-binding protein-like
  Pfam annotation: Domain name=PPR; Domain location=191-225; Score =42.6; E_value=1.3e-09; Accession=PF01535.11; Description=PPR repeat
  Pfam annotation: Domain name=PPR; Domain location=295-329; Score =42.4; E_value=1.5e-09; Accession=PF01535.11; Description=PPR repeat
  Pfam annotation: Domain name=PPR; Domain location=396-430; Score =35.8; E_value=1.5e-07; Accession=PF01535.11; Description=PPR repeat
  Pfam annotation: Domain name=PPR; Domain location=431-465; Score =15.3; E_value=0.12; Accession=PF01535.11; Description=PPR repeat
  Pfam annotation: Domain name=PPR; Domain location=467-500; Score =14.1; E_value=0.16; Accession=PF01535.11; Description=PPR repeat
  Pfam annotation: Domain name=PPR; Domain location=90-124; Score=34.4; E_value=3.8e-07; Accession=PF01535.11; Description=PPR repeat
  Pfam module annotation: Pfam domain module=PPR::PPR::PPR::PPR::PPR::PP R; Domain location=191-225::295-329::396-430::431-465::467-500::90-124
  Subcellular localization annotation: CTP_CleavageSite=60; ConfidenceScore=5.52e-01
MSLLKTTATLIPKPSSTSTFDSLQCGTLLQSLTNSKSLTQALQLHAHVTTGGTLRRNTYLATKLAACYAVCGHMPYAQHIFDQIVLKNSFLWNSMIRGYACNNSPSRALFLYLKMLHFGQKPDNFTYPFVLKACGDLLLREMGRKVHALVVVGGLEEDVYVGNSILSMYFKFGDVEAARVVFDRMLVRDLTSWNTMMSGFVKNGEARGAFEVFGDMRRDGFVGDRTTLLALLSACGDVMDLKVGKEIHGYVVRNGESGRVCNGFLMNSIIDMYCNCESVSCARKLFEGLRVKDVVSWNSLISGYEKCGDAFQALELFGRMVVVGAVPDEVTVISVLAACNQISALRLGATVQSYVVKRGYVVNVVVGTALIGMYANCGSLVCACRVFDEMPEKNLPACTVMVTGFGIHGRGREAISIFYEMLGKGVTPDEGIFTAVLSACSHSGLVDEGKEIFYKMTRDYSVEPRPTHYSCLVDLLGRAGYLDEAYAVIENMKLKPNEDVWTALLSACRLHRNVKLAVISAQKLFELNPDG

SEQ ID NO: 171719 - protein, 508 aa, Glycine max
  Coding DNA Sequence Number=SeqID_54941
  Gene Ontology: Mol. function=actin binding; Cellular component =cytoskeleton; Biological process=cytoskeleton organization and biogenesis
  Homolog annotation: Hit_ID=Q1T1I1; Match level="QueryCoverage=82%, HitCoverage=45%, E-value=0.0, Identity=81%"; Hit description=Villin headpiece; Gelsolin region
  Pfam annotation: Domain name=Gelsolin; Domain location=193-266; Score= 35.0; E_value=2.7e-07; Accession=PF00626.12; Description=Gelsolin repeat
  Pfam annotation: Domain name=Gelsolin; Domain location=306-381; Score= 44.9; E_value=2.7e-10; Accession=PF00626.12; Description=Gelsolin repeat
  Pfam annotation: Domain name=Gelsolin; Domain location=83-166; Score =88.9; E_value=1.5e-23; Accession=PF00626.12; Description=Gelsolin repeat
  Pfam module annotation: Pfam domain module=Gelsolin::Gelsolin::Gelsoli n; Domain location=193-266::306-381::83-166
MATLHALVKFCTVQCKAYAGSKCEDACFFFMHLCIFKVQFAYLFVNNRKYVVADSDVLKNVLLFFSASCAHEFSGLEIWRIENFNPVPVPKSSYGKFFTGDSYVILKTTASKSGALRHDIHYWLGKDTSQDEAGAAAIKTVELDAALGGRAVQYREVQGHETEKFLSYFKPCIIPQEGGVSSGFKHPEAEKHKTRLFVPFARASLNHDDIFVLDTESKIFQFNGSNSSIQERAKALEVVQYIKDTYHEGKCEVAAVEDGKLMADPETGEFWGFFGGFAPLPRKTASDDDKPTDSRPPKLLCVEKGQAEPVETDSLKRELLDTNKCYILDCGFEVFVWLGRNTSLDERKSASGVADEIVSGTDQLKPQIIRVIEGFETVMFRSKFDSWPQTTDVTVSEDGRGKVAALLKRQGVNVKGLLKADPVREEPQPHIDCTGHLQVWHVNGQEKILLQASDQSKFYSGDCFIFQYTYPGEDKEDCLIGTWIGKNSVEGPDNRLDSVILLKMFLKL

SEQ ID NO: 171720 - protein, 62 aa, Glycine max
  Coding DNA Sequence Number=SeqID_54942
MNPSISDQEKRDSSQGRKCIGVIRGRRKFKKNGHMVADDRRQGCWNHRASLNMREEEVGDER

SEQ ID NO: 171721 - protein, 173 aa, Glycine max
  Coding DNA Sequence Number=SeqID_54943
  Homolog annotation: Hit_ID=Q53JG9; Match level="QueryCoverage=45%, HitCoverage=18%, E-value=4e-08, Identity=41%"; Hit description=Zinc finger, C2H2 type, putative
MTRSRSSTTTTITSLCGIIELLEGHPSHNVVEIIFHTSWGPKPFPGRVELIFKVQRASHTLARFEEFRKAMKARATAGLAEGNDDEENTWCIADGNEVVVVVVVMVYDEWAHVTRWAEGCRKGRGRSPMNKGTSLELWRKDRGCSLGEPGTERVKRTHLTESRNEWGPLDEEM

SEQ ID NO: 171722 - protein, 321 aa, Glycine max
  Coding DNA Sequence Number=SeqID_54944
  Gene Ontology: Mol. function=isomerase activity; Cellular component =cytoplasm; Biological process=carbohydrate metabolic process
  Homolog annotation: Hit_ID=Q6Z3M0; Match level="QueryCoverage=99%, HitCoverage=94%, E-value=1e-148, Identity=77%"; Hit description =Putative Aldose 1-epimerase
  Pfam annotation: Domain name=Aldose_epim; Domain location=25-301; Score=302.9; E_value=6.1e-88; Accession=PF01263.10; Description =Aldose 1-epimerase
MSTEKEKTSSPSPSVELCKGFNGLEKVLLRESRGSSAEVYLYGGHVTSWKNDHGEELLFLSNKAIFKPPKAIRGGIPLCFPQFGGLGTLDQHGFARNRFWTIDDDPPPFPTNTLSKAFVDLILKPTEEDTKIWPHSFEFRLRIALGPGGDLMLTSRIRNTNSEGKPFSFTFAYHTYFSVSDISEVRVEGLETLDYLDNLQNKERFTEQGDALTFESEVDKIYLSTPTKIAIIDHEKKRTFVVRKDGLPDAVVWNPWDKKAKAMADFGDDEYKHMLCVEAAAIEKPITLKPGEEWKGRLELSAVPSSYRSGQLDPQRVLLGS

SEQ ID NO: 171723 - protein, 328 aa, Glycine max
  Coding DNA Sequence Number=SeqID_54945
  Gene Ontology: Mol. function=peroxidase activity; Cellular component =vacuole; Biological process=response to oxidative stress
  Homolog annotation: Hit_ID=Q1T1I2; Match level="QueryCoverage=93%, HitCoverage=94%, E-value=1e-147, Identity=83%"; Hit description=Haem peroxidase, plant/fungal/bacterial
  Pfam annotation: Domain name=peroxidase; Domain location=43-292; Score=424.7; E_value=1.3e-124; Accession=PF00141.13; Description =Peroxidase
  Subcellular localization annotation: CTP_CleavageSite=44; ConfidenceScore=5.38e-01
MEDTSFFVILSSFLLLIVSTQTSSAQLTRGFYRNTCPNVEQLVRSAVEQKFQQTFVTAPATLRLFFHDCFVRGCDASILLASPNNKAEKNHPDDISLAGDGFDTVVKAKAAVDSDPQCRNKVSCADILALATRDVINLAGGPFYEVELGRLDGRISTIASVQRQLPHPDFNLDKLNSMFSFHGLTKTDMIALSGAHTIGFSHCNHFSRRIYNFSPQKLIDPTLNLQYAFQLRQACPLRVDSRIAINMDPVTPEKFDNQYFKNLQQGMGLFTSDQVLATDERSRGTVNLFASNEQAFNKAFIEAITKMGRIGVKTGRQGEIRFDCSRVN

SEQ ID NO: 171724 - protein, 99 aa, Glycine max
  Coding DNA Sequence Number=SeqID_54946
MQSIDSVQEDDLTIIGKESYDEIKYLSFGLGVNDERMAEQALTFYKITVLSTCSRRKTTTYECAGVSNDVEIRYFYIVAKERNDVESISYYIGANEKRC

SEQ ID NO: 171725 - protein, 70 aa, Glycine max
  Coding DNA Sequence Number=SeqID_54947
MAIEGFTMRKGERKGVSETPRRGGSVVVCWSGLWAFVGALSATPPRSARVDRALSAHVVGLAHASVRSRA

SEQ ID NO: 171726 - protein, 771 aa, Glycine max
  Coding DNA Sequence Number=SeqID_54948
  Gene Ontology: Mol. function=transmembrane receptor activity; Cellular component=membrane; Biological process=defense response
  Homolog annotation: Hit_ID=Q1SI47; Match level="QueryCoverage=95%, HitCoverage=92%, E-value=0.0, Identity=59%"; Hit description=TIR
  Pfam annotation: Domain name=Arch_ATPase; Domain location=188-379; Score=-92.4; E_value=0.032; Accession=PF01637.9; Description =Archaeal ATPase
  Pfam annotation: Domain name=LRR_1; Domain location=645-666; Score =8.5; E_value=7.3; Accession=PF00560.23; Description=Leucine Rich Repeat
  Pfam annotation: Domain name=LRR_1; Domain location=668-690; Score =9.8; E_value=4.2; Accession=PF00560.23; Description=Leucine Rich Repeat
  Pfam annotation: Domain name=LRR_1; Domain location=692-713; Score =6.4; E_value=18; Accession=PF00560.23; Description=Leucine Rich Repeat
  Pfam annotation: Domain name=LRR_1; Domain location=715-734; Score =4.5; E_value=42; Accession=PF00560.23; Description=Leucine Rich Repeat
  Pfam annotation: Domain name=LRR_1; Domain location=736-757; Score =6.6; E_value=17; Accession=PF00560.23; Description=Leucine Rich Repeat
  Pfam annotation: Domain name=LRR_3; Domain location=622-641; Score =32.9; E_value=1.2e-06; Accession=PF07725.3; Description=Leucine Rich Repeat
  Pfam annotation: Domain name=LRR_3; Domain location=645-665; Score =5.4; E_value=5.3; Accession=PF07725.3; Description=Leucine Rich Repeat
  Pfam annotation: Domain name=NACHT; Domain location=204-353; Score= -4.8; E_value=0.00014; Accession=PF05729.3; Description=NACHT domain
  Pfam annotation: Domain name=NB-ARC; Domain location=167-455; Score =118.0; E_value=2.8e-32; Accession=PF00931.13; Description=NB-ARC domain
  Pfam annotation: Domain name=TIR; Domain location=13-142; Score =174.0; E_value=3.8e-49; Accession=PF01582.10; Description=TIR domain
  Pfam module annotation: Pfam domain module=Arch_ATPase::LRR_1::LRR _1::LRR_1::LRR_1::LRR_1::LRR_3::LRR_3::NACHT::NB-ARC::TIR; Domain location=188-379::645-666::668-690::692-713::715-734::736-757::622 -641::645-665::204-353::167-455::13-142
MSKNNASQTKYDVFVSFRGVDIRRGFLSHLIGTFKSKQINAFVDDKLERGEEIWPSLIEAIQGSSISLIIFSPDYASSRWCLEELVTILECKEKYGQIVIPIFYHIEPTEVRHQRGSYENAFAEHVKKYKSKVQIWRHAMNKSVDLSGIESSKFQDDDELLKEIVKLVLKRLGKHLVNSKGLVGIDKKIADIESLIRKESKDTRLIGIWGMGGIGKTTLPQEVFNKLQSEYQGSYFLANEREQSSKDGIISLKKEIFTELLGHVVKIDTPNSLPNDTIRRMKVLIVLDDVNDSDHLEKLLGTLDHFGAGSRILITTRDEQVLNANKADEIYRLREFNFDKAFELFKLNAFNQSDNQSEYDELSQRVVNYAKGIPLVLKVLARLLRGKNKEVWESELDKLEKMPLREVCDIMKLSYVDLDRKEQQIFLDLACFFLRSQTKITIDYLNSLLKDSESDNSVVVGLERLKDKALITFLENNFISIHDSLQEMACEIVRQESTGDPGSRSRLWDLDDIYEALKNYKGNEAIRSILLHLPTTKKENLSPRLFAKMNRLRFLEVSVEDNYDCLDQLHILGTNLCWPKQQKTRIVDILAKGLKFLATELRFLSWKSYSGKSLPEIFSTEKLVILKLPYSGMEKLWLGVKNLVNLKELDLRCSKKLKELPDISKATNLEVILLRGCSMLTNVHPSIFSLPKLERLNLSDCESLNILTSNSHLRSLSYLDLDFCKNLKKFSVVSKNMKELRLGCTKVKALPSSFGHQSKLKLLHLKGSAIK

SEQ ID NO: 171727 - protein, 180 aa, Glycine max
  Coding DNA Sequence Number=SeqID_54949
  Gene Ontology: Mol. function=2 iron, 2 sulfur cluster binding; Cellular component=chloroplast; Biological process=metabolic process
  Homolog annotation: Hit_ID=Q5Z8I4; Match level="QueryCoverage=91%, HitCoverage=70%, E-value=1e-55, Identity=62%"; Hit description =Putative Nuclear-encoded plastid
  Pfam annotation: Domain name=NifU; Domain location=115-179; Score =13.9; E_value=1.1e-05; Accession=PF01106.8; Description=NifU-like domain
  Pfam annotation: Domain name=NifU; Domain location=34-101; Score =124.6; E_value=2.8e-34; Accession=PF01106.8; Description=NifU-like domain
  Pfam module annotation: Pfam domain module=NifU::NifU; Domain location=115-179::34-101
MKVEFAKCKMGKGEMEVERVVSPRCGLPLTEENVEKVLDEVRPGLMADGGNVALHEIDGLVVVLKLQGACGSCPSSAMTLKMGIETRLRDKIPEILEVEQIMDTETGLELTEENVENVLSEIRPYLVGTGGGILELVQIKDYTVKVRLSGPAAGVTTVRVALTQKLRDKIPAIAAVQLID

SEQ ID NO: 171728 - protein, 255 aa, Glycine max
  Coding DNA Sequence Number=SeqID_54950
  Gene Ontology: Mol. function=triacylglycerol lipase activity; Biological process=lipid metabolic process
  Homolog annotation: Hit_ID=Q9SIN9; Match level="QueryCoverage=98%, HitCoverage=50%, E-value=8e-84, Identity=66%"; Hit description =Putative triacylglycerol lipase
  Pfam annotation: Domain name=Lipase_3; Domain location=3-145; Score =131.1; E_value=3e-36; Accession=PF01764.16; Description=Lipase (class 3)
SLTPAMLDPYNPRPEVKVESGFLSLYTSDESSASNKFGLESCREQLLSEVSRLMNKYKGEKENLSISLAGHSMGSALAILLSYDIAELGLNKKSGTHEVPVTVFSFGGPRVGNSEFKHRCEELGVKVLRIANVNDPITKLPGVVFNENFRVLLGGRYEFPWSCSCYAHVGVELLLDFFNVQNPSCVHDLDSYIGLLRRPNKDEVLMKRERDEDGVNSLLEKARELLFNSQSMKILAGVLTAYNYHDLLNSVSRDI

SEQ ID NO: 171729 - protein, 98 aa, Glycine max
  Coding DNA Sequence Number=SeqID_54951
MKEEVVVFVSYVEEKEEGKNKLLGGMVWVEEKRSKYGRTHTHKKKTTGLENEFLWESDYRESQCAQARTTQRYERVMCTCMANKCWYNCRYLIHKNVS

SEQ ID NO: 171730 - protein, 108 aa, Glycine max
  Coding DNA Sequence Number=SeqID_54952
  Subcellular localization annotation: CTP_CleavageSite=66; ConfidenceScore=5.50e-01
MTSFLSFHFSFFLLPSCLCPSACCLRVCVFPSFSLHPGYSVTPSQQCNSKSKGKVLHAHAWWLRRRCEAKVRVVEMSSACFFRETVTVRVRGGCDNGEVRGHDNVEGS

SEQ ID NO: 171731 - protein, 197 aa, Glycine max
  Coding DNA Sequence Number=SeqID_54953
  Homolog annotation: Hit_ID=Q6K8K1; Match level="QueryCoverage=27%, HitCoverage=40%, E-value=4e-14, Identity=60%"; Hit description=NFkB activating protein-like
  Pfam annotation: Domain name=Got1; Domain location=82-153; Score =11.4; E_value=1.3e-07; Accession=PF04178.3; Description=Got1-like family
MAYEITEIKSKIIRAFLPALQQNACASCDIWSISNLFLTYITHKISKFPDASVICLTPSTNLDELKIYLLWISSISFCNETLSPANVLFEWMPGSASFLLGLFFIFVRWPIVGIILEIYGCVFLFSGFWSSIKVFLYHIPVVGWIIQFISRYNDNFPLCVSVLLVNLHQFPPSSVLSPKGCGTYKGTPTPKLDIHPI

SEQ ID NO: 171732 - protein, 108 aa, Glycine max
  Coding DNA Sequence Number=SeqID_54954
MKILVERRYLGRVLGEKRRGFHAKGKKKKCEMKKARVSPPFILSLQTCTRSGKLPICPGELPTRLGEKIVNQVFCSILLNPYGTPTKHVECAISDQADSEVSSGAQVI

SEQ ID NO: 171733 - protein, 191 aa, Glycine max
  Coding DNA Sequence Number=SeqID_54955
MAPKKLTSKRARKTTAGEGSSTALPVEIEFDGHRFRSEEHQCRFVVIKDWSFLKERREGVMDKHSKVRGQWIPYDIDAINQFLGNSLILEEWQQCEYIARRSRTTGFDEEAIGQLLCFPGCDFFVGIKPPRHPMDPEKSNKASTTIRARLATSANNRCTTITSTSATILGVHLSSLAEDGAPDAHIHASFG

SEQ ID NO: 171734 - protein, 157 aa, Glycine max
  Coding DNA Sequence Number=SeqID_54956
  Gene Ontology: Mol. function=RNA-directed DNA polymerase activity; Biological process=RNA-dependent DNA replication
  Homolog annotation: Hit_ID=Q1SAS4; Match level="QueryCoverage=85%, HitCoverage=8%, E-value=4e-27, Identity=37%"; Hit description=RNase H, putative
MVTLLEVVENRGRIVEREEREIKSHQEETKVVNLGTSEEKKEVKIGTCVSANVQEELVALLRDSQDIFAWPYQDMPSLSSEIMQHRLPLNLECSLMKQKLRRMKPEMSLKIKNRAVARTQSGLPTLCQSPKRMEKCEWYNQIKMAPEDMEKTTFITL

SEQ ID NO: 171735 - protein, 830 aa, Glycine max
  Coding DNA Sequence Number=SeqID_54957
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=55%, HitCoverage=46%, E-value=1e-146, Identity=58%"; Hit description =Pyridoxal-dependent decarboxylase; Actin-binding FH2
  Pfam annotation: Domain name=FH2; Domain location=362-764; Score =454.0; E_value=1.9e-133; Accession=PF02181.13; Description=Formin Homology 2 Domain
MEFTRRSYAVVYVILLCALAQGGSEGKGGKEEEISIDGGGAFSSSIYVHGIKVENELKHCRKELIERNNDVKTSTSPAPVSEKGSSRYLLTKHSGSTLGVESGHGRNLIADSPHNAPSPSATAESPSHGPTPTSSPSSPSQSSPTPSPKGVDLPLPPNMFVPFPPSPRVPHPPPQNFRPIVYAPVPSPPNNENKKKQTIILAAALSGIIILIGLALCYREASRNKGDRDDRPLLVLTSSDYSGGSKKVVRLGDADKEESDIGNGKKPSNFRNWSIKGGHNNGSLVETTASEGVGQVPMPPNGKPAPPPPPPRPPPPPAPKPPPPPAPRAPPPPKGAHPPPAPPKPMGGKNQGPLLAKEGTSSDGDAPKPKLKPFFWDKVNAKPDQSMVWHEIRAGSFVINEEMMESLFGCTNQNKNEPKKNSPHVDTSVHYIQIIDPKKAQNLSILLRALNVTTEEVIDALKEGNEIPVELIQTLLKMAPTTDEELKLRLFTGQLSELGPAERFLKLLVDIPFAFKRLESLMFMFMLKEDFSSIKDSFATLEVACHELRKSRLFLKLLEAVLKTGNRMNDGTYRGGAQAFRLDTLLKLSDVKGTDSKTTLLHFVVQEIIRSEGIRAVRTERASRSISSVGTDSDEGTEESEEHYRSLGLQVISGLSNELGDVKKAALIDGDALSSSVSKLGYSMVKTQEFLDRDMKSIEEESEFQHCMESFMVRAREEVTWLVDEEKRIMALVKSTADYFHGNAGKDEGLRLFLIVRDFLTILDKVCREVSESTVNLAKAASNSAKEATRSSVSSSQNSTTPPVDLHRRLFPAIAERRVDYSSSDEDEEF

SEQ ID NO: 171736 - protein, 517 aa, Glycine max
  Coding DNA Sequence Number=SeqID_54958
  Gene Ontology: Mol. function=transmembrane receptor activity; Cellular component=membrane; Biological process=defense response
  Homolog annotation: Hit_ID=Q1SI47; Match level="QueryCoverage=98%, HitCoverage=65%, E-value=1e-128, Identity=51%"; Hit description=TIR
  Pfam annotation: Domain name=LRR_3; Domain location=458-477; Score =20.3; E_value=0.007; Accession=PF07725.3; Description=Leucine Rich Repeat
  Pfam annotation: Domain name=NACHT; Domain location=56-211; Score= -16.1; E_value=0.001; Accession=PF05729.3; Description=NACHT domain
  Pfam annotation: Domain name=NB-ARC; Domain location=18-315; Score =113.7; E_value=5.4e-31; Accession=PF00931.13; Description=NB-ARC domain
  Pfam module annotation: Pfam domain module=LRR_3::NACHT::NB-ARC; Domain location=458-477::56-211::18-315
MKHFAAQNDAAVLNEIVDLVLKRLVKPHVISKGLVGIEEKITTVESWIRKEPKDNLLIGIWGMGGIGKTTLAEEIFNKLQYEYEGCYFLANEREESKNHGIISLKKRIFSGLLRLRYDDVEIYTENSLPDNILRRIGHMKVLIVLDDVSDSDHLGKLLGTLDNFGSGSRILVTTRDEQVLKAKKVKKTYHLTELSFDKTLELFNLNAFNQSDRQKEYYELSLRVVNYAKGIPLVVKVLAGLLHGKNKEEWESLLDKLKKIPPTKVYEVMKLSYDGLDRKEQQIFLDLACFFLRSNIMVNTCELKSLLKDTESDNSVFYALERLKDKALITISEDNYVSMHDSLQEMAWEIIRRESSIAGSHSRLWDSDDIAEALKNGKNTEDIRSLQIDMRNLKKQKLSHDIFTNMSKLQFLKISGKYNDDLLNILAEGLQFLETELRFLYWDYYPLKSLPENFIARRLVILEFPFGRMKKLWDGVQNLVNLKKVDLTSSNKLEELPDLSGATNLEELKLGGCSMLT

SEQ ID NO: 171737 - protein, 376 aa, Glycine max
  Coding DNA Sequence Number=SeqID_54959
  Gene Ontology: Mol. function=transmembrane receptor activity; Cellular component=membrane; Biological process=defense response
  Homolog annotation: Hit_ID=Q1SI46; Match level="QueryCoverage=66%, HitCoverage=20%, E-value=1e-51, Identity=47%"; Hit description =Leucine Rich Repeat, putative
MFLEILDAECCTSLQTLPELPRFLKTLNIRECKSLLTLPVLPLFLKTLDASECISLKTVLLSPSTAVEQLKENSKRILFWNCLNLNIYSLAAIGQNAQTNVMKFAGQHLSTPNHHHVENYSDYKDNYGSYQAVYAYPASNVPPWLEYKTRNDYIIIDLSSAPPSPLLGFIFGFVFGESTDMNERREVNITISDVKGKGKRETNRVRMYIDYGIGKIISDQVCVIYDQRCSDFLKRRAENQTSFIIQVTIQAQWAVDPVTDQCFNFIKLMESGCASYHPRLVQNDHFVSLKLMSLTIFKYQRLKATKKMKNKAKNCCSSFSLSPSLELVISPQRPKLPGIKSLLINSLVPILPASNPSSSTPSPTCRTLDWKNVTKH

SEQ ID NO: 171738 - protein, 78 aa, Glycine max
  Coding DNA Sequence Number=SeqID_54960
MKVRDHHSSLNLSQKNDDLGLIHRWIVVKFKHQYLWREKKESHEDSTSGGFNLFSVSLTFENSIGAIGGITEGISGNR

SEQ ID NO: 171739 - protein, 57 aa, Glycine max
  Coding DNA Sequence Number=SeqID_54961
MEMQRKIKEKCRSSPILLVSSIQYPWGVGLHHPFPLGKDLTSNPEVLDTLGFFPQHL

SEQ ID NO: 171740 - protein, 35 aa, Glycine max
  Coding DNA Sequence Number=SeqID_54962
MEHESQREKSHSAKKSTCDEFIPCTPVEPKGSKRA

SEQ ID NO: 171741 - protein, 111 aa, Glycine max
  Coding DNA Sequence Number=SeqID_54963
MFQILLKGDVILKFQSRQCDRGSTKRILLRLKHPSRRDGSTASNSGSWWPLVVMGGGGGGVTTWVGVWREKRVKNRVFHTEGHIYNLQILLNELISLSESPLLVLSMTFHA

SEQ ID NO: 171742 - protein, 233 aa, Glycine max
  Coding DNA Sequence Number=SeqID_54964
  Gene Ontology: Mol. function=diacylglycerol kinase activity; Cellular component=cytoplasm; Biological process=protein kinase C activation
  Homolog annotation: Hit_ID=Q1SSQ3; Match level="QueryCoverage=97%, HitCoverage=47%, E-value=2e-88, Identity=69%"; Hit description =Diacylglycerol kinase accessory region; Diacylglycerol kinase, catalytic region
  Pfam annotation: Domain name=DAGK_cat; Domain location=83-229; Score =99.6; E_value=9.2e-27; Accession=PF00781.14; Description =Diacylglycerol kinase catalytic domain
MDPPSSSTMVPIKSSSSIVESLRGCGISGGTRVDKEELRKKLTMPKYLRFAMRDSIRFKDPAAGESRCIHSKDDHNAVAPSTPMVVFINPRSGGRHGPFLKERLQHLMSEEQVLDMLDVKPHEFLRYGLGCLEMLASLGDYCAKETRERIRIMVAGGDGSVGWVLGCLTELHAQGREPIPPVGIVPLGTGNDLSRSLGWGGSFPFSWKTAIKRSLYKASIGPICHLDRLRVKS

SEQ ID NO: 171743 - protein, 109 aa, Glycine max
  Coding DNA Sequence Number=SeqID_54965
  Homolog annotation: Hit_ID=Q6K8Z4; Match level="QueryCoverage=35%, HitCoverage=2%, E-value=7e-07, Identity=71%"; Hit description =Diaphanous homologue-like
MTAEWRRKRERRRHFKEKMSLEKAHHHRRSWIRAWRKKEMNEGRGREEHEILWSKRALKSEIQLKALAEEMQAVSKGLEKVEQELAASENDGGYGTTERSEFILTEVNG

SEQ ID NO: 171744 - protein, 69 aa, Glycine max
  Coding DNA Sequence Number=SeqID_54966
MTSASGPITFKNCFHINTSGSGIMGMTVARIAAEIYGNLSKINDGLVKPDMSPEIYGPYRSPCFSKNFD

SEQ ID NO: 171745 - protein, 76 aa, Glycine max
  Coding DNA Sequence Number=SeqID_54967
MWDRHRLKGALKSGVFTPKTYTPKSPSGPLPPDSGFQNIREKEKGLKPPFHDPTCDASFSVHRKFFINPNGEGVRN

SEQ ID NO: 171746 - protein, 744 aa, Glycine max
  Coding DNA Sequence Number=SeqID_54968
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=O22613; Match level="QueryCoverage=99%, HitCoverage=77%, E-value=0.0, Identity=84%"; Hit description=Plasma membrane proton ATPase
  Pfam annotation: Domain name=Cation_ATPase_N; Domain location=11-92; Score=115.1; E_value=2.1e-31; Accession=PF00690.16; Description =Cation transporterATPase, N-terminus
  Pfam annotation: Domain name=E1-E2_ATPase; Domain location=104-325; Score=304.8; E_value=1.6e-88; Accession=PF00122.10; Description=E1 -E2 ATPase
  Pfam annotation: Domain name=Hydrolase; Domain location=329-615; Score=73.5; E_value=6.6e-19; Accession=PF00702.16; Description =haloacid dehalogenase-like hydrolase
  Pfam module annotation: Pfam domain module=Cation_ATPase_N::E1-E2 _ATPase::Hydrolase; Domain location=11-92::104-325::329-615
MAGDKGTITLEEIKNETVDLERIPIDEVFEQLKCTREGLSSTEGENRLQIFGPNKLEEKKESKFLKFLGFMWNPLSWVMEAAAIMAIALANGEGKPPDWQDFVGIVCLLLINSTISFIEENNAGNAAAALMAGLAPKTKVLRDGKWSEQEAAILVPGDIISIKLGDIIPADARLLEGDPLMVDQAALTGESLPVTKHPGQEVFSGSTCKQGEIEAVVIATGVHTFFGKAAHLVDSTNQVGHFQKVLTAIGNFCICSIAIGMLAEIIVMYPIQHRKYREGIDNLLVLLIGGIPIAMPTVLSVTMAIGSHKLSQQGAITKRMTAIEEMAGMDVLCSDKTGTLTLNKLTVDKNLVEVFAKGVDKDHVILLAARAARTENQDAIDAAIVGMLADPKEARAGIREVHFLPFNPVDKRTALTYIDANGNWHRASKGAPEQIMSLCNLRDDAKKKVHAIIDKFAERGLRSLAVARQEVPEKTKESAGAPWQFVGLLSLFDPPRHDSAETIRRALNLGVNVKMITGDQLAIAKETGRRLGMGTNMYPSASLLGQDKDASIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLNEIFATGVVLGGYLALMTVIFFWAIKETTFFP

SEQ ID NO: 171747 - protein, 124 aa, Glycine max
  Coding DNA Sequence Number=SeqID_54969
MGCYDFSLREKRASLFGTVATTIATAYDGTLIMHEPFVFTSNYGGDSRLEALRKNVHNPNAVMLARKAQQLALAISKSNLLNVLVIDSDVIGSSVTLDVVSHPWVLSCACVISIFGSLFCISVD

SEQ ID NO: 171748 - protein, 112 aa, Glycine max
  Coding DNA Sequence Number=SeqID_54970
  Gene Ontology: Mol. function=ATP binding
  Homolog annotation: Hit_ID=Q1SF03; Match level="QueryCoverage=66%, HitCoverage=21%, E-value=6e-11, Identity=48%"; Hit description=Heat shock protein Hsp70
MEAFLLLLTILFYAIVIHFLNRHVYMMRTALMKNEISSKLCSQEKEKISFAISMATNLLDGNNQQQEGEVFEDYLKELVSLFKNTICKISYLFVILIKDKIFCDANMSSCTW

SEQ ID NO: 171749 - protein, 105 aa, Glycine max
  Coding DNA Sequence Number=SeqID_54971
MAMKATGGERFSIEAVQNEVIVVEGSGQVVGRESIGGWFYGKIGHHARGLLICRSGTSSGEKLAWIGRNRPSRNFCNCLNQVAPKRNYADLWIWRSCAVGTYTMK

SEQ ID NO: 171750 - protein, 255 aa, Glycine max
  Coding DNA Sequence Number=SeqID_54972
  Gene Ontology: Mol. function=small conjugating protein ligase activity; Cellular component=synaptonemal complex; Biological process=protein modification process
  Homolog annotation: Hit_ID=Q70I24; Match level="QueryCoverage=66%, HitCoverage=100%, E-value=7e-83, Identity=91%"; Hit description=SUMO E2 conjugating enzyme SCE1
  Pfam annotation: Domain name=UQ_con; Domain location=118-248; Score =151.5; E_value=2.2e-42; Accession=PF00179.16; Description=Ubiquitin -conjugating enzyme
MLGKRMGQWGSVGPENLRDGIRTVRFDGSKAAAIQKAAFALLARTHNHNTTRQSEEKGQKRKKRLSNSDGSTELTRREWKVLLRNVWWYRSWTPHRGAQVVAEEPSPWFCCEAGDAARWNREFDGVALHYSREDWEFSASKALAPETDWEGGYFPLTLHFSEDYPSKPPKCKFPQGFFHPNVYPSGTVCLSILNEDSGWRPAITVKQILVGIQDLLDQPNPADPAQTEGYHLFIQDAAEYKRRVRQQAKQYPPLL

SEQ ID NO: 171751 - protein, 63 aa, Glycine max
  Coding DNA Sequence Number=SeqID_54973
MMIANLVHGNRMTAVGCRNDEAGRYINDGGDGGDNIGSGSGGDDIGSGSGGDDSSYGGCARIL

SEQ ID NO: 171752 - protein, 562 aa, Glycine max
  Coding DNA Sequence Number=SeqID_54974
  Gene Ontology: Mol. function=signal transducer activity; Cellular component=membrane; Biological process=response to light stimulus
  Homolog annotation: Hit_ID=Q7XIJ3; Match level="QueryCoverage=80%, HitCoverage=100%, E-value=4e-89, Identity=40%"; Hit description =Putative phototropic response protein family
  Pfam annotation: Domain name=NPH3; Domain location=212-438; Score =164.7; E_value=2.4e-46; Accession=PF03000.5; Description=NPH3 family
MEACCCNLEVDVNGEETFMVDKDLISILQHTIICRYYVEHGSRETVITQYSNKFARLFGKSSGATGKLKVIFHDFPGGAEGFELMLKFSYNNGTADISPSNLFLACCAAEYMEMKEPVADVSNLLEQTEKSLQEISYWTWSDLLIGLKQCQSLLVPDSSVMVERCLDTIVGRLVLASEASPCPSTSSTDSSWVRYSCDSKSTESVKTSFSRLTWWFEDLLFLSPLLVAMLVKLMLSRKMDHVVISKFLLYYQKAKFSTATTHEKCKIIEMVIDMHYDMDLSCVPCKTLFGILRVTLGLNISKCSRNKLETMIGSQLDHATLDNLLVPSPYGISYLYDVNLILRFLKAFLRRGNGLVTPIRKVASLIDLYIAEIAPDPCLKTSKFLALATAIPDSARDSYDELYHAMDMYLEVHTQLSQEERLKICCGLNFEKLSPQACLHLSQNKKFPSKFAVQALISQQSKLKNLLHMTPSTSSYNDSPCNSSGAAQKGKKNKTSEQVVLYSSNFDISTDNEKLEAHLQGMQWRVMELEKFCRKMQIQMAKITKSKASGHSYAKSLPKLCS

SEQ ID NO: 171753 - protein, 113 aa, Glycine max
  Coding DNA Sequence Number=SeqID_54975
  Gene Ontology: Mol. function=nucleic acid binding
  Homolog annotation: Hit_ID=Q1S784; Match level="QueryCoverage=82%, HitCoverage=28%, E-value=8e-10, Identity=38%"; Hit description=Zinc finger, CCHC-type
MGEDNLEALLAQQKYAIEKAGFGYTRNKKPKTYKNVFNFTKASSSPFTVFIAAKRQLWYLDSDCSRHMTGDKSKFVSLKAKEEGFVTYEENNQGMAKTLLIKHKPWKCLNTTY

SEQ ID NO: 171754 - protein, 153 aa, Glycine max
  Coding DNA Sequence Number=SeqID_54976
  Gene Ontology: Mol. function=diacylglycerol kinase activity; Biological process=protein kinase C activation
  Homolog annotation: Hit_ID=Q1SSQ3; Match level="QueryCoverage=94%, HitCoverage=30%, E-value=4e-65, Identity=77%"; Hit description =Diacylglycerol kinase accessory region; Diacylglycerol kinase, catalytic region
  Pfam annotation: Domain name=DAGK_acc; Domain location=5-125; Score= -39.2; E_value=0.00046; Accession=PF00609.10; Description =Diacylglycerol kinase accessory domain
MKKSCDRGLKNILRMHVKKINCSEWEQVLVPTSVRAIVALNLHSYGSGRNPWGNLTPEYLEKRGFIEAQFDDGLLEIFGLKQGWHATFVMSELISAKHIAQATAIRLEVRGGEWKDAFMQMDGEPWKQPMSKDFSTFVEIKREPFQSIMINGE

SEQ ID NO: 171755 - protein, 122 aa, Glycine max
  Coding DNA Sequence Number=SeqID_54977
  Gene Ontology: Mol. function=lipoxygenase activity; Cellular component=cytoplasm; Biological process=electron transport
  Homolog annotation: Hit_ID=Q1SBD0; Match level="QueryCoverage=81%, HitCoverage=11%, E-value=1e-33, Identity=68%"; Hit description=Plant lipoxygenase; Lipase/lipooxygenase, PLAT/LH2
MTLMTETLLLADRGGRLTTTFLDMSLDIYVSRDERFGHLKLSNFLANALKSIAQVVKPKLELLFDNTPEDFDSFEDVFKLYEDEIKVPESILKNIRDKIPVEMLKEILQADGERSLKFPIPK

SEQ ID NO: 171756 - protein, 108 aa, Glycine max
  Coding DNA Sequence Number=SeqID_54978
  Subcellular localization annotation: CTP_CleavageSite=41; ConfidenceScore=5.51e-01
MSPRERVCTTANCSQLQTSGSGAPSLTPSSFKQRHFQVRTRCRRIGNEENPNFVFGYKRGKMKLIVLPTVTCITSQAMSPDTYVENKHLVVIVTTTILTMKMMKISDN

SEQ ID NO: 171757 - protein, 76 aa, Glycine max
  Coding DNA Sequence Number=SeqID_54979
MGSEPKVGCFELTDLLKFFVLSREGGTIVRVRLAYWGKGYPPLPQASAMATEEEEEEEERFMMGSGCEHKDEIESN

SEQ ID NO: 171758 - protein, 573 aa, Glycine max
  Coding DNA Sequence Number=SeqID_54980
  Gene Ontology: Mol. function=DNA binding; Cellular component=beta -galactosidase complex; Biological process=DNA integration
  Homolog annotation: Hit_ID=Q1SDN3; Match level="QueryCoverage=57%, HitCoverage=31%, E-value=1e-103, Identity=49%"; Hit description =Polynucleotidyl transferase, Ribonuclease H fold
  Pfam annotation: Domain name=rve; Domain location=20-169; Score=0.6; E_value=0.0053; Accession=PF00665.16; Description=Integrase core domain
  Pfam module annotation: Pfam domain module=RVT_2::rve; Domain location=229-429::20-169
MVEGLYRLKMIPIKSKYKSNFTGSSISNFLPFHGPCNVTSLNGYKYFLTIIDDYSRFVWVFLIQSKVETQSHLESFVANVERQFETKVKVIRSDNRAEFIMRQFYDDTANRKKLDPRAATSVFLGFKPNTKGFIMFDLKTKVIFVSRNVIFYEDYFPFIGQDKPDAVIVLPIPSSHAIDQPDGVLSELPVDIIMPVPNNVDSDPLTLEQSYNTTRRYLRQTHRPSKYKDFHVSYPSSTIASYSTDGSVERHKARLVAKGYTQVEGQDYLDTFSPVVKLITVYMMLPQGMQVAKPGQVCKLQRSLYGLKQASRQWYAMLSSFLISHGYKQCASDHSLFLKHGFNTVTALLVYVDDIVLSGNGLIEIQANTQLLDNVFKIKDLGDLRYFLGFEVARKPIGINLCHRKYALDILSDAGMLGSKPVSTPSDYATKLHQQSGTSLSLEDASSFRRYIKGSPGAASKIHLKGFIDSNWTGCIDTRRFITGYAMYIGDSLISWKYKKQAAVSRSSSEAEYRALASAIGEIQWLTYQLEEFRVDFQQHVTLYCDNKSALHIASNPIFHERTKHIEIDCHIV

SEQ ID NO: 171759 - protein, 49 aa, Glycine max
  Coding DNA Sequence Number=SeqID_54981
MVRGVLDYSRGGLAKSKKCLAIVGGPKGVRPWLRGIWPWLRGVIHSQEA

SEQ ID NO: 171760 - protein, 124 aa, Glycine max
  Coding DNA Sequence Number=SeqID_54982
  Homolog annotation: Hit_ID=O48786; Match level="QueryCoverage=46%, HitCoverage=11%, E-value=4e-27, Identity=94%"; Hit description =Putative cytochrome P450
MEVTQSLQKETSSSSSSSSSSSMAPKSANFNDDEEDLMVEGKDSGENVVGERHGLRRGLQHHANKFLNVSNEETIRGASDSLLGEMGFNFSGSPPEEDGELEEEEKEHEGEREKLEGGEDVLHI

SEQ ID NO: 171761 - protein, 461 aa, Glycine max
  Coding DNA Sequence Number=SeqID_54983
  Gene Ontology: Mol. function=binding; Cellular component =mitochondrion; Biological process=protein amino acid phosphorylation
  Homolog annotation: Hit_ID=O64624; Match level="QueryCoverage=87%, HitCoverage=79%, E-value=1e-146, Identity=32%"; Hit description =Putative salt-inducible protein
  Pfam annotation: Domain name=PPR; Domain location=11-45; Score=27.3; E_value=5.3e-05; Accession=PF01535.11; Description=PPR repeat
  Pfam annotation: Domain name=PPR; Domain location=116-150; Score =12.7; E_value=0.23; Accession=PF01535.11; Description=PPR repeat
  Pfam annotation: Domain name=PPR; Domain location=151-185; Score=3.3; E_value=3; Accession=PF01535.11; Description=PPR repeat
  Pfam annotation: Domain name=PPR; Domain location=186-220; Score =26.1; E_value=0.00012; Accession=PF01535.11; Description=PPR repeat
  Pfam annotation: Domain name=PPR; Domain location=221-255; Score =26.7; E_value=8.2e-05; Accession=PF01535.11; Description=PPR repeat
  Pfam annotation: Domain name=PPR; Domain location=256-290; Score =50.2; E_value=7.1e-12; Accession=PF01535.11; Description=PPR repeat
  Pfam annotation: Domain name=PPR; Domain location=291-325; Score =35.4; E_value=2e-07; Accession=PF01535.11; Description=PPR repeat
  Pfam annotation: Domain name=PPR; Domain location=326-360; Score =35.2; E_value=2.2e-07; Accession=PF01535.11; Description=PPR repeat
  Pfam annotation: Domain name=PPR; Domain location=46-80; Score=31.6; E_value=2.8e-06; Accession=PF01535.11; Description=PPR repeat
  Pfam annotation: Domain name=PPR; Domain location=81-115; Score=43.4; E_value=7.8e-10; Accession=PF01535.11; Description=PPR repeat
  Pfam module annotation: Pfam domain module=PPR::PPR::PPR::PPR::PPR::PP R::PPR::PPR::PPR::PPR; Domain location=11-45::116-150::151-185::186 -220::221-255::256-290::291-325::326-360::46-80::81-115
MKLNGCAPNRATWNTMLAVCSEEVKHNYVNKVLREMKNCGFEPDKDTFNTLISSYARCGSEVDSAKMYGEMVKSGFTPCVTTYNALLNALAHRGDWKAAESVIQDMQTKGFKPNETSYSLLLHCYSKAGNVRGIEKVEKEIYDGQVFPSWILLRTLVLSNHKCRHLRGMERAFDQLQKYGYKPDLVVINSMLSMFSRNKMFSKAREMLHFIHECGLQPNLFTYNCLMDLYVREDECWKAEEVLKGIQNSVPEPDVVSYNTVIKGFCRKGLMQEAIRVLSEMTTKGIQPTIVTYNTFLSGYAGMELFDEANEVIRFMIEHNCRPSELTYKILVDGYCKAGKHEEAMDFVTKIKEIDISFDDKSVKRLGSCIREKVGSTLTCLIESMQAFGPLFKAFTSYTCFILLPAPPLHKNTLTFSNDTPMPEKLHYMFAPLLMPHPKAMAKKCLKQEDRKTKPSTSHLE

SEQ ID NO: 171762 - protein, 432 aa, Glycine max
  Coding DNA Sequence Number=SeqID_54984
  Gene Ontology: Mol. function=monooxygenase activity; Cellular component=membrane; Biological process=electron transport
  Homolog annotation: Hit_ID=Q1RVL3; Match level="QueryCoverage=95%, HitCoverage=96%, E-value=0.0, Identity=86%"; Hit description=E-class P450, group I
  Pfam annotation: Domain name=p450; Domain location=1-424; Score =212.5; E_value=9.6e-61; Accession=PF00067.12; Description=Cytochrome P450
MLLYMFGATFLVWFGPTVRLTVSEPELIREIFTSKSEFYEKNEAPPLVKQLEGDGLLSLKGEKWAHHRKIISPTFHMENLKLLIPVMATSVVEMLEKWSAMGVKGEVEIEVSEWFQTLTEDVITRTAFGSSYEDGKAIFRLQAQQMDLAADAFQKVFIPRVYRFFPTRRNIKSWKLEKEIKKSLVKLIWRRRECGGVEEKGPKDLLGLMIQASNMNSSSNVTVDDIVEECKSFFFAGKQTTSNLLTWTTILLAMHPHWQVRARDELLKLCGSRDLPTKDHVAKLRTLSMIVNESLRLYPPTIATIRRAKADVDLGGYKIPRGTELLIPILAVHHDQAIWGNDVNEFNPGRFSDGVARAGKHPLAFIPFGLGVRTCIGQNLAVLQTKLALAIILQRFSFRLAPSYQHAPTVLMLLYPQYGAPIIFQQFSQSSS

SEQ ID NO: 171763 - protein, 121 aa, Glycine max
  Coding DNA Sequence Number=SeqID_54985
  Gene Ontology: Mol. function=signal transducer activity; Cellular component=nucleus; Biological process=regulation of transcription, DNA-dependent
  Homolog annotation: Hit_ID=Q6UEI5; Match level="QueryCoverage=62%, HitCoverage=11%, E-value=1e-23, Identity=72%"; Hit description =ZEITLUPE
MEWDSNSDLSDDEAVSFMLNDDDDDAVGPLPFPVLQTAPCGFVVTDAVEPDHPIIYVNAVFEMVTGYRAEEVLGRNWDLDFFWDFCCLCVERCVSRFYAGELVRVSRDWGNSLNRFGNPIL

SEQ ID NO: 171764 - protein, 175 aa, Glycine max
  Coding DNA Sequence Number=SeqID_54986
  Gene Ontology: Mol. function=RNA binding
  Homolog annotation: Hit_ID=Q6F393; Match level="QueryCoverage=77%, HitCoverage=48%, E-value=5e-21, Identity=43%"; Hit description =Expressed protein
  Pfam annotation: Domain name=ENT; Domain location=111-171; Score =24.4; E_value=0.0004; Accession=PF03735.5; Description=ENT domain
MKADVTEQELEIHPHHSNRKTGISNMIDMERRKETGTVGCSFGENRESNHADSITCSVGSCSITSRNSCKLQFPVSAGPFDDVDSSFSDAESVCQRSDEEGDCSPPTQEELAAEIHRLELHAYRCTIEALHASGPLSWEQEALMTNLRLSLHISNDEHLMELRNLISSENSIPLR

SEQ ID NO: 171765 - protein, 64 aa, Glycine max
  Coding DNA Sequence Number=SeqID_54987
MTPDDRLRRVCKNNRLEKAADVLLKTRAIVKLKSGLSEDSSGCQELKIKYHLSEVQLALKRGMS

SEQ ID NO: 171766 - protein, 513 aa, Glycine max
  Coding DNA Sequence Number=SeqID_54988
  Gene Ontology: Mol. function=scavenger receptor activity; Cellular component=membrane; Biological process=regulation of transcription, DNA-dependent
  Homolog annotation: Hit_ID=Q2PQA6; Match level="QueryCoverage=96%, HitCoverage=81%, E-value=0.0, Identity=66%"; Hit description=ZTL
  Pfam annotation: Domain name=F-box; Domain location=96-144; Score =27.7; E_value=4.2e-05; Accession=PF00646.23; Description=F-box domain
  Pfam annotation: Domain name=Kelch_1; Domain location=193-243; Score =23.3; E_value=0.00087; Accession=PF01344.15; Description=Kelch motif
  Pfam annotation: Domain name=Kelch_1; Domain location=246-293; Score =16.0; E_value=0.06; Accession=PF01344.15; Description=Kelch motif
  Pfam annotation: Domain name=Kelch_1; Domain location=298-346; Score =5.0; E_value=1; Accession=PF01344.15; Description=Kelch motif
  Pfam annotation: Domain name=Kelch_1; Domain location=351-402; Score =3.0; E_value=1.7; Accession=PF01344.15; Description=Kelch motif
  Pfam annotation: Domain name=Kelch_1; Domain location=420-468; Score =10.6; E_value=0.24; Accession=PF01344.15; Description=Kelch motif
  Pfam annotation: Domain name=Kelch_2; Domain location=193-241; Score =14.0; E_value=0.55; Accession=PF07646.5; Description=Kelch motif
  Pfam annotation: Domain name=Kelch_2; Domain location=246-293; Score =29.5; E_value=1.2e-05; Accession=PF07646.5; Description=Kelch motif
  Pfam annotation: Domain name=Kelch_2; Domain location=297-343; Score =12.4; E_value=0.88; Accession=PF07646.5; Description=Kelch motif
  Pfam annotation: Domain name=Kelch_2; Domain location=351-402; Score =38.5; E_value=2.3e-08; Accession=PF07646.5; Description=Kelch motif
  Pfam annotation: Domain name=Kelch_2; Domain location=420-468; Score =33.1; E_value=9.6e-07; Accession=PF07646.5; Description=Kelch motif
  Pfam module annotation: Pfam domain module=F-box::Kelch_1::Kelch _1::Kelch_1::Kelch_1::Kelch_1::Kelch_2::Kelch_2::Kelch_2::Kelch _2::Kelch_2; Domain location=96-144::193-243::246-293::298-346::351 -402::420-468::193-241::...
  Pfam module annotation: Domain location=246-293::297-343::351 -402::420-468
IRRCLDEGVEFQGELLNFRKDGSPLMNRLRLTPIYGEDEITHVIGIQFFTEANIDLGPLPGSTIKESTKSSDRFHSVLSSLNPVPVGDRNVTRGICGIFQLSDEVLSLKILARLTPRDIASVGSVCRHLYELTKNEDLWRMVCQNAWGSETTRVLETVPGARRLGWGRLARELTTLEAAAWRKLTVGGAVEPSRCNFSACAVGNRVVLFGGEGVNMQPMNDTFVLDLNSSNPEWQHVQVSSPPPGRWGHTLSCVNGSRLVVFGGCGTQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGALRFRSSDVFTMDLSEEEPCWRCVTGSGLPGLPGTGNPGGIAPPPRLDHVAVSLPGGRILIFGGSVAGLHSASQLYILDPTDEKPTWRILNVPGRPPRFAWGHSTCVVGGTRAIVMGGQTGEEWMLSELHELSLASSVS

SEQ ID NO: 171767 - protein, 105 aa, Glycine max
  Coding DNA Sequence Number=SeqID_54989
MDTCYHKLGFQFGSIYKGSDSYQTMRGNEEEDCRNKFSNKAMKFTWVIGLKVKSWVAYEEKATTSHKWKYLDQDFGPTNDLHQKFKWLAILNKRVIGWGKEKERL

SEQ ID NO: 171768 - protein, 517 aa, Glycine max
  Coding DNA Sequence Number=SeqID_54990
  Gene Ontology: Mol. function=magnesium ion binding; Cellular component=chloroplast; Biological process=metabolic process
  Homolog annotation: Hit_ID=Q672F7; Match level="QueryCoverage=78%, HitCoverage=71%, E-value=1e-171, Identity=71%"; Hit description=E -beta-ocimene synthase
  Pfam annotation: Domain name=Acid_phosphat_B; Domain location=389 -517; Score=-58.5; E_value=0.001; Accession=PF03767.5; Description =HAD superfamily, subfamily IIIB (Acid
  Pfam annotation: Domain name=Terpene_synth; Domain location=1-97; Score=-11.3; E_value=1.7e-06; Accession=PF01397.11; Description =Terpene synthase, N-terminal domain
  Pfam annotation: Domain name=Terpene_synth_C; Domain location=101 -345; Score=320.2; E_value=3.6e-93; Accession=PF03936.6; Description =Terpene synthase family, metal binding domain
  Pfam module annotation: Pfam domain module=Acid_phosphat_B::Terpene _synth::Terpene_synth_C; Domain location=389-517::1-97::101-345
VFERFEDNNGNFKASLSRDMKGMLSLYEASFLSYEEELILDKTKAFSSFHLRGALKEGRSNSMLLEQVNHALELPLHHRIQRLEARWYIESYAKRKDANWVLLEAAKLDFNIVQSTLQKDLQEMSSMGMAFEPQFSDLRKGLTKVTSLITTIDDVYDVYGSLDELELFTKAVESWDIKAVQVMPEYMKICFLALYNTVNEFAYDALKIKGQNILPHLTKAWSVMLKAFLQEAKWCRDKYLPPFEDYLNNAWVSVSGVVILTHAYFLLNDNITKDALDSLDNYHDLLRRPSIIFRLCNDLGTSRAELQRGEAASSIVCNMRESCVTEEGAYKNIHSLLDETWKKMNKDRAMHSPFSKPFVEAAINLARISHCTYLNGDGHGAPDIAAKNRIRSLIIEPIPLREINADIVHPTPSSIEAPSLVLPLKLLPLLPLKLLHLFDFIAPTSPLELEVFDHEKFNNWVEKGVAPAIEPSLKLYEDVLNLGFKVILLTGWSERHRSVTVDNLINVGFKEWDQLIL

SEQ ID NO: 171769 - protein, 167 aa, Glycine max
  Coding DNA Sequence Number=SeqID_54991
  Gene Ontology: Mol. function=magnesium ion binding; Cellular component=chloroplast; Biological process=metabolic process
  Homolog annotation: Hit_ID=Q672F7; Match level="QueryCoverage=97%, HitCoverage=27%, E-value=4e-45, Identity=62%"; Hit description=E -beta-ocimene synthase
  Pfam annotation: Domain name=Terpene_synth; Domain location=65-165; Score=-69.9; E_value=0.012; Accession=PF01397.11; Description =Terpene synthase, N-terminal domain
  Subcellular localization annotation: CTP_CleavageSite=53; ConfidenceScore=5.52e-01
MALDSSSMLLNFSFTPPLVSFSKHQKQRGINLLVRRIGSTSQYYCLATSTNVRERKSANYQPNLWNYDFLQSLKNDYADVKYEIMARKLEEVRRMIKDENSEIWVTLDLIDNVKRLGLSYHFDKEIREALHRFLSLERCSATNIHTGLHETALSFRLLREYGDDVSA

SEQ ID NO: 171770 - protein, 231 aa, Glycine max
  Coding DNA Sequence Number=SeqID_54992
  Gene Ontology: Mol. function=RNA-directed DNA polymerase activity; Biological process=RNA-dependent DNA replication
MEQPNIDRLNIEGEVDMEFNILEYEENAIDMSLCLMGDFLANRSIWVPMKERMVEVWRHIGEITIDELQPNHFLFLFYHKRSDENLKSIPLYMLAFWVQIHNLPLGFMTQVIGQNLGNFIVNFLEYDEKNNLNFLPPFICIQVLIDVGKALNKSKRIKRKEGEATKVSFKYEHLRPFCYLCELMRHVNEIYDKHLKMVVDDKIKNWGPKQRAKLRKLVDNGGSWWLHEEGD

SEQ ID NO: 171771 - protein, 145 aa, Glycine max
  Coding DNA Sequence Number=SeqID_54993
  Gene Ontology: Mol. function=RNA-directed DNA polymerase activity; Biological process=RNA-dependent DNA replication
  Subcellular localization annotation: CTP_CleavageSite=46; ConfidenceScore=5.46e-01
MAPVPFLKSLNTAPKTQTRRLSNFGANIVGKLKHAGVNWKMSRNLTTMMSVSLSNIPYKIISKVIANRLKPLWPKIISEEQPTFVEDCSIMDNVLLALEVIHHMRSKSMGKIGEISLKVDISKVFDIIDWNYLLNLSRKMDFHEK

SEQ ID NO: 171772 - protein, 75 aa, Glycine max
  Coding DNA Sequence Number=SeqID_54994
MERFGNWSIHSTIVRPLSSILVTFHWKTNEVTIKKSMMKALHKPIRMNNKASHVIAGKKVAKVSNDKPRKKSVLS

SEQ ID NO: 171773 - protein, 69 aa, Glycine max
  Coding DNA Sequence Number=SeqID_54995
MSGPHSQFFVINHHGEQFSIEVVGQRRGGKAVDDSLSEVDSLSETHSLSEASNSLSGWETLEEDKNGVQ

SEQ ID NO: 171774 - protein, 81 aa, Glycine max
  Coding DNA Sequence Number=SeqID_54996
  Homolog annotation: Hit_ID=Q1SQF7; Match level="QueryCoverage=84%, HitCoverage=30%, E-value=2e-07, Identity=37%"; Hit description =Endonuclease/exonuclease/phosphatase
MGTLEEAHKDRRVVQPAGNSVGEGTMGEDVKPCLSAHGSIQSLFYFIRDIKSTQNAPRVGDVTRELSREFPRITSFVYKNQ

SEQ ID NO: 171775 - protein, 152 aa, Glycine max
  Coding DNA Sequence Number=SeqID_54997
  Homolog annotation: Hit_ID=Q9LH72; Match level="QueryCoverage=73%, HitCoverage=23%, E-value=2e-12, Identity=44%"; Hit description =Arabidopsis thaliana genomic DNA, chromosome 3, BAC clone: T21E2
SDIEALRSGVPLQNFGKEDFALATQEYGINGVLAIFNIGNRTGQARADFYASLNGLVQQFFQSLPMSVPLPFKHEESSVGVKGGDKGWQRGEVAVTQEDLGLLSERLKNHGFAESVSGNGGGSAEEEGDGRFNIGSIGLLGRLVIVYLLIDR

SEQ ID NO: 171776 - protein, 111 aa, Glycine max
  Coding DNA Sequence Number=SeqID_54998
  Homolog annotation: Hit_ID=Q9LV73; Match level="QueryCoverage=76%, HitCoverage=6%, E-value=2e-23, Identity=58%"; Hit description =Arabidopsis thaliana genomic DNA, chromosome 5, P1 clone:MJE7
MRTNMKSSLVCCCRCVTSTTPWHNLCKFDLAAKCFQRATDLVSTLDINSITDVGERKLFSDLNLARSQTAWEVRDLNLVVALLNQSKSFLFSTCEHYGDLAKQFMTFRFSY

SEQ ID NO: 171777 - protein, 154 aa, Glycine max
  Coding DNA Sequence Number=SeqID_54999
  Pfam annotation: Domain name=SLR1-BP; Domain location=39-102; Score= -7.3; E_value=0.0057; Accession=PF07333.3; Description=S locus -related glycoprotein 1 binding
MTIIYLQLKKLRRHYQPPTSRSNVLTIAIAAIMVKNLCSLYAILLLLLTLGDLMATVVGDRCKTDLGVCPPKNGCNEKCSKIHQGGQGICDQNNLCMCNFDCKLCDVVMSDQLLGCTDISCTSECAAKYPGKEATGYCVGFGEPYTNCHCQYQC

SEQ ID NO: 171778 - protein, 128 aa, Glycine max
  Coding DNA Sequence Number=SeqID_55000
  Homolog annotation: Hit_ID=Q2HS04; Match level="QueryCoverage=75%, HitCoverage=91%, E-value=9e-07, Identity=30%"; Hit description =Knottin
  Pfam annotation: Domain name=Nodulin_late; Domain location=1-66; Score=1.4; E_value=0.0083; Accession=PF07127.2; Description=Late nodulin protein
  Pfam annotation: Domain name=SLR1-BP; Domain location=12-76; Score= -8.3; E_value=0.0073; Accession=PF07333.3; Description=S locus -related glycoprotein 1 binding
  Pfam module annotation: Pfam domain module=Nodulin_late::SLR1-BP; Domain location=1-66::12-76
MAKNICSLYAILLLSLTLVAAIVVAGDLMATVVGDRCKTDLGVCPAKNGCNAKCSKIHEGGQGICENNHCMCNFDCKICDVVLSDQLLGCTDISCTSECVAKYPGKGATGYCVSFGQPYTNCHCQYQC

SEQ ID NO: 171779 - protein, 120 aa, Glycine max
  Coding DNA Sequence Number=SeqID_55001
  Homolog annotation: Hit_ID=Q2HU26; Match level="QueryCoverage=88%, HitCoverage=47%, E-value=5e-21, Identity=50%"; Hit description=CCT
  Pfam annotation: Domain name=CCT; Domain location=47-85; Score=70.8; E_value=4.2e-18; Accession=PF06203.4; Description=CCT motif
MRRVCSTGDLQNMKSTDMSQKGSPLLEEANFKVGRYSAEERKEKISKYRAKRSQRKFNKIIKYACRKTLADNRTRIRGRFARNDEISEIPKAPCSSSTTEEYEDEFWVEFIEGLNEEVMA

SEQ ID NO: 171780 - protein, 106 aa, Glycine max
  Coding DNA Sequence Number=SeqID_55002
TYQGNPCGVYPDLSSFIGSGVYPDLSSLTGSGVYPDLSSFTGSGVYPDLSSFTGSGVIQKLYSLYQVIRPVYPSNLPNRTMVFQSPTCWNHPREHVFVLGKAEAPH

SEQ ID NO: 171781 - protein, 370 aa, Glycine max
  Coding DNA Sequence Number=SeqID_55003
  Gene Ontology: Mol. function=calpain activity; Cellular component =intracellular; Biological process=proteolysis
  Homolog annotation: Hit_ID=Q1T2S6; Match level="QueryCoverage=97%, HitCoverage=95%, E-value=1e-54, Identity=40%"; Hit description =Cyclin-like F-box; F-box protein interaction domain
  Pfam annotation: Domain name=F-box; Domain location=7-54; Score=32.5; E_value=1.5e-06; Accession=PF00646.23; Description=F-box domain
  Pfam annotation: Domain name=FBA_1; Domain location=210-364; Score= -10.6; E_value=1.9e-05; Accession=PF07734.3; Description=F-box associated
  Pfam module annotation: Pfam domain module=F-box::FBA_1; Domain location=7-54::210-364
MKDMNSTLPRTLPEDLITEILMMLPVRSILRFKCMCKSWFSLISDPEFARSHFALAATPTTRFFVSADDHQVKCIDIEASLHDDNSAKVVFNFPLPSPEDQYYDCQIDMVGSCRGFILLITRGDVFGFIIWNPSTGLRKGISYAMDDPTYDFDLDRFGFGYDSSTDDYVIVNLSCKWLFRTDVHCFSLRTNSWSRILRTVFYYPLLCGHGVFVNGALHWFVKPFDRRRLRAVIISFDVTERELFEIPLPLNFDLKDPIYDLTVMEGCLCLSVAQVGYGTRIWMMKEYKVQSSWTKLFVPIYNQRHPFFPVFCSICLTKKDEFLGSNHKTLVKLNKKGDLLEHRARWHYVDYCSILVRRGVYRESLLSLPE

SEQ ID NO: 171782 - protein, 269 aa, Glycine max
  Coding DNA Sequence Number=SeqID_55004
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=100%, HitCoverage=20%, E-value=2e-91, Identity=50%"; Hit description =Prefoldin
  Pfam annotation: Domain name=KIP1; Domain location=1-45; Score=63.9; E_value=5.3e-16; Accession=PF07765.3; Description=KIP1-like protein
MIKLIDEEADSFARRAEMYYKKRPELMKLVEEFYRAYRALAERYDHAMGELCHAHKTMAEAFPNQAHYMLTDDSQGVESHTPGVPCPNYSESEHAEKADSEVQTLRKALAKIQSDKDAIFLQYQKSMEKLSEMERDLNKAQKDAGGLDERASKAEIETRVLQEALAHLKSDNEASQVQYNQCLESIAKLETLLSLAQLDVKEFDERASKAEIEAKNLKQELGQLEAQKDAGLLRYKQCVEKISVLEAKITLAEENSRMLNEQLERAELE

SEQ ID NO: 171783 - protein, 385 aa, Glycine max
  Coding DNA Sequence Number=SeqID_55005
  Pfam annotation: Domain name=RNA_pol_Rpc4; Domain location=285-378; Score=75.9; E_value=1.3e-19; Accession=PF05132.5; Description=RNA polymerase III RPC4
  Pfam annotation: Domain name=Sin_N; Domain location=8-272; Score= -108.3; E_value=3.9e-05; Accession=PF04801.4; Description=Sin-like protein conserved region
  Pfam module annotation: Pfam domain module=RNA_pol_Rpc4::Sin_N; Domain location=285-378::8-272
MEAEPKFSESEVVRQIDVFFSPSVGAQTWLYVFRQLSTSPRWRPYSLDEQCQEEVRFNPKHSEFKLDLAIDKEFNQTFSTLWKPYKSVPYVEPGYAVGLLMGDKLHLHPIHEVVHHLNSAEKSVSTSKEQWVPLKYLSCKSDISCSYLQQMVVAEESSSTNNFTMSANDYVTALCTGGSSNNSPKVERKSSVEVAFSLGSSSSHSLGTYGTSKSVDSGTSSGSPSKDQEDQNDASNAFARKIKEQWDYENSYNATLGDSEIHDAEEYDENSVNSAAELRILEKSEDQRMFFFKIPAYLPGTSTVSGEPTHLKDLPRGYMGKMLVYKSGAINLKLGESLFDVYPGSNRGHVEDVVAVNTQKQCCNLGKISKRVNVTPNIDFLDKYN

SEQ ID NO: 171784 - protein, 392 aa, Glycine max
  Coding DNA Sequence Number=SeqID_55006
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=23%, E-value=1e-141, Identity=68%"; Hit description =Prefoldin
MELKYGLQLLKDLEFPKQGFKEEMQENVKENRILNELTFSSTRSLLRRQQTEISKLKEIKEKLERELVVNSEENNALQQEAHQIKNDIQLLNNKYHAMLEQLQTLGLDPKCFAASVKDLQNENSNLKEVCKMERNEKEALHEKSKDMDELLIENAFMEFSLSRLNDELDGLRVTVRKFQESCQVLQEEKSTVVDEKSALLSQLQIVTESMQKLLEKNALLEKSLSDSKIELEGLKAKSTDLEEFCKLLNDEKYNLLNERSILVSQLESVEAKLRNLEKLFTKLEEKYADSEKDKESTGNQVEELRASFLVQKEKHANHKHLSEVRLTNLENLFHALQEELWLGKIEFEKEVDKAVNAQMEMFILQSCIEDLGQKNLALLTECEKHVEASKIF

SEQ ID NO: 171785 - protein, 423 aa, Glycine max
  Coding DNA Sequence Number=SeqID_55007
  Gene Ontology: Mol. function=sequence-specific DNA binding; Cellular component=nucleus; Biological process=regulation of transcription, DNA-dependent
  Homolog annotation: Hit_ID=O81821; Match level="QueryCoverage=91%, HitCoverage=81%, E-value=4e-71, Identity=44%"; Hit description=Heat shock factor protein 3
  Pfam annotation: Domain name=HSF_DNA-bind; Domain location=27-146; Score=63.9; E_value=5e-16; Accession=PF00447.8; Description=HSF-type DNA-binding
MLSIFPVSALGFSCLGVKSGYGKYRSPGWHFSGFRKVDPDRWEFANEGFLRGEKQLLKSISRRKSAHVNGSQQASQVHKSAAGACVEVGKFGLEEEVERLKRDKNVLMQELVRLRQKQQGTDNQLQNVGQRVQSMEQRQQQMMSFLAKAMQSPGFLAQFVQQQNESSKHIPGSNKKRRLQRQEEDSLATKDLHSSLDGHIVKYQSSINEAAKALFRQILQINNSTTQSSIKNPDVFLIDDIPSAIASDSSSSSTQVSNVMVPPISELTSMEVGSQFPLSCMPSNISEVQSSPAVLGFCRSQGMETESSLLNHELNVMGADTRNMGEIDMMSTVLDEADEADHFSPDTDGISKLPEISDEFWELFLRPSPLTEDTEETKCSSLGCGLTEDQGLPSEMGNKQENFDTIQHVDCLTQQMGLHALEY

SEQ ID NO: 171786 - protein, 689 aa, Glycine max
  Coding DNA Sequence Number=SeqID_55008
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=37%, E-value=1e-166, Identity=50%"; Hit description =Prefoldin
MFVAEDENSVLLHEVLALSNLNLVYESFLTQKVIEQKALSEHLSSNLSRLNSDLNQELGVLRKKFELKEEESVYLNEATKRMDKELREIKNANCRLSHQVENSENLLKKKDIELLEIETRLKAAEKLNGEFCRYIEELKMDQEESRLIRENLDRQILELSENCMNQKREIEHFNEENRSFQSVMRSLLHEVEQHKVREQALNTELQDKTNECQLCEAEAASFYLELQISSISEELLKGKVTELTGVFKRLDDESAGKGLGQKGQLSAYTPMITSLKEDFASLERTYFLLTNKTFAVGNGEQKDVAIETCLQEELSYQSLKGSESSLTPDGVADLLSMQTRIRVVEKFMMKELERRVKKESLTANVKAEAVTEMNEHSNLEVGTYPEIDDRKVVMKIKKDNSKRGHNAWRTKSQKRLIMIDIPLDDYKDDPDFNKYGKRDHTRIDNHMLELCETDQHDVTEENKQNSVSLEDVITCHESERCQNYSSELETEKELGVDKLELWKTRKETTSEDSKRKILERLASDSQRLAILKMTLQDLKKKPETQKKSSKVNEIEYETVKRHIEDVEEAVMKQIGIYDQLAKDTEECTSSSSDTSTMQLEKQGGQTQRKKLTEQARRGSEQIGRLQFEVQNIQYILLKLADVKNNKCKNKNSRPTGVLLKDFIRIGRKNSRRRRKGCVCGCSRPSTNED

SEQ ID NO: 171787 - protein, 144 aa, Glycine max
  Coding DNA Sequence Number=SeqID_55009
  Gene Ontology: Mol. function=DNA binding; Cellular component=oxygen evolving complex; Biological process=DNA integration
  Homolog annotation: Hit_ID=Q0KIN0; Match level="QueryCoverage=94%, HitCoverage=8%, E-value=2e-35, Identity=58%"; Hit description =Integrase core domain containing protein
MEFSASSHFLSIEVAQSSSKIVSSQWKYALDILMETRMFDCRSSETPMDPNVKLILGKLNYLTVTGSNIMYVVSMVSQFLNALCDSHWDAVTCILRYIKSVPGHGRCMKTKAIPTSFLTLMLIELGHHQVGDLPLGTMFLLEGI

SEQ ID NO: 171788 - protein, 160 aa, Glycine max
  Coding DNA Sequence Number=SeqID_55010
  Gene Ontology: Cellular component=nucleus; Biological process =intracellular transport
  Homolog annotation: Hit_ID=Q8RWG8; Match level="QueryCoverage=72%, HitCoverage=53%, E-value=5e-33, Identity=59%"; Hit description=Ran -binding protein 1 homolog b
  Pfam annotation: Domain name=Ran_BP1; Domain location=5-91; Score= -60.4; E_value=0.086; Accession=PF00638.9; Description=RanBP1 domain
MVAAVSMKDNKRTNIGGCNISGINMTIYLCWIYDIHHSLTVQEHSGNEKSCVWHASDFADGELKDELFCIRFPSVENCKAFMTTMQEVAESQGEGEENKDASATADLLEKLTVGEDKSDEKEPEKVQITKKLTVGEDKSEDEEPEMATNTNEKGEQDVEA

SEQ ID NO: 171789 - protein, 318 aa, Glycine max
  Coding DNA Sequence Number=SeqID_55011
  Gene Ontology: Mol. function=N-acetyltransferase activity; Biological process=metabolic process
  Homolog annotation: Hit_ID=Q1SZT9; Match level="QueryCoverage=81%, HitCoverage=100%, E-value=1e-113, Identity=80%"; Hit description =GCN5-related N-acetyltransferase
  Pfam annotation: Domain name=Acetyltransf_1; Domain location=119-222; Score=57.0; E_value=6.1e-14; Accession=PF00583.14; Description =Acetyltransferase (GNAT) family
MMMIMIAVTMIMVGSSKDDSGGNENDKIRESGCLVWSCYCTIFSSISDICWGLSEKDSMVNPKVSTQPKICYRPIQPSDLDILEHIHCRLFPIRYESTFFHDVVNGRDIVSWGAVDSSRSDGQSDELIGFVTARIVLAKESEVDPIHIVDMLGYDSAKSDQTLVYVLTLGVVEAYRSLGIASSLIREVIKYASSIPTCRAVYLHVISYNNPAINLYKKMSFKCVRRLQGFYLINGQHYDSFLFLYYVNGGQSPCSPLEFLTAIVSYMKSGFNSVAARLCKNGGRKISRRAKCKESHSLVSATPNKRNVAVECPGYECV

SEQ ID NO: 171790 - protein, 52 aa, Glycine max
  Coding DNA Sequence Number=SeqID_55012
MGAIQATVLALCVVKDWSQWKLGWDIRLLTADFLVIGAVLIVCGLYMYGAVG

SEQ ID NO: 171791 - protein, 136 aa, Glycine max
  Coding DNA Sequence Number=SeqID_55013
  Subcellular localization annotation: CTP_CleavageSite=41; ConfidenceScore=5.37e-01
MAESSKKRKGSSSTTAAASHRRHGPSEAPKTPIHPSLSSPRSSTLFSSDDQLFKNYGLVEFMSLKLPYYPELVKVFYSNLKIQDDIISSEVHDISMIIDQSLFFSLTKLPSQGAPFEGTIVDDWKFDYSSHDARRM

SEQ ID NO: 171792 - protein, 57 aa, Glycine max
  Coding DNA Sequence Number=SeqID_55014
  Gene Ontology: Mol. function=glycine hydroxymethyltransferase activity; Cellular component=mitochondrion; Biological process=L -serine metabolic process
  Homolog annotation: Hit_ID=Q00SC2; Match level="QueryCoverage=98%, HitCoverage=10%, E-value=3e-17, Identity=68%"; Hit description=[E] KOG2467 Glycine/serine hydroxymethyltransferase
MEAVGSCLTNKYSEGLPSKRYYGGDEYIDELETLCQQRALATFHVDGNKWGVNAQTL

SEQ ID NO: 171793 - protein, 50 aa, Glycine max
  Coding DNA Sequence Number=SeqID_55015
MDNDDDIFQGLERAASLLNGCWFFTGIFHNKYGAYEILGVRVIGSGRSWI

SEQ ID NO: 171794 - protein, 163 aa, Glycine max
  Coding DNA Sequence Number=SeqID_55016
MEYARADVLKSIEENPSAAFGHLNFLKKLHNPLTSDEILGKKKRENDARLDAQKQAHILLLEKAQTAQHEVERLTKEAKEGSSEIKACDDNISSWEATIMDLLSQVDDLRQKIVTEQAKRKELQEKAAHSIQKLIAEKGREGLKAFSASQAVADEARVMEGAP

SEQ ID NO: 171795 - protein, 190 aa, Glycine max
  Coding DNA Sequence Number=SeqID_55017
  Gene Ontology: Mol. function=nucleoside-triphosphatase activity; Cellular component=membrane; Biological process=response to abscisic acid stimulus
  Homolog annotation: Hit_ID=Q1S520; Match level="QueryCoverage=96%, HitCoverage=71%, E-value=1e-24, Identity=49%"; Hit description=AAA ATPase
MYEQFFPHHLRTYVKKYTQKLTYPYIQVSFPEFSGGENPKESEAYTVIQTYLSANSSQKAKRIKAEVVKDSQTPLVFSMDDNEKITVKKNTKLRRLLVETSSKSIVVIEDIDCSLDLTGQRKNEEDEDMDTDEEEHNNSVKKCGEEGRRKLSKMTLSALLNFTDGIWSALIRRGRIDKHTEMSFVEDYDV

SEQ ID NO: 171796 - protein, 245 aa, Glycine max
  Coding DNA Sequence Number=SeqID_55018
  Gene Ontology: Mol. function=protein binding; Cellular component =apoplast; Biological process=response to biotic stimulus
  Homolog annotation: Hit_ID=Q1S501; Match level="QueryCoverage=95%, HitCoverage=88%, E-value=1e-114, Identity=78%"; Hit description =Thaumatin, pathogenesis-related
  Pfam annotation: Domain name=Thaumatin; Domain location=20-232; Score= 234.6; E_value=2.2e-67; Accession=PF00314.8; Description=Thaumatin family
  Pfam annotation: Domain name=Toxin_19; Domain location=163-199; Score= 3.8; E_value=0.1; Accession=PF08088.2; Description=Conotoxin I -superfamily
  Pfam module annotation: Pfam domain module=Thaumatin::Toxin_19; Domain location=20-232::163-199
MKIIYAGKAEAHQVNFYVHNKCPFPIWPATAPNSGQPVIADGGFYLAPGQTQRVIAPWTWNGRIWARTGCNFASNWKPACETGDCDGRLACNGLIGTPPATLVEVSLQGRNPNFYDVSLVDGYNIPVSVTPKITNPKCNIPGCLKDLKGLCPPELEVLNSKGEIVACKSACLAFDNDKFCCRNQYGSPGKCKPSVYSKIFKDACPNYFSYAFDTPTPLVSCASSEFIITFCPYGWGEGAGEHKSE

SEQ ID NO: 171797 - protein, 135 aa, Glycine max
  Coding DNA Sequence Number=SeqID_55019
  Gene Ontology: Mol. function=helicase activity; Cellular component =nucleus; Biological process=biological_process
  Homolog annotation: Hit_ID=Q1RTU9; Match level="QueryCoverage=87%, HitCoverage=11%, E-value=7e-44, Identity=73%"; Hit description =DEAD/DEAH box helicase, N-terminal
MTGEHTCMILKPLHNDEIEADGSNQLGFFSPFYQDFRQRFAKLLASTFRGMEYELALSIIDPKINFKCQDPTETSSDKCLQSVRGYLSPHDMKRLEAYVDNLADFHRLTVDWPPRVTKIRLTYKNRQTKNMSPFF

SEQ ID NO: 171798 - protein, 34 aa, Glycine max
  Coding DNA Sequence Number=SeqID_55020
MVAETRIPLGRDTLIGVSRIHLEISTLPLPVGVE

SEQ ID NO: 171799 - protein, 307 aa, Glycine max
  Coding DNA Sequence Number=SeqID_55021
  Gene Ontology: Mol. function=nucleic acid binding; Cellular component= membrane; Biological process=DNA integration
  Homolog annotation: Hit_ID=Q1S1G2; Match level="QueryCoverage=94%, HitCoverage=20%, E-value=5e-49, Identity=36%"; Hit description =Integrase, catalytic region; Zinc finger, CCHC-type; Peptidase aspartic, catalytic
  Pfam annotation: Domain name=zf-CCHC; Domain location=248-265; Score =9.0; E_value=0.033; Accession=PF00098.13; Description=Zinc knuckle
  Pfam module annotation: Pfam domain module=Retrotrans_gag::zf-CCHC; Domain location=79-181::248-265
MVDEATYLYTLQDAQNASNPLYIHPNESPSTVLVSPPLSYGNYHSWSRAMKMSPLIKNKLGFVDGTIVEPPKNHSMSVEIAQSILWRKKASDVWKELREHFSHADLFRISEIQEEIFSQRQGDNSISKFYIAPKTLWDELDVLNPLPVCTCNSKCSCGAIKKIEKEINKNQVVRFLRGLNDQYSGVRSQLMLLDNLPNVNRVFAQQERQFDTKNASVPKALLVASDDTSDSKRNQGSDNGWNNRYTSQKCSWCGKMGHKIDICYRKHGFPAGFKFNNSKNTAPRSANMVMVEKNETNCPDDSSRKDT

SEQ ID NO: 171800 - protein, 334 aa, Glycine max
  Coding DNA Sequence Number=SeqID_55022
  Gene Ontology: Mol. function=DNA binding; Cellular component=beta -galactosidase complex; Biological process=DNA integration
  Homolog annotation: Hit_ID=Q1SS72; Match level="QueryCoverage=94%, HitCoverage=26%, E-value=1e-80, Identity=54%"; Hit description =Integrase, catalytic region
MTTLRVVLALASSKKWLLHQLDVDNAFLHANLEEEIYMALPQGNDISEINKFKQQLHAQFRIKDLGEAKFFLGLEIARSSKGIVLNQRKYALELLSDSSLLCCKAATTPMDTSIKLGPAIGKPLSDISSSRRLIGRLIYLTTTRPNIAFVVNQLSQFLSAPTYRHQAAAHRVLCYIKGSPGCGLFYPTSNAHKLTAYSDSDWADCIDSRKSITVYCLYIGSSLISWRSKKQTTIARSSCEAEYRAIAATMCEVQWISYLLLDLQAAKPSHVSFFCNYRSTIHIAHNPSFHERTKHIELDCHIVREKSTKALFIFCPSPQHNDRYLHKASDACTV

SEQ ID NO: 171801 - protein, 47 aa, Glycine max
  Coding DNA Sequence Number=SeqID_55023
MGEKVSSDHRKALEKEDKDYLFPKIDVAQQWQQQGCSDNPVDMKEAF

SEQ ID NO: 171802 - protein, 347 aa, Glycine max
  Coding DNA Sequence Number=SeqID_55024
  Gene Ontology: Mol. function=nucleic acid binding; Cellular component= beta-galactosidase complex; Biological process=DNA integration
  Homolog annotation: Hit_ID=Q1ST43; Match level="QueryCoverage=63%, HitCoverage=20%, E-value=4e-54, Identity=40%"; Hit description =Integrase, catalytic region; Peptidase aspartic, catalytic
  Subcellular localization annotation: CTP_CleavageSite=4; ConfidenceScore=5.51e-01
MATSSSSGEEDLTPPPTPPPPPPSFTGPSQNPASPFYIHPSKSLTFVIVTPPLTANNFQSWSCSFRMALISKHKMDFLNGSIPIPQLTDPIYSSWERCNVLLMSWLLNSLSPSIAQSVIFFEHAIDIWNDLRERFSQGDLLRVAEFQEEIYTLKQGSLSVTDYCTTLKSLWEELDNYRPLSPSSCSAKTYHQQDFIIRFLKGLDERFAMVRSQILLLDPLPFANRGESTRKCDFYGHLDHTIDSCFQKLNTMRQNVAIVTNLVTPVMFATLSLGTLLDTRNTQVAHVSLTTNLLLVAPQPPQVEDMSTLKTIGLADLKEGLFHLIVGKDRSPSTNNITITNINNSKL

SEQ ID NO: 171803 - protein, 81 aa, Glycine max
  Coding DNA Sequence Number=SeqID_55025
  Homolog annotation: Hit_ID=Q53PH6; Match level="QueryCoverage=52%, HitCoverage=3%, E-value=5e-07, Identity=60%"; Hit description =Expressed protein
MDILFARIQVDLRSNDALHQSGAFLQAVQQSAVGRDIAIIAKTNYPNIAIIAIWMGCWQAQGRRRMRQSAWGPTCSTAPAA

SEQ ID NO: 171804 - protein, 132 aa, Glycine max
  Coding DNA Sequence Number=SeqID_55026
MERKETIDFSSYFYLEASGDSEEADFDHTFACEMAKADGGGEVVDDNDDALSCNGSGACNVAESDGCDESCDEHDGGIEKKEEEDGVYGMSYCEDDEMQEEQMKSYVSFDSGHKSLDEMEKNRLFWEACLAS

SEQ ID NO: 171805 - protein, 398 aa, Glycine max
  Coding DNA Sequence Number=SeqID_55027
  Gene Ontology: Mol. function=nucleic acid binding; Cellular component= ribonucleoprotein complex; Biological process=embryonic development
  Homolog annotation: Hit_ID=Q7XAN8; Match level="QueryCoverage=81%, HitCoverage=77%, E-value=9e-68, Identity=45%"; Hit description =Putative CUG triplet repeat RNA-binding protein 1
  Pfam annotation: Domain name=RRM_1; Domain location=284-355; Score =88.0; E_value=2.9e-23; Accession=PF00076.12; Description=RNA recognition motif. (a.k.a. RRM, R
  Pfam annotation: Domain name=RRM_1; Domain location=42-111; Score =54.2; E_value=4.3e-13; Accession=PF00076.12; Description=RNA recognition motif. (a.k.a. RRM, R
  Pfam module annotation: Pfam domain module=RRM_1::RRM_1; Domain location=284-355::42-111
MVRWYYYSPDWEASYFLCPIQASSPLQVKYADGELERLEHKLFIGMLPKNISEDEVSDLFSMYGTIKDLQILRGSQQTRCAFLKYETKEQALAALEAINGKHTMEGSSVPLVVKWADTEKERLARRAQKAQSQVSNMPQADPQHPSLFGALPMGYVPPYNGYGYQAPGGYGLMAYRFPPMQNQPGFHNMNMNQVNAVRPDLGHSVNPRNYHAPPASYIGPYPAVPGVQHPMVYPRRIVGIATLHLQVPVKVPVVKLKKMLVFVDNPNSVNYFNFSGLGPPGANLFIYHIPQEYGDEELATTFQPFGRVLSAKIFVDKVTGVSKCFGFVSYDTPEAAQSAISTMNGCQLGGKKLKVQLKRDNKQRSMNYCFIVCTCYYFQCHSSWWGRGFGLTGWLRTI

SEQ ID NO: 171806 - protein, 619 aa, Glycine max
  Coding DNA Sequence Number=SeqID_55028
  Gene Ontology: Mol. function=protein binding; Cellular component =nucleus; Biological process=regulation of transcription, DNA -dependent
  Homolog annotation: Hit_ID=Q8GV45; Match level="QueryCoverage=63%, HitCoverage=92%, E-value=1e-177, Identity=77%"; Hit description =Fertilization independent endosperm development protein
  Pfam annotation: Domain name=WD40; Domain location=173-212; Score =22.7; E_value=0.0013; Accession=PF00400.22; Description=WD domain, G- beta repeat
  Pfam annotation: Domain name=WD40; Domain location=218-258; Score =35.1; E_value=2.4e-07; Accession=PF00400.22; Description=WD domain, G-beta repeat
  Pfam annotation: Domain name=WD40; Domain location=291-327; Score =8.4; E_value=3.8; Accession=PF00400.22; Description=WD domain, G -beta repeat
  Pfam annotation: Domain name=WD40; Domain location=340-380; Score =5.8; E_value=7.7; Accession=PF00400.22; Description=WD domain, G -beta repeat
  Pfam annotation: Domain name=WD40; Domain location=83-124; Score=0.6; E_value=31; Accession=PF00400.22; Description=WD domain, G-beta repeat
  Pfam annotation: Domain name=zf-U1; Domain location=426-451; Score =22.7; E_value=7.8e-05; Accession=PF06220.3; Description=U1 zinc finger
  Pfam module annotation: Pfam domain module=WD40::WD40::WD40::WD40::WD4 0::zf-U1; Domain location=173-212::218-258::291-327::340-380::83 -124::426-451
MVGETAATGKSVGLGLGCDPVVGSLACSKKREYRVTNRLQEGKRPLYAVIFNFIDSRYFNVFATVGGNRVTVYQCLEGGVIAVLQSYVDEDKDESFYTVSWACNVDGTPFVVAGGINGVMRVIDVGSEKIHKGVPLWQHHRLQWHVYMAELWPSAVFFHPPLITLLKCDRSVGCYSGSFVGHGDSVNEIRTQTLKPSLVISASKDESVRLWNVHTGICILIFAGAGGHRNEVLSVDFHPSDIYRIASCGMDNTVKIWSMKGRYVTAEFWTYVEKSFTWTDLPSKFPTKYVQFPVYNASVHLNYVDCNRWLGDFILSKSVDNEIILWEPKVKEQTPGEGVVDILQKYPVPECDIWFIKFSCDFHFNLAAVGNREGKIFVWELQSSPPVLVARLSHPQSKSPIRQTATSFDGRFVSHTGHQYVANVVCVLLQPSVRKQHNAGYKHKANVRTYYQQFEEQQTQSLIDQRIKEHLGQAAAFQQVGVAYNHLMVQRPNLPPVLPPPRLPIPGNAQIPGGQPLMQGMRPPVFPRPPGAPGYVSAHTMPPMLPPPGAPQVPGQLNTIPRPPSLAPPPTVPGSTATPASNGAPSMVSSAMYQANPPAPSSGSYDNYNTSAQAPEGNH

SEQ ID NO: 171807 - protein, 378 aa, Glycine max
  Coding DNA Sequence Number=SeqID_55029
  Gene Ontology: Mol. function=serine-type endopeptidase activity; Cellular component=chloroplast thylakoid membrane; Biological process=proteolysis
  Homolog annotation: Hit_ID=O82261; Match level="QueryCoverage=58%, HitCoverage=70%, E-value=1e-72, Identity=71%"; Hit description =Protease Do-like 2, chloroplast precursor
  Pfam annotation: Domain name=Trypsin; Domain location=99-265; Score =54.2; E_value=4.2e-13; Accession=PF00089.16; Description=Trypsin
  Subcellular localization annotation: CTP_CleavageSite=84; ConfidenceScore=5.76e-01
MAVALTSCISSSSVLFSTVKFRYSLRHRPIVASFYNNNNYPLRLSSSSSSSSKSNRQKEGVGQKKQSKDERPARGNVLEPQQTSSSKPFGIQRKNKDLIFDSKDQQVEPSALQDSAFLNAVVKVKVKKRGDDSKYVAKVLARGVDCDIALLSVESEEFWRDVEPLRLGRLPHLQDSVTVVGYPLGGDTISVTKGVVSRIEVTSYAHGSSDLLGIQIDAAINPGNSGGPAFNDQGECIGVAFQVLRSDEAENIGYVIPTTVVSHFLTDYERNGRYTACKDRYLRFEFEDSYVAVLEKESVTAASPSVLSDYGIPSERSSDLLKPYVDALEVEGDQPADEEFGDSPRQHLKQVITILGCRESAATVWGNLDVNTLCYHGG

SEQ ID NO: 171808 - protein, 485 aa, Glycine max
  Coding DNA Sequence Number=SeqID_55030
  Gene Ontology: Mol. function=GTPase activator activity; Cellular component=intracellular; Biological process=signal transduction
  Homolog annotation: Hit_ID=O82460; Match level="QueryCoverage=93%, HitCoverage=98%, E-value=1e-160, Identity=67%"; Hit description=Rac GTPase activating protein 3
  Pfam annotation: Domain name=PBD; Domain location=69-110; Score=42.9; E_value=1.1e-09; Accession=PF00786.18; Description=P21-Rho-binding domain
  Pfam annotation: Domain name=RhoGAP; Domain location=159-299; Score =104.5; E_value=3e-28; Accession=PF00620.17; Description=RhoGAP domain
  Pfam module annotation: Pfam domain module=PBD::RhoGAP; Domain location=69-110::159-299
MTGVVMVTKGGGCGGGGKRTRSARTAEEEEEQQNQLSLVALLLAAIRKSMVSCRVDPPEDVISTVHHMEIGWPTNVQHITHVTFDRFNGFLGLPYEFQVEIPARVPSARERKCKTFMKGSEEDDVARTLFQTSAFGVSVFGVSAESMQCSYDPKGNSVPTILLLMQDRLYSQGGLKAEGIFRINPENSQEEHVRDQLNRGIVPDDIDVHCLAGLIKAWFRELPSGVLDGLSPEQVLQCNTEEESVELVKQLKPTESALLSWAIDLMADVVEEEEFNKMNARNIAMVFAPNMTQMSDPLTALMHAVQVMNLLKTLIMKTLREHEQTAKGGYSPMSYHSSDRQSEDEYSSQREMDTSGELRGTKSDYDDHAHYGHSSEGEAGSLSEIEEECFLKQLDENKKGFSEESAVYLDKYVSTRSFSGYNMEPSISVTDGKAGNSCLSTTLTDLASNVDSSSSSIGCTGTKDVEMMDKFADSISPVPPLLASS

SEQ ID NO: 171809 - protein, 98 aa, Glycine max
  Coding DNA Sequence Number=SeqID_55031
  Homolog annotation: Hit_ID=Q9FXF2; Match level="QueryCoverage=63%, HitCoverage=6%, E-value=9e-15, Identity=53%"; Hit description =Receptor-like serine/threonine kinase
MGVANFSVFLLIISLSFFQLLRISESKLPKEEVDALKEIVSTMGATYWKFDADSCNIEMVGVTLEPPDESERRIGCDCSFEDGTVCHVVNMYDYYQII

SEQ ID NO: 171810 - protein, 569 aa, Glycine max
  Coding DNA Sequence Number=SeqID_55032
  Gene Ontology: Mol. function=GTPase activity; Cellular component =nucleus; Biological process=immune response
  Homolog annotation: Hit_ID=Q1SQ91; Match level="QueryCoverage=99%, HitCoverage=83%, E-value=0.0, Identity=68%"; Hit description=Dynamin central region; Dynamin; Dynamin GTPase effector
  Pfam annotation: Domain name=Dynamin_M; Domain location=152-439; Score=-71.2; E_value=9e-07; Accession=PF01031.10; Description =Dynamin central region
  Pfam annotation: Domain name=Dynamin_N; Domain location=3-139; Score =86.3; E_value=9.5e-23; Accession=PF00350.13; Description=Dynamin family
  Pfam annotation: Domain name=GED; Domain location=464-560; Score =30.8; E_value=4.9e-06; Accession=PF02212.8; Description=Dynamin GTPase effector domain
  Pfam module annotation: Pfam domain module=Dynamin_M::Dynamin_N::GED; Domain location=152-439::3-139::464-560
MRLQNHSLPKPELVLEYNAKIVSTDEAQVSDAIRVATDELAGGGKGISNTPLTLVVKKDGVPDLTMVDLPGITRVPVHGQPEDIYDQIKDIIMEYIRPEESIILNVLSATVDFSTCESIRMSQGVDKTGERTLAVVTKADKAPEGLHEKVTADDVNIGLGYVCVRNRIGDESYEDARAEEVNLFRTHTLLSKIDKSIVGVPVLAQKLVQLQAASISKILPEIVKKINDKLGSQLSELDKFPRKLTSVPNAMSAFMHIIGLAKESLRKILLRGEFDEYPDDKHMHCTARLVDMLDQYSNDLYKGPESDAGEKFLMEEIKVLEEAKWIGLPNFMPRSAFLTLLQNKVRAISSMPIEFTVKVWDYLEEVVVAVLKRHSEHYHQLQTSTKRAGKNLIAKMKENSMKYVMEVVEMEKLTDYTSNPEYMSEYNELMANQDEFVEKVNTGNYHEVALDGFEQAIKVGHLSQYSTLLPQAFDLKMRLRAYWKIVLRRLIDGTALHLQLSIFNLVDKDLGDEIVKDMMSPYAGGIEKLLEEAPSVSMKRDKLNRSIKVLRESKEVVANIMDKISSYDD

SEQ ID NO: 171811 - protein, 90 aa, Glycine max
  Coding DNA Sequence Number=SeqID_55033
  Subcellular localization annotation: CTP_CleavageSite=49; ConfidenceScore=5.36e-01
MPLPLGTVLVPLVRCSHRSKPNSLSNPVLPPSICFSLCRAAAPDLHLVRCFGTEAGSTSSESPSKILVRGEFDEYPDDKHMHLLLVRGYA

SEQ ID NO: 171812 - protein, 461 aa, Glycine max
  Coding DNA Sequence Number=SeqID_55034
  Gene Ontology: Mol. function=phosphoprotein phosphatase activity; Cellular component=nucleus
  Homolog annotation: Hit_ID=Q8L7U5; Match level="QueryCoverage=66%, HitCoverage=39%, E-value=3e-89, Identity=53%"; Hit description =Serine/threonine-protein phosphatase BSL1
MESASLLCSSSLHYNITHIWGWRNNAGHVNQRLNNAGHPTHGTLMEFPANPHSVNSDALFCGLYSVHILWGLFCSCQGGLEESMFCFIFFDHCTVFVGARLHATGGVLRGGRSVEGEASIAVLDTAAGVWLDRNGIVSSSRSNKGHDYDPPLELMRRCRHAAAAVGVHIFIYGGLRGDILLDDFLVAENSPLQPDINSPERASPVTSSKQNQSNLTYNVTAPNLDGGPDTPSFGHSGMDKNSLEKLREASAAEAEAAGAVWQAVQSISSNPAEETSLSVENSQAAETVSDGRCKKHTFLLQVVVSKEAVGNLGGMIISTLLRPRNWKAPANRRVFLDSYEVGELCYAAEQIFMHEPIVLQLKAPVKVFGDLHGQFGDLMRLFDEYGFPSTAGDITPGIKALLAVSGVLNVVNNNFNSEVPSRFSKLKDLNISEFVICWLCGDTAETRECRPTKVCPKLQQD

SEQ ID NO: 171813 - protein, 376 aa, Glycine max
  Coding DNA Sequence Number=SeqID_55035
  Gene Ontology: Mol. function=aminoacyl-tRNA ligase activity; Cellular component=nucleus; Biological process=electron transport
  Homolog annotation: Hit_ID=Q9ZT99; Match level="QueryCoverage=82%, HitCoverage=85%, E-value=1e-100, Identity=66%"; Hit description =Putative WD-repeat protein
  Pfam annotation: Domain name=WD40; Domain location=178-216; Score =14.2; E_value=0.46; Accession=PF00400.22; Description=WD domain, G -beta repeat
  Pfam annotation: Domain name=WD40; Domain location=220-258; Score =8.4; E_value=3.9; Accession=PF00400.22; Description=WD domain, G -beta repeat
  Pfam annotation: Domain name=WD40; Domain location=259-297; Score =37.0; E_value=6.3e-08; Accession=PF00400.22; Description=WD domain, G-beta repeat
  Pfam module annotation: Pfam domain module=WD40::WD40::WD40; Domain location=178-216::220-258::259-297
MGYAMSRLEIESGLSEDGDAIQEDSSSGETKRPLKNLDNEIAQITKLKSTPHQQLVQVGTGRPELPVSPVKMLAGRESNYSGRGRFSSADRCHLLSRYLPVNGPWLIDQMSSRAYVSQFSADGSLFIAGFQGSHIRIYNVDRGWKVQKNILAKNLRWTITDTSLSPDQRYLEIHDGLDFSSNDDGGYSFGIFCVKFSKDGKELVAGSSGDSIYVYDLEANKLSLRILAHTCDVNTVCFADETSHLIYSGSDDSFCKVSGAQVATLKHHKSPVRDCSWHPFHTTLVSSSWDGDVVKWEFAGSGDTPGSSTKKRQQPETDKELDIGQWMVANGGKTEFQTQDSKGLQLQCKKGYPNGCPTCNHFPLQGAPTRAYGKLS

SEQ ID NO: 171814 - protein, 350 aa, Glycine max
  Coding DNA Sequence Number=SeqID_55036
  Gene Ontology: Mol. function=peroxidase activity; Cellular component =vacuole; Biological process=response to oxidative stress
  Homolog annotation: Hit_ID=Q40487; Match level="QueryCoverage=84%, HitCoverage=90%, E-value=3e-98, Identity=59%"; Hit description =Cationic peroxidase isozyme 40K precursor
  Pfam annotation: Domain name=peroxidase; Domain location=67-314; Score=444.5; E_value=1.4e-130; Accession=PF00141.13; Description =Peroxidase
MDEIIVAQARAHAGNSSESEVKGLKILNMKISILLCVVLLGFLGVCQGGSLRKKFYRDSCPQAEDIIKTKTQQHVSANPDLPAKLLRMHFHDCFVRGCDASVLLNSTASNTAERDAIPNLSLAGFDVIDDIKSAVEAKCSKTVSCADILALAARDAVSVQFNKPMWEVLTGRRDGTVSNSNEALANIPAPFFNFTQLKESFAGKGLTLHDLVVLSGAHTIGIGHCNLFSNRLYNFTGKGDQDPSLNTTYAEFLKTKCQSLSDTTTTVEMDPGSSTKFDSDYYPNLLQNKGLFQSDAALLTQEQSEDIAKELVDQNKFFTEFAQSMKRMGAIEVLTGSAGEIRNKCSVVNS

SEQ ID NO: 171815 - protein, 691 aa, Glycine max
  Coding DNA Sequence Number=SeqID_55037
  Gene Ontology: Mol. function=phosphoprotein phosphatase activity; Cellular component=nucleus
  Homolog annotation: Hit_ID=Q8L7U5; Match level="QueryCoverage=99%, HitCoverage=100%, E-value=0.0, Identity=64%"; Hit description =Serine/threonine-protein phosphatase BSL1
  Pfam annotation: Domain name=Kelch_1; Domain location=264-313; Score =2.7; E_value=1.9; Accession=PF01344.15; Description=Kelch motif
  Pfam annotation: Domain name=Kelch_1; Domain location=29-93; Score =7.8; E_value=0.5; Accession=PF01344.15; Description=Kelch motif
  Pfam annotation: Domain name=Kelch_1; Domain location=332-382; Score =5.0; E_value=1; Accession=PF01344.15; Description=Kelch motif
  Pfam annotation: Domain name=Kelch_1; Domain location=98-146; Score =7.4; E_value=0.56; Accession=PF01344.15; Description=Kelch motif
  Pfam annotation: Domain name=Kelch_2; Domain location=151-206; Score =9.5; E_value=2.1; Accession=PF07646.5; Description=Kelch motif
  Pfam annotation: Domain name=Kelch_2; Domain location=212-259; Score =10.6; E_value=1.5; Accession=PF07646.5; Description=Kelch motif
  Pfam annotation: Domain name=Kelch_2; Domain location=264-313; Score =15.6; E_value=0.19; Accession=PF07646.5; Description=Kelch motif
  Pfam annotation: Domain name=Kelch_2; Domain location=29-93; Score =13.2; E_value=0.69; Accession=PF07646.5; Description=Kelch motif
  Pfam annotation: Domain name=Kelch_2; Domain location=332-382; Score =8.5; E_value=2.9; Accession=PF07646.5; Description=Kelch motif
  Pfam annotation: Domain name=Kelch_2; Domain location=98-146; Score =7.3; E_value=4.1; Accession=PF07646.5; Description=Kelch motif
  Pfam module annotation: Pfam domain module=Kelch_1::Kelch_1::Kelch _1::Kelch_1::Kelch_2::Kelch_2::Kelch_2::Kelch_2::Kelch_2::Kelch_2; Domain location=264-313::29-93::332-382::98-146::151-206::212 -259::264-313::29-93::332-382::98-146
MGSKPWLYPAPTYRTIETVWDTDEDAPGPRCGHTLTAVAATKTLGPRLILFGGATAIEGGSSSAPGIRLAGVTNTVHAYDVQSRKWTSVKPAGEPPSPRAAHAAAAVGTMVVFQGGIGPAGHSTDDLYVLDLTNDKYKWHRVVVQGQGPGPRYGHAMDLVAQRYLVTVSGNDGETNSLPGKRVVSDAWALDTAQKPYVWQKLNPEGDRPSARMYATASARSDGMFLLCGGRDSSGAPLADAYGLLMHRNGQWEWTLAPGVSPSPRYQHAAVFVGARLHVTGGVLRGGRSVEGEASIAVLDTAAGVWLDRNGIVSSSRSNKGHDYDPPLELMRRCRHAAAAVGVHIFIYGGLRGDILLDDFLVAENSPLQPDINSSERASPVTSSKQNQSNLTYNVTAPNLDGGPDTPSFGHSGMDKNSLEKLREASAAEAEAASAVWQAVQSISSNPAEETSLSDENSQAAETVSDGSDTEGDVRLHPRAVVVAKEAVGNLGGMIISTLLRPRNWKAPANRRFFLDSYEVGELCYAAEQIFMHEPTVLQLKAPVKVFGDLHGQFGDLMRLFDEYGFPSTAGDITSDPTENDSVEGLRPNARGPGLVTFGHSRLHVIAFQSHAGCVILGTANNAGAILVVGRGLVVVPKLIHPIPPPLQSPETSPERGMDETWMQELNIQRPPTPTRGRPQPDLDRGSLAYI

SEQ ID NO: 171816 - protein, 432 aa, Glycine max
  Coding DNA Sequence Number=SeqID_55038
  Gene Ontology: Mol. function=protein binding; Cellular component =integral to membrane; Biological process=protein amino acid phosphorylation
  Homolog annotation: Hit_ID=Q9ZT98; Match level="QueryCoverage=85%, HitCoverage=93%, E-value=1e-158, Identity=70%"; Hit description =Putative leucine-rich repeat protein
  Pfam annotation: Domain name=LRRNT_2; Domain location=59-100; Score =42.1; E_value=1.9e-09; Accession=PF08263.3; Description=Leucine rich repeat N-terminal domain
  Pfam annotation: Domain name=LRR_1; Domain location=156-178; Score =11.4; E_value=2.1; Accession=PF00560.23; Description=Leucine Rich Repeat
  Pfam annotation: Domain name=LRR_1; Domain location=180-202; Score =18.0; E_value=0.035; Accession=PF00560.23; Description=Leucine Rich Repeat
  Pfam annotation: Domain name=LRR_1; Domain location=204-225; Score =10.6; E_value=2.9; Accession=PF00560.23; Description=Leucine Rich Repeat
  Pfam annotation: Domain name=LRR_1; Domain location=226-246; Score =13.3; E_value=0.86; Accession=PF00560.23; Description=Leucine Rich Repeat
  Pfam annotation: Domain name=LRR_1; Domain location=249-271; Score =14.8; E_value=0.32; Accession=PF00560.23; Description=Leucine Rich Repeat
  Pfam annotation: Domain name=LRR_1; Domain location=273-295; Score =11.8; E_value=1.8; Accession=PF00560.23; Description=Leucine Rich Repeat
  Pfam annotation: Domain name=LRR_1; Domain location=296-317; Score =2.5; E_value=95; Accession=PF00560.23; Description=Leucine Rich Repeat
  Pfam annotation: Domain name=LRR_1; Domain location=318-337; Score =0.8; E_value=2e+02; Accession=PF00560.23; Description=Leucine Rich Repeat
  Pfam annotation: Domain name=LRR_1; Domain location=339-362; Score =12.2; E_value=1.5; Accession=PF00560.23; Description=Leucine Rich Repeat
  Pfam annotation: Domain name=LRR_1; Domain location=366-388; Score =7.4; E_value=12; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1; Domain location =59-100::156-178::180-202::204-225::226-246::249-271::273-295::296 -317::318-337::339-362::366-388
LDTCGSEGDDVAFEAEAWRPNRLGEPFDVTVPEECRSSTSPYALFVFFFCFLQVQAILDPADFLALQNIRKALEDMPGSDFFSTWDFTADPCNFAGVYCDSDKIIALNLGDPRAGSPGLTGRLDPAVGKLSALAEFTVVPGRIYGPLPETLSDLKNLRFLGVNRNFISGQIPTKLGDLRNLRTIDLSYNQLSGRIPPTVGTLPELTNLILCHNRLSGSVPRFESHTLTRLDLKHNGLSGSLPPDCLPPSLQYLSLSWNQLTGPMDRHLARLDQLNYLDLSLNQFTGPIPGRIFSFPLTNLQLERNQFSGMVQPVDQVSIPTVDLSYNRLYGQISPMLATVQNLYLNNNRFTGRVPASFVERLLDASIQILYLQHNYLTGIEISPTAVIPERSSLCLQYNCMVPPVETPCPLRAGKEKTRPTAQCNQLKDLKD

SEQ ID NO: 171817 - protein, 63 aa, Glycine max
  Coding DNA Sequence Number=SeqID_55039
MEKDMKQSLLNLMKHFQRDSRLKNAITTSQLHRTRTRLMLNIVYLSKSGDRILVNSATGADRD

SEQ ID NO: 171818 - protein, 325 aa, Glycine max
  Coding DNA Sequence Number=SeqID_55040
  Gene Ontology: Mol. function=transferase activity; Cellular component= integral to membrane; Biological process=transport
  Homolog annotation: Hit_ID=Q1RWV8; Match level="QueryCoverage=73%, HitCoverage=33%, E-value=5e-66, Identity=55%"; Hit description=IMP dehydrogenase/GMP reductase
  Pfam annotation: Domain name=Ponericin; Domain location=237-266; Score=15.4; E_value=0.061; Accession=PF07442.2; Description=Ponericin
MDELLKRASMYEYDDDGNKPLQNLGDKDQQTDPYSFDGGGSVTLADITEEQQHLTIKGEPKHQKIGGKKDENPLGSSLNLYCCHCTSKKDEKNEKISTKEKKVLETPILIAAKNGVTEMVAKIMDSFPVAVHDMDAKKKNIVLLAVENRQTYLYNFLLSKKNLKESNIFEKVDNEGNSALHLAAKLGDYKPWLIPGEALQMHWEIKWYLFVKGSMQPHFFSHYNNENKTPRDIFSETHKDLVRSGGEWLKKTAESCSLVAALIAAVAFSTSTNVPGDFKDDTGSPTLEERPEFKAFAHRISHCSLLLCHLTGAVPLNTHISVSRA

SEQ ID NO: 171819 - protein, 156 aa, Glycine max
  Coding DNA Sequence Number=SeqID_55041
  Gene Ontology: Mol. function=transferase activity
  Homolog annotation: Hit_ID=Q1RWV2; Match level="QueryCoverage=58%, HitCoverage=20%, E-value=4e-11, Identity=43%"; Hit description=Di -trans-poly-cis-decaprenylcistransferase
LAFQIIDLYGDLVNSVNEDGLTPLHLLANKPSVFKSGGRLGRFEALVYYAIIVNELKVAPSCQQQCPTTDKEKNSYPKNYQTCMEFLRMTKIFTLVDSFSTYPVIKPFTQFLQKKLPPKDQTVTERVDLEASKKVATNNGAVTEASVRVVIFKLLV

SEQ ID NO: 171820 - protein, 98 aa, Glycine max
  Coding DNA Sequence Number=SeqID_55042
  Gene Ontology: Mol. function=protein binding; Biological process=two -component signal transduction system (phosphorelay)
  Homolog annotation: Hit_ID=Q659H7; Match level="QueryCoverage=89%, HitCoverage=58%, E-value=3e-30, Identity=67%"; Hit description =Putative histidine-containing phosphotransfer protein 3
  Pfam annotation: Domain name=Hpt; Domain location=31-98; Score=31.4; E_value=3.1e-06; Accession=PF01627.13; Description=Hpt domain
MFVSFIGDLLDCKFSQLQKLQDESTPDFVIEVITMFFDDSENLLKNMARCLEQVPVDFKQIDAHAHQYKGSSASIGAARVKNVCATFRAFCEAKNLEG

SEQ ID NO: 171821 - protein, 56 aa, Glycine max
  Coding DNA Sequence Number=SeqID_55043
MEKRGSNFNLWAPKSRKRLVSCGVRKSIESLSNYPPDMQTGASMCNSTLTFIFDEI

SEQ ID NO: 171822 - protein, 453 aa, Glycine max
  Coding DNA Sequence Number=SeqID_55044
  Gene Ontology: Mol. function=GTPase activity; Cellular component =nucleus; Biological process=immune response
  Homolog annotation: Hit_ID=Q1SQ91; Match level="QueryCoverage=98%, HitCoverage=91%, E-value=2e-78, Identity=47%"; Hit description =Dynamin central region; Dynamin; Dynamin GTPase effector
  Pfam annotation: Domain name=Dynamin_N; Domain location=27-212; Score= 162.1; E_value=1.5e-45; Accession=PF00350.13; Description=Dynamin family
  Pfam annotation: Domain name=GED; Domain location=354-450; Score= -15.2; E_value=0.055; Accession=PF02212.8; Description=Dynamin GTPase effector domain
  Pfam module annotation: Pfam domain module=Dynamin_N::GED; Domain location=27-212::354-450
HIRPVLDAVENLRRLNISNKRIQLPTIVIVGDQSSGKSSVLESLTGISLHRGQGICTRVPLIMRLQNHSLPKPELVLQFNSKNVSTDESHVSDAIRVATDELAGDGKGISNTPLTIVVKKNGVPDLTVVDLSGITRVSIQGQPKDIFYLSATKPKDIYDQIEDIVMEYIRHEESIIVNVLSATVDLYACESIRMSQGVDKTGERTLAVLIQLQAASIFKILPENDLHKGSESDAGEKFLMEEIKVLEEVKRIGLPNFMPGNAFSYPLLQNKVRAISSMPIDKNLIVKLKEKSIKHLIEVLEMEKLIDYTRNPEYMSEYNELMTNQDKFVKIVNTSNYVVLDGFEHAIKVGHLRRYSTLLLQAFDLKMKLRAYCKIVLRGLMHSTALHLQLSIFNLVDKDLGDEIVKDTMSPYAGGIEKLLEEAPSVSMKGDKLNRNIKLLREIKGVVARFNMQ

SEQ ID NO: 171823 - protein, 327 aa, Glycine max
  Coding DNA Sequence Number=SeqID_55045
  Gene Ontology: Mol. function=protein serine/threonine kinase activity; Cellular component=cytoplasm; Biological process=protein amino acid phosphorylation
  Homolog annotation: Hit_ID=Q9FGC3; Match level="QueryCoverage=97%, HitCoverage=72%, E-value=1e-110, Identity=64%"; Hit description =Serine/threonine protein kinase-like
  Pfam annotation: Domain name=Pkinase; Domain location=116-327; Score =78.4; E_value=2.3e-20; Accession=PF00069.15; Description=Protein kinase domain
  Pfam annotation: Domain name=Pkinase_Tyr; Domain location=116-327; Score=46.6; E_value=2.5e-15; Accession=PF07714.7; Description =Protein tyrosine kinase
  Pfam module annotation: Pfam domain module=Pkinase::Pkinase_Tyr; Domain location=116-327::116-327
MKEKLDSPVTVLEDYFRSSDSESSSSKEPSADSESQELSKPASRWHSFIQLLRSGSKKQMNNTLHPLSVLKLSKRMSTSMRESILPICLLDATASPCRSPWKIFTHHEIQVATNSFSQENLIGKGGYAEVYKGCLPNRQLVAIKRLTRGTADEIIGDFLSELGVMAHVNHTNTAKLVGYGVDGGMYLVLELSEKGSLASVLYGSKEKLPWCIRHKIALGTAKGILYLHEGCQRRIIHRDIKAANILLTKDFEPQICDFGLAKWLPENWTHHTVSKFEGTFGYLAPEYLLHGIVDEKTDVFAFGVLLLELVSGRRALDYSQQSLVLWV

SEQ ID NO: 171824 - protein, 629 aa, Glycine max
  Coding DNA Sequence Number=SeqID_55046
  Gene Ontology: Mol. function=protein serine/threonine kinase activity; Cellular component=membrane; Biological process=protein amino acid phosphorylation
  Homolog annotation: Hit_ID=Q8LI83; Match level="QueryCoverage=92%, HitCoverage=92%, E-value=1e-148, Identity=49%"; Hit description =Receptor protein kinase PERK1-like protein
  Pfam annotation: Domain name=Pkinase; Domain location=286-560; Score =132.0; E_value=1.7e-36; Accession=PF00069.15; Description=Protein kinase domain
  Pfam annotation: Domain name=Pkinase_Tyr; Domain location=286-560; Score=83.0; E_value=9.5e-22; Accession=PF07714.7; Description =Protein tyrosine kinase
  Pfam module annotation: Pfam domain module=Pkinase::Pkinase_Tyr; Domain location=286-560::286-560
  Subcellular localization annotation: CTP_CleavageSite=45; ConfidenceScore=5.25e-01
MSSLIHLFLFFFFFLCLSHSSLCDTCPLNFTILGRTKPTSFDTSRCQVISQALRLVQSDYLRRSGFFLPPLNASDTCWTHFQSYVNNFDQTYNITTSCGFKTSWISQGCNNVTTKQDFESLVPQSALQNMRNNCNQSLENNSPCALCTTSFSTLPPLGDSVGNLTYCTKYASIYAAAFANRFGPSDPGTAKCLFSLQFSSNNNNNSSSSSKRKKVVIAVVSVVGVLVVLLLVLGVWVYCKLEDKVAGDKDVRVAEIGLVSGLDSMEQSTTLIRFTFDDIKKATKNFSRDNIVGRGGYGNVYKGLLPDGSEVAFKRFKNCSASGDASFTHEVEVIASVRHVNLVALRGYCSVTTRLEGYQRIIVCDMVKNGSLHDHLFGSNGVKLSWPIRQKIALGTARGLAYLHYGAQPAIIHRDIKASNILLDDKFEAKVADFGLAKFNPEGMTHMSTRVAGTMGYVAPEYALYGQLTERSDVFSFGVVLLELLSGRKALQMNNDGQPSSLTDWAWSLVRTGKALDVIEDGMPQSGSEHVLEKYVLIAVLCSHPQLYARPTMDQVVKMMETDESVPSIPERPIPLVAGRLDIERSVSSSGSGQLSSPTGYRSYTIESDRQSSNSRDERSSSSRILSTD

SEQ ID NO: 171825 - protein, 76 aa, Glycine max
  Coding DNA Sequence Number=SeqID_55047
MPFWSSNVGFGSAGAMENRAALKVATRMAAANWPPETAEEAAEVLVEELEHGREVGMDFVSGRKTKKENSGFEGKS

SEQ ID NO: 171826 - protein, 275 aa, Glycine max
  Coding DNA Sequence Number=SeqID_55048
  Gene Ontology: Mol. function=endonuclease activity
  Homolog annotation: Hit_ID=Q9ZU86; Match level="QueryCoverage=77%, HitCoverage=44%, E-value=2e-49, Identity=54%"; Hit description =Expressed protein
MFKLLNKNLRRLLRRLRWPIRRRSKPKVVVINKLGKNAPKAQTEASTNFSAAVHPNAQLGTPKPIRVATFNAALFSMAPALPKPTFEDQNGIASKNPENLNSRSRSTKERPRSILKQSQSVKNRVNDSDNVTRLAKSKMRVSINLPDNEISLLRSRQSSFSEHDKASSWWGGGGVHVSNRTVVEVLKEVDADVLGLQDVKAEEENGMKPLSDLAAALGMNYVFAESWAPEYGNAVLSKWPIKRWNSHKIFDHTDFSLLVCLNVEFGSVISGIEYD

SEQ ID NO: 171827 - protein, 498 aa, Glycine max
  Coding DNA Sequence Number=SeqID_55049
MQVEKMKSEMLNLQIQLLGMNTSTNCIDGFSHSNEGLRRRRSVSLASNNDIGIPDKEDQVLGRLDHTIREDSVYPINLHEPSACTNVESPLTEDYMKHSVDSPFCEITEIDIDTSSSDSGKKEKFKGQAKENPLKSAVQLIGDGVSQVQFIGNQAVNNLVSFLNISQEDSDSNEHTNIEDRIYDEMESQKTRHIYMDRSSSVQSDKSSDAASLQLGRIFRYIWHQMRSNNDVVCYFCFVLVFLWNFSLLSMVYLGALFFSITPKDGEWMSSTDFKFKRNDLHAKDDHTSYNWQGRARDLLNQMIIMVSMDVNFWPEDGIQPERIESGINQVLRIVHNDKCKAKNPNLCSFASRVNVQSIERSQEKPNVALVVFEVVYASPVIDCSSTEWNKSLTPASDVAKEILKAQRAGFVEEMGFPYRILSVIGGGKREIDLYAYIFCADLIVFFLVAIFYQSVIKNKSEFLEVYQLEDQFPKEYVFMLMLKLMELLVPDVVLEVL

SEQ ID NO: 171828 - protein, 317 aa, Glycine max
  Coding DNA Sequence Number=SeqID_55050
  Homolog annotation: Hit_ID=Q6AVA9; Match level="QueryCoverage=45%, HitCoverage=92%, E-value=1e-35, Identity=46%"; Hit description =Putative methyl-binding domain protein
  Pfam annotation: Domain name=MBD; Domain location=221-294; Score =64.5; E_value=3.5e-16; Accession=PF01429.10; Description=Methyl-CpG binding domain
  Pfam annotation: Domain name=zf-CW; Domain location=165-214; Score =64.1; E_value=4.5e-16; Accession=PF07496.5; Description=CW-type Zinc Finger
  Pfam module annotation: Pfam domain module=MBD::zf-CW; Domain location=221-294::165-214
MVKYGREKREVTYVNNMKGGQEISKTPSSSKLGVQMRERCDGTLETSGYHTYLYLFQDGLPRLGLEGDDGARRCILYSGSGRLVDIQPDRQVIGFGSPIYHWAQPNDDQRVVCCCSAVVLICGGSRVSDMSEDAPVEIKLFGRTVHNPQALSLKGMKLVEGSVDIYAAQCKNCLKWREIDTQEEFEEIRSKVAEEPFLCSRKANSSCDEPGDIKYDSSRTWVIDKPNLPKTPQGFKRSLVLRKDYSKLDAYYITPAGKKLRTRNEIAAFLKDNPEFKGVSASDFDFSSPKIMQDTIPEVVEQKDSANKKVKIAKDEV

SEQ ID NO: 171829 - protein, 188 aa, Glycine max
  Coding DNA Sequence Number=SeqID_55051
  Gene Ontology: Mol. function=DNA binding; Cellular component=nucleus; Biological process=regulation of transcription, DNA-dependent
  Homolog annotation: Hit_ID=Q1S7P2; Match level="QueryCoverage=92%, HitCoverage=100%, E-value=2e-26, Identity=53%"; Hit description=SBP
  Pfam annotation: Domain name=SBP; Domain location=64-136; Score=52.1; E_value=1.9e-12; Accession=PF03110.5; Description=SBP domain
MDTSRYEGKRVLRYKEEDENDDDEEEEEVSEVGFGEDRRRNKRVMRDLHGKRSGSKGGGSMPPSCQVDNCDADLSEAKQYHRRHKVCEYHAKAPSVHMAGLQQRKLETNDGIDVLKANNPITTTFLTNKRIYCSPLQKIIRDSMSYQNLMTQRGVVERGWLGIMRDVAKMQLTTMENDFFYGMDINNH

SEQ ID NO: 171830 - protein, 363 aa, Glycine max
  Coding DNA Sequence Number=SeqID_55052
  Gene Ontology: Cellular component=integral to membrane
  Homolog annotation: Hit_ID=Q017L1; Match level="QueryCoverage=86%, HitCoverage=13%, E-value=2e-24, Identity=27%"; Hit description=[S] KOG1893 Uncharacterized conserved protein
MTKCCNGICLFFVLICVIWAPMLKFLYQKIQKCKKCARIKLKECEKFVKKWLMYSSGNPTNIANPIKDASFQVDIKTASGRLNLYQTTLCERLQWDLLNSNINPDPYGYLGAYNKNDIQLICCQADASTLWLVPLVVRTRLIQSLEWNIDMEIFSTWILSRDRPKGKEIVKYEKAVDPQYLPTRSDVQKVLNGSMNSFSIYNVYPRYFRVTGSGDVRPLEEDNAVSADLIINREQLEWWAFRDTNPSNLSRLCGGLTGPMAIIVSEETPPQGILGDTLSKFSIWGLYITFVLAVGRFIRLQCADLRMRIPYENLPSCDRLIAICEDIYAARAEGELGIEEVLYWTLVKIYRSPHMLLEYTKPD

SEQ ID NO: 171831 - protein, 397 aa, Glycine max
  Coding DNA Sequence Number=SeqID_55053
  Gene Ontology: Mol. function=oxidoreductase activity
  Homolog annotation: Hit_ID=Q10PC8; Match level="QueryCoverage=52%, HitCoverage=29%, E-value=1e-28, Identity=34%"; Hit description =Hydroxyproline-rich glycoprotein family protein, putative, expressed
  Pfam annotation: Domain name=2OG-FeII_Oxy; Domain location=181-276; Score=20.7; E_value=0.0011; Accession=PF03171.10; Description=2OG -Fe(II) oxygenase superfamily
MVKLNIYAETVSRRLVIIHLTYLGSQEMQASPTNVNICSNHEQCEGRSSQFKLTKGFTAKESENVVKGLKLYEDIFTDSELCKLTDFVNEIHAAGQNGELSGETFILFNKQMKGNKRELIQLGVPIFGQIKEDAKCNIEPIPALLQGVIDHLIQWQLLPEYKRPNGCIINFFEEVNITYLILSRLLFNFYLGEFSQPFLKPPHLDQPVSTLLLSESTMAFGRILMSENDGNYKGPLTLSLKQGSLLVMRGNSADMARHVMCPSPNRRVSITFFRVRPDSNQCQSPTPTTMTSAMTVWQPGIAASPYALPNGALTSYEGMDMNMMPKWGMLRAPMVMLTPMRPVALNPHKLSGGGTGVFLPWNVPSRKPAKHLPPRAQKGRLLTLPSPVEPQMGESTS

SEQ ID NO: 171832 - protein, 869 aa, Glycine max
  Coding DNA Sequence Number=SeqID_55054
MRQALILLCEIHFSLLYVLQINLISTALEKKGSLSMEIVMQLGLRNEDSAWDFLEVALLACFCAIHNHGFEMLFSFSAIIQHAPSPPIGFGILKAGLNKSVLLSVYSSSSVRNSDESLSYERRIASYLSAIGQKFLSIYRSCGSHVAFVTILLTVYMVRPNYISFGYIFLLLLWIIGRQLVERTKRQLWLPLKVYAILVFIFIYSLSSFSSLEMWLSKLIDLYLYLGYDSKASSFDNVWESLAVLIVMQLYSYERRKNKQNRQDHLDQLEPGALGFIRRFIIWHSQKILFIALFYASLNSISAFGFLYLIGLIFCSILPKTSSIPSKSFLAYTGFLVTAEYLFQMWGKQAKMFPGQKYSDISLFLGFHVFQPGFWGLESGLRGKVLVIVACTLQYNVFHWLERMPNTVLSKGQWEEPCPLFVPTEDAFIDDAKCNEESKSSYNSQLPSAIKEGVSGNSLQIITSGLSQAPDTPSSKTEGSSDSSSKKYSFGFIWGSSKESHKWNKKRIVALRKERFETQKTVLKVYLKFWMENTFNLFGLEINMISLLLVSFALLNALSMLYIALLAACVLLNRHIIRKVWPIFVFLFASILILEYLAIWKDMLPLNSHASSEIRCRDCWKTSTLHFSYCKKCWLGLIVDDPRMLISYFVVFMLACFKLRADRLPSFSGSSTYRQIMSQRRNTFVWRDLSFETKSMWTFVDYLRLYCYCHLLDLVLILILITGTLEYDILHLGYLAFALIFFRMRLEILKKKNKIFKFLRIYNFAVIITSLAYQSPFIGGLSAGKCETVNDIYEMIGFYKYDYGFRITARSAIVEIIIFVLVSLQSYMFSSQEFDYVCRYLEAEQIGAIVREQEKKAAWKLHNCNKFVK

SEQ ID NO: 171833 - protein, 148 aa, Glycine max
  Coding DNA Sequence Number=SeqID_55055
  Gene Ontology: Mol. function=protein dimerization activity
  Homolog annotation: Hit_ID=Q1S735; Match level="QueryCoverage=99%, HitCoverage=54%, E-value=6e-27, Identity=56%"; Hit description =Probable transposase [imported]-Arabidopsis thaliana-related
  Pfam annotation: Domain name=DUF659; Domain location=10-100; Score= -49.2; E_value=0.0022; Accession=PF04937.6; Description=Protein of unknown function (DUF 659)
MPRTTPRAQPSLKSVLQNKKVEEKCDKAIAKWMIDASVSFNAVNSIYYQPIIDVISSMGPRLLEKDFSKLYWSPCVAHCINLMLQDFGKFEEHTGERDILCPTPTQFATNFIVLQSILAQNDALRAMVTSRDWTSSTYAKDSKAKKFV

SEQ ID NO: 171834 - protein, 172 aa, Glycine max
  Coding DNA Sequence Number=SeqID_55056
MAAGPTSLSDRSTMVPPPMLVSDSFAKDAILAWFRGEFAAANAIIDALCAHLSSAAASSAHDYDAVFAAIHRRRLNWIPVLQMQKYHSIADVTLELARLADRNHYAAAEDDDAKHETDEKTTPSESVGDGGGGDEHEEYESPESEITDSGMRTTRHKKRKGSGAYGVTVKLG

SEQ ID NO: 171835 - protein, 177 aa, Glycine max
  Coding DNA Sequence Number=SeqID_55057
MDLLKDTMMMGCRPAETPIDPNKKLGSEDKGDPFDMAWILRYLKSAPGKGLCFKKIGQQGIKEGQSCTSRRMNKYHHRDINSILKEKFTYIESIYYKSIHVKKVLILHSSIKENHVHKTSTIKVFEDFKLTSSGSERQRVATNVASNTEEDDCRCDEDDDAEVTWSYDRDEDATDVR

SEQ ID NO: 171836 - protein, 207 aa, Glycine max
  Coding DNA Sequence Number=SeqID_55058
  Gene Ontology: Mol. function=methyltransferase activity; Cellular component=cellulose and pectin-containing cell wall
  Homolog annotation: Hit_ID=Q9SIZ3; Match level="QueryCoverage=73%, HitCoverage=25%, E-value=2e-44, Identity=54%"; Hit description =Expressed protein
  Pfam annotation: Domain name=DUF248; Domain location=92-207; Score= -293.3; E_value=4.3e-08; Accession=PF03141.7; Description=Putative methyltransferase
MAISVESLLKERKYPFIFTFMVLLICFTILTFTSTSTSTLDPIGFYPDVKPQPLAHFSSPSPKRQRLPLKGEPFLVDATIDWKPCKGPLAMDYIPCLDNFKAIKALKKRRHMEHRERHCPHSSPHCLVPLPKGYKVPLPWPKSRDMIWYDNVPHTKLVEYKKEQNWVVKSGDYLVFPGGGTQFKEGVNHYIKFIEKVCIKGQYRLLN

SEQ ID NO: 171837 - protein, 107 aa, Glycine max
  Coding DNA Sequence Number=SeqID_55059
MVEKGVMWWVRRRRRQKSIHSKSLCDSVLGQKRSAAPKPQFLLSKAPPMNAAAFAKLAAGNALFQAAAGILRRGEAPLLPGGLLQGAQKMTVGENKMSALDMNDGVE

SEQ ID NO: 171838 - protein, 96 aa, Glycine max
  Coding DNA Sequence Number=SeqID_55060
TAEKEEWEGVAEEAEVGVGAVLPCAVMALLREAATAAVGCCESPVGKVELDEEAVEEIDSTRGAVWARLGFKKKQEVLQPRLGLEEGKMVQRERRS

SEQ ID NO: 171839 - protein, 47 aa, Glycine max
  Coding DNA Sequence Number=SeqID_55061
MKYFMLVASPTAQHIMFEVSIGKVVDFASNIVRFVGTRCKRFNVQKS

SEQ ID NO: 171840 - protein, 237 aa, Glycine max
  Coding DNA Sequence Number=SeqID_55062
  Homolog annotation: Hit_ID=Q1RSI8; Match level="QueryCoverage=94%, HitCoverage=53%, E-value=2e-53, Identity=53%"; Hit description=IMP dehydrogenase/GMP reductase
MMQKLCLIASHGCPPGLTLQQELAMVGCTITKGCQPLLPSSVLKPEIIRYGSPLNPFEESSKSRKEWFNSNQIVNVNLSTQRPMLIDVQETYPSPVDFGFGIIERCSEHDKILQCIMSESAEAGIGGVHISLLSDLMDLQLSSIDEPQKPLTPLIPKSKFFIPKLLLDIFQDSPISSKITVHPDGQVTFMDTAIEIKDLLSVVADSYLLRKGEKQSMLVPHFSRYKFVDLFKSQLIT

SEQ ID NO: 171841 - protein, 703 aa, Glycine max
  Coding DNA Sequence Number=SeqID_55063
  Gene Ontology: Mol. function=protein binding
  Homolog annotation: Hit_ID=Q8H3E5; Match level="QueryCoverage=52%, HitCoverage=85%, E-value=1e-167, Identity=76%"; Hit description =Putative zinc finger POZ domain protein
  Pfam annotation: Domain name=BTB; Domain location=200-319; Score =104.2; E_value=3.9e-28; Accession=PF00651.21; Description=BTBPOZ domain
  Pfam annotation: Domain name=MATH; Domain location=47-176; Score =64.6; E_value=3.2e-16; Accession=PF00917.16; Description=MATH domain
  Pfam module annotation: Pfam domain module=BTB::MATH; Domain location= 200-319::47-176
  Subcellular localization annotation: CTP_CleavageSite=40; ConfidenceScore=5.56e-01
MGKILRETARPFSNCSSSSASPLSAPPATTSSTSLTDTVRGSHRFKITGYSLSKGIGIGKYIASDIFSVGGYDWAIYFYPDGKSVEDNATYVSLFIALASEGTDVRALFELTLLDQSGKERHKVHSHFERTLESGPYTLKYRGSMWGYKRFFKRTALETSDYLKDDCLSVNCSVGVVKSHTEGPKIYKIPIPSSNMGQQFGKLLESGKDSDVSFEVNGEIFAAHKLVLAARSPVFRAQLFGPMKNQNTHCIKVEDMEAPVFKALLHVIYWDSLPDMQELTGLSSKWATTLMAQHLLAAADRYGLERLRLMCETSLCEDVAINTVATTLALAEQHHCFQLKAVCLKFVARPENLRAVMQTDGFEYLKESCPSVLTELLEYVARFTEHSDFLCKHRNELILDGSDVNGRRATDSNSIPSFIFTSRSLGVLRRCVKEEKEEEQLLEGMPKEYYDDEWQAQQREKTKELHRLRIQEEEEEERKIGEYREIGMRLKEYPEDDVIKARKLVSSFLRAAEEVEERIEEAAEKGELTELVLMVIWNRLDLARRDEEKDAIRSLDLLYRRVETEILKREATPAMRLLNDLLIMYDGYNFEEWLKKCKKVMIDTFPREDPFSILVPPGFESFDIDKHHGPLRPSLEVDNTLLRVDFVREVDELLQEVHSEESEVQNEPGFDPESVANRLKQQEKQQTIRQVEALLDLAIGLKW

SEQ ID NO: 171842 - protein, 186 aa, Glycine max
  Coding DNA Sequence Number=SeqID_55064
  Gene Ontology: Mol. function=ion transporter activity; Cellular component=integral to membrane; Biological process=ion transport
  Homolog annotation: Hit_ID=Q6ZF47; Match level="QueryCoverage=72%, HitCoverage=21%, E-value=1e-15, Identity=38%"; Hit description =Putative organic cation transporter
  Subcellular localization annotation: CTP_CleavageSite=28; ConfidenceScore=5.15e-01
MGWDRPMQASIISKFRLKCSSSFVMGLLAFMFFAVRPDRTRGELGWLIRFELSLTGLVGGLVLVTMVDSSFSRKNMLFFSCLIVSISSFLATFSANVWIYSVLKFLNRFGRGNVGTAALVLVAELFTKGWRGKLSVAVPRWLCVCEDSNECLLTIREPRKGDEKSMKELGPVELISYALVYFGAKR

SEQ ID NO: 171843 - protein, 535 aa, Glycine max
  Coding DNA Sequence Number=SeqID_55065
  Gene Ontology: Mol. function=zinc ion binding
  Homolog annotation: Hit_ID=Q1RSJ8; Match level="QueryCoverage=57%, HitCoverage=87%, E-value=1e-126, Identity=74%"; Hit description=Zinc finger, RING-type
MDRMSINEVEVRSLSSTLDIHSTLTVPLKSPEKVKVKPSQKKNKKVARERDLFKKNYLHACESLLSLMVDKRRHRKTAILSLKKSGPELPELLTQFSASIAGTGLAVLLSVICKLACGRGVPFCAYKLLNTGFGFGLVWLSWAVNKLRDTIVCMNKNAGKLGLKDEEMIQKVDKSLREVYFRAAALLAVAHKIVDDWLDQHLGGVLTVWLVPHFNNQSKEHTRLLGTRAMIPWGGLSCCLSAAALYLLGRSSGRDAEILKSVTRVNQLKELAQLLDAEILPLIVTISGRVSSETPINCEFSGLRGVIVEETAEQHFLKHNDAGSWIQDSALMLSMSKEVPWYLDDGTDRVHVVGARGASGFALPVGIEAFEESGRSLVRGTLDYLQGLKMLGVKRIERVLPVGTSLTVVGEAAKDDVGAIRIQRPHKGPFYVSPKTIDQLIANLGKWARWYKYASVGLTVFGAYLIAKHAIRYILERRRRSELQRRVLAAAAKKSGQNNDVEKADSLSDGAKKDRLMPDLCVICLEQEYNAVFVP

SEQ ID NO: 171844 - protein, 53 aa, Glycine max
  Coding DNA Sequence Number=SeqID_55066
  Gene Ontology: Mol. function=hydrolase activity, acting on ester bonds; Biological process=lipid metabolic process
  Homolog annotation: Hit_ID=Q1SQ99; Match level="QueryCoverage=87%, HitCoverage=13%, E-value=2e-09, Identity=57%"; Hit description =Lipolytic enzyme, G-D-S-L
MDERERGSNDYLNNYFLPEHHPSSRTYSPEQYDVALVQEYARNLKDLHALGTR

SEQ ID NO: 171845 - protein, 501 aa, Glycine max
  Coding DNA Sequence Number=SeqID_55067
  Homolog annotation: Hit_ID=Q1S7H5; Match level="QueryCoverage=94%, HitCoverage=34%, E-value=1e-148, Identity=61%"; Hit description =PWWP; Regulation of nuclear pre-mRNA protein
MNCGFILKLLYSLLAFFWFPSFCNPADVEAFTEEKKQSILGKHHGKGAEFGRAVKEIIEVFEKLKKETQLDETGSGGDVANADVSNPVNSSAKYQTNAPELAHTLPMNSLNSIINKHEVVCAAEDDSATVLKDESHNKEALLGKPADKMAVVKSPKPVTYSSRKRSMGDLCLQGCVTHRHTSVRRSRNSSRAQNCVLPCNDSGKSAGNPSTTAAQSVCAQRNRNVRKSPDLSGCDNFESSTFVSNGSIDDNSSEIITTDSDTFSLNEGSTMDSNFKLELSEAIECPEVELNKGLNLEIKPVVNKKKRKPNRKRAANDASKPISRPEEETGVQNASQSSQNMCGNSKERCFEQDGDEHLPLVKRARVRMGKSSVEAELHSTLQCLEKNCKENTNSVQQMITPSNCENNSPADGDSSVLNGALDDVSPKISVPCSNTQICNTKKDQTFSSVDVEAALPPSKRLHRALEAMSANAAEGQAHLEASSSMISSSGMCCISDVKRCP

SEQ ID NO: 171846 - protein, 800 aa, Glycine max
  Coding DNA Sequence Number=SeqID_55068
  Homolog annotation: Hit_ID=Q1S7H5; Match level="QueryCoverage=97%, HitCoverage=57%, E-value=0.0, Identity=58%"; Hit description=PWWP; Regulation of nuclear pre-mRNA protein
  Pfam annotation: Domain name=Extensin_2; Domain location=494-790; Score=-137.6; E_value=0.063; Accession=PF04554.4; Description =Extensin-like region
MIFTENKSPIQVGKQLTMIQHESDKDVLPGATDQVGEELSDHTICQTAKVDLKIQSNGQISSNLGSKCCYVGSIQDSPDPSLPANSEDNIRTVNDSNTASDASEHNGISLDPVICVDKNDAFSPHNVDVLQNEGAVCEDAECLKPAVVEIGTSNDMRDIVKEVKCKGPEQDMNSVSTSDDCLGEKGILDIRSSPSLSDGGDCVPQSSPPTTSVCNVSTSDSSNILHNGSCSPDVHLHQKQIVCGPVDGSKDGDVAIQQSICMGKSTEAGRAALLYFEAMLGTLTRTKESIGRATRIAIDCAKFGIADKAMYVEYIHLLSKLSFHDYYLLLLLLEILAKKTVGSVSRQVLRLWLERRILPESIIRRHIRELDLYSSSGGIYLRRSMRTERALDDPVREMEGMLVDEYGSNSTFQLPGFCMPQMLKDEDDGEGSDSDGGNFEAVTPEHTSEIYEITSAIEKHRHILEDVDGELEMEDVAPSNEVEMNSICNVDRENAKQCEKNLPLFFAPLHQDMRSSSPPPLSFLPPPPPPSIPHHMPSTSDPYNTVVNSKGCTVSQHQVANNSWFTLSFLSTRAHLQTLKENHHPLHSVAQLMAAPRHSQPICDAVHHQVPEYREMQMHMPESTCSFNSFPVPPPENFRHTDGVTTHNKGYSIRPPQHVPCNQFSFVNGEQHVKHRREVPPPLPYSSRQHFVQNIERENFYNNHERLRPPPYDYQERWNGPAPYPGPWYQEKGVPPPYGCHPCESSRIPDHGWRFPPQSMNQRNSMPFRPPFEDAIPVSNRGAFPLTPHFFFYCEKFLVG

SEQ ID NO: 171847 - protein, 69 aa, Glycine max
  Coding DNA Sequence Number=SeqID_55069
MTMPRTRKPIQVSSLFPTRKIRKECCTWAGSRDRKLIARDTRVPAMISARHVRSTTTTTWFCFEPTQYT

SEQ ID NO: 171848 - protein, 319 aa, Glycine max
  Coding DNA Sequence Number=SeqID_55070
  Gene Ontology: Mol. function=tRNA isopentenyltransferase activity; Cellular component=mitochondrion; Biological process=tRNA processing
  Homolog annotation: Hit_ID=Q1W5W3; Match level="QueryCoverage=95%, HitCoverage=91%, E-value=1e-115, Identity=71%"; Hit description =Adenylate isopentenyltransferase
  Pfam annotation: Domain name=IPPT; Domain location=41-240; Score =25.1; E_value=1.4e-12; Accession=PF01715.8; Description=IPP transferase
  Pfam annotation: Domain name=IPT; Domain location=7-232; Score= -142.6; E_value=0.077; Accession=PF01745.7; Description=Isopentenyl transferase
  Pfam module annotation: Pfam domain module=IPPT::IPT; Domain location= 41-240::7-232
MRQIEKEKIVVVMGATGAGKSRLSIDLATCFPSEIINSDKIQVYEGLDIVTNKISKEDQRGVPHHLLGIINPNMDFSANDFCDTSSEIIASITRSERLPIIVGGSNSYLEALIDDDDYKCRSRFDFLCLWVDVAMPDLQSYVAERVDDMLYNGMVDELRPFYSPNGDYSRGVRRAIGVPEFDEYFRREEEVVDEETRTRLLEEAVKEMKLNTCKLAMKQLGKIRRLRNVKRWEIHRLDATPVFRRRGEEANEAWKKLVAEPSAMIVARFLYNSNSKNNATNVVSGSGLRVKPATSSETVLAAATWLASFLGVVLVGKDL

SEQ ID NO: 171849 - protein, 127 aa, Glycine max
  Coding DNA Sequence Number=SeqID_55071
MGEVFQTSSAAEDKALHNLEMHCVTLVLARVKKLSIIMCNCLEVNELAIVPYQPMTRDRVPLTIHYIGQNANAQRLQSSLMSLQVGCKNYCLLENLPLSEKAEGFELFLGCLRAVHLVLLGFWSQAT

SEQ ID NO: 171850 - protein, 103 aa, Glycine max
  Coding DNA Sequence Number=SeqID_55072
MIDGMINSVNGNEEGIRWNGGVDLDFLATSYPDNKHKSVRLAQVGAKGRWVNKAIWQDVKAEERVVTAEATYLQVCSVYQEVHDISRASIIHAFVHMHHDTNY

SEQ ID NO: 171851 - protein, 78 aa, Glycine max
  Coding DNA Sequence Number=SeqID_55073
MAVQANDVKGSWFCELLSTSSKIYSENLGDVNERCGIIDDPIVPTKRRDKPNKILIMGLKQPEILMDPNHQFKKKYSD

SEQ ID NO: 171852 - protein, 533 aa, Glycine max
  Coding DNA Sequence Number=SeqID_55074
  Homolog annotation: Hit_ID=Q1S7H9; Match level="QueryCoverage=47%, HitCoverage=94%, E-value=3e-21, Identity=37%"; Hit description=UBA -like
MYYVDPRLLRAVAIEHPKDADLAAGIVLAEVIPFMSKKLPAAIPPQHNDHGAPLDVEVESEEEGNRLRHCQRVDDVNVGPSSTLSNGCNSKDDTEKFLGMDDIKELDIFQNAEDNFIGETLNEIAQEMSNGFIQEEDNENFERQPVDFDCENLISSADDYDVTPSHRLEECETYLIELESSEAQEVCHVQGDTLNSKDSLQSELDAGSSTAGGNTSDVENDNGAKSAGSQYSQVSRIDLLEEIIDEAKTNKKTLFSSMESLINLMREVEVQEKAAEQANMEAATGGSNILARIEEYKTMLVQAKEANDMHAGEVYGEKAILATELKELQSRLLGLSDERDKSLAILDEMRHILEERLAAAEESRKAAEQQKLEKEESARKALVEQERLVEMVVHESQRLQQEAEENSKLQEFLIDRGRVVDMLQGEISVICQDIKLLKEKFDANLPLSKSFTSSQTSCKLASSGSSHKTLASDAGSDHSESSGIRKTSWTTSIESLSSKIGHDEEKSKADHNALLDDGWDIFEKDAELNSGVC

SEQ ID NO: 171853 - protein, 178 aa, Glycine max
  Coding DNA Sequence Number=SeqID_55075
  Homolog annotation: Hit_ID=Q2RAL5; Match level="QueryCoverage=96%, HitCoverage=64%, E-value=6e-41, Identity=49%"; Hit description =Expressed protein
MVLHRELDHLFSSPFVDPPKDDAKSSGMSIEKKIEFLESLTGKVTNRRSRRWLNDRLLMELVPRLNAEEIRGLFAPPPWGDEVPPSTFSMTNMEEWDRFRNIDMDKEGLRAWYCNHDIIPLVNIIHSLENSIEKRKGHIDADKMAVLNGWHRIDCRTRDALRRSCLSELIEGYEVYIC

SEQ ID NO: 171854 - protein, 141 aa, Glycine max
  Coding DNA Sequence Number=SeqID_55076
MKRVKIFILITLALTFVAFVPKIESQIMPPLIPFPPPSLHPLCLSQLALVSYACAMLPPTTTLPPSPLTPPPSPSSPGDDEGHGNDQSQGHHQTSQEENCCRTQSALENRVMSLTRAVEVMVIVSDSLCHRVLETKCAVAL

SEQ ID NO: 171855 - protein, 127 aa, Glycine max
  Coding DNA Sequence Number=SeqID_55077
  Subcellular localization annotation: CTP_CleavageSite=30; ConfidenceScore=5.20e-01
MEQSKITFPRNFEFKPNCSKCKKIVKTVFSTMMGSVTSVKVEGEGDVGVKLTVTSTMSPDVFAAIIANITKENSHKITSTTSPDMQLDAILGKTAKENSHKDKAQASNANQEENNNIEVSYGQNKFK

SEQ ID NO: 171856 - protein, 35 aa, Glycine max
  Coding DNA Sequence Number=SeqID_55078
MESASIVMYCNGDMIPSYKGTHSTTKLIVRTCRLM

SEQ ID NO: 171857 - protein, 584 aa, Glycine max
  Coding DNA Sequence Number=SeqID_55079
  Gene Ontology: Mol. function=inorganic phosphate transporter activity; Cellular component=integral to membrane; Biological process=phosphate transport
  Homolog annotation: Hit_ID=Q1JUJ0; Match level="QueryCoverage=84%, HitCoverage=96%, E-value=0.0, Identity=76%"; Hit description =Putative phosphate transporter
  Pfam annotation: Domain name=MFS_1; Domain location=28-462; Score =75.6; E_value=1.6e-19; Accession=PF07690.6; Description=Major Facilitator Superfamily
  Pfam annotation: Domain name=Sugar_tr; Domain location=23-504; Score =118.1; E_value=2.5e-32; Accession=PF00083.14; Description=Sugar (and other) transporter
  Pfam module annotation: Pfam domain module=MFS_1::Sugar_tr; Domain location=28-462::23-504
MARDQLQVLNALDVAKTQWYHFTAIVIAGMGFFTDAYDLFCISLVTKLLGRIYYFEGHDKPGSLPSNVSAAINGVAFCGTLAGQLFFGWLGDKMGRKRVYGMTLMLMVICSIASGLSFGKDPKAVMATLCFFRFWLGFGIGGDYPLSATIMSEYANKKTRGAFIAAVFAMQGFGILAGGTVAIVVSSAFKALYPAPAFQVNPVLSTVPQADYVWRIILMFGALPALLTYYWRMKMPETARYTALVAKNAKQAAADMSKVLQVEIEAEQEKVEQLDTRKGNEFGLFTKQFLRRHGLHLLGTAVTWFLLDIAYYSQNLFQKDIFSTIGWIPEAKTMNAIEEVFKIARAQTLIALCSTVPGYWFTVALIDKMGRFTIQLMGFFFMTVFMFALAIPYHHWTMKGNQIGFVVLYSLTFFFANFGPNATTFVVPAEIFPARLRSTCHGISAAAGKAGAMVGAFGYLYTQNAIGLRNTLIVLGVVNFLGLLFTFLVPESKGKSLEEMSGEAEEETTAATRESAMEAGLEVSVFLLVLTFSFALYNCFRIKQSGPIVDFYSFKVAIKELEDKAQLTTLRLKPKLSYSHFCSL

SEQ ID NO: 171858 - protein, 418 aa, Glycine max
  Coding DNA Sequence Number=SeqID_55080
  Gene Ontology: Mol. function=RNA-directed DNA polymerase activity; Cellular component=extracellular region; Biological process=RNA -dependent DNA replication
MPKKENPSSMRDLRPISLCNVLYKILSKVFANRLIPLLHKCISQEQSAFVENSSILDNALVGMETIHHMKCKSKGKRGEVVLKVDMSKAFDRVEWGYLKGIMLKLGLCQQWVNWVTMFIFPNQWTEAKGDIHGIQVCKRVPIITHLLFANDYILFFRAEEKEGKCLKEILEVYEKTSDQVVNLAKSELYFSKNTSSVIRDRLVVVLGVSKYLGTGRYLGLPSMIGRKKKAMFNYLKDCIWKKVQSWSGDAENDQLVLVGTNRINGRGINWDKLAVRNYWTIAGLWDDIQELMDNADGFVDFFLLAYLTSWLCGYGLSSGGETIWFGKEKISLHSCWLTKPTMSSPSGILLSEKICSCKIELWRQVALVETIKGEFKYNIDATVNSDQQRYGMGNCVRNDKGEFVFGKNLLGSGLHSVD

SEQ ID NO: 171859 - protein, 297 aa, Glycine max
  Coding DNA Sequence Number=SeqID_55081
  Gene Ontology: Mol. function=pepsin A activity; Biological process =proteolysis
  Homolog annotation: Hit_ID=Q1S7J2; Match level="QueryCoverage=83%, HitCoverage=57%, E-value=7e-96, Identity=72%"; Hit description =Peptidase aspartic, catalytic
  Subcellular localization annotation: CTP_CleavageSite=12; ConfidenceScore=5.07e-01
NTCGVIPDNTVTGTATSGELAEDVVSLQSTNGFNPKQNATVSRFLFACAPTFLLQGLATDVSGMAGLGRTKIALPSQFASAFSFRRKFAVCLSSSNGVAFFGDGPYVLLPNVDASQLLTFTPLLLNPVSTASAFALGEPSAEYFIGVKSIKIDEKSVRVNTTLLSINSSGVGGTKISSVNPYTVLEASIFKAVTEAFVKASAARNITRVASVAPFEVCFSSENVVATRLGAAVPTIELVLQNQKTVWRIYIWSKLDALRSMLTTPMEDTSLMTSSESIQPYPTPTWHDFIAIAPTPH

SEQ ID NO: 171860 - protein, 112 aa, Glycine max
  Coding DNA Sequence Number=SeqID_55082
MDCPLWMLWSIECNICGVKIKSAGLAERGSGSGICEGARGITGIFVEEEGGSVEEEGPPVSGAEVEKASDLFLLAFLGPLKVTIGSSRFQQFFLMYAKLMARLKLSKDLESD

SEQ ID NO: 171861 - protein, 81 aa, Glycine max
  Coding DNA Sequence Number=SeqID_55083
MEEFDAQMTWPGDQLSSSGGGRASIAQEPMTEEPPAPAPAEEQATLDQTPQPSPSSAHAPKETHSSALDLNEDQPQEEHDI

SEQ ID NO: 171862 - protein, 71 aa, Glycine max
  Coding DNA Sequence Number=SeqID_55084
MFVITFNTSSYAYNLPPLSYYYRSSLPTQMYDMGYEDEEEDDDNNNNKDDDDDDNDNGHDGDIHDHQQQQQ

SEQ ID NO: 171863 - protein, 100 aa, Glycine max
  Coding DNA Sequence Number=SeqID_55085
MRFMRTLGLSSTALVQSSWSLLFMALVTGSILGRITSLFIGALLLYLYASLIALCPDVLQHKVPLSTSPSHLLPRTQGSRSSQDPNTNSKPGVSYHIPNY

SEQ ID NO: 171864 - protein, 130 aa, Glycine max
  Coding DNA Sequence Number=SeqID_55086
  Homolog annotation: Hit_ID=Q40849; Match level="QueryCoverage=77%, HitCoverage=73%, E-value=4e-07, Identity=30%"; Hit description=EMB24 protein
  Pfam annotation: Domain name=DUF26; Domain location=85-130; Score= -7.4; E_value=0.052; Accession=PF01657.8; Description=Domain of unknown function DUF26
KDHKKMGIPSEIAAVGVVLLWLWSVAVDSVPNTNITVILCNVGAYSSGDPFAVSLSYVVGELETETPTRKNYDYYNISPYPNAFAYGHAACNINLTATDCKTCLGVAKTSVFNGCPKRVGARSVLHDCTI

SEQ ID NO: 171865 - protein, 75 aa, Glycine max
  Coding DNA Sequence Number=SeqID_55087
MKVDKKWLVPKRQRKNTKFKPKNANYNMSQGDNQERQQKTSRKIEFNDSRESIRLKMRETSREMKNLDMVRTFRK

SEQ ID NO: 171866 - protein, 290 aa, Glycine max
  Coding DNA Sequence Number=SeqID_55088
  Gene Ontology: Mol. function=protein serine/threonine kinase activity; Cellular component=nucleus; Biological process=protein amino acid phosphorylation
  Homolog annotation: Hit_ID=Q6ULS3; Match level="QueryCoverage=88%, HitCoverage=100%, E-value=1e-143, Identity=100%"; Hit description =Phosphoenolpyruvate carboxylase kinase 4
  Pfam annotation: Domain name=Pkinase; Domain location=11-260; Score =273.2; E_value=5e-79; Accession=PF00069.15; Description=Protein kinase domain
  Pfam annotation: Domain name=Pkinase_Tyr; Domain location=11-245; Score=-19.4; E_value=2.8e-11; Accession=PF07714.7; Description =Protein tyrosine kinase
  Pfam module annotation: Pfam domain module=Pkinase::Pkinase_Tyr; Domain location=11-260::11-245
EVMSQDLKRDYVVSEEIGRGRFGTVFRCSSADSGHSYAVKSIDKVAITAAGDSLDAQCLLTEPKIVQLLSPHPHIVNLHDLYEDETNLHMVLDLCYESQFHHRVMSEPEAASVMWQLMQAVAHCHRLGVAHRDVKPDNILFDEENRLKLADFGSADTFKEGEPMSGVVGTPHYVAPEVLAGRDYNEKVDVWSAGVVLYQMLAGFLPFRGDSPVEIFEAVLRANLRFPTRVFCSVSPAAKDLLRRMLCKEGTHGLALLNRVSNLMCVEVEENPLFPLWLEDSAEYRVQRSV

SEQ ID NO: 171867 - protein, 254 aa, Glycine max
  Coding DNA Sequence Number=SeqID_55089
  Gene Ontology: Mol. function=malate transporter activity; Biological process=response to aluminum ion
  Homolog annotation: Hit_ID=Q9LS23; Match level="QueryCoverage=77%, HitCoverage=35%, E-value=7e-35, Identity=39%"; Hit description =Arabidopsis thaliana genomic DNA, chromosome 5, BAC clone:F10E10
  Pfam annotation: Domain name=UPF0005; Domain location=53-253; Score =127.1; E_value=4.8e-35; Accession=PF01027.11; Description =Uncharacterised protein family UPF0005
MESTHVISILNGEENVVPRKNDNTFQFSLPPVFSRLRENKVIHQFSLCPITSYLRQKKDTKKIIHSIKVGISLVLISLLYFVDPLYEQVGDNAIWAIMTVVVTFEFFAGATLGKGLNRGIGTVLGGGLGCIAAVLAQNVGNGGVANLIIIGTFVFIFGTFATYCRLFPSVKKRYNYGVMIFILTFNLVVVSGVRIQDQKVWEIARERLLTIVMDFVVCICVSLLVFPYWASDELHDSTVYRFQHLANALQVIVT

SEQ ID NO: 171868 - protein, 157 aa, Glycine max
  Coding DNA Sequence Number=SeqID_55090
MAPKKYETTRILGIKNEGDANKEITQNIVNKLLYDGFQPIASNKQVVNKFLRDYVSNKDKFYIYNVIVEKKVNLREVIFYYWLQAFKDRFNQKKNRKLVPYYMLFSQIMRDVRVDVFGFARSEDSTQLIRSSFAKMVGTLDQPMDLKSAATSQQAQE

SEQ ID NO: 171869 - protein, 123 aa, Glycine max
  Coding DNA Sequence Number=SeqID_55091
  Gene Ontology: Mol. function=oxidoreductase activity; Cellular component=membrane; Biological process=electron transport
  Homolog annotation: Hit_ID=Q8W228; Match level="QueryCoverage=87%, HitCoverage=21%, E-value=4e-31, Identity=56%"; Hit description =Cytochrome P450
MGRENSEGDSQFTGYAIRLNGYFSYNNLVDTFRAPKESTGDEESPNGVGNYCGYVEEGEGIRLGQVGVFGYGYKGKHEAPSSGTVTNATPIEGRLHGWRFFHTKKIKGDSKCMGNYERLKCME

SEQ ID NO: 171870 - protein, 116 aa, Glycine max
  Coding DNA Sequence Number=SeqID_55092
MSLATLFGKLQEHEMELQCLNKNEETDKRKRSIALKASSSMQEEKEEEESDDEKDFSLFVKKFHKFVKKKKSDFYLQRSRHLNHEKEFIQHLVFLKSSLVIDYYNTVIDYSKSGRV

SEQ ID NO: 171871 - protein, 268 aa, Glycine max
  Coding DNA Sequence Number=SeqID_55093
  Gene Ontology: Mol. function=hydroxymethylbilane synthase activity; Cellular component=chloroplast; Biological process=tetrapyrrole biosynthetic process
  Homolog annotation: Hit_ID=UPI000068CFF3; Match level="QueryCoverage =99%, HitCoverage=87%, E-value=1e-60, Identity=47%"; Hit description =porphobilinogen deaminase
  Pfam annotation: Domain name=Porphobil_deam; Domain location=1-175; Score=158.7; E_value=1.6e-44; Accession=PF01379.11; Description =Porphobilinogen deaminase, dipyromethane cofactor binding domain
  Pfam annotation: Domain name=Porphobil_deamC; Domain location=183 -256; Score=54.4; E_value=3.9e-13; Accession=PF03900.6; Description =Porphobilinogen deaminase, C-terminal domain
  Pfam module annotation: Pfam domain module=Porphobil_deam::Porphobil _deamC; Domain location=1-175::183-256
MPILSSGDKNLNQPLYALGITGVFTRDLDTALLNDEIDIAVHSLKDVPTKLPQHTELIAYLERDYPQDVLIRKESAKNKEFHELKLATSSLRRRAFWLKYYPEATFSDIRGNIQTRLQKLEEQDFDATILSLAGIKRMKMDIDYEMLPLMIPAPSQGVIAVAGHSDKKEINEIVRQINHKPTQICVEIERNFLSTLEGGCTAPIGAFAEIFDDQIRFKAALCSLDGKNCIATDENFTYNDSENFGEKYAKIVLENGGKELMAEIKSQI

SEQ ID NO: 171872 - protein, 150 aa, Glycine max
  Coding DNA Sequence Number=SeqID_55094
DFKGINLVNQDDPMVVSIIIANFMVSRVLIDQGASLISCIGKPSKDSRSHPTLSTLTLGKLSNSFTIRYLMVDANKSYFALIGSKTLNELGAIVFTLYLTMKFPTIIGEIVTINADQKQARQCYAESLKVAPYPPIQELTILHPIAAEGT

SEQ ID NO: 171873 - protein, 224 aa, Glycine max
  Coding DNA Sequence Number=SeqID_55095
  Gene Ontology: Mol. function=DNA binding; Cellular component=nucleus; Biological process=regulation of transcription, DNA-dependent
  Homolog annotation: Hit_ID=Q8GZA8; Match level="QueryCoverage=72%, HitCoverage=67%, E-value=2e-34, Identity=43%"; Hit description =Protein ULTRAPETALA1
MAEEEFGLPTVNLYASHCDPPKQKKSQGNEKKTEDDNITQGPSKRRKQFRVGDDGKILFDEEELKMILDFKRGEDYIEVLCGASNKKYGDYVGRLKINNEGQYFITCECCPKCPLVSVTLEAFEKHALREGSGRWKRNIWVHCVDEDKVPLWKTPLIKYYTHQANVANRKDSAMRKQNFHRDEFLRCTRCGKERRFHLKSRPDIKNYHDALNNKCWTVLFGRIK

SEQ ID NO: 171874 - protein, 86 aa, Glycine max
  Coding DNA Sequence Number=SeqID_55096
MTKTMMKINKKIEEMFNTVHIMDQDVSSTMYSFMKAPGLTHLNLEGITEYKIVYNQWRKTAKIGNGWTTFAQSQNLQAGTQIIFEF

SEQ ID NO: 171875 - protein, 129 aa, Glycine max
  Coding DNA Sequence Number=SeqID_55097
MVKTRSLGRTLGKVIERSLGRQVNRDSDEAPLRCVEAKLHEDDKGDDKKFKGQSKNEFKIFKIESRTLQDSRGKLISRIKNQYSRDQDFKNQDSRDQDFKNQEIKIQDYSRIKRKLDQDKYEKVFSKIE

SEQ ID NO: 171876 - protein, 140 aa, Glycine max
  Coding DNA Sequence Number=SeqID_55098
MNKDGRGGGFSFIWKGSIKGEIVLFSENITNLQIEEDIFGSSSGLAPLRLQRGYERLRFYGHPSRGKVENHDWLLETVGEYFKHLFLSQNININPINGIVSLHLAEEDNNFLTSNFFVDEFKEVVFHMHPNKLISRSRWP

SEQ ID NO: 171877 - protein, 102 aa, Glycine max
  Coding DNA Sequence Number=SeqID_55099
MKALEKSNGHNFYLGCPIQMSDSGTSHIETLKIEQRKLSRNLNGHNFSHECPIQAHHILRRSILKNGCSREIQMVITFHMEVRFRRIIECPIQAHNITRRSE

SEQ ID NO: 171878 - protein, 69 aa, Glycine max
  Coding DNA Sequence Number=SeqID_55100
PWARNYPKAHKNPRVFSCISGPIYLEFLYPMLLQGRIVSVSVSSKRTIVSTATPLGLEVIPQVKVFLDE

SEQ ID NO: 171879 - protein, 82 aa, Glycine max
  Coding DNA Sequence Number=SeqID_55101
  Gene Ontology: Mol. function=protein kinase activity; Biological process=protein amino acid phosphorylation
  Homolog annotation: Hit_ID=Q1SDE3; Match level="QueryCoverage=75%, HitCoverage=82%, E-value=3e-22, Identity=76%"; Hit description =Protein kinase
DVEDNKDDDLVLSNLVLRCVVSRNLEVVVRHDSEVLNDFKRFEEMALVGLWCVHPNPALRPSMKHVMQMLDGTVEVGIPHLV

SEQ ID NO: 171880 - protein, 98 aa, Glycine max
  Coding DNA Sequence Number=SeqID_55102
MPLLLLLSVYLVSEQCHPEFKNGTMLSFTHSLVLFYLRCAVLSRFVRFGEGEDGGSGSVRCCSGRWRQHTRSSMNLRIKLIRILLRNQLDPQRTYIST

SEQ ID NO: 171881 - protein, 139 aa, Glycine max
  Coding DNA Sequence Number=SeqID_55103
MVDCAWAKRMHFDDKLAATMDEINFKQEDSKEKEGSFPKAADGVLAEKDQTPRKVESLTVMNLVATKEGEKEVLTPPQASLSACTRSARRSGLAREGPRRKAQFALSTHRRAQRGEAEGKDTPSLKALQCINPYHEPLP

SEQ ID NO: 171882 - protein, 64 aa, Glycine max
  Coding DNA Sequence Number=SeqID_55104
MPCKYEMTPKKLPAKRSKKDSTREGSSAAPQADMEFDRHRFWSAEHQQRFEAIKDWSFLRERRV

SEQ ID NO: 171883 - protein, 129 aa, Glycine max
  Coding DNA Sequence Number=SeqID_55105
MQQGQAVILIARFPDPNYGVKTGFVLYRNRKPSWKIPLRLKGSSRCGVSTEKNDSLWWLMVAVGDVESAWDVRNGFGRKKEKKMMFFLSYLDYKAQNAQVSNALGNGNLAHTPGIFSTIPTVRSWTSDL

SEQ ID NO: 171884 - protein, 37 aa, Glycine max
  Coding DNA Sequence Number=SeqID_55106
FEVADTGCCGTGRFEMGFLCDPKFTCEDATNGNRQNS

SEQ ID NO: 171885 - protein, 72 aa, Glycine max
  Coding DNA Sequence Number=SeqID_55107
MSLWDEIICPQYAPQVEQPPANFESTPTPNVEGTPTPTTTQGTPTPSVETNFIPPPLLTMFRPPPIRPSTSI

SEQ ID NO: 171886 - protein, 437 aa, Glycine max
  Coding DNA Sequence Number=SeqID_55108
  Gene Ontology: Mol. function=transporter activity; Cellular component= integral to membrane; Biological process=transport
  Homolog annotation: Hit_ID=Q13Y54; Match level="QueryCoverage=96%, HitCoverage=99%, E-value=1e-178, Identity=71%"; Hit description =Major facilitator superfamily (MFS) 2-ketogluconate transporter
  Pfam annotation: Domain name=MFS_1; Domain location=28-394; Score =216.0; E_value=8.3e-62; Accession=PF07690.6; Description=Major Facilitator Superfamily
  Pfam annotation: Domain name=Sugar_tr; Domain location=12-435; Score=- 88.5; E_value=0.00042; Accession=PF00083.14; Description=Sugar (and other) transporter
  Pfam module annotation: Pfam domain module=MFS_1::Sugar_tr; Domain location=28-394::12-435
MRPPQPEESPMKSQTIAPKRWWYIMPIVFITYSLAYLDRANFSFASAAGINEDLGITKGMSSLLGALFFLGYFFFQIPGAVYAERRSVKKLIFWCLILWGGCASLTGIVSNIPMLAAIRFVLGVVEAAVMPAMLIYISNWFTKSERSRANTFLILGNPVTVLWMSVVSGYLINSFGWREMFIIEGFPAVIWAIAWWFMVQDKPAQAKWMSDEEKAALQAQLQKEQENIKAVRNYSEAFRNRNVILLCLQYFAWSIGVYGFVLWLPSILRNGTQMGMVEAGWLSAVPYLVATIAMLVVSWASDKTQNRKLFVWPLLLIGALAFLGSWMVGSSNFWLSYALLVIAGGAMYAPYGPFFAIIPEMLPRNVSGGAMALINSMGALGSFIGSWIVGYLNGATGSPAASYVFMGAALLASVWLTLIVKPAANKTPPPIHGAKHA

SEQ ID NO: 171887 - protein, 69 aa, Glycine max
  Coding DNA Sequence Number=SeqID_55109
MAFFLSYLDYKAQNAQVSNALRNGNVVHTLDIFSKIPTVRLWTTSLRGFLEKLPHGFFEKLSREASMRS

SEQ ID NO: 171888 - protein, 136 aa, Glycine max
  Coding DNA Sequence Number=SeqID_55110
  Gene Ontology: Mol. function=DNA-directed RNA polymerase activity; Cellular component=chloroplast; Biological process=transcription
  Homolog annotation: Hit_ID=Q8HVY3; Match level="QueryCoverage=85%, HitCoverage=8%, E-value=1e-54, Identity=89%"; Hit description=DNA -directed RNA polymerase beta'' chain
MPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQENHTGPVQSLFQSEKIKIK

SEQ ID NO: 171889 - protein, 96 aa, Glycine max
  Coding DNA Sequence Number=SeqID_55111
MGNVACPIISKHNLGLRPSPTTPQFKETKHKFAPNCLTELVKLGTIESIKGINGKLETKGILGCLPTALFACPELGMGRRSIDRDPSLYLLPSLST

SEQ ID NO: 171890 - protein, 47 aa, Glycine max
  Coding DNA Sequence Number=SeqID_55112
MALPEESEGGSEFHRSTRPLDKKTTLPIYFASQKLLDLYVGNQNFNN

SEQ ID NO: 171891 - protein, 65 aa, Glycine max
  Coding DNA Sequence Number=SeqID_55113
  Subcellular localization annotation: CTP_CleavageSite=44; ConfidenceScore=5.83e-01
MSKAFSSKKYSSLPPSPTPFTAAPSRAKKKPCPRSPLQDLNRISSSSNSSYASSSVSTEAPKGCL

SEQ ID NO: 171892 - protein, 68 aa, Glycine max
  Coding DNA Sequence Number=SeqID_55114
MKDFPGTPGTGLGLALRISQFVFAAGSIASMATTPSFFNFTAFCIDHILKLTSHICYAPDCCRFVFIF

SEQ ID NO: 171893 - protein, 566 aa, Glycine max
  Coding DNA Sequence Number=SeqID_55115
  Homolog annotation: Hit_ID=Q53M54; Match level="QueryCoverage=18%, HitCoverage=12%, E-value=2e-11, Identity=42%"; Hit description =Expressed protein
MENLPKGNAGLRTKTLASDKKRTHKKNPLCLYQWQSGKKSGSRTGQKSKPCSALNEHGKLLHRLPSASEELKEKEDILGGRNDNAGEHAHVNLGHGAVNSTPLSKKVTGSYLEDVRVFRDVEENPNSMDSRTPPIHDSLSPEIQCGSSLVPKTATPACYGAGYVVSGVVDKRKCRPRGILTVEKNYSCSDKIAANSFDNDEKKKVIDTNDHASPSLLPLPTEAVVHWLSSPFNKGKKIPSKEFGNGLNQSQGLAESTTLASSTSPSSSSKTFWNVSDNGDLSGGANGIMRKISSSISPNGLAEFQVPSNYILSPSYSSLLFSPNPTPICRAGSSGKGKTDRYNLIDENSPFSLNSFGSGNVIQTPQSDSSSDLHVGLSLVHADKRKEDISNPGLNSSSKILLSESLLLNISMPLEDSVNSSFQFDFLTMPCESIDLSKRPNFLEGQDPWLSSSTTENASQSQMRISWREGLMSQLYELDEFDCCRCLSDEREIANESGTNRFSGPQVNIEINDGKKLNSDVGITETEDTEQEIDGLSKEKIPALISCSGAESISTDGGSLVAPGDD

SEQ ID NO: 171894 - protein, 137 aa, Glycine max
  Coding DNA Sequence Number=SeqID_55116
  Homolog annotation: Hit_ID=Q8L7R5; Match level="QueryCoverage=65%, HitCoverage=59%, E-value=4e-25, Identity=64%"; Hit description =Ethylene responsive element binding protein, putative
  Pfam annotation: Domain name=DUF588; Domain location=6-122; Score =42.7; E_value=1.2e-09; Accession=PF04535.3; Description=Domain of unknown function (DUF588)
MNPAQLGMELGLEMRMRLGRVMAKKGCLHYLIASMGLLVIWSFVLALLDAYALVKKKVLHNAVLVSLFVVGDWVTATLSLAAASSSAGITVLYFNDLGHCHFGEECQKYQISVALAFLSWFPISISSLIMLWLLAAG

SEQ ID NO: 171895 - protein, 108 aa, Glycine max
  Coding DNA Sequence Number=SeqID_55117
MAQVVEGKVEAQHPKFRQTQVVGGSSMMDKRSSVTRDDLGRNISRDGDGDNIESCQVCGTLRWRWTEVPYIHQLYDVRQMGLWGRANLGNKTVDVCRFLSFYLTLVMY

SEQ ID NO: 171896 - protein, 74 aa, Glycine max
  Coding DNA Sequence Number=SeqID_55118
MAEKTKKKLEEAAQSGSTEGATKEIAEKIASHGSFVPHGHQNVLTTDIGRPEHPGYVHAAGAGVTINQYFGFAP

SEQ ID NO: 171897 - protein, 229 aa, Glycine max
  Coding DNA Sequence Number=SeqID_55119
MVIIIVRNNWPGSSVVRVMPQAHRPSQDAGNGQEKIDRGVLGEVEDALDEATILAEDLEGKITGGTAVEPSEMFVATIFRGHSNRLKGIIVRVQESFIVFFFIDTLMFLYNTPLLPQQQPPRCSATMHLPLSSSSSALIFFSSPHHHIDIEKRKGSCHRKGSSPSKEAYANKATWQLRIKRRRPCHLKNSPSDYSSPSEQIPMGGRNCNSFLDFEELAQRVVLGQRAVP

SEQ ID NO: 171898 - protein, 135 aa, Glycine max
  Coding DNA Sequence Number=SeqID_55120
MFSSLSVRYMNAIKYLYRIKQNIPRYGGEGEEAQSCHDARVRRTRCSSLDKTMVRWRTDSFKVDGEQREQESLDGEEDNEKEKTVRRRRNIPRYGGKGEEAETCDDAQVRRTRCSDADRDLQGRRRLEEEESAKA

SEQ ID NO: 171899 - protein, 148 aa, Glycine max
  Coding DNA Sequence Number=SeqID_55121
  Gene Ontology: Mol. function=DNA binding; Cellular component=nucleus; Biological process=regulation of transcription, DNA-dependent
  Homolog annotation: Hit_ID=Q9FNN6; Match level="QueryCoverage=85%, HitCoverage=41%, E-value=5e-39, Identity=65%"; Hit description =Similarity to I-box binding factor
  Pfam annotation: Domain name=Myb_DNA-binding; Domain location=9-58; Score=38.3; E_value=2.7e-08; Accession=PF00249.21; Description=Myb -like DNA-binding domain
MTVDEVGSSSEWSTEQDKAFENALAIHPEDASDRWEKIVADIPGKTLEEIKHHYELLVEDVNQIESGCVPLPSYNSSPEGSTSHASDEGAGKKGGHSWNSNNESNHGTKASRSDKERRKGIAWTEDEHSVCHCEQHKAGSIVLWKRQF

SEQ ID NO: 171900 - protein, 271 aa, Glycine max
  Coding DNA Sequence Number=SeqID_55122
SMMIGCGITWMLWKLGRIEWGPGVERNEDKGYVGVRELSWRWATGDVVPGDMSRGSGDLGDVRRTPGSQQIKGTKTTKQGGLCGDWPTGGQLITRLKNEDMRLRWSLVIDYQGVLKKGTGRLWRPLIVMAAQLIHDRVEMECLEGAWETLEGNTRCQFRGTIRFTATSLVHPDEPARTLQRTVERILPMPTPYRLVEPVHVIEVTSSEEDPEEDLEELPPEPAVDALDFLEGDEDPLPEVDSSEDVMSASEANSTEDSGPGEMAISGGSSS

SEQ ID NO: 171901 - protein, 520 aa, Glycine max
  Coding DNA Sequence Number=SeqID_55123
MANPNHQGYHQGGNPGYHQGAISLRTRVKVRGSILGTTSIRIKEIPEVIGNLKIVPTRMTFQQVDHSIKRPYGVVEDVLVKVQQFTFPVDFMIMDIEEDLDVPLILGRLFMSTAKCVMNSGGQDMRVRLIKGEKSITGSVLIHILLAFENWPRRTQRNARNWNQRNGTQTEAGFFSVSKCPFLPQIVKGEHFWSREVRGYEWNFENPVDPTVNELDRRNCYCGLYVRKAVILVDLGRIDGDPVLRETRIWATWEYVSSVGGGQQGMVGLVKLPAFIVDHRVVPGDMSRGSGDLGDVRRAPGSQQIKGKQDHKARRLVVAGQLQGAKMVSGNWELMGASGNRLPACVIDYTEEWVTASGNRLPRLCNRLPEMESLKIPLLLHVMFMRRIVCSTRELGRPSKATRGADFRGTIRFTATSLVHPDEPARTLQRTVEWILPTPTPYRLVEPAQVIEVTSSEEDPEEDLEELPPEPAVDALDFLEGDEDPLLEVDSPEEVMSASEADSTEDSGPREMAISGGSSS

SEQ ID NO: 171902 - protein, 112 aa, Glycine max
  Coding DNA Sequence Number=SeqID_55124
MEMNGNEMLQMNAGWHAGHDAKSPTGLSDHTLSRMVRAYCTCTVDMVDLVLEDEGEDLEEDILYEEDPSMDKEDPTVETEIMEEDSLQDSSGESYQETFLHLTLTDSFCGYG

SEQ ID NO: 171903 - protein, 184 aa, Glycine max
  Coding DNA Sequence Number=SeqID_55125
  Gene Ontology: Mol. function=nucleic acid binding
  Pfam annotation: Domain name=zf-CCHC; Domain location=162-179; Score =9.0; E_value=0.032; Accession=PF00098.13; Description=Zinc knuckle
MASHNTQAMTIGSIAGSSNNWYLDLGCPPLIYSIFTLSLANVGFGFFLIHPLTPALFGLGRFRVYSQKCDYGKFQAFHMPCQNVIADCAHVHVDQCVSLYRLQNVFNVYNHSFGILPNESLWPENPGDECCHDPKNQRNLGGHPKTRHIRIKMDMRERGQPKRCSICQTISHSKSKCPNNPREA

SEQ ID NO: 171904 - protein, 73 aa, Glycine max
  Coding DNA Sequence Number=SeqID_55126
MAGTFFLLKKQNSLEIMSSEKEMTPNRVGRHIMEMGNGNLEMSVEYQKVTFNLFEAIKHPNDYKTCFKMEAVK

SEQ ID NO: 171905 - protein, 272 aa, Glycine max
  Coding DNA Sequence Number=SeqID_55127
  Gene Ontology: Mol. function=nucleic acid binding; Biological process= RNA-dependent DNA replication
MNWYTCQGVKKFLASLPGTLSLALEDDLVPLNLEIEATYRRINVSRRRREQQERQENLRERGASSSASSSTVPVVFEKLTVSNPHHIFEEPLMLIQGNLFHGLPNEDPYAHLTTYIEICNTVKIVGVPEDVIRLNLFSFSLASEAKIWFHLFKENNLRTWEEGVENSLKKYFSESYTTEGKINIFNDGLQPHSEQLLDASAGGKIKLKTPDEAMDLIENMTVSDHVILRDKSYTPAKKILLELTSQDALLAQNKLLDKQLETLMETLNKLSQ

SEQ ID NO: 171906 - protein, 361 aa, Glycine max
  Coding DNA Sequence Number=SeqID_55128
  Gene Ontology: Mol. function=RNA-directed DNA polymerase activity; Cellular component=intracellular; Biological process=RNA-dependent DNA replication
  Homolog annotation: Hit_ID=Q1S3H4; Match level="QueryCoverage=43%, HitCoverage=31%, E-value=1e-43, Identity=49%"; Hit description =Integrase, catalytic region
ACLEDLDRLKEIPSGEYAFEELKKDFATKRPKVELKVLPPYLKYVIKKYKATIRWHIFDLEGISPSYCVQKFIMEVDYRPVRQPQRRLNPSMKEEVQKEVLKLLEAGLIFPIFDSAWVSPVQVVPKKSSMMVIHNEKNDLTLTRAFTEWRMCIDYHKLNDTTRNDHFPLSFMEQILERLAGQAFIVSWMATQGIEVDKAKIDIIEKLPPLMNVKGIQSFLIHARLLSEVIIFTDHVAIKYLLTKADFKPRLIRLVLLLQEFDIEIKDKKGCENLVPDDLSRLRPWFTNIVNFKAVGIILDDLNWHQWKKFLPDEHYYVRDDPHLFKLGADNLLRMCVTKEEARSILWHCHNSPYGGHYNGD

SEQ ID NO: 171907 - protein, 223 aa, Glycine max
  Coding DNA Sequence Number=SeqID_55129
MIGLSALFALSPRWPPRNVELPPVDLKGWNLHGTPPDSHRRWLGTDTRIMHWHRKLTRVSKRNIDVALVKEFYANIYDPEDSLPKQRKVRGKVIQFDAQMLNTFLETPSRRGVAIVVRLCTPRGQFIMNAEGALWKILWKDLTTLAQTWSVLSYFNLAPTSHTLDLNMEKAQQIYRIIMKMDMDLGSMISSQIAQSNSSRLGFPALIIAFYNAKGVYLDTVIP

SEQ ID NO: 171908 - protein, 79 aa, Glycine max
  Coding DNA Sequence Number=SeqID_55130
TLDIEQRKLSRNANGHKFSHGGQIQAHNISRHSKLNNGSSREIQMVITFHTEAHKISRRSKLNNGSSREIQMVITFHPE

SEQ ID NO: 171909 - protein, 136 aa, Glycine max
  Coding DNA Sequence Number=SeqID_55131
  Subcellular localization annotation: CTP_CleavageSite=45; ConfidenceScore=5.18e-01
MILGSKKLISQALLGLYSIPDYMCVPLTLPFSPFHSSSSASSMVGVAMVVEEILAHPIVREYVLSSPSSEIPLSSYPSYDPITQTRFLLPECLTNWPPVLEDYVDDDNDEKKDSSKDANDVKESSRSEEDPYEDSS

SEQ ID NO: 171910 - protein, 43 aa, Glycine max
  Coding DNA Sequence Number=SeqID_55132
MTPPLLCLPLHLRGGKSPLKDLIEAQRSSLHRSPTSCGLTPKC

SEQ ID NO: 171911 - protein, 219 aa, Glycine max
  Coding DNA Sequence Number=SeqID_55133
MCAKPLYTSLMTNLWLSEGCLAKPSQLCKEKFYINDNILGRNILSERNVKLYHTEFDEFKVESERRNLHKRLANLQDGSIDVALVKEFYADLYTTEDQAPKQARVRGHLIKIDVDKLNEFLQTPVVLEEGTNHQEIVARLCIPYKGFVLNAEGQPWKLLRKDLTTLAQTWSVFSYSNLAPTSHTSDLNMDRARLVYGLATNMDMNIRAFISVQISSIAQ

SEQ ID NO: 171912 - protein, 249 aa, Glycine max
  Coding DNA Sequence Number=SeqID_55134
  Gene Ontology: Mol. function=DNA binding; Cellular component=nucleus; Biological process=regulation of transcription, DNA-dependent
  Homolog annotation: Hit_ID=Q70RD0; Match level="QueryCoverage=66%, HitCoverage=56%, E-value=2e-46, Identity=54%"; Hit description=MYB10 protein
  Pfam annotation: Domain name=Myb_DNA-binding; Domain location=62-128; Score=26.7; E_value=8.2e-05; Accession=PF00249.21; Description=Myb -like DNA-binding domain
  Pfam annotation: Domain name=Myb_DNA-binding; Domain location=9-56; Score=45.4; E_value=2e-10; Accession=PF00249.21; Description=Myb -like DNA-binding domain
  Pfam module annotation: Pfam domain module=Myb_DNA-binding::Myb_DNA -binding; Domain location=62-128::9-56
MEGPSSVRKGAWSKCEDDLLRACVQLYGEGKWHLVPQRAGLNRCRKSCRLRWLNYLKPNIKRGDFSEDEVDMMIRMHKLLGNRHLFRDLKEDQGKLSKKDQGNKWSLIAGRLPGRTSNDVKNYWNTYMRRKVYSHKKDNNVEKQADEAKSTVQRHQVIKPIPRALTKTAPRLQGKLFNSSKVGVSEAAGAASSGSGNWWETFLENKKDNHEDGELDLWDEELNPIACDFLSEGILIWLYIGMAIGQDGH

SEQ ID NO: 171913 - protein, 93 aa, Glycine max
  Coding DNA Sequence Number=SeqID_55135
MRIKRSFEVVMGPRTRYGKIWNKWLNPKGIEEQWGITFEKQHHIQHVQHLTNMQCTSSMAQNISRSMTNKTCYPMKQNPPHLFPKQFQSSKIP

SEQ ID NO: 171914 - protein, 116 aa, Glycine max
  Coding DNA Sequence Number=SeqID_55136
MVHSTLVEGILPSNPRIALMSNILTHYLLVGSWSVGDLVPQLFSPRGIFFINGFLCFLEDEWQRNEERKRERKCHFKEKMSLEEAHHHRRPWIRAWRKKEMNEGRGREEHEILCSK

SEQ ID NO: 171915 - protein, 127 aa, Glycine max
  Coding DNA Sequence Number=SeqID_55137
MVNGGRESTSKIISPSKYEVGYIDILMAKVNALSLKIDKMEKAKVNDVSTPSPCCELRGMQGHSTMECQTMMPADHDEQVENVASTHNFYDYPRKRKFDPYLRARKSRLQSPPTELVEPGKCTGSHK

SEQ ID NO: 171916 - protein, 75 aa, Glycine max
  Coding DNA Sequence Number=SeqID_55138
MKPVVLWTMKSPGVRHINCEGSVVWHLVLSCGSVLMLRDEMHAGFICSSHQNKDSSNSHAAATCMHSTINLDFRL

SEQ ID NO: 171917 - protein, 57 aa, Glycine max
  Coding DNA Sequence Number=SeqID_55139
MWLKIGWREILGKQIGTPCRGWGMIIRSLLDIGPHKYEGSNKKDNISSTMDRGFART

SEQ ID NO: 171918 - protein, 83 aa, Glycine max
  Coding DNA Sequence Number=SeqID_55140
MTISDYHSPLEMCIMKREGKGDAKVSKRQLLITKEKANRLSRLANITISSIKEGEEEEQYSEVTRIGIFQKQFMLQPSSFTTT

SEQ ID NO: 171919 - protein, 223 aa, Glycine max
  Coding DNA Sequence Number=SeqID_55141
  Homolog annotation: Hit_ID=Q9SHL7; Match level="QueryCoverage=34%, HitCoverage=8%, E-value=3e-26, Identity=73%"; Hit description =Putative mitotic control protein dis3
MNIANQYRESSYTKPVSQKVTITQLQQRVKSLLISHHLQIDHHLRNILFISGRLTLAHVLGGGRLVNLLAVLLGILCPIFIFWWFLCNQTPTVSWIKDDKHMGLRLRNFKVFPYLFPFPFQGSVADHAPRTIPQQGIVDLWRQWLCLQGVVVLPMPCLSPKIAKFPTFESKPVNFRTFWTRGLLCHLFLGIISLDIHEAIMCALLGRYVIGILKSRYGILDFV

SEQ ID NO: 171920 - protein, 43 aa, Glycine max
  Coding DNA Sequence Number=SeqID_55142
MVRPHRAAMSPSSSLRPCDDLTPLNRASGDVRVEVTPPPWRIL

SEQ ID NO: 171921 - protein, 730 aa, Glycine max
  Coding DNA Sequence Number=SeqID_55143
  Gene Ontology: Mol. function=receptor activity; Cellular component =integral to membrane; Biological process=red or far red light signaling pathway
  Homolog annotation: Hit_ID=Q2HT55; Match level="QueryCoverage=98%, HitCoverage=95%, E-value=0.0, Identity=74%"; Hit description=SPX, N -terminal; EXS, C-terminal
  Pfam annotation: Domain name=EXS; Domain location=553-722; Score =200.4; E_value=4.3e-57; Accession=PF03124.5; Description=EXS family
  Pfam annotation: Domain name=SPX; Domain location=1-297; Score=125.4; E_value=1.6e-34; Accession=PF03105.10; Description=SPX domain
  Pfam module annotation: Pfam domain module=EXS::SPX; Domain location =553-722::1-297
MVPEWEEAYMDYNCLKATLKNISKFRELNESAPMASTPKGSLKRRLTLYRAFSGLTDRQRGSPRKDEDEVILVRAAEGEGSEGLYQTLFLKPSEEGAEQDLVFFKKLDHEFNKVNSFYKKMVKEMIEEAAELSKQMNALIALRIKVDKVGFINLGSYGHSRVHMDVIHEIEMSNGRHLENGSGNYEEETTSRTSVEGFRPASLEILDHVKINMTTPETAMSTIKGLLPSSKSDPSFSKKELRKAEEQISIALKEFYNKLRLLKSYSFLNLLAFSKIMKKYDKVSSRNTSKDYLKMVDSSYVGSSDEVNRLMERVEHAFIKHFANGNHRKGMNTLRPAVKKERHRITFLLGLFTGCSIALVVALIILIHARNILYSEGRTRYMDNIFPLYSLFGYIVLHMIMYSANVYLWRRYKINYPFIFGFKEGTELGYREVFLLSSGLAVLSLAAVLSNLDMEMDQRTKSFSALTELVPLGLVIVLLLITFSPFNIIYKSSRFFLIQCAFHSACAPLYKVNFPENFLADQLTSQVQAFRSLEFYVCYYFWGNFKTRSNKCLESDVYKAFYLIVAIIPFWIRCLQCFRRLLEERNTMHGLNGLKYISTVVALVLRTTNEFRRGMVWQILAATSSSIATIVNTYWDIVIDWGLLRRNSRNPWLREKLSVPNKSVYFVAMVLNVILRLAWMQSVLGIREAPFLHRTALTALVTCLEILRRGIWNFFRHGDLHMNPDIPWMP

SEQ ID NO: 171922 - protein, 208 aa, Glycine max
  Coding DNA Sequence Number=SeqID_55144
  Gene Ontology: Mol. function=DNA binding; Cellular component=nucleus; Biological process=regulation of transcription
  Homolog annotation: Hit_ID=Q2VAZ5; Match level="QueryCoverage=45%, HitCoverage=51%, E-value=9e-09, Identity=33%"; Hit description=VENOSA
MMTTIMTMVVVTEVKIIMIFAMLVTTAIMKVMTVEVVIVDDDDGDNSDDYGGDYSSAHGGRLPGRTSNDVKNYWNTYARRKLHSHKKDNNIEKQARAKTTVKPHEVIKPVPRALTKTSPRLQGKFINSSEVGVSHEEGATSISGSGNWWETFLDDKEDIEEGNNNKCFFGGEDGALDLWGEELNSIACDFLTQGETWSDFLLDLGLGD

SEQ ID NO: 171923 - protein, 82 aa, Glycine max
  Coding DNA Sequence Number=SeqID_55145
  Gene Ontology: Mol. function=DNA binding; Cellular component=nucleus; Biological process=regulation of transcription, DNA-dependent
  Homolog annotation: Hit_ID=Q70RD0; Match level="QueryCoverage=97%, HitCoverage=32%, E-value=1e-32, Identity=76%"; Hit description=MYB10 protein
  Pfam annotation: Domain name=Myb_DNA-binding; Domain location=9-56; Score=50.6; E_value=5.1e-12; Accession=PF00249.21; Description=Myb -like DNA-binding domain
MEGSSGVRKGTWSQIEDDLLKACVQLYGEGNWHLVPKRAGLNRCRKSCRLRWLNYLKPNIKRGDFSEDEIDMMIRLHKLLGN

SEQ ID NO: 171924 - protein, 46 aa, Glycine max
  Coding DNA Sequence Number=SeqID_55146
VARPGELTRRLYTGMTRVRGPKLLMLRQPLRKVLIETPQDRLGIEQ

SEQ ID NO: 171925 - protein, 60 aa, Glycine max
  Coding DNA Sequence Number=SeqID_55147
MAKGAEDDVSLCASTGSFASWLTKGAEGGGDDISLCVSTGSFAPWLTKGAGNHKVTPHVT

SEQ ID NO: 171926 - protein, 145 aa, Glycine max
  Coding DNA Sequence Number=SeqID_55148
  Gene Ontology: Mol. function=argininosuccinate synthase activity; Cellular component=chloroplast; Biological process=amino acid biosynthetic process
  Homolog annotation: Hit_ID=Q2QVC1; Match level="QueryCoverage=82%, HitCoverage=24%, E-value=1e-49, Identity=83%"; Hit description =Argininosuccinate synthase
MAQLKASPVTAPSLHTTGVALRGKLSKVVLAYSGGLDTSVIVPWLRENYGCEVVCFTADVGQGIQELEGLEAKAKASGASQLVVKDLKEEFVSDYVFPCLRAGAVYERKYLLGTSMARPVIAKVLLLEKFHIFIFLGKAISSISS

SEQ ID NO: 171927 - protein, 306 aa, Glycine max
  Coding DNA Sequence Number=SeqID_55149
MKDIKKAAGRQLQMAMEIMYDAERQTYITWIDELLSSLKNSTLQGLKFWFHVGTVCDVDKWIHFAIQKKVQKLELYFGHTFEYVLPLNLFKLESFNSLHVLRLKSITVTKEMLEYLLCCSSLLETLSLVNSGVPKTMMVSGSSLKLKYLELVRCWELIKLEIFAENLVSFKYYGSHLDTEFKSVSSLVVATFGGSFVEFTRESFLPQIKMLKLDLTQNEPEVLYWLSQLPKLKNLKHLELAACVDDGTTLACALLLKASPSLWRFTVKMLNIKPSFRTERKFTMNAGTISKSWHWLGFVEQHVKLN

SEQ ID NO: 171928 - protein, 103 aa, Glycine max
  Coding DNA Sequence Number=SeqID_55150
  Gene Ontology: Mol. function=DNA binding; Cellular component =mitochondrion; Biological process=DNA integration
  Homolog annotation: Hit_ID=Q1SRN1; Match level="QueryCoverage=95%, HitCoverage=6%, E-value=5e-29, Identity=61%"; Hit description =Integrase, catalytic region
MANTTADLLWIQSLLRELQVPFLTPTLLCDNLSAVSLSHNPILHSKTKHIELDIHFVREKVLSKQLNILHVSAQDQLADPLTKPLSPSQHTAIRTKLKVFPLA

SEQ ID NO: 171929 - protein, 65 aa, Glycine max
  Coding DNA Sequence Number=SeqID_55151
MEEKRINFGSKGGAFLHSNNKENENETKGGRRKNNKERRKEIPFAQGGQKLKLPIEGFSWISGKE

SEQ ID NO: 171930 - protein, 47 aa, Glycine max
  Coding DNA Sequence Number=SeqID_55152
MVQFYSTFSSTLTAFSTPNVAALNKISAICNENAKQNGKRNAARGLV

SEQ ID NO: 171931 - protein, 156 aa, Glycine max
  Coding DNA Sequence Number=SeqID_55153
MVYSGRKRHGFWVKMFLSGSLQPYFLAGEVKKKIEEMIPKLFKLLEILCNFNPSKLTLSNRSKISIRSPESSDKEIHACETNPKRNTNKIHRELAERGMDSGSRCFCRVHSNHGIPKIPLDHQRKIQLKKRLKLKLLKRKRMADFLAKNGEEEKAQ

SEQ ID NO: 171932 - protein, 118 aa, Glycine max
  Coding DNA Sequence Number=SeqID_55154
METEETNLWGNDTNEGCRFEAGREMIRNTGEKTTCITNRMAKAKHSTWHKTWHKTKSDKEQGKLRMERTSTWTWSVKTKSRLASLLDYEQPSLIAMVYVYYLYQVVGLMRCMHDMKRM

SEQ ID NO: 171933 - protein, 116 aa, Glycine max
  Coding DNA Sequence Number=SeqID_55155
MVKAREKREVVAAQLAQASSAHPRELDCFYQKAPSSVGTPWKAQVGLVAICTPILISSPPSFVIYGKVIEALQKHIGLDFLLFFFSFSPILGEICLFKVLGILRKHYGSLTEAYRT

SEQ ID NO: 171934 - protein, 137 aa, Glycine max
  Coding DNA Sequence Number=SeqID_55156
MFVKFLIFFCKASICSLKSATTIVSLETEDELEIRIAARLPWWHCRMKLPENAQQLPLADMDKSREQAAATEPQSRRRRSNSAWEEEEEEATSSFVNPNFFGEEEATLRVLHVRTVVQGPGSMLWLETDPRIHQAGD

SEQ ID NO: 171935 - protein, 331 aa, Glycine max
  Coding DNA Sequence Number=SeqID_55157
  Gene Ontology: Mol. function=oxidoreductase activity; Cellular component=glycerol-3-phosphate dehydrogenase complex; Biological process=electron transport
  Homolog annotation: Hit_ID=Q59159; Match level="QueryCoverage=97%, HitCoverage=87%, E-value=1e-100, Identity=56%"; Hit description =Opine oxidase subunit B
  Pfam annotation: Domain name=3HCDH_N; Domain location=6-136; Score= -114.7; E_value=0.099; Accession=PF02737.8; Description=3-hydroxyacyl- CoA dehydrogenase, NAD binding domain
  Pfam annotation: Domain name=DAO; Domain location=8-331; Score=194.1; E_value=3.4e-55; Accession=PF01266.14; Description=FAD dependent oxidoreductase
  Pfam annotation: Domain name=Pyr_redox_2; Domain location=8-272; Score=-40.3; E_value=0.086; Accession=PF07992.4; Description =Pyridine nucleotide-disulphide oxidor
  Pfam module annotation: Pfam domain module=3HCDH_N::DAO::Pyr_redox_2; Domain location=6-136::8-331::8-272
MRRLPDQNIVIIGAGLVGSAIAWGLARSGLRPMLLDGEDLSLRASRANFALIWVQGKGVGAPHYARWTMQSARLWPAFADELRDVTGLDVALKQTGAFTFCLDKRELQMFAEDVATVARALGDDAPEHVVLDHQETAKMVSSIGRDVIGSIYSPMDGDVNSLRLFRALHTGMIKLGAAYEPHCEVSSITPQNGGFLLSGAWGEVFTERVILAAGNGNTELAKSVGLATPVVRSKGQILVTEKCAPFFPYTAATLRQADEGGVMIGDSQETHTDRIATNQDISAVLANRAVRTFPHLAEVNVIRSWTGFRIKTPDGLPIYEQSESHPGAYAV

SEQ ID NO: 171936 - protein, 64 aa, Glycine max
  Coding DNA Sequence Number=SeqID_55158
MHVEEDIVGETKKPLERSIRQMRKDTIPFDPHQVTLEGPHLGFAPQYPENDSQRKLENATTNSQ

SEQ ID NO: 171937 - protein, 126 aa, Glycine max
  Coding DNA Sequence Number=SeqID_55159
  Subcellular localization annotation: CTP_CleavageSite=54; ConfidenceScore=5.53e-01
MLQRSINISSPLSLLKVADSTSTRFQQEPLFKPSTFNRIIAFITLVGKSSSSTMQNSIEDFNFLKNFKVMVHPRKAPVVTLKSHGIPPYAVEPNATQMVLQGDLWVLLLAKIFSKIHREVLWVISP

SEQ ID NO: 171938 - protein, 531 aa, Glycine max
  Coding DNA Sequence Number=SeqID_55160
  Gene Ontology: Mol. function=RNA-directed DNA polymerase activity; Cellular component=nucleus; Biological process=RNA-dependent DNA replication
MIAVRSVTYVFNINGRFTRRLEARRGIRQGDPISPLLFILVMEYLNRILSQLDKIPNFNYHSKCEKMKITNLCFADDLLLFSRGDIGSVQIMLDKFNTFLRSMGLHVNPSKCNIYCGSVDINVKEQLLLISGFKEGKMPFRYLGIPLSSKKLNIKHYQVLIDKIVGRITHWSAGLLSYAGRVQLIQSVIFATINFWMQCLPLPKFVIMRINAICRSFLWIGNSNISRKSPIAWEKVCSPKINGGLNIINLAIWNKISILKLLWNICNKSDNLWIKWLHTYYIRGQSIWSMVLKKSHSWIMSSMMKLRPLLLQYQSRMQDVFKMKKIYLALFEESEKMSWRTLMCNNLARPRALFCLWQACHFRLASKDRLIKFGLNVDANCAFCSSMESHEHLFFGCIELKTIWTAVLNWLQITHMPSTWSEELNWITRKCKGKGWRAMLLKCAFTETIYHIWAYRNHRVIGGNVNNRKVEDSIINTIIYRVWDRKRYRRMLEKCIVNRNNIIAGLRADPKQRLSAVEVLNVNRKYLAAKE

SEQ ID NO: 171939 - protein, 66 aa, Glycine max
  Coding DNA Sequence Number=SeqID_55161
MVEEEENPSSSIEHVVTNNQNKEKLTVVLSKSQRKMLKRLQNSSIGGSLQPNLWALYDNSLDPMMV

SEQ ID NO: 171940 - protein, 76 aa, Glycine max
  Coding DNA Sequence Number=SeqID_55162
  Subcellular localization annotation: CTP_CleavageSite=66; ConfidenceScore=5.76e-01
MAPPQAKSDSTYLGASGDTSTRRSVTTCFMTTQASTRASSCLPKEEKKLKPMLGNLRRRRRRNTVRERSKSQTSRR

SEQ ID NO: 171941 - protein, 461 aa, Glycine max
  Coding DNA Sequence Number=SeqID_55163
  Gene Ontology: Mol. function=DNA binding; Cellular component =mitochondrion; Biological process=DNA integration
  Homolog annotation: Hit_ID=Q1RSZ9; Match level="QueryCoverage=98%, HitCoverage=32%, E-value=1e-144, Identity=57%"; Hit description =Polynucleotidyl transferase, Ribonuclease H fold
MTYHNKVIVCRHVLFEENEFPFSKLHTSSSSTYDFLDNGLSPYVINHLQNQSTPHIQVQNHPSLAPTQSPGQPRSPNHATPSSPQPTQPTSSPPQSAHSTSTNPKSSSSTLGQSDLSPHLDHTQHLPLPPIFQLTSSSENKPITRSQHGIFRPNTKYQHGFLTNVTKSPLPRNPVSALPNPNWKMAINDEYIALIKNKTWDLVPYPPDVNVIQSMTIDSGETFSPVVKPATIQIVLSLALSKAWPIHQLDVKNAFLHGELKETVYMHQPLGFKDPDHPNHVCLLRKSLYGLKQAPRAWYKRFVDYVSSIGFSQSKSDKSLFIYKKGLEMAYILLYVDDIILTASSVALRKSIMLLLNFEFAMKDLGPLSYFLGIAVTQHAGSLFLSQKKYVEEIIERVGVSSCKPCPTPVDTKSKLSAKTSTPYEDPTHYRSLAGALQYLTFTRSDISYMLYNRSVYLCII

SEQ ID NO: 171942 - protein, 287 aa, Glycine max
  Coding DNA Sequence Number=SeqID_55164
  Gene Ontology: Mol. function=DNA binding; Biological process=DNA integration
  Homolog annotation: Hit_ID=Q1SJ98; Match level="QueryCoverage=32%, HitCoverage=14%, E-value=1e-24, Identity=58%"; Hit description =Integrase, catalytic region
MMKNSLRCHDITNFADSKVLEHIIPPTDAKEKAVYDKAKANDFPLWKWLDAAVLQWIYATVSSDILTFILIDDDLAEHAWHSFHQRLADFSTTNAYCNRLKSLADQLANVEAPVNDQNMVLRMLQGLTEQYSHFVTDAKQESSLVAYSHNSDDDMNHQNSSQGTNRKNNKNSGSRNSKKVGRNTGNGSNGLVLVVDVENTNNSGSLGLGCSGLRGLALLLHILPTTIGPDPLSVLDHHSLVFLDRSLSRQLTMQMHPAQLILKQLFILSALLNLIRHGTWTPGRHLT

SEQ ID NO: 171943 - protein, 199 aa, Glycine max
  Coding DNA Sequence Number=SeqID_55165
  Gene Ontology: Mol. function=transcription factor activity; Cellular component=nucleus; Biological process=regulation of transcription, DNA-dependent
  Homolog annotation: Hit_ID=Q8S9H4; Match level="QueryCoverage=98%, HitCoverage=97%, E-value=1e-41, Identity=47%"; Hit description =Ethylene response factor 1
  Pfam annotation: Domain name=AP2; Domain location=5-69; Score=117.5; E_value=3.9e-32; Accession=PF00847.10; Description=AP2 domain
MARPQQRYRGVRQRHWGSWVSEIRHPILKTRIWLGTFETAEDAARAYDEAARLMCGARARTNFPFNPNVPHSSSSSSKLLSATLTAKLHSCYMASLQITRQALECESQRTPSVPNATSTTTLFSNFSVRSEQTPAVLPHKRPEEEQESEANRGGKRVKAVENVPLQFKPLEEDHIEQMIEELLDYGSIELCSVIPPQAL

SEQ ID NO: 171944 - protein, 189 aa, Glycine max
  Coding DNA Sequence Number=SeqID_55166
MSLKYSYVKGIWADICKEGKIIIYLDMTNLSTTSNGKDQESPITIDEKDILGSIPQGIDMKLQKGRQTNSTKQEYKVIYVIAGEFTSGCPSNNTRKRHAREVLIVAHNRRNHKSTKRRPPPLISNDKDVDMSIVLDHDNPLLVKTLINNKERGYQERDMNAQHGSGKKLSEPLDQEGATTNDIYRSGFG

SEQ ID NO: 171945 - protein, 309 aa, Glycine max
  Coding DNA Sequence Number=SeqID_55167
  Gene Ontology: Mol. function=transcription factor activity; Biological process=regulation of transcription, DNA-dependent
  Homolog annotation: Hit_ID=Q669F4; Match level="QueryCoverage=95%, HitCoverage=94%, E-value=1e-112, Identity=67%"; Hit description =PutativeLlysR-family transcriptional regulatory protein precursor
  Pfam annotation: Domain name=HTH_1; Domain location=4-63; Score=63.3; E_value=7.7e-16; Accession=PF00126.17; Description=Bacterial regulatory helix-turn-helix protein, lysR family
  Pfam annotation: Domain name=LysR_substrate; Domain location=87-293; Score=159.1; E_value=1.2e-44; Accession=PF03466.10; Description=LysR substrate binding domain
  Pfam module annotation: Pfam domain module=HTH_1::LysR_substrate; Domain location=4-63::87-293
MPILSDLRVFVLVARRAGFAAAAEELGVSPAFISKRIALLEKALDVSLLHRTTRRVAITEDGERIYEWAQRILNDVDQMMDELSEVRQAPQGMLRVVSSFGFGRRFVAPALSALAREYPQLELRLDVSDRLVDLVSEGFDLDIRIGDDIAPNLIARKLADNQRILCASPAYLQRHGVPKSVAELAGRTCLVIKERDHPFGLWRLQGPGDEETVKVTGALASNHGEIVHQWCLDGQGVALRSAWDVKENIDSGRLVHILPEYYQPANIWAVYVSRLATSAKVRVTVEFLRDYFREHYGETGPASENPPRP

SEQ ID NO: 171946 - protein, 46 aa, Glycine max
  Coding DNA Sequence Number=SeqID_55168
MAKHPPRQQHVANASGDFPVSPMPVAGLPCIANVSGRMHTTKSTIT

SEQ ID NO: 171947 - protein, 336 aa, Glycine max
  Coding DNA Sequence Number=SeqID_55169
  Homolog annotation: Hit_ID=Q1SZU3; Match level="QueryCoverage=96%, HitCoverage=96%, E-value=1e-133, Identity=73%"; Hit description=NERD
  Pfam annotation: Domain name=NERD; Domain location=38-137; Score= -12.0; E_value=0.074; Accession=PF08378.1; Description=Nuclease -related domain
MWLEIIFGLVIYKLFRRFFYDDDVLDIEGSDSSALFFVADRLKKLYGANVYVGLRIPDADTASRQSIDMVLLTKQELWVISVKNFSGILTIGGDGSWVCEKPDKHKAERHPDPAALDVEEHELIAYLVEEARKQASIVESYLEQRGVALPEGYISCKVILPNPKLCTIPAGSFPSEVITHDQWMQLKPEPKRMLSSWVKSAFRSGKKDMQESVNQNLDFVLGSAPIWDRVELKGNKYVLGEFLEFKGKQEDVEALRPIRRSKVGRMIIQKTSMFGLAPSRLQVLYSLRDYRTEGASGPEWKEVTVRSSTEIAFQPENASKVRKFKLSSVSSMLLSA

SEQ ID NO: 171948 - protein, 343 aa, Glycine max
  Coding DNA Sequence Number=SeqID_55170
  Gene Ontology: Mol. function=DNA binding; Cellular component=nucleus; Biological process=regulation of transcription, DNA-dependent
  Homolog annotation: Hit_ID=Q84PP3; Match level="QueryCoverage=95%, HitCoverage=100%, E-value=2e-88, Identity=55%"; Hit description =Transcription factor MYB103
  Pfam annotation: Domain name=Myb_DNA-binding; Domain location=25-72; Score=54.9; E_value=2.7e-13; Accession=PF00249.21; Description=Myb -like DNA-binding domain
  Pfam annotation: Domain name=Myb_DNA-binding; Domain location=78-123; Score=45.2; E_value=2.2e-10; Accession=PF00249.21; Description=Myb -like DNA-binding domain
  Pfam module annotation: Pfam domain module=Myb_DNA-binding::Myb_DNA -binding; Domain location=25-72::78-123
MNECCMQYVMMRTPIASNDESGLKKGPWSPEEDKILVDFIEKHGHGSWRALPRLAGLNRCGKSCRLRWTNYLRPDIKRGKFSDEEEQLIINLHSALGNKWAAIASHLPGRTDNEIKNLWNTHLKKKLMQMGLDPVTHRPRTDNLNLLSNLQQILAAAKIVSSLTNPSALSWLQSDATLQLLQNMYARPTASNSDPLINPFRTLNSLPDSYSLLNDLLGFNLHSNLQNLYDGNSLSQIQPNFQNFEAPQQPTQHLNGGRNTSFRESQKQFGSTNNIADPSLSSSLPNLVSASPERSPFKEAENIMVNSKDCSTSFELTWGDFMDEETTETYWKGFIDRPWSTVP

SEQ ID NO: 171949 - protein, 632 aa, Glycine max
  Coding DNA Sequence Number=SeqID_55171
  Gene Ontology: Mol. function=transferase activity; Cellular component= mitochondrion; Biological process=metabolic process
  Homolog annotation: Hit_ID=Q1SZV4; Match level="QueryCoverage=99%, HitCoverage=72%, E-value=0.0, Identity=49%"; Hit description =Pentatricopeptide repeat
  Pfam annotation: Domain name=PPR; Domain location=124-158; Score =38.2; E_value=2.8e-08; Accession=PF01535.11; Description=PPR repeat
  Pfam annotation: Domain name=PPR; Domain location=159-193; Score =39.5; E_value=1.2e-08; Accession=PF01535.11; Description=PPR repeat
  Pfam annotation: Domain name=PPR; Domain location=194-228; Score =48.5; E_value=2.2e-11; Accession=PF01535.11; Description=PPR repeat
  Pfam annotation: Domain name=PPR; Domain location=229-263; Score =33.0; E_value=1e-06; Accession=PF01535.11; Description=PPR repeat
  Pfam annotation: Domain name=PPR; Domain location=280-314; Score =40.8; E_value=4.7e-09; Accession=PF01535.11; Description=PPR repeat
  Pfam annotation: Domain name=PPR; Domain location=315-349; Score =42.3; E_value=1.6e-09; Accession=PF01535.11; Description=PPR repeat
  Pfam annotation: Domain name=PPR; Domain location=350-384; Score =37.9; E_value=3.5e-08; Accession=PF01535.11; Description=PPR repeat
  Pfam annotation: Domain name=PPR; Domain location=385-419; Score =46.7; E_value=7.7e-11; Accession=PF01535.11; Description=PPR repeat
  Pfam annotation: Domain name=PPR; Domain location=420-454; Score =45.3; E_value=2e-10; Accession=PF01535.11; Description=PPR repeat
  Pfam annotation: Domain name=PPR; Domain location=455-489; Score =23.7; E_value=0.00068; Accession=PF01535.11; Description=PPR repeat
  Pfam annotation: Domain name=PPR; Domain location=523-557; Score=8.4; E_value=0.76; Accession=PF01535.11; Description=PPR repeat
  Pfam annotation: Domain name=PPR; Domain location=560-594; Score =30.9; E_value=4.3e-06; Accession=PF01535.11; Description=PPR repeat
  Pfam annotation: Domain name=PPR; Domain location=595-629; Score =12.2; E_value=0.27; Accession=PF01535.11; Description=PPR repeat
  Pfam annotation: Domain name=PPR; Domain location=89-123; Score=25.5; E_value=0.00019; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=124 -158::159-193::194-228::229-263::280-314::315-349::350-384::385 -419::420-454::455-489::...
  Pfam module annotation: Domain location=523-557::560-594::595-629::89- 123
MASGLCEASLFEEAMDVLNRMRSNSCIPNVVTCRILLSGCLGRCKRILSMMMTEGCYPNREMFNSLYLLELAEKAYSEMLDFGVVLNKVNVSNFARCLCGAGKFDKAFKIICEIMSKGFVPDDSTYSKVIGFLCDASKVEKAFLLFEEMKKNGIVPSVYTYTTSIDSFCKAGLIQQARNWFDEMLGDGCTPNVVTYTSLIHAYLKARKVFDANKLFEMMLLKGCKPNVVTYTALIDGYCKAGQIDKACQIYARMQGDIESSDKDMYFKLDDNDCETPNIITYGALVDGLCKANRVKEARELLDTMSIQGCEPNQIVYDALIDGFCKTGKLENAQEVFVKMSERGYSPNLYTYSSLINSLFKEKRLDLVLKVLSKMLENSCTPNVVIYTDMIDGLCKVGKTDEAYKLMLKMEEVGCYPNVITYTAMIDGFGKIGKIEQCLELYRNMCSKGCAPNFITYRVLINHCCSTGLLDEAHRLLDEMKQTYSPRHISSYHKIIEGFNREFITSIGLLDKLSENESVPVESLFRILIDNFIKAGRLEVALNLLEEISSSSSLAVANKYLYTSLIESLSHASKVDKAFELYASMINNNVVPELSTFVHLIKGLARVGKWQEALQLSDSICQMDIRWLHEEM

SEQ ID NO: 171950 - protein, 138 aa, Glycine max
  Coding DNA Sequence Number=SeqID_55172
MVPRKLSFPHHNSVSRTSKKPKIEKQPHMCLWCICLTCQGHVMLSVLQIMFKTQDLPLGFDGMDSWDIVEARRIPNCASNEKLALWVIEWMQMEESFGSLLYGVLDEKALRMKVTMTLLLGTQPLQGRLDQKCRTHLA

SEQ ID NO: 171951 - protein, 117 aa, Glycine max
  Coding DNA Sequence Number=SeqID_55173
MTTRNGDNEAEKSVGSKGEAGKEHSLEVPLPTSMRSLRVEKDKVVVGDISGSATLDDVVAAIKQDYNQSAKDVVEDVAMSGTHNTFTYDETLCYENPNKAVSKATARCSRKEAYGKC

SEQ ID NO: 171952 - protein, 765 aa, Glycine max
  Coding DNA Sequence Number=SeqID_55174
  Gene Ontology: Mol. function=binding; Cellular component =intracellular; Biological process=metabolic process
  Homolog annotation: Hit_ID=Q5G1T1; Match level="QueryCoverage=89%, HitCoverage=93%, E-value=1e-130, Identity=32%"; Hit description =Embryo-defective 2261
  Pfam annotation: Domain name=PPR; Domain location=158-192; Score =44.4; E_value=3.9e-10; Accession=PF01535.11; Description=PPR repeat
  Pfam annotation: Domain name=PPR; Domain location=193-227; Score=4.1; E_value=2.5; Accession=PF01535.11; Description=PPR repeat
  Pfam annotation: Domain name=PPR; Domain location=259-293; Score =23.7; E_value=0.00067; Accession=PF01535.11; Description=PPR repeat
  Pfam annotation: Domain name=PPR; Domain location=294-328; Score=2.5; E_value=3.8; Accession=PF01535.11; Description=PPR repeat
  Pfam annotation: Domain name=PPR; Domain location=360-394; Score =43.0; E_value=1e-09; Accession=PF01535.11; Description=PPR repeat
  Pfam annotation: Domain name=PPR; Domain location=461-495; Score =42.4; E_value=1.6e-09; Accession=PF01535.11; Description=PPR repeat
  Pfam annotation: Domain name=PPR; Domain location=496-529; Score =10.9; E_value=0.38; Accession=PF01535.11; Description=PPR repeat
  Pfam annotation: Domain name=PPR; Domain location=532-566; Score =20.3; E_value=0.0072; Accession=PF01535.11; Description=PPR repeat
  Pfam annotation: Domain name=PPR; Domain location=598-632; Score =19.8; E_value=0.0096; Accession=PF01535.11; Description=PPR repeat
  Pfam module annotation: Pfam domain module=PPR::PPR::PPR::PPR::PPR::PP R::PPR::PPR::PPR; Domain location=158-192::193-227::259-293::294 -328::360-394::461-495::496-529::532-566::598-632
  Subcellular localization annotation: CTP_CleavageSite=66; ConfidenceScore=5.17e-01
MSSITCQGSWVLSNSSPIVVANDKNNDARHANFAQIPSWVSLKSSHSSLRTHQNQQGQVENLHLISLAKQGNLREVHEFIRNMDKVGISINPRSYEYLFKMCGTLGALSDGKLFHNRLQRMANSNKFIDNCILKMYCDCKSFTSAERFFDKIVDQDLSSWSTIISAYTEEGRIDEAVRLFLRMLDLGITPNSSIFSTLIMSFTDPSMLDLGKQIHSQLIRIGFAANISIETLISNMYVKCGWLDGAEVATNKMTRKNAVACTGLMVGYTKAARNRDALLLFGKMISEGVELDGFVFSIILKACAALGDLYTGKQIHSYCIKLGLESEVSVGTPLVDFYVKCARFEAARQAFESIHEPNDFSWSALIAGYCQSGQFDRALEVFKAIRSKGVLLNSFIYTNIFQACSAVSDLICGAQIHADAIKKGLVAYLSGESAMISMYSKCGQVDYAHQAFLTIDKPDTVAWTAIICAHAYHGKAFEALRLFKEMQGSGVRPNAVTFIGLLNACSHSGLVKEGKKILDSMSDEYGVNPTIDHYNCMIDVYSRAGLLQEALEVIRSLPFEPDVMSWKSLLGGCWSHRNLEIGMIAADNIFRLDPLDSATYVIMFNLYALAGKWDEAAQFRKMMAERNLRKEVSCSWIIVKGKVHRFVVGDRHHPQTEQIYSKLKELNFSFKKSKERLLNEENALCDFTERKEQLLDHSERLAIAYGLICTAADTPIMVFKNTRSCKDCHDFAKRVSIVTGRELVVRDGNRFHHINSGECSCRDYW

SEQ ID NO: 171953 - protein, 115 aa, Glycine max
  Coding DNA Sequence Number=SeqID_55175
MVRDWYRVGAANRDDEYAGLHSPLVVRGLDDAAGSPRARRGSQSVCISDMKRGKCQNVNMGVPCCRRSWQRPRPTAKALEDREANLPWQAYPDKNVSAEKAERVKALDSSPLFIG

SEQ ID NO: 171954 - protein, 178 aa, Glycine max
  Coding DNA Sequence Number=SeqID_55176
  Homolog annotation: Hit_ID=Q2QMH5; Match level="QueryCoverage=70%, HitCoverage=24%, E-value=7e-21, Identity=51%"; Hit description =Expressed protein
  Pfam annotation: Domain name=DUF828; Domain location=23-168; Score= -117.6; E_value=0.1; Accession=PF05703.2; Description=Plant protein of unknown function (DUF828)
MEPNLTMKFRRNENLPTNGKHLPESPRVPMEFLSRSWSASSLEVSKALTPPSSISDIPSKPPNAPSSVSVTNSISEQASEEFSTMCGNQFSFASSATSQLVLDRIMSQSAREEVSPLTSGRLSHSSEPLNGGASLTGTDSPPISPSAEFDDVVKLILNIDLKKVELILIICMWGHCYN

SEQ ID NO: 171955 - protein, 554 aa, Glycine max
  Coding DNA Sequence Number=SeqID_55177
  Gene Ontology: Mol. function=protein serine/threonine kinase activity; Cellular component=cytosol; Biological process=protein amino acid phosphorylation
  Homolog annotation: Hit_ID=Q1SMH9; Match level="QueryCoverage=99%, HitCoverage=91%, E-value=0.0, Identity=76%"; Hit description=Protein kinase
  Pfam annotation: Domain name=Pkinase; Domain location=1-202; Score =123.5; E_value=6.1e-34; Accession=PF00069.15; Description=Protein kinase domain
  Pfam annotation: Domain name=Pkinase_Tyr; Domain location=1-202; Score=-55.7; E_value=4.7e-09; Accession=PF07714.7; Description =Protein tyrosine kinase
  Pfam module annotation: Pfam domain module=Pkinase::Pkinase_Tyr; Domain location=1-202::1-202
MELISKVRNPFIVEYKDSWVEKGCFVCIVIGYCEGGDMAEAIKKANGVYFPEERLCKWLVQLLMALDYLHANHILHRDVKCSNIFLTKDQDIRLGDFGLAKMLTCDDLASSVVGTPSYMCPELLADIPYGSKSDIWSLGCCVYEMAAHKPAFKALTFYRLIGNIGKCIGRYQVISRGLVKSMLRKNPELRPSAAELLNHPHLQPYILKIHLKLNNPRRSTYPFQWSDSNYVRRTQFLEPGSVSTLSDRDKRLSFSNDRALNPSISGTELGSVCSTQRALGFSTCSKEKHYELSVGLVREECNFNKSRDTKSSTVDRLPRLRSAKEYATPRRQTIPSKISYTGSKRELLPSTPAGGKFTPPTRRASLPLPTRTMCTTTPYRANVGLLRGVDSPDISVNAPRIDKMAEFPLASCEDSLFPVRGTSSTSAQCSSGSPKSADCLITKDKCTIQVVDKASVPSSGSDACPAAPVSHGNECSEHAVSSHSSAESSRHRFDTSSYQQRAEALEGLLEFSARLLQQQRFEELGVLLKPFGPEKVSPRETAIWLAKSFKETVA

SEQ ID NO: 171956 - protein, 107 aa, Glycine max
  Coding DNA Sequence Number=SeqID_55178
METSVLVISVCGSDSIPITHHNPNPIFRSVFFLSSLGLLIEDILEKVAVTKLKLDKDRKAKGRVATDKEKGTKFTLVDIICAYHVIIKVNGINCVYERLGAITEMDA

SEQ ID NO: 171957 - protein, 352 aa, Glycine max
  Coding DNA Sequence Number=SeqID_55179
MEMEEAETIDLYELQYSDLSSPSTSSMVDSIMEALEPTVPGLLAVPIASNLRSHLLSLSRKLALLDLDTRKLVLKEHNLGSDVPLRNPDRSVSPFAMQLKYAKSQHVQQTVSECYGMEFENLGRSFKELGFCMMELGFCLARICDKAIGGNELEQSLLDSCAAKGRLIHHHSHLDALLLKQHERSRATSKRRGNNVKPLEGSESNSIASNVNSGGNHLNLWQQWHYDYGIFTVLTTPLYMIPISKERAIMVKAPPESFIIQVGEALLDPPAWTKTFSISDYHHANSTFNGQLLVATDEEQEQSERDSNNLSQEIKKIVPPLSSRLKEGMTFAEFSRETTKQFYGGSGLQSNR

SEQ ID NO: 171958 - protein, 116 aa, Glycine max
  Coding DNA Sequence Number=SeqID_55180
  Homolog annotation: Hit_ID=O22145; Match level="QueryCoverage=37%, HitCoverage=9%, E-value=5e-08, Identity=70%"; Hit description =Putative O-sialoglycoprotein endopeptidase
  Subcellular localization annotation: CTP_CleavageSite=57; ConfidenceScore=5.48e-01
MSLCCIPDSISAVKVLKATCLVFFSTFAPKLLPKPPPSLFSALTTFCRNQLPLISSLAASKRDGDVVVLGIETSCDDTADAVVRSDGEILSQVVSSQVRCRIVCAEFAFVVFPSQV

SEQ ID NO: 171959 - protein, 441 aa, Glycine max
  Coding DNA Sequence Number=SeqID_55181
  Gene Ontology: Mol. function=zinc ion binding
  Homolog annotation: Hit_ID=Q108W5; Match level="QueryCoverage=44%, HitCoverage=13%, E-value=1e-22, Identity=36%"; Hit description =Expressed protein
DLKGSRHLKESGAFDRKFPSRIDRPVASLVVSTPKGDQKLTPHAESSKASAMNNNRELKVNQDGKSCALPRSMSNISRKSLEPQVSSERTSTRVDETQQDVLSQSRETANQVERSRDSSSDRGRPAVPTSKNPLCQKCKEFGHALECCTAGSTQESGAEISVTASSSSKEEMHKDNILKVAIQAALLRRPEIYKKKEVSYQTDEVSTSGTELNCEVTSKDQVLVSSTLKNSISADETQEQQEILENSTSDSSKCSSANDLKQLNSCPTDFRSKPGKSDSIGLAAGKPVVRDLSDKAVTMSSVPLKMLAFPEYEYTWQGVFEVHRNGKPPDLYTGFQAHLSSCASPKVLGVVNKFLPKVSLSEVSRLSMWPSQFLHGGVSDDNIALYFFARDVERQAYGYYSYIDSVDHEMQKFHFSLLQELTFYLCSVTVMRDTTRVYWIT

SEQ ID NO: 171960 - protein, 310 aa, Glycine max
  Coding DNA Sequence Number=SeqID_55182
  Homolog annotation: Hit_ID=Q75GL2; Match level="QueryCoverage=93%, HitCoverage=64%, E-value=2e-59, Identity=43%"; Hit description =Expressed protein
  Pfam annotation: Domain name=DUF828; Domain location=1-155; Score =55.4; E_value=1.8e-13; Accession=PF05703.2; Description=Plant protein of unknown function (DUF828)
  Pfam annotation: Domain name=PH_2; Domain location=195-305; Score =235.0; E_value=1.7e-67; Accession=PF08458.1; Description=Plant pleckstrin homology-like region
  Pfam module annotation: Pfam domain module=DUF828::PH_2; Domain location=1-155::195-305
MSGATTGNATPSSGPKTVGRWLKDRREKKKEEHRAHNAQLHAAISVAAVAAAVAAVTAATAASSAANKDEKMAMAVASAATLVAAQCVEAAEAMGAERDHLASVVSSAVNVRSHDDITTLTAAAATALRGAATLKARALKEVWNITAVTPIERGIGIGICGKGNNSNSSTSDSGEIINGENFLGACSQEFLARGTALLKRTRKGDLHWKIVSVYIHRTGQVMLKMKSRHVAGTITKKKKNVVLDVCTNLPAWPGRHLFDDSEERRYFGLKTEARGIVEFECRNQREYDTWTHGVSRLLSIVARRQNINGV

SEQ ID NO: 171961 - protein, 135 aa, Glycine max
  Coding DNA Sequence Number=SeqID_55183
MAASDIAIMRDKAHIPTKKSLLELTSQDALLAQNKLLSKQLEALTETLRCTICGGAHESGCCIPVEEHPAREVNYMGNQPRNNFNAGEFSGFQHGQQYNQQQGQWRNHPENQFNRDQGGTSIRPQQLGPSLCGIL

SEQ ID NO: 171962 - protein, 129 aa, Glycine max
  Coding DNA Sequence Number=SeqID_55184
MRHLVTLFHQHLNIPLDSEPYVPIKRSFLKGASVIASFGYQKEHDGSWVKKGARHVCEEGHDGEDSSLLSKIMGRFDGLQTFVGERFDTLELQVDMRFNEMESRITKVEEDVSYIRSSFDLPPPPPPSS

SEQ ID NO: 171963 - protein, 70 aa, Glycine max
  Coding DNA Sequence Number=SeqID_55185
MSVKNLVRRLGVHDKTNHTLASQVTLTSFISPPLKGLSINSPPLKGLIINSPPFKGLIINSSPLKGLKVV

SEQ ID NO: 171964 - protein, 93 aa, Glycine max
  Coding DNA Sequence Number=SeqID_55186
  Subcellular localization annotation: CTP_CleavageSite=38; ConfidenceScore=5.43e-01
LIYKGWSVAYNPWPTSKRPSPKPKVSKSTRPVTDKSSRVQLKTSKKCYKEAAYDAILPRKGPVTRAISKRLQEDWTRAAKEGPRVLMNLKVDF

SEQ ID NO: 171965 - protein, 887 aa, Glycine max
  Coding DNA Sequence Number=SeqID_55187
  Gene Ontology: Mol. function=binding; Cellular component=thylakoid; Biological process=ethylene mediated signaling pathway
  Homolog annotation: Hit_ID=Q1SMH2; Match level="QueryCoverage=99%, HitCoverage=100%, E-value=0.0, Identity=81%"; Hit description=BTB/POZ
  Pfam annotation: Domain name=BTB; Domain location=173-280; Score= -6.2; E_value=0.015; Accession=PF00651.21; Description=BTBPOZ domain
  Pfam annotation: Domain name=TPR_1; Domain location=381-414; Score =6.2; E_value=0.97; Accession=PF00515.18; Description=Tetratricopeptid e repeat
  Pfam annotation: Domain name=TPR_1; Domain location=510-543; Score =5.8; E_value=1.1; Accession=PF00515.18; Description=Tetratricopeptide repeat
  Pfam annotation: Domain name=TPR_1; Domain location=710-743; Score =29.3; E_value=1.4e-05; Accession=PF00515.18; Description =Tetratricopeptide repeat
  Pfam annotation: Domain name=TPR_1; Domain location=839-872; Score =8.1; E_value=0.57; Accession=PF00515.18; Description=Tetratricopeptid e repeat
  Pfam annotation: Domain name=TPR_2; Domain location=381-414; Score =6.0; E_value=6.6; Accession=PF07719.7; Description=Tetratricopeptide repeat
  Pfam annotation: Domain name=TPR_2; Domain location=510-543; Score =7.9; E_value=4; Accession=PF07719.7; Description=Tetratricopeptide repeat
  Pfam annotation: Domain name=TPR_2; Domain location=636-669; Score =5.4; E_value=7.7; Accession=PF07719.7; Description=Tetratricopeptide repeat
  Pfam annotation: Domain name=TPR_2; Domain location=710-741; Score =11.8; E_value=1.4; Accession=PF07719.7; Description=Tetratricopeptide repeat
  Pfam annotation: Domain name=TPR_2; Domain location=742-775; Score =13.8; E_value=0.61; Accession=PF07719.7; Description=Tetratricopeptid e repeat
  Pfam annotation: Domain name=TPR_2; Domain location=806-838; Score =4.8; E_value=9.1; Accession=PF07719.7; Description=Tetratricopeptide repeat
  Pfam annotation: Domain name=TPR_2; Domain location=839-872; Score =13.6; E_value=0.7; Accession=PF07719.7; Description=Tetratricopeptide repeat
  Pfam module annotation: Pfam domain module=BTB::TPR_1::TPR_1::TPR _1::TPR_1::TPR_2::TPR_2::TPR_2::TPR_2::TPR_2::TPR_2::TPR_2; Domain location=173-280::381-414::510-543::710-743::839-872::381-414::510 -543::636-669::...
  Pfam module annotation: Domain location=710-741::742-775::806 -838::839-872
MRTFFTAESCKEAHHSALNPQSWLQVERGKLPRLSSQSSSASIESLIKVPQSPILPFFKPVDYVEVLAQIHEELESCPPQEQSNLFLLQYQVFKGLGDVKLMRRSLRSAWQRANTVHEKIIFGAWLKYEKQGEELVAQLLTACGKCEKEFGPLDVESHIPFDKNVSSQDRALMNGNDASEYVIFKIGDEKIVCDRQKISELSAPFHAMLKGCFRESLSETIDLSENNLSPSGMRAVSYFSLTDSLLDVPPNLLVEILAFANKYCCEGLKQACDRRLASLVSSREDALELMEYAVDQNSAVLAASCLQVLLRNIPKCLSDNRVVELFIHANKQQLAVMVGPGIFSLFCFLSEVSMNLNSSSDTTAHFLERLVDFAENDKQRLLAFHQLGCVRLSRKEYDEAYCLFERALNVGHIYSVAGLARLDSIKGEKLLSYEKISSVISSVTPLGWMYQERSLYCDGDLRRKDLEKATELDPTLIYPYMYRTASLMKSGNVQVALAEINRILGFKLSLECLELRFFIYLVLEDYKAALRDVQAILSLCPSYKMFEGRVAASQLCTLVREHVEHWTTADCWARLYDCWSAVDDIESLSVIYQMLESDVAKGVLYFRQSLLLLRLNCPEAAMRSLQLAWQHVSSEHERLVYEGWILYDTGHCEEGLQKAEESISIKRSFEAYFLKAYALADSSLDSSCSSTVISLLEDALRCPSDNLRKGQALNNLGSVYVDCGKLELAEDCYIKALKIQHTRAHQGLARVHFLKNDKAAAYKEMTNLIEKARNNASAYEKRSEYGDREITKADLEMVTRLDPLRVYPYRYRAAVLMDSHKEEEAIAELSRAIAFKADLHLLHLRAAFHEHKGDVLGALRDCRAALSVDPFHQKMLELHCRVNSHEP

SEQ ID NO: 171966 - protein, 341 aa, Glycine max
  Coding DNA Sequence Number=SeqID_55188
  Gene Ontology: Mol. function=sequence-specific DNA binding; Cellular component=nucleus; Biological process=regulation of transcription, DNA-dependent
  Homolog annotation: Hit_ID=Q9LUH8; Match level="QueryCoverage=91%, HitCoverage=87%, E-value=1e-77, Identity=46%"; Hit description=Heat shock transcription factor-like protein
  Pfam annotation: Domain name=HSF_DNA-bind; Domain location=40-204; Score=222.0; E_value=1.3e-63; Accession=PF00447.8; Description=HSF -type DNA-binding
MNYMYQVKEEYLESSPSSSYQLGGEFPAKPIEGLHDTGPPPFLTKTFDVVDDPVTNHVVSWSRDGTSFVVWDPNTFSTSLLPRYFKHNNFSSFVRQLNTYGFRKIDPDKWEFANEGFIRGHRHLLRNIRRRKAPSQLTQGHHCVEVGRFDLDKEIDRLRHDKLVLLMELVNLRKQQQKARMYIQEMEQRLQGTEIKQKQMMAFLARAIKNPTFIHQLLQKEKSKELEEAFTKKRRQIEQGARGFGESSSVKVEALEFGESELEMLAREMQGFGKGGIDREVGPEALESQERLDRVLDEEFWEELLFSEKFEGRLDIPTAEDKDEDVIKVLANQLDLLDSSH

SEQ ID NO: 171967 - protein, 456 aa, Glycine max
  Coding DNA Sequence Number=SeqID_55189
  Gene Ontology: Mol. function=zinc ion binding
  Homolog annotation: Hit_ID=Q2QSD0; Match level="QueryCoverage=23%, HitCoverage=8%, E-value=4e-20, Identity=44%"; Hit description=PHD -finger family protein, expressed
  Pfam annotation: Domain name=C1_3; Domain location=252-282; Score =5.9; E_value=0.1; Accession=PF07649.3; Description=C1-like domain
  Pfam annotation: Domain name=PHD; Domain location=253-302; Score =25.4; E_value=0.00016; Accession=PF00628.19; Description=PHD-finger
  Pfam module annotation: Pfam domain module=C1_3::PHD; Domain location= 252-282::253-302
MIQNIDMRLESGTCNVCSAPCSSCMHLNHALMGLKAEEFSDENCRIGEANSMDEDNEYSLRSRACESSQHTVSEASNMQSVNSSHDALSENADSRQIILNKYQDSKHLEGLDDNTSCISRASDANLVNDSHQRNEERIIMNVERDSFSHVPEKLSECSIENSSSSLTKEREPVVSGEKYIAVIESTSKISLKVCPKSEADTDVCDANNEDPKYAVQDGQCEKAQELVKSPGKQEPQSDDESDESDVVEHDVKVCDICGDAGREDLLAICSRCSDGAEHTYCMREMLEKVPEGDWLCEECKDAEENENKRLDVDDKKMVEVSSTSQVSGKRLSDNIEVAPAAKRQALESSIGSPKTSSPKRLVPLSRESSFKSLDKSKVKPGLLMPIRNHSGGIDTEIARSPSIGPRGQNPKGMLLKSNSFNNLNSKPRVKLVDEVVPPPKKGGNEHTSKNMEMPAR

SEQ ID NO: 171968 - protein, 120 aa, Glycine max
  Coding DNA Sequence Number=SeqID_55190
MVACAIWYTQAKRSYIYILRDCYSVRQIWKATLVDLLGLNFFTMDLFRWVVLNLKADCNSIDGFEWATWFVESVYLIWQARNQEVFSDIHLSTGVLGTPHIMINCDSKVVLELVPQEVFA

SEQ ID NO: 171969 - protein, 316 aa, Glycine max
  Coding DNA Sequence Number=SeqID_55191
MSHEFQAFYTSIRVWTITPSPMHDFPHLFANGAHPTRTTKDSFITHRAFCDALAEESARLSANQLATNTTTNPLVHSLFLLPTQQRNNNNNINFINPWDPNPNPSNLTTLHNNNIKPESHNFHIPNTSTNNNNNISSSLLHHHQQPNKRIITSPYRDLHVRTQPHSNAATSAHLSATALLQKAATVGAAAITGPTLMTQLSMAELGAVTTQLDSVPMTVPLPPDQRYMNMRGLKNNNNDGLTRDFLGLTNGSAVDVSIDVKDMLTFTAGSIEYNHRHQQQQSYEHHHSHNNLLFKPQQGFGFLGTTTGPESWGNCE

SEQ ID NO: 171970 - protein, 205 aa, Glycine max
  Coding DNA Sequence Number=SeqID_55192
  Homolog annotation: Hit_ID=Q6ZIK5; Match level="QueryCoverage=80%, HitCoverage=44%, E-value=4e-44, Identity=52%"; Hit description =Putative growth-regulating factor 1
  Pfam annotation: Domain name=QLQ; Domain location=12-48; Score=74.1; E_value=4.3e-19; Accession=PF08880.1; Description=QLQ
  Pfam annotation: Domain name=WRC; Domain location=76-121; Score =100.8; E_value=3.9e-27; Accession=PF08879.1; Description=WRC
  Pfam module annotation: Pfam domain module=QLQ::WRC; Domain location =12-48::76-121
MNKSGGGEMSKWPFTMSQWQELEHQALIYKYMVAGLPVPPDLVLPIQNSFHSISQTFLHHPSTTMSYCSFYGKKVDPEPGRCRRTDGKKWRCSKEAYPDSKYCERHMHRGRNRSRKPVESQTMTQSSSNVSSLTVTAGSSSSATGNFHNLTTTNAYGNPQGTGSGSDQTHYHMDSIPYGIPSKEYRKKNYFNGNYVTRIILPGIF

SEQ ID NO: 171971 - protein, 103 aa, Glycine max
  Coding DNA Sequence Number=SeqID_55193
  Homolog annotation: Hit_ID=Q9FIX7; Match level="QueryCoverage=76%, HitCoverage=9%, E-value=3e-20, Identity=61%"; Hit description =Arabidopsis thaliana genomic DNA, chromosome 5, TAC clone:K9D7
  Pfam annotation: Domain name=Plus-3; Domain location=1-92; Score =16.8; E_value=3.4e-05; Accession=PF03126.8; Description=Plus-3 domain
MNVLYVRWINTRGSISQLDGFFLRLRLGKWEEGPGGTGYHVAYINETQSQRQCSEQNTRKSLSVKVGSIKCMVESQYISNHDFLELNAIVRETNHFKYNEDQR

SEQ ID NO: 171972 - protein, 682 aa, Glycine max
  Coding DNA Sequence Number=SeqID_55194
  Gene Ontology: Mol. function=nucleic acid binding
  Homolog annotation: Hit_ID=Q1STK5; Match level="QueryCoverage=83%, HitCoverage=99%, E-value=6e-79, Identity=60%"; Hit description=Zinc finger, CCHC-type
  Pfam annotation: Domain name=zf-CCHC; Domain location=494-511; Score =16.1; E_value=0.0022; Accession=PF00098.13; Description=Zinc knuckle
  Pfam annotation: Domain name=zf-CCHC; Domain location=535-552; Score =12.9; E_value=0.0075; Accession=PF00098.13; Description=Zinc knuckle
  Pfam module annotation: Pfam domain module=zf-CCHC::zf-CCHC; Domain location=494-511::535-552
MDQNPSPGRHSDGSVNIGLEKKAVVTDDDLHTAVEPIIEYRGSGAHETNLASSSKNPLEKLEYSAENDLQTFNCEAACAGTSRVNVSETENKFQDTEMMLPCDKILPVLHSPCHSRIHMAINKGKEKSLSDGDANVMLSREENDSHSSVESCNSTGFFSTGKKRRNFQQQLIIGSKRVKKQIEESSGPKSYVKQDNSFMNWISNMVKGLSPSIQNDSNTLALTLANPDHHNLQPDEKLIACNMNQDPEPKNTGFKSIFQSICCPSLKNVGTRMSHQEGKSSQDLVPGNMEHGIDATPITCWAENNSLSKLCLQSNKFEVSTGGNDAGLSSQPKIKPLNFFNCHESSKNNPVETKNYSILGHSKDKEEVASHSSSTKQNTDNNDNIDSNVLCDRKEEENICHRRDNLGSLWITRFSPKFTAPLREQPANDTEVSTDLKEDKGNNDHKSMYLFKPLSSSPGFRNLEPTASMFGRRFGAIKQIIPTNATDTTTQVNMLCFFCGTRGHQLSDCLAIAENKLEDLQKNIDSYGGLEEHHCLCIKCFQPNHWAISCPTSISTRKHELKANALVNDCGKHLISSNEGSARLLTDEDDRVLSGGSINDETDQRAGQNINLKWKSNEIITHKVGCNASFKKYRGLSSEENKFRENPTLSPSKLAERQISQVPKEIFEAVKKLQLSRTDILK

SEQ ID NO: 171973 - protein, 150 aa, Glycine max
  Coding DNA Sequence Number=SeqID_55195
MGINKRRWCRFYGLFRCGCYALNTVQISDNRLLNCKLTNRSTGTDEEQLQSPICISLIFGGTCGANSSIRFHFIWHLQTQTKKSSSFKYASIHSLEQKSLNAIMYFLSYMKVKLKSQCTCSATNARDSCTGTMMRIETIEKRKMPPSKYI

SEQ ID NO: 171974 - protein, 243 aa, Glycine max
  Coding DNA Sequence Number=SeqID_55196
  Pfam annotation: Domain name=Tryp_alpha_amyl; Domain location=68-148; Score=22.4; E_value=0.00051; Accession=PF00234.12; Description =Protease inhibitorseed storageLTP f
MERWWREKENKDRGNANAMMRVLDQSASFLSVVTPNAKRITATTKNAAAALLLLVFFLSAATEAAAGCTEELISFSACLPYVSYPPNNLTESASKKCCEEFSSAVESESVCLCYLIRQPLILGFPLNTTRLHSLSSLCSTSTSFPFLCSSSSSESSALPPLNSALPTQTEGSSASLSGAGGGGSRGKGGGSYGSGTTVVPTFTGAGGGSQHRSSHVSTLTTSQFLSIHLATIFLTTCHLYNSC

SEQ ID NO: 171975 - protein, 244 aa, Glycine max
  Coding DNA Sequence Number=SeqID_55197
  Gene Ontology: Mol. function=N-acetyltransferase activity; Biological process=metabolic process
  Homolog annotation: Hit_ID=Q5ZC07; Match level="QueryCoverage=95%, HitCoverage=50%, E-value=1e-61, Identity=45%"; Hit description =Transcription factor jumonji (JmjC) domain-containing protein- like
MESSSIGIRRYEELPTVKDFESLIEPANVPAARVGYCTVEAMVSQSAPVFYGDLGGHQRVPLPFSTFLDFCKKRMQMQSKHQQGLDQCPASQTHDDTEHAYLALEDAPEQIYLAQVSIMNSDRQENVQLETLREDIQTPPILVSKELSSINLWMNNAQARSSTHYDPHHNLLCIVSGCKQVVLWPPSASPSLYPMPIYGEASNHSSVTLENPDYSIYPRAECSMEFAQKAVLQAGDALFIPEGW

SEQ ID NO: 171976 - protein, 71 aa, Glycine max
  Coding DNA Sequence Number=SeqID_55198
MVQNQECDRERTKSSSLSQTSYAAALVLRSLVLTNLPTPAILHDSNNCGYNPIPTEILLDSNTIGPGTLTL

SEQ ID NO: 171977 - protein, 122 aa, Glycine max
  Coding DNA Sequence Number=SeqID_55199
MTTEPRTWKSVWCGMKTTHQYNLEHIPYVYGELFHTLYGSTEWVKNSSISQPLVSSIWYLEPPCLFFKGFCIWSAKPKVPSLSLCPNNNLNIQKFLPLTYPLSKAALVTLTKNRRPLLFLPR

SEQ ID NO: 171978 - protein, 694 aa, Glycine max
  Coding DNA Sequence Number=SeqID_55200
  Gene Ontology: Mol. function=hydrolase activity; Cellular component =cellular_component; Biological process=multicellular organismal development
  Homolog annotation: Hit_ID=Q8GYD9; Match level="QueryCoverage=81%, HitCoverage=57%, E-value=0.0, Identity=63%"; Hit description =Probable RNA helicase SDE3
  Pfam annotation: Domain name=ResIII; Domain location=202-373; Score= -21.9; E_value=0.0032; Accession=PF04851.6; Description=Type III restriction enzyme, res subunit
MAALQYLLTLPKTSARLVRVGAVIVEYGGILGSNRKVWNLSPTLEVWDSNMGFIRTWVLQLKQLAFFVWFSSGSYQNHLYKLNITNKTSAQLVCVCAGVVECSGMLGSHCKVRVLSPTLEVRDSNGYIHRVEADEIYLKFDPGFHFYHRDENRYDVHFTYNRINMRRLYQAAEAAEKLVTDFLFPSTSRKRHIKTTSLLPISGTFNEEQISSIKMILGCKGAPPYMIHGPPGTGKTRTMVEAILQLYKYHKNARILVCAPSNSAADYILEKLLAQQDVEFRENEIFRLNASARPYEDVKPEFVRFCFFDEMVFKCPPVNALIHYRIIISTYMSASLLYAEDVSHGHFSHIFLDEAGQASEPETMIPVSHLCTSDTVVVLAGDQLQLGPVIYSKKADEYGLGVSYMERLCECELYASGDTNYVTRLIRNYRCHPVILHLPSKLFYCGELIACRDSKSFMVIGDLLPNKDFPIIFYGIQGCDEREGNNPSWFNRIEASKVIEVVRRLIAGGNIKEENIGIITPYRQQVLKIKQTLENLDMPEIKVGSVEQFQGQEKEVIIISTVRSTIKHNEFDRVHCLGFLSNYRRFNVAITRAISLLVIIGNPHIICKDDHWSQMLWHCVDNSSYQGCSLPERVELYEDEDTGENTCFTEDNASPSNNVEWGQDSSNNGEWGQDSSFTKPVTDEAEWSDGWRSN

SEQ ID NO: 171979 - protein, 258 aa, Glycine max
  Coding DNA Sequence Number=SeqID_55201
  Homolog annotation: Hit_ID=Q1G2Y5; Match level="QueryCoverage=32%, HitCoverage=39%, E-value=1e-22, Identity=60%"; Hit description =Protease inhibitor
  Pfam annotation: Domain name=Tryp_alpha_amyl; Domain location=85-165; Score=35.1; E_value=2.4e-07; Accession=PF00234.12; Description =Protease inhibitorseed storageLTP f
MAVELSNQLQHLYFFSPPLPFYSLFINFLTLLHFPIIKLPIPNCTFEHKQPKLQNMERFVRLTVVLAMAMVMAAPAYAQISSTPCSTSMINSLFNPCMNFLTNSSANGTSPTAECCNSIKSLTSGGMDCLCLIITGNVPFRIPINRTLAISLPRACNLPRLPLQCKTSGGSPLPAPGPAAFGPSLSPSAPSLSPEASSVLPSPSLAPVSDTTPPLLTPSSATTGSGRSDLTPSSAMSSYRFLPSVVLIVLGFAVLKHY

SEQ ID NO: 171980 - protein, 542 aa, Glycine max
  Coding DNA Sequence Number=SeqID_55202
  Gene Ontology: Mol. function=inositol or phosphatidylinositol phosphatase activity; Biological process=abscisic acid mediated signaling
  Homolog annotation: Hit_ID=Q9LR47; Match level="QueryCoverage=92%, HitCoverage=94%, E-value=0.0, Identity=62%"; Hit description=Type I inositol-1,4,5-trisphosphate 5-phosphatase CVP2
  Pfam annotation: Domain name=Exo_endo_phos; Domain location=92-502; Score=156.5; E_value=6.9e-44; Accession=PF03372.13; Description =EndonucleaseExonucleasephosphatase family
MVLLMEFTKSGFFPQELGTNMLLLQSNEMQKHCGEKIEGRDDVEYRSRNSSFSEREIKKSKTEKFSRNTEQVRRGRVSLDHPRIIDVHNYSIFVATWNVAGRSPPSNLSIDDWLHASPPADIYVLGFQEIVPLNAGNILGAEDNGPAKKWLALIGKTLNNLPGTSGGGGYYTPSPIPQPVVEINADFEGSARQKNSSFFHRRSFQTTSSGWGMDNDTSTMQPRLDRRFSVCDRVIFGHRKSDFDPSFRWGYRPSDYSRASDYSRPSDYSRWGSSDDDNGLGDSPSTVSPLSYGGPASAEDGYGMPGRSRGLMGYLGNKGSISISMSLHETSFCFICSHLTSGQKEGDELRRNSDVMEILKKTRFPRVHGADNEKSPETILEHDRIIWLGDLNYRIALSYRSAKALVEMQNWRALLENDQLRIEQKRGRAFVGWNEGKIYFPPTYKYSTNSDRYAGDDMHPKEKRRTPAWCDRILWYGEGLHQLSYVRGESRFSDHRPVYGIFWAEVESSHGRLKKSMSCSRNRIEVEELLPYSHGYTELSFF

SEQ ID NO: 171981 - protein, 121 aa, Glycine max
  Coding DNA Sequence Number=SeqID_55203
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q84QD6; Match level="QueryCoverage=55%, HitCoverage=17%, E-value=5e-12, Identity=53%"; Hit description =Avr9/Cf-9 rapidly elicited protein 284
  Subcellular localization annotation: CTP_CleavageSite=66; ConfidenceScore=5.79e-01
MSCSVAVPTSPVFSFYNNNNNVNSSTAEPLMLSLPIPSTTPSCSSLSPPSSPLLKRKRPAKIDIPVASIAFAVSPTAAPSPARDAFEVDGPGFSVFCKRGRRHHMEDCFSAAVDLHGQPKQ

SEQ ID NO: 171982 - protein, 1046 aa, Glycine max
  Coding DNA Sequence Number=SeqID_55204
  Homolog annotation: Hit_ID=Q9LS59; Match level="QueryCoverage=72%, HitCoverage=88%, E-value=1e-134, Identity=37%"; Hit description =Genomic DNA, chromosome 3, P1 clone: MYF24
  Subcellular localization annotation: CTP_CleavageSite=56; ConfidenceScore=5.32e-01
MSTSILAPLPLNPISVNTLNQGTLKPAFQSSTLLSAHPLATPSRLEHAHSLLLDLCAAEKALSQGQQLHARLLKSHLSVFLATKLVHNRGGGTFGGAASAIAMELSEEWKSFFPTGASTVSPLLLSRSHSLPLGPLLFNPNPNSLSVLFSSPSLVPCLHLPPHLFPSRFLLTSHPHSILPSTASSVASLFSFPNQNDAASLFLRNRLHLLYYPNRPNAVVFFPTGANDDKLGFFILAVKDSRLDILLDSNGDVFRASTGSAHRILNISVNPVADSGLFNESHVIGYLLASALYSVHWFAVKHNSVLDRPSVFYLGGKTFKTCPVGTRLKVPWNDLGFSVNNTVWLSCEFSWHPRVFVVARSDAVFLVDFRLKECSVSCLMKIETLRMYAPGGNERFLALSRVGPDDFYFAVASTSLLLLCDMRKPLVPVLQWMHGIEGPCFMSVLSLSNLRSHSRDDAFKLASESGFCIVLGSFWNCEFNIFCYGSILPFRKGSVTSKINPNICAWELPFEIKLSGHECHCGSCLLRKEFSKDALPEWVDWQLKKEIVLGFGVLSNDLAALLCEPDENGGFTLIRLMSSGRFELQRYHASWTQARNMKDFHDQVFCLDRHLLYPESDEKYKFRKYFHYLKLDFLYEYAGGDLSRFLVKKLEKNCMDAQDEEPFCDEVHELLCEKLNACGFGQSRSYPAVTSVFNDVKLPASLHEVALRRLWVDLPMELLQLAFLSYAECHKVVGDLDQNKIALEFLAVPDLPQLPPFFLRKSSPHGNEDIVGPVIPFPVLLVLNEFHNGYSNLEGDAFSVEAELGLKYKEVMQVAGEIAVSAYGPAHLDDHAVSLAEDGEETWVGSSKPKSFLLYHPIAFNSSATDLVREKSVYSNTIYDTFISHVPEKKSNEKTESVGQEIFDDLCPVELRFAAPVNKLEPQVMGFGSGKLPIYEVGATIDIALDSCMVSLKKVEANQASICSASGVTMIFPFLVSDILGVNNSAQKVFGEVTSFSLLLTTLHGLQSDSGDLDQSSLNVCIKLKLLDLIEKFAMLVRSIRKASCQ

SEQ ID NO: 171983 - protein, 3676 aa, Glycine max
  Coding DNA Sequence Number=SeqID_55205
  Gene Ontology: Mol. function=metal ion binding; Cellular component =membrane; Biological process=actin cytoskeleton organization and biogenesis
  Homolog annotation: Hit_ID=Q9ZQX5; Match level="QueryCoverage=97%, HitCoverage=99%, E-value=0.0, Identity=62%"; Hit description =Putative transport protein
  Pfam annotation: Domain name=Beach; Domain location=3058-3338; Score =755.0; E_value=4.8e-224; Accession=PF02138.8; Description=BeigeBEACH domain
  Pfam annotation: Domain name=WD40; Domain location=3415-3452; Score =24.0; E_value=0.00054; Accession=PF00400.22; Description=WD domain, G-beta repeat
  Pfam annotation: Domain name=WD40; Domain location=3464-3502; Score =42.9; E_value=1.1e-09; Accession=PF00400.22; Description=WD domain, G-beta repeat
  Pfam annotation: Domain name=WD40; Domain location=3625-3663; Score =6.7; E_value=6; Accession=PF00400.22; Description=WD domain, G-beta repeat
  Pfam module annotation: Pfam domain module=Beach::WD40::WD40::WD40; Domain location=3058-3338::3415-3452::3464-3502::3625-3663
  Subcellular localization annotation: CTP_CleavageSite=47; ConfidenceScore=5.68e-01
MKWVTLLKDFKEKVGLTQSPPSASAPPSSFSPPSSSSRDNNNAFPASQSSASSPTRDKHELELDFKKFWEEFRSSSSEKAKEAALNLSIDAFCRLVKQHANVAQLVTIIITLAYITLSVRSCNMLLSVFTLVVYGAVMLLMLNCYVLVIWLVETHIFSFVVGRAFVTDIEKLKISSKTRSLDVAQVLKFFSEVTKRFPSMQDGISPGANLLTSVEILVSGPIDKQSLLDSGIFCCLIQVLNALLDPDVTIQRPNSTTDHEDNIVLQKDYDEVGQNRRLEVEGSVVHIMKALASHSSAAQSLIEDDSLQLLFQMVAKGSLIVFSRYKEGLVPLHSIQLHRHAMQILGLLLVNDNGSTAKYIRKHHLALVQGVGWCGFSIYCDKRIPFRSLLFQSHIKVLLLSVKDFDPDCGDAAFTVGIVDLLLKCVELSYRAEAASVRLREDIHNAHGYQFLVQFALTLSNMSKNQGFQSTRSDTFDDQDIASDGSENSRGQNSNEQEHSSIQYLSPTLSRLLDVLVSLAQTGPNESPRTYGGKGSKSTQNKGGGHSKSRTLSSDWLGDELWEKENDKIKDLEAVQMLQDILIKANSWKLQAEVLNRLFKIFSGHIENYRLCQQLRTVPLLILNMAGFPSHLQEIILKILEYAVTVVNCVPEQELLSLCCLLQQPITSALKQTILSFFVKLLSFDQQYKKVLREVGVLEVMLDDLKQHRILGPDQLTVNSDQLERKNSSNNFKKRLDNRDVIITSPKLMESGSGKFPIFDVEDTIAIAWDCMVSLLKKAEVNQASFRSASGVTVMLPFLVSDVHRSGVLRILSCLIIEDTSQAHPEELGVVVEILKSGMVTSASGSQYRLTLDAKCDTMGALWRILGVNNSAQKVFGEATGFSLLLTTLHGFQSDGGNSDQSLLNAYIKVFTYLLRVVTAGVSDNAVNRMKLHAIISSQTFFDLLSESGLLCADHEKQVIQLMLELALEIVIPPFLASEGLTKSNAIENESSHNLLLAPSGPINPDKERVYNAGAIRVLIRSLLLFTPMVQLKLLDLIEKLARAGPFNQESLTSVGCVELLLETIHPFLLGSSSLLSYALKIVEVLGSYRLSASELRMLIRYVLQMRMKNSGHIIVEMMEKLILMGDMALENISLAPFVEMDMSKIGHAGIQVSLGERSWPPAAGYSFVCWFQLRNFLKSQSKDTDASKFASSKKRSGSSGLHERHILRIFSVGATNNDNATYAELYLQEDGVLTLATSNSSSLSFSGVELEEGRWHHLAVIHSKPNALAGLFQASFAYVYLNGKLRHTGKLGYSPCPPGKQLQVTIGTSVGNARVSDLTWKLRSCYLFEEVLSPGCICFMYILGRGYRGLFQDTDLLQFVPNQACGGGSMAILDSLDADLTLSANGPRLDATSKQGDLKADGSGIVWDLERLGNLSLQLSGKKLIFAFDGTSTEFIQSSGSFSMLNLVDPMSAAASPIGGIPRFGRLCGDIYICKQGVIGETIRPIGGLELVLALVEAAETRDMLHMALTLLACALHQNPQNLKDMQIYRGYHLLALFLRRRMSLFDMQSLEIFFQIAACEASFSEPKKLESSQTTLSPSSSLLETSLEDHFLSKFHDENSSLGSHGDMDDFSVQKDSFSHISELENTDVAAETSNCIVLSNADMVEHVLLDWTLWVTAPVSIQIALLGFLENLVSMHWYRNHNLTILRRINLVQHLLVTLQRGDVEVPVLEKLVVLLGVILEDGFLSSELENVVRFVIMTFDPPGLVPQRPIMRESMGKHVIVRNMLLEMFIDLQVTIKSEELLELWHKVVSSKLITYFLDEAVHPTSMRWVMTLLGVCLTSSPTFALKFRTGGGYLGLVRVLPSFYDSPDIYYILFCLIFGKPVYPRLPEVRMLDFHALMPSDGSYTELKFVELLDSVIAMAKTTFDRISMQAMLAHQTGNLSQVGASLVAELVEGNSDMAGELQGEALMHKTYAARLMGGEASAPAAATSVLRFMVDLAKMCPTFTAVCRRAEFLESCIDLYFSCVRAAHAVKMAKDLSAVTEEKTLNDCEDTCSSQNTFSSLPLDQDQSVKTSISVGSFPQGQVSTSSDDMAAPPNSMAGERPQNNLSVSELESNKSVREDIQTVQSLDGDNADQGSVASSAHEFSFHSIKGNLDILPPTDSQSSASFAALDSPVFSEKSSSIVPLTHSSSPVVALASWLGSANHNEAKSPLTATPSFDSSMSAAEFDTSSNLKSSSQGPSSTNAYFTVTSKLLLDVDDSGYGGGPCSAGATAMLDFIAEVLSDFVTEQVKASQLVENILESVHLYVDGESVLVFQGLCLSRFINFLERRLLRDDEEDEKKLDKIRWSTNLDALCWMIVDRVYMGAFPQPSGVLKTLEFLLSMLQLANKDGRIEEAAPGGKRLLSISRGNKQLEAYIHSILKNTNRMILYCFLPSFLVSIGEDDLLLRLGLLNEPIKKLSSTSSQDDSGIDISTVLQLLVAHRRIIFCPSNIDTDLNCCLCVNLISLLCDKRQNVQNITIDVFKYLLVHRRAALEDLLVSRPNQGQQLDVLHGGFDKLLTRSLSEFFEWYQNIEQVVNKVLEQCAGIMWVQYIAGSAKFPGVRIKGMEGRRKKEMGRKSREAAKLDLRHWEQVNERRYALDLVRDAMSTELRVVRQDKYGWILHAESEWQCHLQQLVHERGIFPLSKSSFTEEPEWQLCPIEGPYRMRKKLECCKLKIDTIQNILDGHFELEKPELSKVKFENGPDSSESKPYFQLLTDGGKQNGSDGEPFDEPFFEKLDSVKDAFSAKNEWNDDKASSINEASLHSALELGAKSSAVSVPIEESTHGRSEMGSPRQSSSLKIDDVKIADDKSDKELHDNGEYLIRPFLEPFEKIRFKYNCERVISLDKHDGIFLIGEFSLYVIENFYIDDSGCFCEKECEDELSVIDQALGVKKDFTGSVDFQSKSTLSWSTPAKSLVGGRAWAYSGGAWGKEKVHSIGNLPHPWRMWKLDSVHEILKRDYQLRPVAVEIFSMDGCNDLLVFHKKEREEVFKNLVAINLPRNSMLDTTISGSSKQESNEGSRLFKIMAKSFSKRWQNGEISNFQYLMHLNTLAGRGYSDLTQYPVFPWVLADYESENLDLSNPKTFRRLDKPMGCQTPEGEDEFRKRYESWDDPEVPKFHYGSHYSSAGIVLFYLLRLPPFSTENQKLQGGQFDHADRLFNSIKDTWLSAAGKGNTSDVKELIPEFFYMPEFLENQFNLDLGEKQSGEKVGDVVLPLWAKGSAREFISKHREALESDYVSENLHHWIDLIFGYKQRGKAAEESVNVFYHYTYEGSVDIDSVTDPAMKASILAQINHFGQTPKQLFLKPHVKRRTDRKLPPHPLKHSSHLAAHEIRKSSSPITQIVTLNDKILIAGTNNLLKPRTYTKYVAWGFPDHSLRFISYEQDKLLSTHENLHGGNQIQCASVSHDGHILVTGADDGLVNVWRVSKFGPRALRRLKLEKPLCGHTGKITCLQVSQPYMLIVSGSDDCTVIIWDLSSMAFVRQLPEFPAPVSAIYVNDLTGEIVTAAGILLAVWSINGDCLAMIKASQLPSDSILSVTSSTFSDWLDTKWYATGHQSGAVKVWQMIHCSNPDSSLSKSGFGGSGGLNLGGLEPEYKLVLRKVLKFHKHSVTALHLTTDLKQLLSGDSGGHLLSWTLPEESLRGSLNQG

SEQ ID NO: 171984 - protein, 226 aa, Glycine max
  Coding DNA Sequence Number=SeqID_55206
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O24078; Match level="QueryCoverage=99%, HitCoverage=59%, E-value=1e-109, Identity=82%"; Hit description =Protein phosphatase 2C
  Pfam annotation: Domain name=PP2C; Domain location=1-215; Score =261.9; E_value=1.3e-75; Accession=PF00481.12; Description=Protein phosphatase 2C
AFFGIFDGHGGTKASEFAAHNLEKNVLEEVVRRDENDIEEAVKHGYLNTDSEFLKEDLNGGSCCVTALIRNGNLVVSNAGDCRAVISIGGVAEALTSDHKPSREDERDRIETQGGYVDVCRGVWRIQGSLAVSRGIGDRNLKQWVIAEPETKVLKIEPQHDLLILASDGLWEKVSNQEAVDIARPFCVGNNKQQPLLACKKLVELSVSRGSVDDISVMIIKLQNYI

SEQ ID NO: 171985 - protein, 135 aa, Glycine max
  Coding DNA Sequence Number=SeqID_55207
  Homolog annotation: Hit_ID=Q67YE3; Match level="QueryCoverage=99%, HitCoverage=65%, E-value=1e-54, Identity=62%"; Hit description=MRNA, , clone: RAFL25-03-N20
APCVSYLLRKRALYDDMSRYTCCAGYMPCSGRCGESKCPELCLGAEAFMFVLQQLACIFSIIALIVGNSEIRQASQLLSCLADFVYCTVCACMQTQHKIEMDKRDGKFGPQSVMGVPPVQQMSRFDQAVPPFVGY

SEQ ID NO: 171986 - protein, 58 aa, Glycine max
  Coding DNA Sequence Number=SeqID_55208
  Subcellular localization annotation: CTP_CleavageSite=46; ConfidenceScore=5.04e-01
MGKTPSLFAVPPLTVDSKRLLPRPHLCLYCNLPTCRASQNHLPMKRCSSSLSLVVDVG

SEQ ID NO: 171987 - protein, 402 aa, Glycine max
  Coding DNA Sequence Number=SeqID_55209
  Gene Ontology: Mol. function=oxidoreductase activity; Cellular component=peroxisome; Biological process=electron transport
  Homolog annotation: Hit_ID=Q76FR9; Match level="QueryCoverage=91%, HitCoverage=98%, E-value=1e-177, Identity=81%"; Hit description =Hypothetical protein PsOPR5
  Pfam annotation: Domain name=Oxidored_FMN; Domain location=35-370; Score=333.2; E_value=4.4e-97; Accession=PF00724.10; Description =NADH:flavin oxidoreductase  NADH oxid
MAHVTLNAQKWNLSINKRQFHFKVEIEFTQEMASPLLTPYKMGKFNLSHRVVLAPLTRQRSYDNVPQPHAILYYSQRTSNGGLLITEATGVSDTAQGYPQTPGIWTKDHVQAWKPIVDAVHAKGGVFFCQIWHVGRVSDSVYQPNGQAPISSTDKPLTPQIRSNGIDQVQFTPPRRLRTDEIPHIVNDFRLAARNAIEAGFDGVEIHGAHGYLLEQFMKDKVNDRTDEYGGSLENRCRFALEVVEAVVNEIGADRVGIRLSPFAEYSESGDSNPKELGLYMMNALNKYGILYCHMVEPRMKTVGEKTECPHSLVPMRKAFNGTFIAAGGYDRQDGINAVAENRADLVAYGRWFLANPDLPKRFALNAPLNKYHRETFYTSDPVLGYTDYPFLDDEESNAVAS

SEQ ID NO: 171988 - protein, 123 aa, Glycine max
  Coding DNA Sequence Number=SeqID_55210
  Gene Ontology: Mol. function=oxidoreductase activity; Biological process=electron transport
  Homolog annotation: Hit_ID=Q76FS0; Match level="QueryCoverage=43%, HitCoverage=14%, E-value=9e-22, Identity=88%"; Hit description =Hypothetical protein PsOPR3
MASCTFSVLRISIFFILLTRIGAVHDGINAVAEDRADLVAYGRLFLANPDLPKRFALNAPLNKYHRETFYISDPVLGFTLILTTPFFPSKFIFAIWLVRTIVVVIMSLDQNKCWAKAIYAPDL

SEQ ID NO: 171989 - protein, 95 aa, Glycine max
  Coding DNA Sequence Number=SeqID_55211
MERFCFFHRKTCHLVQDIVRKYLPGAKKHQQPVRYFSWLPHQEGIMAVVALAGKLGNGGPCKNLIRQIQSFGYSVKEFQCRHVMSPINFNQSECV

SEQ ID NO: 171990 - protein, 183 aa, Glycine max
  Coding DNA Sequence Number=SeqID_55212
  Gene Ontology: Mol. function=oxidoreductase activity; Biological process=electron transport
  Homolog annotation: Hit_ID=Q76FS0; Match level="QueryCoverage=94%, HitCoverage=76%, E-value=9e-20, Identity=52%"; Hit description =Hypothetical protein PsOPR3
  Pfam annotation: Domain name=Oxidored_FMN; Domain location=8-181; Score=-145.8; E_value=0.00086; Accession=PF00724.10; Description =NADH:flavin oxidoreductase  NADH oxid
MAASVPVPLITPYKKGYVSPLVLFPVKLQFVLFFVPQHHAILYYSQRASNGGLLIAEATGVSDTAQGYPQTPGTLEARNAIHGAHGYLLEQFMKDKVNDRTDVYGGSLENRCRFTLEVIEAVVNEIGTNPDLPKRFLLNAPLNKYNRETFYIDDPDAYIHIFFTYFSANTLEPVGTSSKCEGM

SEQ ID NO: 171991 - protein, 527 aa, Glycine max
  Coding DNA Sequence Number=SeqID_55213
  Gene Ontology: Mol. function=nucleic acid binding; Cellular component= mitochondrial matrix; Biological process=RNA catabolic process
  Homolog annotation: Hit_ID=Q10D00; Match level="QueryCoverage=95%, HitCoverage=81%, E-value=0.0, Identity=66%"; Hit description =Helicase conserved C-terminal domain containing protein, expressed
  Pfam annotation: Domain name=Helicase_C; Domain location=217-303; Score=57.4; E_value=4.8e-14; Accession=PF00271.21; Description =Helicase conserved C-terminal domain
ARRKHRRVILHVGPTNSGKTHHALKQLESSASGVYCGPLRLLAWEIAKRLNKAQVPCDLITGQEREEVDGANHKAVTVEMADLSADYQCAVIDEIQAIVLLIENWSNCFMTETSAFEEELMALWALMIGCTTRGYSFTRALLGIAADELHLCGDPAAVPLIQEILKITGDEIEVQFYERLSPLVPLNVPLGSFSNVRNGDCIVTFSRQEIYKLKKRIEKEGKHLCSVVYGSLPPETRTRQASMFNDASSEFDVLVASDAIGMGLNLNISRIIFSTMKKFDGFEVRDLSVPEIKQIAGRAGRYGSNFPVGEVTCMDEEDLLLLHSSLNSPSPILERAGLLPTFDLMYMYSRLHPRNGFYQILAHFLDHAKLSENYFIVNCEQLLKVAAVIDELPLGLHEKYLFCISPADMDDEISSQGLTQFAENYAKKGLVRLREIFTPGSLKVPKTPAALKELESIHKVLDLYVWLSFRLEESFPDHELAVSQKAICSMLIEEFLERLGWQKPMARRLASHKMSSPLLSQHMRKCL

SEQ ID NO: 171992 - protein, 76 aa, Glycine max
  Coding DNA Sequence Number=SeqID_55214
  Gene Ontology: Mol. function=calcium ion binding; Cellular component =flagellin-based flagellum; Biological process=ciliary or flagellar motility
  Homolog annotation: Hit_ID=Q9LIK5; Match level="QueryCoverage=85%, HitCoverage=79%, E-value=4e-21, Identity=57%"; Hit description =Similarity to calmodulin
  Pfam annotation: Domain name=efhand; Domain location=12-40; Score =39.1; E_value=1.6e-08; Accession=PF00036.22; Description=EF hand
  Pfam annotation: Domain name=efhand; Domain location=48-76; Score =25.1; E_value=0.00025; Accession=PF00036.22; Description=EF hand
  Pfam module annotation: Pfam domain module=efhand::efhand; Domain location=12-40::48-76
MGRTIKENLTEELKDSFKVFDRDNDGYISATELRQVMVKLGERLTDEEVEQMIREADLDGDGRDSYEEFLRFMTLN

SEQ ID NO: 171993 - protein, 618 aa, Glycine max
  Coding DNA Sequence Number=SeqID_55215
  Gene Ontology: Mol. function=binding; Cellular component =intracellular; Biological process=protein kinase C activation
  Homolog annotation: Hit_ID=Q1S7U1; Match level="QueryCoverage=98%, HitCoverage=94%, E-value=0.0, Identity=58%"; Hit description =Tetratricopeptide-like helical
  Pfam annotation: Domain name=PPR; Domain location=116-150; Score =31.6; E_value=2.8e-06; Accession=PF01535.11; Description=PPR repeat
  Pfam annotation: Domain name=PPR; Domain location=186-220; Score=7.8; E_value=0.89; Accession=PF01535.11; Description=PPR repeat
  Pfam annotation: Domain name=PPR; Domain location=23-57; Score=12.1; E_value=0.28; Accession=PF01535.11; Description=PPR repeat
  Pfam annotation: Domain name=PPR; Domain location=248-282; Score =41.5; E_value=2.8e-09; Accession=PF01535.11; Description=PPR repeat
  Pfam annotation: Domain name=PPR; Domain location=349-383; Score =36.4; E_value=9.7e-08; Accession=PF01535.11; Description=PPR repeat
  Pfam annotation: Domain name=PPR; Domain location=384-418; Score=8.3; E_value=0.77; Accession=PF01535.11; Description=PPR repeat
  Pfam annotation: Domain name=PPR; Domain location=420-454; Score=9.3; E_value=0.6; Accession=PF01535.11; Description=PPR repeat
  Pfam module annotation: Pfam domain module=PPR::PPR::PPR::PPR::PPR::PP R::PPR; Domain location=116-150::186-220::23-57::248-282::349 -383::384-418::420-454
MALPEGVQVHGAVVKMGLEGEIFVSNSLIHFYEECGRVDLGRKMFEGMLERNVASWTSLINGYAGRLFLFSFKWLRLLGVELNTLMVNALVDMYMKCGDICAARWIFDECTDKNLVMYNTIMSNYVQDGWAGDVLVILDEMLQKGPRPDKVTMLSTIAACAQLDDLSVGESSHTYVLQNGLEGWDNISNAIIDLYMKCGKREAACKVFEHMPNKTVVTWNSLIAGLVRDGDMELAWRVFDEMLERDLVSWNTMIGALVQVSMFEEAIKLFREMHNQGIQGDRVTMVGIASACGYLGALDLAKWVCTYIEKNDIHLDLQLGTALVDMFSRCGDPSSAMHVFKRMKKRDVSAWTAAVGALAMEGNTEGAIELFNEMLEQKVKPDDVVFVALLTACSHGGSVDQGRELFWSMEKSHGVHPQIVHYACMVDLMSRAGLLEEAVDLIQTMPIEPNDVVWGSLLAAYKNVELAHYAAAKLTQLAPERVGIHVLLSNIYASAGKWTDVARVRLQMKKKGVQKVPGSSSIEVHGLIHEFTSGDESHTENTQIGLMLEEINCRLSEAGYVSDRTNVLLDVDEQEKEHLLRRHSAKLAMAYGLITTDQGIPIRDSVLVEIIGNRFISI

SEQ ID NO: 171994 - protein, 558 aa, Glycine max
  Coding DNA Sequence Number=SeqID_55216
  Gene Ontology: Mol. function=RNA-directed DNA polymerase activity; Cellular component=intracellular; Biological process=RNA-dependent DNA replication
  Pfam annotation: Domain name=PPR; Domain location=162-196; Score =12.4; E_value=0.25; Accession=PF01535.11; Description=PPR repeat
  Pfam annotation: Domain name=PPR; Domain location=197-231; Score =21.7; E_value=0.0026; Accession=PF01535.11; Description=PPR repeat
  Pfam annotation: Domain name=PPR; Domain location=232-265; Score=0.9; E_value=5.9; Accession=PF01535.11; Description=PPR repeat
  Pfam annotation: Domain name=PPR; Domain location=266-300; Score =42.2; E_value=1.8e-09; Accession=PF01535.11; Description=PPR repeat
  Pfam annotation: Domain name=PPR; Domain location=301-335; Score =37.0; E_value=6.6e-08; Accession=PF01535.11; Description=PPR repeat
  Pfam annotation: Domain name=PPR; Domain location=336-370; Score =41.0; E_value=4e-09; Accession=PF01535.11; Description=PPR repeat
  Pfam annotation: Domain name=PPR; Domain location=371-405; Score =32.0; E_value=2.1e-06; Accession=PF01535.11; Description=PPR repeat
  Pfam annotation: Domain name=PPR; Domain location=406-440; Score =37.8; E_value=3.8e-08; Accession=PF01535.11; Description=PPR repeat
  Pfam annotation: Domain name=PPR; Domain location=441-475; Score =17.6; E_value=0.044; Accession=PF01535.11; Description=PPR repeat
  Pfam annotation: Domain name=PPR; Domain location=476-510; Score =33.8; E_value=6.1e-07; Accession=PF01535.11; Description=PPR repeat
  Pfam module annotation: Pfam domain module=PPR::PPR::PPR::PPR::PPR::PP R::PPR::PPR::PPR::PPR; Domain location=162-196::197-231::232-265::266- 300::301-335::336-370::371-405::406-440::441-475::476-510
MPSKFRFLKLFTHRLSPRTAAANGSHRFLYGNPLCTMAESPELPPWLKFSDTPTPPDADSDDNFVIPSLAHWVDTHMLTTKPKVLTQSPKQDNLDELEAVTKVLQKRYPSPELASLALDGLSFQPSSGLVSQVLNRFSNDWVPALGFFKWAKSLTGYRHSPELYNLMVDILGKCRSFDSMSELVEEMARLEGYVTLETMTKVMRRLARARKHEDAIEAFGRMEKFGVKKDTAALNVLIDALVKGDSVEHAHKVVLEFKGSIPLSSRSFNVLMHGWCRARDFDNARKAMEDMKEHGFEPDVFSYTNFIEAYGHERDFRKVDQVLEEMRENGCPPNAVTYTSVMLHLGKAGQLRKALEVYEKMKSDGCVADTPFYSSMIFILGKAGRLKDACDVFEDMPKQGVVRDVVTYNSMISTACAHSREETALRLLKEMEDGSCKPNVGTYHRLLKMCCKKKRMKVLKFLLDHMFKNNISPDLATYSLLVNALRKSGKVEDAYSFLEEMVLRGFTPKPSTLKKLAGELESKSMLEEKVRVEEWMDRFSQNLIRPGLSDRSDRDPVT

SEQ ID NO: 171995 - protein, 281 aa, Glycine max
  Coding DNA Sequence Number=SeqID_55217
  Homolog annotation: Hit_ID=Q9LUZ9; Match level="QueryCoverage=30%, HitCoverage=28%, E-value=1e-20, Identity=55%"; Hit description=RING -H2 finger protein ATL5O
  Pfam annotation: Domain name=zf-C3HC4; Domain location=133-174; Score= 28.6; E_value=2.2e-05; Accession=PF00097.15; Description=Zinc finger, C3HC4 type (RING finger)
MSIQPDSPNNNTLTQMFQNIFSDNSNIMLAAIISLLLVILFVLLLHLYAKLFLAQAQPQAHARRRRRRRRRNTVTVSDVLGPARFHHFHSFNIEDSSPLTTKGLDSSTIRTIPLFIYEPNNNKVQEEEEELECVICLSAFVSGEVGRCLPKCGHGFHVECIDMWLSSHSNCPICRASIVASVEENVSRVVVSSSDHHRDELYYGGDHDLVEIVIESGGAPSSEIIREGDGNGGARTSVSVGSETSSSEFFGCSLERMLGKVFPSSNGLFEWGGGWCYLLTS

SEQ ID NO: 171996 - protein, 661 aa, Glycine max
  Coding DNA Sequence Number=SeqID_55218
  Gene Ontology: Mol. function=carbohydrate binding; Biological process= fructose 2,6-bisphosphate metabolic process
  Homolog annotation: Hit_ID=Q93XR7; Match level="QueryCoverage=99%, HitCoverage=100%, E-value=0.0, Identity=58%"; Hit description =Fructose-6-phosphate 2-kinase/fructose-2,6-bisphosphatase
  Pfam annotation: Domain name=6PF2K; Domain location=407-521; Score= -23.1; E_value=8.7e-07; Accession=PF01591.8; Description=6 -phosphofructo-2-kinase
  Pfam annotation: Domain name=PGAM; Domain location=485-620; Score =24.0; E_value=3.1e-05; Accession=PF00300.12; Description =Phosphoglycerate mutase family
  Pfam module annotation: Pfam domain module=6PF2K::PGAM; Domain location=407-521::485-620
MGTGASKDAEEGSKEERDRLDHAGGQLYVSLKMENRKLTGDLVPHVYGSVPLVGSWDPSKALFMERESVSMWELSFVVPPNHGNAFYFLESVALSNGFVAFTMRRESGIEGKRMRGRAGHWKVEGEQKELGRNLVLRYLGELGYGNCVVHDCLNSEIGGVFSFLKYAWISETLDFKFLLKPKDSNTPCFVEEGPSRLLVGGALQEDARLALFRLDSGEVLEYQVFVKADRVSPFDLAASWRAYQDNFRPSSVRWIPDVSINSAPQTSGENGCSVGLELDLEHYVVPTPATSANSAHVYAANLTENPRSLIIGSGSSSYPIKEMEVIVPDPSKIFQSPGMVESKSVGTFSPLQKQESQRGLFVDRGVGSPRPVKSSSSNIFSTDLNLDSDTKNSMPAAAGAVAAAAVADQMLGPKEDRHLAIILSADFFRADNPEGMEARNEVAALAFEDMISWMQEGGQVGIFDATNSSKERRNMLMKLAEGRCKVYETVNEGSYIKMIDMVSGHGGQIQAGELYSKKLAKFVGKRLKSERAASIQWRALDEINAGVCDGMTYAEIKKNMPEEYEYVANLSRKKDKLRYRYPRGESYLDVIQRLEPVIIELERQRAPVVVISHQAVLRALYAYFADRPLNEIPHIEVPLHTIIEIQMGVTGVQEKRYKLMD

SEQ ID NO: 171997 - protein, 66 aa, Glycine max
  Coding DNA Sequence Number=SeqID_55219
MASETASSADEETVVVVSAAAGAGGTDKRGKHRILAELKRLDQESKFLQMPPLMHPKPWPCGTLNL

SEQ ID NO: 171998 - protein, 369 aa, Glycine max
  Coding DNA Sequence Number=SeqID_55220
  Gene Ontology: Mol. function=ammonium transporter activity; Cellular component=membrane; Biological process=transport
  Homolog annotation: Hit_ID=Q851M9; Match level="QueryCoverage=86%, HitCoverage=91%, E-value=2e-82, Identity=52%"; Hit description =Putative ammonium transporter
  Pfam annotation: Domain name=Ammonium_transp; Domain location=24-328; Score=-53.3; E_value=6.6e-09; Accession=PF00909.11; Description =Ammonium Transporter Family
MSRLPSNLLPVDGSPEWMNRGDNTWQLTSATLVGLQSVPGLVILYGSIVKKKLMGFELCLHGPPNTALDREFVFRQAFAGEFPNATMVYFQLAFAAIRAVKDRERFPPNNILLMAYHGFNGGDPYAASIDASLAVLNTHVCTAMSLLTWLFLDILFFGKPSVIGATQGMITGLVCNTPAAGVVQGWAAIIMGMMSGSIPWYTMMVLHKESKLLKQVDDTSAVFHTHAVAGSLGGILAGFFADPNLCYLFYGVQDSLHYTGLVYGIFNGNLKTGFRQMGVQLLGIVFVILLNVTTTSIVCLLVRMIVPLRMSEDDLQVGDEAVHGEVAYALWGDGEKLETAAGEALTSEKNHELPTVELIKSLSDAPLID

SEQ ID NO: 171999 - protein, 52 aa, Glycine max
  Coding DNA Sequence Number=SeqID_55221
MGGSSVCHNRVNFNKNFVPHYPEALRYAKVWGRDIVRSLTLVYAKRLFSDAK

SEQ ID NO: 172000 - protein, 212 aa, Glycine max
  Coding DNA Sequence Number=SeqID_55222
MADKIRREDTVANSTDPVLISDKISQTEPVSGIAVQDDTAVGDRVAVVVAIILDGKCDVDIGRDDNKTACVATCVIDRGGTSSPFLAMGSRSNRVGMVFVHCRAIGVVGVAETLGDLRESSVGGDFMVSTGCRDVLSTWNAVAVKSKLRRERLVSMFCGSIIMVSTGGGDLGGDGVGVKADRRLFKEVHRGLVAGKTRTMVDDRGRGRSSGR

SEQ ID NO: 172001 - protein, 243 aa, Glycine max
  Coding DNA Sequence Number=SeqID_55223
MDLFEEAVYYFTQNLSTMTTKTLEMNAKLDVILNRLSAFTPTPSPPKSPPPVETIIMEPQNIDTNLSRLSFDFTATAFHVDNTSLQPVDTMKSPPTDDSRRSPKVSATPTTPMARQCTKTMPTLLDLLPMARKGEEVPPLSMTQVATQAVLLSSRPISTSHFPSKLPPLVTKHAAAQVILLGVFRTVHQHYRHDHCNTIPYSSVILHSDAANWFCLRATNIHSLIPTPILIWDPGSIFLEPTP

SEQ ID NO: 172002 - protein, 122 aa, Glycine max
  Coding DNA Sequence Number=SeqID_55224
MWAFHTGRQLDWAHLVRYRMHKALRLNAPLPYPQLVTLFLRHFEILLDSESYIPIKRSILIGAAAIASFGYRKKRDGSWFDAMELQVDMRFDAMESRITRVEEDVSFIQTCFDPPPPPPSSS

SEQ ID NO: 172003 - protein, 92 aa, Glycine max
  Coding DNA Sequence Number=SeqID_55225
MGCQNVQIAPTSSADTWLAPLCFFVLFAPDVVLFLCVVFFGFHLLGLKMKEVKHWGIKIGLKLSMEFTSGHGLPQGAKYKLSLLGQWMQKPY

SEQ ID NO: 172004 - protein, 156 aa, Glycine max
  Coding DNA Sequence Number=SeqID_55226
  Gene Ontology: Mol. function=sequence-specific DNA binding; Cellular component=nucleus; Biological process=regulation of transcription, DNA-dependent
  Homolog annotation: Hit_ID=Q4VPF0; Match level="QueryCoverage=73%, HitCoverage=51%, E-value=3e-56, Identity=87%"; Hit description =Homeobox knotted-1-like protein KNOX3
  Pfam annotation: Domain name=ELK; Domain location=53-74; Score=28.4; E_value=2.6e-05; Accession=PF03789.4; Description=ELK domain
  Pfam annotation: Domain name=Homeobox; Domain location=76-135; Score =6.1; E_value=0.0011; Accession=PF00046.19; Description=Homeobox domain
  Pfam module annotation: Pfam domain module=ELK::Homeobox; Domain location=53-74::76-135
MWLSNPCRIEWLSVNFFLAVACWPNDGGVSSEEGFSAGDGDPQDGQLRSEDRELKDRLLRKFGSHIGYLKLEFSKKKKRGKLPKDARQTLLQWWNIHYKWPYPTEGDKIALAKSTGLDQKQINNWFINQRKRHWKPSENMPFSMVDGLTGRFLTDE

SEQ ID NO: 172005 - protein, 432 aa, Glycine max
  Coding DNA Sequence Number=SeqID_55227
  Gene Ontology: Mol. function=protein serine/threonine kinase activity; Cellular component=mitochondrion; Biological process =protein amino acid phosphorylation
  Homolog annotation: Hit_ID=Q9FNE1; Match level="QueryCoverage=91%, HitCoverage=73%, E-value=2e-55, Identity=32%"; Hit description =Receptor-like serine/threonine kinase
  Pfam annotation: Domain name=Pkinase; Domain location=199-381; Score=- 21.1; E_value=2.7e-07; Accession=PF00069.15; Description=Protein kinase domain
  Pfam annotation: Domain name=Pkinase_Tyr; Domain location=199-404; Score=-40.3; E_value=5.4e-10; Accession=PF07714.7; Description =Protein tyrosine kinase
  Pfam module annotation: Pfam domain module=Pkinase::Pkinase_Tyr; Domain location=199-381::199-404
MEKISEQMHNTGYGTAVVGTGGPDTNYGLAQCYGLYSFYDKYTGPGDKAVCGNTTRRSTNFQAAAKKVVWSAVQAAPNNEGYAREEVSVAGTANDSAYVLLIVGGVWTQEGRALNTGCFMRYSDRDFLNKEQEKGSSEDNVLVIVVAVVSSVIVLVVGIAIVAYIRKHRYIQMKRRVSQELHHNSLNFKYSLEKATNSFDEVNRLGQGGFGTGVLADGREIAIKTLYFNNRHKAADFYNKVNIISSVEHKNLVRLLGCSCSGPESLLIYEYLPNRSLDRFIFGNNSTHEIDCLISDSKIPPFHDIKASNILLDAKLHAKIADFGLARGYMAPEYLAHGQLTEKADTWKHFQSGTAEQVIDPCLVLDDNHRSNVLNEILRVLHIGLLCTQEIPSLRPSMSKALKMPTKKEEHLELEAPSNPPFIHESTMELHD

SEQ ID NO: 172006 - protein, 94 aa, Glycine max
  Coding DNA Sequence Number=SeqID_55228
MKWNNLYWRKNYFSCVRLYDFLANKNNNNSLIPSSEVDYKDHTTAIELGKKPNSQEYYSLTKKATGSTSDESRLHGKECTYNKYNTRSGLRHKE

SEQ ID NO: 172007 - protein, 324 aa, Glycine max
  Coding DNA Sequence Number=SeqID_55229
  Homolog annotation: Hit_ID=Q2R1Y3; Match level="QueryCoverage=69%, HitCoverage=28%, E-value=2e-25, Identity=41%"; Hit description =Expressed protein
MTTAIVRDQNLEKHIHKQMGCMAGFLQIFDRHQILTGKRIYSHKRLPPASPEPEKPAASPTRSTPSPPREVVSSEPKASVPTLPVLEFKEGTRSSWKFAREAPRLSLDSRAIVDAKGTLHLHPRGEIPPENDADKQRRSTSVIAKLMGLEPLPDSEPEPGPGPVAKLQRSASESRVPRDLPLPLTQCRFFDPNNFTAQVTTNVVHENNNNNNNNNSYYTNNNAVIDSRFVSSRVAADPPKQRLKKSFYDSADFFPEPKHTVSVYGEIERRLRVRGINEPSKDLHTLKHILEALQLKGLLHNSTKTKPISHCGYETGSICESDRE

SEQ ID NO: 172008 - protein, 159 aa, Glycine max
  Coding DNA Sequence Number=SeqID_55230
  Subcellular localization annotation: CTP_CleavageSite=75; ConfidenceScore=5.09e-01
MSEEKKKEGENPSRGASVTLLRYFRDRFCGRSSLFFTVLRSPTDAPVSLASPSRRRVGRDNGEQTKQKKGMEQAKAEEKPTHKNNKRTTHRNNGRKIRRGAERRTKKRTDQANIENNNTTGEQRKEKKHTKQANAEEKPRVGAGGRDNLDILIAHSFIK

SEQ ID NO: 172009 - protein, 311 aa, Glycine max
  Coding DNA Sequence Number=SeqID_55231
MGIKHFEVVKRRSHADKQWFPDDIRDFDSLGIMKASVRITKGCLRMLPDFSQLGISACRLTQGSGSADVVLVRITAGYICLPPDSRGQNQQILCLYGLPLGISACRLTQGSGSADVVLVWITAGYICLPPNSRMLCWVRITLRYIRLPPDSWVGKCVSTDNYLGISACFLTHGSGSANVVFVRIIAGYIRLLPDSSRCCVCTDYSWVYLSAALTQGSGSADVVLVRITAGYIRLPPDSRGQNQQILCLYGLPLGISACRLTQGSGSADVVLVWITAGYICLPPNSRMLCWVRITLGYIRLPPDSWVGVTEL

SEQ ID NO: 172010 - protein, 90 aa, Glycine max
  Coding DNA Sequence Number=SeqID_55232
MPQLLAAATFTSPLLPDHMMWMWIMSFLCSPNPKRSLPKKSRYHSGLVDDSSNHCIVKAFPKATPPSRLNDAKMSLTSRAHMKVHQGQVH

SEQ ID NO: 172011 - protein, 204 aa, Glycine max
  Coding DNA Sequence Number=SeqID_55233
MGEVEEVQEQMKADMEAMKEQMTTMMEAMMSIKKIMEANAVAVVVTSIVAKVNLTPPSGLNQMNHPTSDMVGKDLGSTGGPIMCKFKTSTPSRHMACLPTILHPMWRTLPSQQPQSDHAHVSQPMGETHEIPHHNLAELEPCLGYATEGQAVGGIPLQNTLEGPSISPLTITLLWENNGLHTFKLYGFGLRRRNDQSGSGKRQI

SEQ ID NO: 172012 - protein, 102 aa, Glycine max
  Coding DNA Sequence Number=SeqID_55234
MLGFTSNSPQISANPHQLDFAPYASRSYSAQWNVPKLLHDMHMLCSSRILGKMEVEEPWQGLWLSLHYQVVFGHWACGEQAGRVADLGMDFMDDWVKGTVIG

SEQ ID NO: 172013 - protein, 784 aa, Glycine max
  Coding DNA Sequence Number=SeqID_55235
  Homolog annotation: Hit_ID=Q1S7U5; Match level="QueryCoverage=99%, HitCoverage=100%, E-value=0.0, Identity=62%"; Hit description =Calcium-binding EF-hand; Tesmin/TSO1-like, CXC
  Pfam annotation: Domain name=CXC; Domain location=486-534; Score =69.5; E_value=1e-17; Accession=PF03638.5; Description=TesminTSO1 -like CXC domain
  Pfam annotation: Domain name=CXC; Domain location=579-620; Score =84.3; E_value=3.8e-22; Accession=PF03638.5; Description=TesminTSO1 -like CXC domain
  Pfam module annotation: Pfam domain module=CXC::CXC; Domain location =486-534::579-620
  Subcellular localization annotation: CTP_CleavageSite=61; ConfidenceScore=5.38e-01
MDTPERNQITSTLSKFEDSPVFNYINSLSPIKPVKSVPISQTFNSLSFSSPPSVFTSPHVSCLKESRFLRRHNPLGTSKPKVPSEDVIKVHSSEETLADSTHAHHNSSKLEEENTGKGISVRDASIELSREHIKFSDELPQALKYNCGSPGFDPPPCGDEANSLLELPGEAATDVGYVQEGCKTDSVEVEVHLQEVCQMEPKSEGPDCYWDSLIPDALDMLIFNSPGDAEAFKGLMHKPLASSIRLNEFMSMLPHSTINNGRKMHIVDSDASGSAPEIEDHCSELMTATGTNQTQDNFANVALVTSNSNEKANDQLVSATHRTIRRRCLDFEMANVQRKNSDENSNTGSSTSESDERNVANEKQLLPAKRNGDLQRGILQGIGLHLNALAALKEYKGIQIEKLSSGRQLSLPSSTSLQISTSQEHQNLSLVPVSSERELDPSDNGVQPAEDCSQPSAYMAGEDFNQNSPKKKRQVKRKSETPGETEGCKRCNCKKSKCLKLNGIVYCSYCECFAAGVYCIEPCSCQDCFNKPIHEDTVLQTRKQIESRNPLAFAPKVIRNSDSVPEIGDDPNKTPASARHKRGCNCKKSSCLKKYCECYQGGVGCSISCRCEGCKNAFGRKDGSASVGIETDPEETEATDKGVTEKALQKTEIQNTEDHPDSATVATPLRLSRPLLPLPFSSKGKPPRSFVTTISGSALFASQKLGKPNPLWSQAKHFQTVPDEEIPDILQGDSSPITCIKTSSPNGKRISSPNCDLGSSPSRRGGRRLILQSIPSFPSLTPHP

SEQ ID NO: 172014 - protein, 473 aa, Glycine max
  Coding DNA Sequence Number=SeqID_55236
  Gene Ontology: Mol. function=protein serine/threonine kinase activity; Cellular component=membrane; Biological process=protein amino acid phosphorylation
  Homolog annotation: Hit_ID=Q9FNE1; Match level="QueryCoverage=99%, HitCoverage=65%, E-value=4e-83, Identity=39%"; Hit description =Receptor-like serine/threonine kinase
  Pfam annotation: Domain name=DUF26; Domain location=176-228; Score =52.1; E_value=1.9e-12; Accession=PF01657.8; Description=Domain of unknown function DUF26
  Pfam annotation: Domain name=DUF26; Domain location=33-90; Score =27.3; E_value=2.3e-06; Accession=PF01657.8; Description=Domain of unknown function DUF26
  Pfam annotation: Domain name=Pkinase; Domain location=308-473; Score =14.1; E_value=2.1e-09; Accession=PF00069.15; Description=Protein kinase domain
  Pfam annotation: Domain name=Pkinase_Tyr; Domain location=308-473; Score=-12.1; E_value=1e-11; Accession=PF07714.7; Description=Protein tyrosine kinase
  Pfam module annotation: Pfam domain module=DUF26::DUF26::Pkinase::Pkin ase_Tyr; Domain location=176-228::33-90::308-473::308-473
  Subcellular localization annotation: CTP_CleavageSite=52; ConfidenceScore=5.20e-01
FVANFLAAMDALTPLTTSHGHGAVFNGSQNATVFAFGECMRDLSQNDCNLCLAQCKTQLLACLPFQRGTRGGRLFFDGCYLRLVLRGQVNLITPSVSYFRYDDYNFFGETRSDQDTTVCGNNSSNNNSNSAANSATNSSSGVYKANAMALVRNLSGLAPKNDGFFVGSVERKNVSVYGLAQCWEFVNGSACERCLADAVTRIGSCSTQEARALSAGCYLRYSSQKFYNNSSDVVTAGKHGKRTLVKILAASSAALALLLVVVTVVFFTRKNVVTRRRERRQFGALLATVNKSKLNMPYEVLEKATNYFNEANKLGQGGSGSVYKGVMPDGNTVAIKRLSYNTTQWAEHFFTEVNLISGIHHKNLVKLLGCSITGPESLLVYEYVPNQSLHDHFSVRRTSQPLTWEMRQKIILGIAEGMAYLHEESHVRIIHRDIKLSNILLEEDFTPKIADFGLARLFPEDKSHISTAIAGTL

SEQ ID NO: 172015 - protein, 415 aa, Glycine max
  Coding DNA Sequence Number=SeqID_55237
  Homolog annotation: Hit_ID=Q9LIJ8; Match level="QueryCoverage=68%, HitCoverage=78%, E-value=3e-71, Identity=51%"; Hit description =Arabidopsis thaliana genomic DNA, chromosome 3, BAC clone:F5N5
  Pfam annotation: Domain name=DUF506; Domain location=72-286; Score =372.5; E_value=6.5e-109; Accession=PF04720.3; Description=Protein of unknown function (DUF506)
MHFPMKIQPIDSQVPSEGTRLELAKPVVKSRLKRLLERQFSGVLRNSAPEKIAGGDEPLNGAKDFEPSSACLAKMVQSFIEESHEKHSASHHRNRCNCFNRNYDDSSDEDSNSFGDSNFSSGEACETLKGLVACASVRDRSLLADTAKIVEKNKICKRKDSFCRKIVTDGLLALGYDASICKSRWEKSPSYPAGGYEYIDVMMGKERVVIDIDFRSEFEIARSTKAYKTILQNLPYIFVGTCERLQSIVALVSEAAKQSLKKKGMHVPPWRRTEYVKAKWLSPYTRTHDIKEEKKKEEEQQQLFKDNLNTAESESSGEDNTAVVEWKPPELKPKGSLSGVKVVTGLAVVGGGFGWWRFGWVWVAVGWLWCVEVGDCGNGVVTSAAAIEWPSRWFVAVQEAALVFGGTVVMEVRYI

SEQ ID NO: 172016 - protein, 203 aa, Glycine max
  Coding DNA Sequence Number=SeqID_55238
  Gene Ontology: Mol. function=GTPase activity; Cellular component =signal recognition particle, endoplasmic reticulum targeting; Biological process=immune response
  Homolog annotation: Hit_ID=Q10C30; Match level="QueryCoverage=59%, HitCoverage=19%, E-value=5e-57, Identity=87%"; Hit description =Guanylate-binding family protein, putative, expressed
  Pfam annotation: Domain name=GBP; Domain location=1-187; Score=-38.5; E_value=4.1e-05; Accession=PF02263.9; Description=Guanylate-binding protein, N-terminal domain
MVSVFHFLVKSGSSGFGVGHMRDTKTKGIWVWGTPIDLDINGVRTSVFYLDTEGFESVGKSNVYDDRIFALATVLSSVLIYNLPETIREADISRLSFAVELAEEFYGRVKGQDVAFEPAKLLWLIQRDFLRDIYSNKKIFLHHVSLYQSWGEPGVEPMRNKNLEKQYPHKEEFVQLIPEIDRGKADEVNGTGSEFGGGVPGRG

SEQ ID NO: 172017 - protein, 73 aa, Glycine max
  Coding DNA Sequence Number=SeqID_55239
MQQAMQGCSCSRVDSPMSMAGCASPGIVKLAGDLLYFKRVHYKSRNSATPATLSSSSYYCTTLLFFLFCFWFR

SEQ ID NO: 172018 - protein, 74 aa, Glycine max
  Coding DNA Sequence Number=SeqID_55240
MHCKHKNKGNDERAGSMEGALIQAKAKKLRNNYNNKEESSLACSRCKKKNHSRQKCYWRPDVKCKKCYNLGHME

SEQ ID NO: 172019 - protein, 256 aa, Glycine max
  Coding DNA Sequence Number=SeqID_55241
  Gene Ontology: Mol. function=GTPase activity; Biological process =immune response
  Homolog annotation: Hit_ID=Q10C30; Match level="QueryCoverage=99%, HitCoverage=42%, E-value=1e-103, Identity=71%"; Hit description =Guanylate-binding family protein, putative, expressed
MVNEALRRVPNTDGNKNIDMVNQIRDSLAVMGDNSTAFSLPQPHIQRTKLCDMEDVELDQLYVKRREQLKELVASIITPKIVQGKTLNGKEFVSFLEQILEALNKGEIPSTGSLVEVFNKNILEKCLKLYSEKMAKLVLPLPEESLQGAHDRSRDEVTKVFDQQHFGRHHAKKSFMQLDEEIQQVYKNVVLQNEYQSSRLCEALYTRCEDKMDQLQVLKLPSLAKFNAGFLQCNRSFEHECVGPSKTNYELRMMKV

SEQ ID NO: 172020 - protein, 99 aa, Glycine max
  Coding DNA Sequence Number=SeqID_55242
MTTNEDKEWTLLMSFGAVACASSTSLSHKPCTWLGLCPFEETQNPNPWIWLGVGQWAKRLKEKQNERKGLDRGPRRIKKKAGKSATLTYRFEVVPPIAL

SEQ ID NO: 172021 - protein, 70 aa, Glycine max
  Coding DNA Sequence Number=SeqID_55243
MSLCKGWSQTPRSHRASTSTPCYNANKFCPLYSVDRINFIEVFRHGPTQNGPYCTNVQQEEGPGLRTWWT

SEQ ID NO: 172022 - protein, 283 aa, Glycine max
  Coding DNA Sequence Number=SeqID_55244
  Gene Ontology: Mol. function=single-stranded DNA binding; Biological process=DNA replication
  Homolog annotation: Hit_ID=Q75GK2; Match level="QueryCoverage=58%, HitCoverage=57%, E-value=4e-40, Identity=49%"; Hit description =Putative single-strand binding protein
  Pfam annotation: Domain name=SSB; Domain location=128-223; Score =82.4; E_value=1.4e-21; Accession=PF00436.15; Description=Single -strand binding protein family
  Subcellular localization annotation: CTP_CleavageSite=39; ConfidenceScore=5.24e-01
MGMGASLLQSTKLGSNQWAETQPFCPKPITNFPVPLSIRAVERTKTRERKMVLEQAVSSSSTLRNVFTNPKTLISKPQFQVAASPSWKPQQPRWEGWLGINLKCSMTTTTTPSSYPKPSEIPWQKELCNSVNLIGNVAAPVEIKYLPSGKVVAWTRLYVKKSATQSSPINLTFWDDLAHVASQHLQKGHQIHVSGRLITDTVETEEGKSQTYYKVVVQQLNFIERNFSSVSSSQGQEFDFAMAGSGRKVSNAANSTGSVVETWNAFFANPGEWWDNRNNKVNS

SEQ ID NO: 172023 - protein, 161 aa, Glycine max
  Coding DNA Sequence Number=SeqID_55245
  Gene Ontology: Mol. function=nucleic acid binding
  Homolog annotation: Hit_ID=Q1SLA4; Match level="QueryCoverage=91%, HitCoverage=26%, E-value=7e-11, Identity=29%"; Hit description=Zinc finger, CCHC-type; Lipocalin
MSFARVFEHSESSKGKPSLEEEENLVRSTKKHKKDVVTIEDGSDGEVDEGWKMEKRMFDNFPIANNTYNTNELGWKVSLSDKEWEKWSKPWRKTLVVKVLGRCVNFWVLEAKLQRSWTKGGSINDKSDDFYLVKFAIEEDYNLALFEGPRMVADHYLIVQR

SEQ ID NO: 172024 - protein, 93 aa, Glycine max
  Coding DNA Sequence Number=SeqID_55246
MVGGCFGNLGEVEGVGTSIIGGISREGGVSVWWCMVEEGGVVGGSGGVGKELEEVRVVHGKGKVVHDDRVGVRGANNKKGLSECGTVFQFLWS

SEQ ID NO: 172025 - protein, 193 aa, Glycine max
  Coding DNA Sequence Number=SeqID_55247
  Gene Ontology: Mol. function=protein dimerization activity; Cellular component=nucleus; Biological process=regulation of transcription, DNA-dependent
  Homolog annotation: Hit_ID=O24542; Match level="QueryCoverage=99%, HitCoverage=97%, E-value=1e-80, Identity=77%"; Hit description=Auxin- induced protein 22D
  Pfam annotation: Domain name=AUX_IAA; Domain location=8-193; Score =278.1; E_value=1.8e-80; Accession=PF02309.7; Description=AUXIAA family
MGKYEKELNLEATELRLGLPGSDEPGKRSIVRSNKRSSTEASEEECISKGNMNSNGSDITSDDQDNLVPPAKKNIYMIDAWKNTLQQKKEEQGEGSGMYVKVSMAGAPYLRKIDLNVYKSYPELLKALGNMFKCTFGEYSEREGYNGSEYAPTYEDKDGDWMLVGDVPWNMFVSSCKRLRIMKASEAKGLGCF

SEQ ID NO: 172026 - protein, 89 aa, Glycine max
  Coding DNA Sequence Number=SeqID_55248
  Gene Ontology: Mol. function=single-stranded DNA binding; Biological process=DNA replication
  Homolog annotation: Hit_ID=Q75GK2; Match level="QueryCoverage=60%, HitCoverage=17%, E-value=1e-12, Identity=64%"; Hit description =Putative single-strand binding protein
RNPKAPDFKHKDTGEALWIEGRYNPPWVKSQLEILDSRMGSFASQNARMPVVLIMVKFALELYLVSDQVIVLHSAFSIPVVHLLESIKH

SEQ ID NO: 172027 - protein, 512 aa, Glycine max
  Coding DNA Sequence Number=SeqID_55249
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=54%, E-value=0.0, Identity=46%"; Hit description =Prefoldin
  Pfam annotation: Domain name=KIP1; Domain location=1-45; Score=63.9; E_value=5.3e-16; Accession=PF07765.3; Description=KIP1-like protein
MIKLIDEEADSFARRAEMYYKKRPELMKLVEEFYRAYRALAERYDHAMGELRHAHKTMAEAFPNQAHYMLTDDSQGVESHTPGVPCPNYSESEHAEKADSEVQTLRKALAKIQSDKDAIFLQYQKSMEKLSEMERDLNKAQKDAGGLDERASKAEIETRVLQEALAHLKSDKEASQVQYNQCLESIAKLETLLSLAQLDVKEFDERASKAEIEAKNLKQELGQLEAQKDAGLLRYKQCVEKISVLEAKITLAEENSRMLNEQLERAELEVKALRKDLAELNEEKESLAVLYHQCLEKISKMENEILLAQENSEKLNREIEKGAEKLKTSEEHCDMLEKSNQSLRLEAENLLQKIAMKDQALLEKHAEIERLQTLVHEEHSHFLEIESTLQTLQKLYSKSQQEQGSLVMELKYGLQLLKDLEFPKQGFKEEMQENVKENRILNELTFSSTRSLLRRQQTEISKLKEIKEKLERELVVNSEENNALQQEAHQIKNDIQLLNNKYHAMLEQLQTL

SEQ ID NO: 172028 - protein, 152 aa, Glycine max
  Coding DNA Sequence Number=SeqID_55250
  Gene Ontology: Mol. function=metal ion binding
  Homolog annotation: Hit_ID=Q9XF92; Match level="QueryCoverage=53%, HitCoverage=48%, E-value=2e-28, Identity=69%"; Hit description=BRH1 RING finger protein
EGGVGGADEGNPAGVEVLGDGDAGGGGGELRGVPVRVRGRGRDQTADELSPHIPQRVSGPLDGVRSKNVPPVSDTLHTPPYASCILLQSSLDWPLFLFSGSSVKVVERNLIWIVKTCLIGRRYSCVLRRGTDTGSGSFLFQFYLHGSKTEKA

SEQ ID NO: 172029 - protein, 397 aa, Glycine max
  Coding DNA Sequence Number=SeqID_55251
  Gene Ontology: Mol. function=inositol or phosphatidylinositol phosphatase activity; Biological process=abscisic acid mediated signaling
  Homolog annotation: Hit_ID=Q1RYG3; Match level="QueryCoverage=99%, HitCoverage=71%, E-value=0.0, Identity=85%"; Hit description =Inositol polyphosphate related phosphatase
MRDDNSKKSKLSWPKTLVKKWFNIKSKNEDFQADDVLYAGVNQEWRNCSQREEDTIKRSKTERAKRRHSDRMRRGRIDRDAAPVTDVHNYRIFAATWNVAGKSPPSYLSLEDWLHSSPPADIYVLGFQEIVPLNAGNVLGTEDNGPARKWLSLIRKTLNSLPGTSGECHTTSPLPDPIVELDADFEGSMRQKTTSFFHRRSFQSLSHSMRMDNDMSLPQACLDRRLSVCDRMMFGHRPSDYDPCYRWASSDDENGPGDSPVVTHYSPMTYRGCFSMEDRFRQTGQSRYCLVASKQMVGIFLTVWVKSDIRDDVHNMKVSCVGRGLMGYLGNKGSISISMSLHQTSFCFICSHLTSGQKEGDELRRNSDVMEILRKTRFPRVQDMGDESSPQTILDHE

SEQ ID NO: 172030 - protein, 371 aa, Glycine max
  Coding DNA Sequence Number=SeqID_55252
  Gene Ontology: Mol. function=catalytic activity; Biological process =metabolic process
  Homolog annotation: Hit_ID=Q01CB8; Match level="QueryCoverage=54%, HitCoverage=66%, E-value=2e-49, Identity=48%"; Hit description =Homology to unknown gene
  Pfam annotation: Domain name=PGAM; Domain location=75-251; Score =115.4; E_value=1.6e-31; Accession=PF00300.12; Description =Phosphoglycerate mutase family
  Subcellular localization annotation: CTP_CleavageSite=23; ConfidenceScore=5.47e-01
MAVLPFSYSGFPTLSLPLSQQKRLKTKPNSNTNTCSLIQCCHNQTEPIELNGQARFPEKNPHINPAAAVPPRPRRIILVRHGESEGNVDESVYTRIPDPKISLTEKGKVQAEECGKRIKQMIENDHDQHWQVYFYVSPYRRTLQTLQHLARPFQRSRIAGFREEPRIREQDFGNFQNREKMRVEKALRQRYGRFFYRFPDGESAADVYDRITGFRETLRTDINIGRYQPPGEKKTDMNLVIVSHGLTLRVFLMRWYKWTVQQFESLNNMGNGNMLVMEKGFGGRYSLLMHHGEEELRRFGLTDEMLIDQEWHKFAKPADLNYDCPMVNSFFPHLSEEACSSRMNYFMITCGYLTPQLFSYSWVGSIGLLAS

SEQ ID NO: 172031 - protein, 287 aa, Glycine max
  Coding DNA Sequence Number=SeqID_55253
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=100%, HitCoverage=15%, E-value=2e-96, Identity=66%"; Hit description =Prefoldin; tRNA-binding arm; t-snare; Protein kinase PKN/PRK1, effector
MEVMTTEIDNLRKQLSDLEKSHNNLQEDSCKILEEKKSLTRSFLYLGEEKSNLEEEICVMIHETIAQSNISLIYENVIFEKLLELKELGEDLDKHCSANNDLDERLKVMVCKLENAEMENSHLKESFIKSNVELHLVESINDQLSCQISDEREMLHQKENELLEAAEMFRVLHTEKTELQRMVEDVKIKYDEARAMLEEQANQILKLSTDKDHQNEELTCLCEVNQKLESEMGYLRQELGETKLREKKLGDTVLKGTNEIEQWETQASTLFAELQISAVNETLLVGK

SEQ ID NO: 172032 - protein, 329 aa, Glycine max
  Coding DNA Sequence Number=SeqID_55254
  Gene Ontology: Mol. function=kinase activity; Cellular component =proton-transporting two-sector ATPase complex; Biological process =ATP synthesis coupled proton transport
  Homolog annotation: Hit_ID=Q1SMI5; Match level="QueryCoverage=95%, HitCoverage=18%, E-value=9e-47, Identity=43%"; Hit description =Prefoldin; tRNA-binding arm; t-snare; Protein kinase PKN/PRK1, effector
MGYLRQELGETKLREKKLGDTVLKGTNEIEQWETQASTLFAELQISAVNETLLVGKVSELAEMFRVLHTEKTELQRMMENLKIKYDEAWVMLEEQANQILKLSSDKDHQNEELICLCEVNQKLESEMGYLRQELGETKLRERKLGDEVLKGTNEIEQWETQASTLFAELQISSVNETLLEGNVCELAEMFRVLHTEKTELQRMVENLKIKYDEAEVMLEEQANQILKLSTDKDHQNEELICLCEVNQKLESEMGYLRQELGETKLRERKLGDEVLKGTNEIEQWETQASILFAELQISAVNETLLEGNVCELAEMFRALHTEKTELQRM

SEQ ID NO: 172033 - protein, 168 aa, Glycine max
  Coding DNA Sequence Number=SeqID_55255
  Homolog annotation: Hit_ID=Q5MK24; Match level="QueryCoverage=69%, HitCoverage=48%, E-value=5e-23, Identity=46%"; Hit description=ARV1
MRTLSFVEDRCLILESSKGKLGSSNSVSSLVSICWKVLMDVIIGNLMFLLTFFFMVKMFFHVSITISRCIDLLLTLMISSYFKIFLIAMMVWDFPSSVIFIIELFCLSSNAAALKVMTESTMRRCVWTCFSAYAIKFIVTRILELILLGQLMQGWSQMPFTFSKATMI

SEQ ID NO: 172034 - protein, 168 aa, Glycine max
  Coding DNA Sequence Number=SeqID_55256
MIWLKQDRTKVYFAEGLKEFRKDLSIYESVIIKFLACNEKSMFDLYFVPSLECQTCGRPEVMSRQHIWTLEIAQSILGAPGPLRLPNCAITHVNACGQHMTILRRFGPPLQWNVVVVDGGVRRRYVVQPWYQFIADNDFSHGDEVSFYYRTIDKIWEIVIRQRKNWEY

SEQ ID NO: 172035 - protein, 106 aa, Glycine max
  Coding DNA Sequence Number=SeqID_55257
  Homolog annotation: Hit_ID=Q2HSZ5; Match level="QueryCoverage=99%, HitCoverage=28%, E-value=7e-28, Identity=65%"; Hit description =UBA/TS-N domain, putative
  Pfam annotation: Domain name=UBA; Domain location=64-103; Score=48.0; E_value=3.3e-11; Accession=PF00627.21; Description=UBATS-N domain
MGSPRAPSSARNVVRNLPSYPTHQMEASSYAFMILMTLSAFYAAAIFEAGCRNYPAPMQAAVEPTEDSITTLVSMGFDRNSARQALVQARNDVNVATNILLEAQSH

SEQ ID NO: 172036 - protein, 552 aa, Glycine max
  Coding DNA Sequence Number=SeqID_55258
  Gene Ontology: Mol. function=glycerophosphodiester phosphodiesterase activity; Cellular component=membrane; Biological process=glycerol metabolic process
  Homolog annotation: Hit_ID=Q9SZ11; Match level="QueryCoverage=99%, HitCoverage=75%, E-value=1e-167, Identity=53%"; Hit description =Probable glycerophosphoryl diester phosphodiesterase 2 precursor
  Pfam annotation: Domain name=GDPD; Domain location=44-335; Score= -17.0; E_value=0.00016; Accession=PF03009.8; Description =Glycerophosphoryl diester phosphodiesterase family
MAISRVLAILILQYSLVALVSSAGPRGGWKTLQGSPPLVIARGGFSGIFPDSSSLAYSLTLDTCGPNVTLWCDVQLTKDGVGICFPELKLDNASDISIAYPGKAKDYLVNEVSTRGWFSVDYNLAELANVSVVQGVYSRTNKFDGNKLPIRSVEDVAKLIKSPSTGLWLNIQHDSFFKQQNLSVENFLQSLPAKSVPVNYISSPDVDFLRRVKSSFSSGPTGFIFRFLEQSKLEPTTNQTYGELLKNLMLIKTFASGILVPKGYIWPVDSGLYLQPHTPLVTDAHREGLQVFVSDLTNDVPFSYNFSYDPLAECLSFIDGDDFSVDGVLSDFPVTPSAAINCFSGLGKNAKKQVDTLVITKYGASGDNPACTDLAYNQAKSDGADVLDCPVQMSKDGIPFCLSSIDLSESTTVADTQLKNRATTIPEIKYRSGIYTFSLTWDEIKTLTPSILNPYEKYILSRNPKSKNLGKLITLSDFLSLTEGSRILISIENAAYLAEKQNLRVTDAVLDALQKAKPRSHKINPKFERVYKVDENIGGAADSAIEDIKTFC

SEQ ID NO: 172037 - protein, 301 aa, Glycine max
  Coding DNA Sequence Number=SeqID_55259
  Gene Ontology: Mol. function=transcription cofactor activity; Cellular component=nucleus; Biological process=abscisic acid mediated signaling
  Homolog annotation: Hit_ID=Q75LB9; Match level="QueryCoverage=94%, HitCoverage=78%, E-value=5e-96, Identity=57%"; Hit description =Putative pirin-like protein
  Pfam annotation: Domain name=Pirin; Domain location=30-129; Score =81.3; E_value=3.1e-21; Accession=PF02678.6; Description=Pirin
  Pfam annotation: Domain name=Pirin_C; Domain location=182-287; Score =138.3; E_value=2.1e-38; Accession=PF05726.3; Description=Pirin C -terminal region
  Pfam module annotation: Pfam domain module=Pirin::Pirin_C; Domain location=30-129::182-287
MPQKKGCSFLNEPRLVARKFLARPQIEGVGAVVRRSIGRFELKYFDPFIVLDEFSEYQLSYYQLVPKVVICEVIMHEDFEGHKGTIEAGDLQWMTAGRGIVHSEMPGAQGIHSKMPGAQGTQRGLQLWINLASKYKMIEPRYQEVLSKDIAEAEDDGIKVRVIAGEALGIKSPIYTRTPTMFLDFTLKPGGHLQQPIPKSWNAFVYVLEGEGIFGNMKSQPSNSHHILLLGAGDGLEAWNQSSKLLRFILVGAEPLGEPLVQFGPFVMNTQEEIDQTIDDFENFANGFEKARHWRSESQIN

SEQ ID NO: 172038 - protein, 227 aa, Glycine max
  Coding DNA Sequence Number=SeqID_55260
  Gene Ontology: Mol. function=transferase activity; Cellular component= integral to membrane
  Homolog annotation: Hit_ID=Q4VWQ6; Match level="QueryCoverage=68%, HitCoverage=31%, E-value=5e-49, Identity=58%"; Hit description=Beta 1,2 xylosyltransferase
MNKRTTLLIRTLLFLFVLNSLYLSLYFTHKPSYSSPSEEKEKSELEPDTYLTPFSHEPHSSKPWPILPSYLPWTTSARSHSCEAYFGNGFTRRRDALLPRGGAGWFRCHHNDALRSSVCEGGRLRMEPEKITMAKGGEDLAAVMGRTEDEEMPVFQNGAFQVDGGEVAVDRKVLVDQEFLDEYVPRGGIDRHTMRDLIAKIRIVRGKDFQCDEEIVTDVDSIVVTDT

SEQ ID NO: 172039 - protein, 65 aa, Glycine max
  Coding DNA Sequence Number=SeqID_55261
MVILDYQIKRVCWIMVVLLVLRSFALSLGGSYLGPKMVQLGGGAMRGLREWEVVGEGEGLWGVGI

SEQ ID NO: 172040 - protein, 839 aa, Glycine max
  Coding DNA Sequence Number=SeqID_55262
  Gene Ontology: Mol. function=proteasome activator activity; Cellular component=proteasome complex (sensu Eukaryota); Biological process =RNA elongation from RNA polymerase II promoter
  Homolog annotation: Hit_ID=Q6Z8S7; Match level="QueryCoverage=98%, HitCoverage=97%, E-value=0.0, Identity=62%"; Hit description =Putative signal transducer and activator of transcription interacting protein
  Pfam annotation: Domain name=WD40; Domain location=111-152; Score =16.2; E_value=0.12; Accession=PF00400.22; Description=WD domain, G -beta repeat
  Pfam annotation: Domain name=WD40; Domain location=165-208; Score =2.9; E_value=17; Accession=PF00400.22; Description=WD domain, G-beta repeat
  Pfam annotation: Domain name=WD40; Domain location=215-261; Score =31.8; E_value=2.5e-06; Accession=PF00400.22; Description=WD domain, G-beta repeat
  Pfam annotation: Domain name=WD40; Domain location=300-350; Score =27.5; E_value=4.6e-05; Accession=PF00400.22; Description=WD domain, G-beta repeat
  Pfam annotation: Domain name=WD40; Domain location=406-444; Score =30.7; E_value=5.2e-06; Accession=PF00400.22; Description=WD domain, G-beta repeat
  Pfam annotation: Domain name=WD40; Domain location=458-498; Score =13.7; E_value=0.69; Accession=PF00400.22; Description=WD domain, G -beta repeat
  Pfam annotation: Domain name=WD40; Domain location=53-102; Score =31.6; E_value=2.7e-06; Accession=PF00400.22; Description=WD domain, G-beta repeat
  Pfam annotation: Domain name=WD40; Domain location=588-626; Score =5.4; E_value=8.6; Accession=PF00400.22; Description=WD domain, G -beta repeat
  Pfam annotation: Domain name=WD40; Domain location=635-673; Score =28.2; E_value=3e-05; Accession=PF00400.22; Description=WD domain, G -beta repeat
  Pfam annotation: Domain name=WD40; Domain location=684-722; Score =45.8; E_value=1.4e-10; Accession=PF00400.22; Description=WD domain, G-beta repeat
  Pfam annotation: Domain name=WD40; Domain location=728-771; Score =12.7; E_value=1.2; Accession=PF00400.22; Description=WD domain, G -beta repeat
  Pfam annotation: Domain name=WD40; Domain location=792-835; Score =28.6; E_value=2.2e-05; Accession=PF00400.22; Description=WD domain, G-beta repeat
  Pfam module annotation: Pfam domain module=WD40::WD40::WD40::WD40::WD4 0::WD40::WD40::WD40::WD40::WD40::WD40::WD40; Domain location=111 -152::165-208::215-261::300-350::406-444::458-498::53-102::588 -626::635-673::684-722::728-771::792-835
MRGGGGGGGEVEVKRVFIGAGCNRIVNNVSWGASGLLSFGAHNAVAIFCPKSAQILTTLPGHKAVVNCTHWLPSSKFLFKAKLLEQHYLLSGDADGAIILWELSLADGKWRQMLQLPQSHKKGVTCISGIMVSQTEAIFASTSSDGTACVWELVFPTTGSGDCKLSCLDSFSVGSKSMVALSLAELPGDSGQIVLAMGGLDNKIHLYCGGRTRKLVHACELKGHTDWIRSLDFSLPISINGEVNNIFLVSSSQDKGIRIWKMALRSSMSNGHGIDKKGEISLSSYIEGPVLVAGSSSFQISLESLLIGHEDWVYSVMWQPPLVASMEGDAYYQPQSILSASMDKTMMIWQPEKTSDVWMNVVTVGELSHCALGFYGGHWSPNGDSILAHGYGGSFHLWKNVGNDNWLPQKVPSGHFASVTDIAWARSGDYIMSVSHDQTTRIYAPWKVEAPLQDGEFWHEISRPQVHGHDINCMAVIHSKGNHRFVCGAEEKVARVFEAPLSFLKTLSNATLQKSCSSDDIMGDVQILGANMSALGLSQKPIYVQAVHEAPERSGVNGLDTLETIPDAVPTVFTEPPIEDQLAWHTLWPESHKLYGHGNELFSLCCDHKGELVASSCKAQSAAVAEVWLWQVGSWKAVGHLQSHSLTVTQMEFSHDDNFLLTVSRDRQFSVFSITRTGTGEISCSLLARQEGHKRIIWSCSWNPHGQEFATGSRDKTVKIWAIERDSIRQLMSLPQFTSSVTALSWVGLHHRRNNGLLAVGMENGQIELWNLSYNRADDGSIAAPGLATSLAVRIDPFICHASTINRLAWKKNEDDHMSMQLASCGADNCVRVFDVTVE

SEQ ID NO: 172041 - protein, 471 aa, Glycine max
  Coding DNA Sequence Number=SeqID_55263
  Gene Ontology: Mol. function=protein serine/threonine kinase activity; Cellular component=cellulose and pectin-containing cell wall; Biological process=protein amino acid phosphorylation
  Homolog annotation: Hit_ID=Q9ZU46; Match level="QueryCoverage=97%, HitCoverage=63%, E-value=1e-147, Identity=58%"; Hit description =Putative receptor-like protein kinase
  Pfam annotation: Domain name=LRRNT_2; Domain location=24-64; Score =51.3; E_value=3.3e-12; Accession=PF08263.3; Description=Leucine rich repeat N-terminal domain
  Pfam annotation: Domain name=LRR_1; Domain location=115-137; Score =11.4; E_value=2.1; Accession=PF00560.23; Description=Leucine Rich Repeat
  Pfam annotation: Domain name=LRR_1; Domain location=139-161; Score =10.9; E_value=2.6; Accession=PF00560.23; Description=Leucine Rich Repeat
  Pfam annotation: Domain name=LRR_1; Domain location=163-186; Score =13.7; E_value=0.66; Accession=PF00560.23; Description=Leucine Rich Repeat
  Pfam annotation: Domain name=LRR_1; Domain location=188-210; Score =20.9; E_value=0.0045; Accession=PF00560.23; Description=Leucine Rich Repeat
  Pfam annotation: Domain name=LRR_1; Domain location=212-235; Score =2.8; E_value=86; Accession=PF00560.23; Description=Leucine Rich Repeat
  Pfam annotation: Domain name=LRR_1; Domain location=91-114; Score =10.7; E_value=2.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=24-64::115-137::139-161::163 -186::188-210::212-235::91-114
MLPFFALFFFLLCCNSLAPVVYSLNAEGSVLLTLKQTLTDPQGSMSNWNSFDENPCSWNGITCKDQTVVSISIPKRKLYGSLPSSLGSLSQLRHINFRNNKLFGNLPPRLFQAQGLQSMVLYGNSLSGSVPTEIQNLRYLQALDLSQNFFNGSLPAGIVQCKRLKTLILSQNNFTGPLPDGFGTGLSSLERLDLSYNHFNGSIPSDLGNLSSLQGTVDLSNNYFSGSIPASLGNLPEKVYIDLTYNNLNGPIPQNGALMNRGPTAFIGNPGLCGPPLKNSCASDTSSANSPSSFPFIPDNYSPQGTGNGSMGSEKNKGLSKGAVVGIVVGDIIGICLLGLLFSFCYSRVCGFNQDLDENDVSKGKKGRKECFCFRKDDSEVLSDNNVEQYDLVPLDSHVNFDLDELLKASAFVLGKSGIGIMYKVVLEDGLALAVRRLGEGGSQRFKEFQTEVEAIGKLRHPNIATLRAYY

SEQ ID NO: 172042 - protein, 202 aa, Glycine max
  Coding DNA Sequence Number=SeqID_55264
  Gene Ontology: Mol. function=nucleotidyltransferase activity; Biological process=biosynthetic process
MHAKFQQHLFDECEIQFNKDQQLELINGQICFKIYPFENEIPVERKIIMPGSFHPLHDGHLKLMEVATRIHLSSICGDGYPCFEISAVNADKPPLSVSQIKDRIKQFEKVGEAYIAIGTSQTITILLREHYGCPLTEWRARMLFTLMHSHSVLQNVKQLNPWFLLDHVTVPHVFVFYPWTVLLLLRKNTFYSLEWVRNQQLK

SEQ ID NO: 172043 - protein, 80 aa, Glycine max
  Coding DNA Sequence Number=SeqID_55265
  Gene Ontology: Mol. function=nucleotidyltransferase activity; Biological process=biosynthetic process
MLLLQHPKYYDGDYSMMLKILVGCKETGCTFLVGGRNVDGAFKVLDDIDVPEELKGMVVSIQAEQFRMDISSPEIRNRNH

SEQ ID NO: 172044 - protein, 156 aa, Glycine max
  Coding DNA Sequence Number=SeqID_55266
  Gene Ontology: Mol. function=ribonuclease H activity; Biological process=RNA-dependent DNA replication
  Homolog annotation: Hit_ID=Q1RYI2; Match level="QueryCoverage=62%, HitCoverage=15%, E-value=6e-12, Identity=38%"; Hit description =Ribonuclease H
MEHYDVMVGGLGSMERNGHAPVAVTTFLNILYPRRPHLFCLNFGTYFFLLVDFIKLKCDGAMVQSQSMTSCGGVIRDYKGHFIRAFLRKLRSCLILEAELWSLLFGMMMLKDAEMPNVIIESDCLEVVHLVNGGSSPGHTFVDLVDEICKLKEKFS

SEQ ID NO: 172045 - protein, 276 aa, Glycine max
  Coding DNA Sequence Number=SeqID_55267
  Gene Ontology: Mol. function=sequence-specific DNA binding; Cellular component=nucleus; Biological process=regulation of transcription, DNA-dependent
  Homolog annotation: Hit_ID=Q7Y0Z9; Match level="QueryCoverage=59%, HitCoverage=26%, E-value=1e-21, Identity=43%"; Hit description=Bell -like homeodomain protein 3
  Pfam annotation: Domain name=POX; Domain location=200-276; Score= -3.9; E_value=1.1e-06; Accession=PF07526.2; Description=Associated with HOX
MLVNQIQGFVSDPEMYNLTTGMEMIGFPKSDTNAVMWRSFIPKPGPSSSKTINDNSTTFYHHDYNNKHADFTPAGNISQTSADNLIVGSHDSASWQDNINNNNNSSRFDDSSLRCVFPCETNERPSQGLSLSLSSTNPSSIGLQSFELRQTGQHLDFVSSSSRDGFFGKPVSLQQQQMVSQDGYVSSNSKVASVYQQGHFLVKNSKFLVPAQDLLNEFCSLDAKQSDLGKPTKSLNKKQWEEENNGIGSSKKHSLTSLEFVELQKRKTKLLSMLEE

SEQ ID NO: 172046 - protein, 296 aa, Glycine max
  Coding DNA Sequence Number=SeqID_55268
MVARVHDINLVQNIHELFITKGFQSVKLRHMGDNFMLLTPLDGLEMKEIVKGPEDWLKEVVEEIKAQDVCHSCCGVTRFMENGNGSYIRSLDLEFTSSVSKCSSDAGRWLDADKVVRDVVPVSAMRESNLQHVGGVVDTVSHQTGCEGTKGDQHSGKGNDDHDIYRVMENGVVHLNLVDTQHQQVEDTVHHENPKGIDDMSKVLLPNIEPCMVNESVEKGTPLKARDGASMVVKYCENYGTRGGVRLCDREIELFNLRNNCARQVIEATFEANVVGVTNMEKDVDMQGKSNLAAWR

SEQ ID NO: 172047 - protein, 185 aa, Glycine max
  Coding DNA Sequence Number=SeqID_55269
MVLCFPSTPKKLAMTIAVSLSGASILAVGMHLSYVNVEPQRARTRDRDAFVMETLNKKYGYTSPYEKLARNGSSVERSQESSMRENYARARNDLHIVHTTGRERKSEAVVERISSKNRYLKCYMSSFILNVKNRISKLLQLKLGKVKIALAESSLLRSFANSRDADTVGGQWKIVEKLVQHVPAQ

SEQ ID NO: 172048 - protein, 453 aa, Glycine max
  Coding DNA Sequence Number=SeqID_55270
  Gene Ontology: Mol. function=transferase activity; Cellular component= integral to membrane
  Homolog annotation: Hit_ID=Q4VWQ6; Match level="QueryCoverage=99%, HitCoverage=84%, E-value=1e-168, Identity=68%"; Hit description=Beta 1,2 xylosyltransferase
  Subcellular localization annotation: CTP_CleavageSite=41; ConfidenceScore=5.36e-01
LLPRPLPAPARPTSGTASCAAATSSSPAAEPGGSGAATAIRSGAREEEELPAFQNGAFEVDGGEVVDREFLVDKKFLDEYVPRGGIDRHTMRDLIAKIRIVRGKDFQCDEGLISENRILGGKDFECDEARKWKMLRVTVRDLISKIRIMGRKDFESDEGFYLQWIEEPALLVTRFEYANLFHTVTDWYSAYVSSRVTGLPNRPHLIFVDGHCAAPLEETWRALFSSLRYAKNFSGSVCFRHAILSPLGYETALFKGLTEDIDCYGAPAQELWQNPDDHKTARLSEFGEMVRAAFGLPLNVHRGGKPLFGHNILFVRREDYLAHPRHGGKVESRLSNEQEVFDSLKSWASNYKGCKINLVNGLFAHMSMKDQVRAIQDASVIIGAHGAGLTHIVSALPKTVILEIISSYFRRPHFAYISRWKGLEYHAINLAGSHADTGTVIKELVDIMKSLGC

SEQ ID NO: 172049 - protein, 112 aa, Glycine max
  Coding DNA Sequence Number=SeqID_55271
  Subcellular localization annotation: CTP_CleavageSite=60; ConfidenceScore=5.17e-01
MKMEGDLHDINKFNQLVSVVVMASLPRSFKALVQTLLVGRSTLNLDEVTVTPRENGKMMRTENVDDEHNAIAMMETERGRNHSRKHDGPRGRSKSQSRPQRDMNHNRVHNEI

SEQ ID NO: 172050 - protein, 230 aa, Glycine max
  Coding DNA Sequence Number=SeqID_55272
  Gene Ontology: Mol. function=transferase activity, transferring glycosyl groups; Cellular component=membrane
  Homolog annotation: Hit_ID=Q9FN55; Match level="QueryCoverage=90%, HitCoverage=39%, E-value=1e-86, Identity=70%"; Hit description =Arabidopsis thaliana genomic DNA, chromosome 5, P1 clone:MYC6
  Pfam annotation: Domain name=DUF604; Domain location=23-211; Score =316.0; E_value=6.8e-92; Accession=PF04646.3; Description=Protein of unknown function, DUF604
  Pfam annotation: Domain name=XET_C; Domain location=143-177; Score= -4.8; E_value=0.08; Accession=PF06955.3; Description=Xyloglucan endo -transglycosylase (XET)
  Pfam module annotation: Pfam domain module=DUF604::XET_C; Domain location=23-211::143-177
MTINIDITIIIVIDTSRGVCGLYDVYGNLFGLLAAHPVTPLVSLHHLDVVEPIFPNATRVEAIKRLTIPMKLDSASLIQQSICHDRNRRWTISVSWGFAVQIFRGIFTQREMEMPSRTFLNWYRRADYTAYAFNTRPFSRNPCQKPFVFYFSKAKLNSTLQQTVTDYERDPIPSPECRWNMADPSALDKIEVHKKKDPHLWDRAPRRNCCRVMKSNKTGILKIEVAVCRD

SEQ ID NO: 172051 - protein, 255 aa, Glycine max
  Coding DNA Sequence Number=SeqID_55273
  Gene Ontology: Mol. function=sequence-specific DNA binding; Cellular component=nucleus; Biological process=regulation of transcription, DNA-dependent
  Homolog annotation: Hit_ID=Q43457; Match level="QueryCoverage=93%, HitCoverage=93%, E-value=4e-60, Identity=50%"; Hit description=Heat shock transcription factor 34
  Pfam annotation: Domain name=HSF_DNA-bind; Domain location=9-193; Score=187.1; E_value=4.4e-53; Accession=PF00447.8; Description=HSF -type DNA-binding
MSQQQRSTPAPFLTKTYLLVDDPATDDVVSWSEGGNTFVVWKHADFAKDLLPKYFKHNNFSSFVRQLNTYGFRKTVPDKWEFANEYFKRGQTDLLAEIRRRKVVSPVTGKSTGGGVNISASHSGGDDMGSTSTGSMEAATAAGADISGENEKLKKDNEKLSGELALAKKQCEELVAFLRDSLNVSPDVIERIIRQGTCVSSNNDAVRFDAIINNDLDDDENAGQNGKENSIGKCRKRGRQDYPIAATAKELKTLV

SEQ ID NO: 172052 - protein, 278 aa, Glycine max
  Coding DNA Sequence Number=SeqID_55274
  Gene Ontology: Mol. function=RNA-directed DNA polymerase activity; Biological process=RNA-dependent DNA replication
MEIIQNSTNVGRANGDPVMVTKCHIRQMVRNYKPSLLLLFETHSSLGTDLGTILASFKRHKGTPEASGFYLVEDFSSTLVDSMPHAITTFTVKKMYPPPVLVPCTVFWDYLITLGEHIQGPWLMLKDFNDIILSSEVSGGLFYPSRAFALANFFNECGLLDLGTVRGRFTWRKNIQNGGHMRKKLDRCMVNSGWRLFFPHGLAEVLNPYGSDHNPVLVHCFKSPSIKNTSFHFQAAWTLHPDFRNLVSQTWDSTQGDAIMKLDGVLTFLQLQPNPTWS

SEQ ID NO: 172053 - protein, 293 aa, Glycine max
  Coding DNA Sequence Number=SeqID_55275
  Gene Ontology: Cellular component=chloroplast thylakoid membrane; Biological process=transport
  Homolog annotation: Hit_ID=Q67TV5; Match level="QueryCoverage=50%, HitCoverage=46%, E-value=4e-15, Identity=30%"; Hit description =Nuclear transport factor 2 (NTF2)-like protein
MEQLSELGTDSLVKARESSLFFCAIKLSTRASCHWPGINSNITKRLAIRLPPSRTKCNLHLHKMEIQRHSIKKNVLNKSWDRNRVLAMASKRDPKSQQNSLSPADTVEQYYTSINDKDLRQLDECISEDACFDDYAFTKPFQGKKEVIRFLEQLTHCMGRNVTFRLKHIYEGDDLTAVASWHLEWNEKQIPFTRGCTFFKLSKLGKNLVIWNAEVLIESPIKPGSIVLVTPKTPRFLRSPNVILTWILRVYNIFVAPWLHPLLEGYIKLWGFFVRLLNSVITVVIFISKTFFK

SEQ ID NO: 172054 - protein, 179 aa, Glycine max
  Coding DNA Sequence Number=SeqID_55276
  Gene Ontology: Mol. function=transferase activity, transferring glycosyl groups; Cellular component=membrane
  Homolog annotation: Hit_ID=Q9FN55; Match level="QueryCoverage=94%, HitCoverage=33%, E-value=1e-29, Identity=44%"; Hit description =Arabidopsis thaliana genomic DNA, chromosome 5, P1 clone:MYC6
MCTILGLPEAYGMAHVPGFTHLHGLHSQAGIHVHVIKHVQPRAFHHQPPLLHNLFLFLKWNGVAGSGIFIFIPQFPCRKGETGAENGAPAPGVRNRGVVEAMGTQKELHKDLVQEGEDEGSGVAGRSREEEPQRRVATNQGFHRHFQFRIHQQAGPPLRDSNIAHRDGNAAYGAQGRAV

SEQ ID NO: 172055 - protein, 1151 aa, Glycine max
  Coding DNA Sequence Number=SeqID_55277
  Homolog annotation: Hit_ID=Q10K57; Match level="QueryCoverage=66%, HitCoverage=98%, E-value=1e-117, Identity=36%"; Hit description =Expressed protein
  Subcellular localization annotation: CTP_CleavageSite=70; ConfidenceScore=5.59e-01
MPLHLHPQVGAPLSHMHPSQPPLFQFGQLRYTSPISQGIMPLGPQSMSFVQPNIPSSFSYNRNPGGQMPVQNAPETSDSFIKNEIRHHSVDSQPGNSRNLSQGSLPSENAENIAGIKQGRIESSHVHNNSSRTSTSFQLDKRGNQNVVGKRSNISSSAKESEVQPVTRDASYNPVSKENFMESKTQFGGRGKRYVFTVKNSNPRSSGPAPRVNRPDSGGFMRRPRRNMQRTEFRVRENADKRQSTSSVLTDQFGLDNKSNINGRGAGISGRTVPRKAMSNKLGKQTVELATENSQGMDSGSRGEKVDGKESTKTQGFSHSGQSNLKRNLCSEEDVDAPLQSGIIRVFEQPGIEAPSDEDDFIEVRSKRQMLNDRREQREKEIKAKSRVAKAQRRPRSGSQSVVAVANSTKGSIAGVEVANSLHADFVAADVLGMTKMDASSGFNSSLLSQALPPIGTPPPLKIDTQPDLRSQISRSHQTSLPAVSGGEKDPGSGVIFENKNKVLDNVQTSLGSWGNAQISQQVMALTQTQLDEAMKPQQFDSQASVGNMTGAVDEPSLPTSSILTKEKTFSSASSPINSLLAGEKIQFGAVTSPTVLPSSSRVVSHGIGRPRSSRSDMQMSHNLTASDNDCSLFFDKEKHGNESHGHLEDHDAEAEAEAAASAVAVAAISSDEIVGNGLGACSVPASDGKSFVAADIDRVVAGVGCEQQSANQSRSEEPLSVSLPADLSVETPPISLWPPLPSTQNSSGQMISHFPSVPPHFPSGPPSHFPFYEMNPMMGGPVFAFGPHDESASTTQSQPQKSTTSASRPIGSWQQCHSGVESFYGPPTGFTGPFIAPPGGIPGVQGPPHMVVYNHFAPVGQFGQVGLSFMGTTYIPSGKQPDWKHIPTSSAVGAGEGDMNSMNMASSLRNPANMPSPIQHLAPGSPLMPMASPVAMFDVSPFQPSTEMSVQARWPHVPNSQLPLSIPLQQQEGVQTSQFSHVPSVDQPLNAKRFTSSRASTSSDGDRNFPRAADVNVNQLPDELGLVDNSNFTATKTSAQTVVIKTPSVIPITDTVKVDVQNGNSSSSNNNQNASSSFKNQPSQSDHSSGHGNYQRGGVSQRNNSGGEWSHRRVYQGRNQSLGSDKNFSSTKVKQIYVAKQTISGASTVS

SEQ ID NO: 172056 - protein, 78 aa, Glycine max
  Coding DNA Sequence Number=SeqID_55278
MSWIQPPKLLLMTVMQWRSYKTQQMLDVPMVTLSWSQSVTPHVLDSATEVTPYDGDAMEIIQNSTNVGRANGDPVMVT

SEQ ID NO: 172057 - protein, 43 aa, Glycine max
  Coding DNA Sequence Number=SeqID_55279
MGKVSEKDIMQGYQIVKMASWMLRMQGTLLKFGYNQPNHKLSD

SEQ ID NO: 172058 - protein, 169 aa, Glycine max
  Coding DNA Sequence Number=SeqID_55280
  Gene Ontology: Mol. function=RNA-directed DNA polymerase activity; Cellular component=chromatin; Biological process=chromatin assembly or disassembly
MSRNVGDMHTWGKLLPPGENPKQRPNWLSWAGYWFNTTYPSPSPPGDTFPLKVEDVIRLQMEGELEFSVGDWVYLKRIGSVAYKLELPEHARIHPVFQVCLLKKALAALSVEQPLPLVLTEEWELQPQPEGINDGDRAGVQNPLEAPYGQILAANTQVETTPAPHPKKV

SEQ ID NO: 172059 - protein, 610 aa, Glycine max
  Coding DNA Sequence Number=SeqID_55281
  Homolog annotation: Hit_ID=UPI000016344C; Match level="QueryCoverage =97%, HitCoverage=91%, E-value=3e-67, Identity=30%"; Hit description =protein binding
  Pfam annotation: Domain name=Ank; Domain location=118-188; Score=2.0; E_value=16; Accession=PF00023.20; Description=Ankyrin repeat
  Pfam annotation: Domain name=Ank; Domain location=14-44; Score=12.8; E_value=0.45; Accession=PF00023.20; Description=Ankyrin repeat
  Pfam annotation: Domain name=Ank; Domain location=49-82; Score=9.1; E_ value=1.5; Accession=PF00023.20; Description=Ankyrin repeat
  Pfam annotation: Domain name=Ank; Domain location=84-116; Score=17.9; E_value=0.037; Accession=PF00023.20; Description=Ankyrin repeat
  Pfam module annotation: Pfam domain module=Ank::Ank::Ank::Ank; Domain location=118-188::14-44::49-82::84-116
MLHLLSKARRFNHSHYHPLHLAILKGDWESTKAFLDNDPSALTAKVTAIGGTALHAAAVGGQWQIIEKLVQHVPAQVLSDLDLMGCTCLHYVAMGESTSAAKALVAINPSLTQLTDKKGFTPLIYSITSSKCKEMVWYFVLNTTDEEPGCPFSGPSADQLVALLTAAGFHDITMYLLQRYPNLATLSDSNGSIILNVLSKLPTEFQSGNKLGFWKRCIYHCVPNELDFLPPSHLRGNLKDSYGNSSHHQSHFGGTIWNAIQNIVPGIKLVRETKLRHISSVRLVEFVCRQVSTTNDSEFWQSHMSADIIFNATSSGIVEILRICFQFFPDLVWTHMPHEGFVAQIAIKNRQEKVFSLICEMPIVCKFLILALDESQNTTSHLAARFASPQLASISGAAFQMQKELQWFKEVEKWDHPLHKEVKAKDGKTPWQLFREEHKPLLEEAKNWMKDTSNSCMLVATLIATVVFAASITVPGGNNQDKGFPIYLLDNTFMVFIVSDTLALFSSMASLLMFLSILTARYTEEDFLRRLPERIILGLASLFFSIVTTMIAFGAALDLLLRERLQWVAIPIALLACVPVALFARLQLPLFIQMIISTYGSRIYHHQSLW

SEQ ID NO: 172060 - protein, 724 aa, Glycine max
  Coding DNA Sequence Number=SeqID_55282
  Pfam annotation: Domain name=ERM; Domain location=64-635; Score= -195.4; E_value=0.027; Accession=PF00769.9; Description =Ezrinradixinmoesin family
  Pfam annotation: Domain name=TolA; Domain location=57-443; Score= -135.7; E_value=0.013; Accession=PF06519.2; Description=TolA protein
  Pfam module annotation: Pfam domain module=ERM::TolA; Domain location= 64-635::57-443
MGGKGLPVNDPLLNFGREKRALPKSEKGFLEDPFMKDFGGSSFDGRDLLGGLVGVVKKKKDVLKQTDFHDPVRESFEAELERVQRMQEQERQRIIEEQERALELARREEEERLRQAREQEERQRRLEEEAREAAWRAEQERIEALRKAEEQRLAREEEKQRMVLEEERRKQAAKQKLLELEQRIARRQAEASKSGSNAPVVVEEKMPAILNEKEASRATDVGDWEDSERMVDRILTSASSDSSSVNRALEMGSRSHFSRDLSSTFGDRGKPVNSWRRDGYENWNSSTFYPQDQENSHNSPRRDLSIGGKPFMRKDYNGGAGFVSSRPYYKGGISEPHLDEYAHVKPQRWNQSADGDNLSRNTEIDSDFHENYFERFGDGWTQGRSRGNPFPQFPERTYPNSESEGPYALGRSRYSVRQPRVLPPPSLGSVHRTYKNENEHPGPSAFLENEMHYNQATRSDSTLPTGYDNGNRGQPEVVDARQETTENEDHKVESTPRCDSQSSLSVSSPPSSPTHLSHDDLDDSGDSPTILTSEGSKNDPLTAPDNESIATPAGNENVVTPCAVSSGDDDEWTTENNEQFQEQEEYEDEDYQEEDEVHEGDDHAQLNQDFEDMHLQEKGLPHLMDNLVLGFDEGVQVGMPNEKFERTSKDEETTFVAQQASGISLEECVSYDNASDDDKALQPVNDTKVNLNSTSSVFQESEKPAQDLVIQPSNSLSPVVSESL

SEQ ID NO: 172061 - protein, 80 aa, Glycine max
  Coding DNA Sequence Number=SeqID_55283
  Gene Ontology: Mol. function=DNA binding; Biological process =induction of apoptosis
  Homolog annotation: Hit_ID=Q6L5A4; Match level="QueryCoverage=82%, HitCoverage=89%, E-value=2e-22, Identity=80%"; Hit description =Putative apoptosis-related protein
  Pfam annotation: Domain name=dsDNA_bind; Domain location=1-69; Score =8.8; E_value=8.4e-06; Accession=PF01984.10; Description=Double -stranded DNA-binding domain
MECGIETIVWYALVARIALVKPEKARGVEDFILRAAQMGQITEKVSEERLISLLEQINNQTTRQTKVTIQRRRSVLEDDD

SEQ ID NO: 172062 - protein, 183 aa, Glycine max
  Coding DNA Sequence Number=SeqID_55284
  Homolog annotation: Hit_ID=Q6F2U6; Match level="QueryCoverage=91%, HitCoverage=52%, E-value=4e-62, Identity=66%"; Hit description =Expressed protein
  Pfam annotation: Domain name=Lysine_decarbox; Domain location=40-177; Score=19.1; E_value=3e-06; Accession=PF03641.4; Description=Lysine decarboxylase family
MGPSHSHYVQAQDLAKEAMIVAKIENLLDCTTWSGGPGLMDAVTEGAMLAGKPVGGFKIGREAGEWTASNFHPYLSSENYLTCRFFPARKHGLVDAVVRNNSFDKTAVVALPCGIDTLDEVFEILALIQLEWIGSKLHLLEFLNDCEGWGTVSKGEVASLWKVCNSNSEASVVPRRILWHFFL

SEQ ID NO: 172063 - protein, 134 aa, Glycine max
  Coding DNA Sequence Number=SeqID_55285
MAVNCCMERKNSMKGEEVELQLHGESTLFFGLACGLSGQSSLRPFGSTTNPFTRNTHSKRILSSGVAFSQPKIHFQNGYFRMDLFKSARFISCSHFQFTNEGGHALLETRFEFDVNLFFLSSNTIQFKLTNNSV

SEQ ID NO: 172064 - protein, 199 aa, Glycine max
  Coding DNA Sequence Number=SeqID_55286
MITVGWIGAIILGLQLETGDEVSLEKTIIQWLAASQKKEIQAAGVSLSEPYALSEVHNSLSVLENPRRGSVREMCAQRAISSPSESFVPYRAQHAQLVRANGYFLPNLPLAMFRENSHSTWTYLSLNDFLLGTLIHVVVGCSLDFVTNMDGSDDDKYMVMVVTNSIERPHADGIVREDNVAPDHALVPSRRYIGSGIKE

SEQ ID NO: 172065 - protein, 241 aa, Glycine max
  Coding DNA Sequence Number=SeqID_55287
  Gene Ontology: Mol. function=drug transporter activity; Cellular component=membrane; Biological process=multidrug transport
  Homolog annotation: Hit_ID=Q1SB90; Match level="QueryCoverage=82%, HitCoverage=37%, E-value=4e-42, Identity=43%"; Hit description=Multi antimicrobial extrusion protein MatE
  Pfam annotation: Domain name=MatE; Domain location=1-157; Score=60.0; E_value=7.9e-15; Accession=PF01554.9; Description=MatE
MGLITYGKSAISTYFLGKLSKEALVGGSLAIGVANITGYSIISSLATSMDGISSQACGAQQWTLIGQTLQCSIMILTLTCITISILWLNIEPVLLFCGQNPTISSIATTYLGFSLPDLIFTSLIISFKIFLRTQDVTLPFMFSATLAPFLHAIINNVVIHTFGLGIQGVALVGSFTNIKFLIILLLYLWFSRNCSNSWQGVGKRVGLPRIRPSRPTFLHEPNKLVCPRPADPWVKQTCPRA

SEQ ID NO: 172066 - protein, 351 aa, Glycine max
  Coding DNA Sequence Number=SeqID_55288
  Gene Ontology: Mol. function=DNA binding; Cellular component=nucleus; Biological process=regulation of transcription, DNA-dependent
  Homolog annotation: Hit_ID=Q9LTF2; Match level="QueryCoverage=27%, HitCoverage=53%, E-value=1e-45, Identity=90%"; Hit description=40S ribosomal protein S10-3
  Pfam annotation: Domain name=S10_plectin; Domain location=199-294; Score=262.8; E_value=6.9e-76; Accession=PF03501.5; Description =PlectinS10 domain
MTTTQSVDHHHPQFNYNSNQLDHYGHQENLTAKPPMQETLFSSTCPLFMFDTSSLDQGTTTVDTTTNVRTELFQDSLGLSSTETWNLSHHQVHVLPPQLAATFTAATVIDTTNYLPPLIENVDNMVPNMEVQSCSIDEEGEMALECLRRQGLNEWVEHQQQCPNFLFWDSINVEGQLGGEELAPNTLYTSPLQRSNMIIPEKNRKEICKYLFQEGVCFAKKDFNLAKHPEIDVPNLQVIKLMQSFKSREYVRETFAWMHYYWFLTNDGIEFLRTYLNLPSEIVPATLKKQAKPAGRPFGGPPGDRPRGPPRFDGERRFGGDRDGYRGGPRGPGGDFGDKGGAPADYRPSFG

SEQ ID NO: 172067 - protein, 445 aa, Glycine max
  Coding DNA Sequence Number=SeqID_55289
  Gene Ontology: Mol. function=DNA binding; Biological process =regulation of transcription, DNA-dependent
  Homolog annotation: Hit_ID=Q9FHB2; Match level="QueryCoverage=25%, HitCoverage=41%, E-value=4e-26, Identity=48%"; Hit description =Arabidopsis thaliana genomic DNA, chromosome 5, P1 clone:MCK7
  Pfam annotation: Domain name=B3; Domain location=51-145; Score=81.4; E_value=2.8e-21; Accession=PF02362.12; Description=B3 DNA binding domain
  Subcellular localization annotation: CTP_CleavageSite=37; ConfidenceScore=5.33e-01
MLLQATPAEAQKFASSIKVATEGTSSRGQAMSSAVLQAEEVQSNLEREFPSFVKSLVRSHVASCFWMGLPVSFCKRHLPDKDTTFILEDESGKEYMTKYIACKTGLSAGWRQFSAVHKLHEGDVVVFQLVEPTKFKVYIIRANNTRELDGAFLSLDSCIKQKMGGKTCFAMLLISCIVSIKNHQGFMHSLFCFLFSGNDNADSDDVACNNSKRKHGKSVQQDVQTKKKASASRLRPKARPSVEQSENDSEEALSEVMEGFKMLEFNDVKGFENFSIIVDGVPIDAEFSTEVRNKYYRLCCSQHAFLHENLIKGMNYKLIAGIILETVNIADAIEVSVICTPRAEFSNWDKTLLAFEHLGMDVEFLRVRLRRLARIAYEKDDASETKKHLAYRNEYSRADDEIKNMEAKLEELKGACNGFGAYLESLKCRAESNHIKFQKEVVAPW

SEQ ID NO: 172068 - protein, 242 aa, Glycine max
  Coding DNA Sequence Number=SeqID_55290
  Gene Ontology: Mol. function=RNA-directed DNA polymerase activity; Cellular component=chromatin; Biological process=chromatin assembly or disassembly
MNFDNHIGEQGYNRMGHVSLRQYTQVHSFGKSIDDHQDNGVAGAQQTSYLLRFILSTLAINTFGQELGDVIPQSYPVEVFRDMGEGLCYADMAASGSGMEFGKRGFHAGIGSLYHLSKKLFKAMIVGDNGKPVAKQVLTPLLDGGSNREQFSDCYYGRIASDKPAIKTSKAQEAPQRLSGSRNGPLLNGNDLGARGSTPLFENKCPKATIDENIIEENDDEVAEGAYEFGDTPVRGPTSRST

SEQ ID NO: 172069 - protein, 388 aa, Glycine max
  Coding DNA Sequence Number=SeqID_55291
MDYAKQMKTPMHPTTVLGMDEESKQNVGYVIKANLMLCGIHHFFKDPKVVVLELICEFWRIAKVYRNKVIGGYFTGKVLGISVKLSVETIAKAISCEGRGTKFMNWGDELEDHIRHSLARALGKTSTIVLHSLKYLKPTTIRKFLYETSVNVQDKIYLDEVFLQKQKAFSQENILKMRLVDDGSFQQKFQVDDFILSELHQKLGLNIGQDDYFAKAAPAQQCLPLTLVAPKAIGAMARVSKRLAPKKQKLLSSVENLRALSETKRRTLGFARMCTKGGPSVFGDGHVHLGFCQAYGAVSRLTKDGPWILWTCNDQQARNLSLTSLACNISVVILHIWHSSWMTCIKDDLPRANLGFCEPFRGLTRELFYLGFGHCTLAYMSLVMGGMQ

SEQ ID NO: 172070 - protein, 142 aa, Glycine max
  Coding DNA Sequence Number=SeqID_55292
  Gene Ontology: Mol. function=RNA-directed DNA polymerase activity; Cellular component=chromatin; Biological process=RNA-dependent DNA replication
MVGNGQQLDCNSVCRAVSISIQATTFVVDLHVLPNFGANVVLGVQWLKSLGPVLTDYNALSMQFFYNGKLVQLQGDIDASLSVLSPPQFFHLCRKHGDSLYYHITLLSTSAPPCPDELPEAIRALLTKYKALFQAPHSLPPP

SEQ ID NO: 172071 - protein, 581 aa, Glycine max
  Coding DNA Sequence Number=SeqID_55293
  Gene Ontology: Mol. function=steroid hormone receptor activity; Cellular component=nucleus; Biological process=regulation of transcription, DNA-dependent
  Homolog annotation: Hit_ID=Q45GJ7; Match level="QueryCoverage=89%, HitCoverage=89%, E-value=8e-98, Identity=38%"; Hit description =Expressed protein
MDFPSSMEGWMKALYVVFVFFYAFFLGALKGIVVGPIAALILIIGNVGVILGLFPAHVAWTLYTLLKIHMFDAPMKAAILIALPALFGLWLGLGVAGSVLVGVGYGFFTPWVSTFEAFRQDNESKKFSHCIVDGTWGTIKGSCTVVRDFADMCYHSYPSYLKELRESPASDERQRLRLIHVPGCVIVGIMGLVVEIPLFTAIALVKSPYLLFKGWFRLLHDLISREGPFLEIVCIPIAGLTIFVWPLVVIASILLAIFSSIFVGLYASVIVYQERSFRRGIAYVIAMVAEFDEYTNDWLYLREGTFLPKPQYRKKKASQSSEFSVRGNSVRGNTSMEPPAMLMPCLAPSRSVKETIQEVKMVQIWGNMMRYCEMRGKELLDANVLTASDLYEWMKGKNNNEAAIVGVGLPCYSLLQTLVFSIKANSCGVLLLDDFEITYLNRPKDKLLDWFFNPVMVLKEQIRVIKLGEAELRYLEKVVLFGSNKQRMEAWDNGGLMIHDALRAAQIEGISRRMIGMIRGISKLPTYKRKFRQIVKALVTHSLEKDVSERALVTHHSVDVLDVSEKALVTRYLEKDPSGRS

SEQ ID NO: 172072 - protein, 250 aa, Glycine max
  Coding DNA Sequence Number=SeqID_55294
  Gene Ontology: Mol. function=RNA-directed DNA polymerase activity; Cellular component=chromatin; Biological process=chromatin assembly or disassembly
GKVGGENVFVRDEQMETGLASVARGPFIVTMVAEPLVAAYGELLSGESLDREFRGEGKGSAAEAEDRGDDRASCPPEAGQARWPLREQAGDETAEQRGRGDADGAVGEALKSCKNDGAKRDSSACNMAGHEEKKPLRDGEAFELRDTLVIEELGYFEYPAQRVVAIETGNVELEGYGGKAFEEGFNLGCEGRVDIVNLGIEGLMTLGEGSVALGEAVDSFFELVGGGLAGMVIGHGVGGRSDQFDTNLSG

SEQ ID NO: 172073 - protein, 554 aa, Glycine max
  Coding DNA Sequence Number=SeqID_55295
  Gene Ontology: Mol. function=RNA-directed DNA polymerase activity; Cellular component=chromatin; Biological process=chromatin assembly or disassembly
  Pfam annotation: Domain name=Chromo; Domain location=470-521; Score =13.9; E_value=0.022; Accession=PF00385.14; Description='chromo' (CHRromatin Organisation MOdifier
  Pfam annotation: Domain name=rve; Domain location=246-404; Score =57.6; E_value=4e-14; Accession=PF00665.16; Description=Integrase core domain
  Pfam module annotation: Pfam domain module=Chromo::rve; Domain location=470-521::246-404
MWYPTKVSSPYQTRALRGFLGLAGFYRRFIKGYATLAAPLTKLLGHDQFVWSLEAAAAFQALKDAINHSPMLALPDFTIPFVVETDASGLGMGVVLSQGGHPIVFFSKQLCLKLLSSFTYVRELAAINPAVKKWRQYLLGHHFVILTDHRSLKDMMNQVIQTPKQHRYLARLLGFDYTIQYRTGKTNVVADALSRSMELSAGSLFILSMPALLVEFHQSPAWGHMGIKKTLNHLEDNFIWSTIREDTPQPWEDLSMDFIVGLLAYPDHTCILVIIDHFSKGLHLGMLPTHHTAHVVALLFMELVGKLHGMPRSIVSDRDPLFISKFWQELFSLSGTKLRMSSAYHPQTDGQTEVANQSPPNFPQYIIGTSKIDVVDDLLSQREAVFTLLRRKLLKSQSHMKTIADTHRRDHEFKEVIERMGKVAYKLKLPEQSHIHPVFLCSILKPYVESSTPIETVELPPMAFDNQLTVTLLTIMATKSIPSASGLKQMVLVQWLGLHPDETSWEDWSVLKAAHHLEDKVWLDGLGNDTNSTKGLQERTLGSRHQIVPLGSGE

SEQ ID NO: 172074 - protein, 245 aa, Glycine max
  Coding DNA Sequence Number=SeqID_55296
  Gene Ontology: Mol. function=sequence-specific DNA binding; Cellular component=nucleus; Biological process=regulation of transcription, DNA-dependent
  Homolog annotation: Hit_ID=O04609; Match level="QueryCoverage=80%, HitCoverage=70%, E-value=9e-18, Identity=33%"; Hit description=WRKY transcription factor 22
  Pfam annotation: Domain name=WRKY; Domain location=119-181; Score =122.2; E_value=1.5e-33; Accession=PF03106.6; Description=WRKY DNA -binding domain
MDWDLQAIVGCNKAPAATVMDNPHLIFSQHFCPEEQDDLLCNFQEFSETTTVVDELEELYKPSYPRHVHDNPLPVVANSPPILDEKVKELKPSDKTASRCKKSKKRQKNKRVVTAADGVSDPWAWRKYGQKPIKGSPYPRSYYRCSSSKGCLARKHVERSHLDPGVFIVTYTAEHSDPHPTCKNSQQRKNSSTIPLPTTRTRDDQHTLIPVVAEAIEDEHEEIKELKKEEDFVEGVGFQASKLRN

SEQ ID NO: 172075 - protein, 115 aa, Glycine max
  Coding DNA Sequence Number=SeqID_55297
MAIMKAANRGHNEVVKCCSEAVWFWPTQIEGKMKVPNAAIKTVNRGHNEGVKCCKKDGEQKVQHKCQMLQLRQRVEGTTKLSNAAIKATKRAAMKVARVFSAEAEFLDWELCYQV

SEQ ID NO: 172076 - protein, 419 aa, Glycine max
  Coding DNA Sequence Number=SeqID_55298
  Gene Ontology: Mol. function=binding; Cellular component=thylakoid; Biological process=photosynthesis
  Homolog annotation: Hit_ID=Q49TU9; Match level="QueryCoverage=98%, HitCoverage=96%, E-value=4e-66, Identity=41%"; Hit description =Pollen-specific SGT1
  Pfam annotation: Domain name=CS; Domain location=163-221; Score=34.3; E_value=4.2e-07; Accession=PF04969.6; Description=CS domain
  Pfam annotation: Domain name=SGS; Domain location=338-417; Score =171.8; E_value=1.7e-48; Accession=PF05002.5; Description=SGS domain
  Pfam annotation: Domain name=TPR_1; Domain location=2-35; Score=16.6; E_value=0.055; Accession=PF00515.18; Description=Tetratricopeptide repeat
  Pfam annotation: Domain name=TPR_1; Domain location=36-69; Score =21.7; E_value=0.0026; Accession=PF00515.18; Description =Tetratricopeptide repeat
  Pfam annotation: Domain name=TPR_1; Domain location=70-103; Score =13.0; E_value=0.15; Accession=PF00515.18; Description=Tetratricopepti de repeat
  Pfam annotation: Domain name=TPR_2; Domain location=2-35; Score=18.2; E_value=0.029; Accession=PF07719.7; Description=Tetratricopeptide repeat
  Pfam annotation: Domain name=TPR_2; Domain location=36-69; Score =20.0; E_value=0.0086; Accession=PF07719.7; Description =Tetratricopeptide repeat
  Pfam annotation: Domain name=TPR_2; Domain location=70-103; Score =10.5; E_value=2; Accession=PF07719.7; Description=Tetratricopeptide repeat
  Pfam module annotation: Pfam domain module=CS::SGS::TPR_1::TPR_1::TPR_ 1::TPR_2::TPR_2::TPR_2; Domain location=163-221::338-417::2-35::36 -69::70-103::2-35::36-69::70-103
MATALEKKAKEAFFDDEFGLAVDLYSEAIRLDPNDANLFADRAQAHIKLNAFTEAVSDANKSIQLNPSLPKAYLRKATACIKLQEYHTAKVALQNGAAFAQDDSRFANLIQQCDRCIAEESSGLTSTLSSHLSNRNNGMTKEEAEGDSLLSQKNEATLNRPKYRHEYYQKPEEVVVTIFAKGISAKDVVVDFGEQIVAKQIIPNNCRVEVLSTKIEIRLAKAEAINWTSLEYGKNTLPPIINRPIGLGLSNYTTSFCGVILSRFLSIGIRTFYHVSWLQTSGTGGDNGIIVFAQDCGCGVQWDVKIQLQVMGLESHKYGILVWVQSERASYPSPKPRTKDWDKLEAQVKKEEKEEKLDGDAALNKLFRDIYQNADEDMRRAMSKSFSNGTVLSTDWKEVGSKKVEGSPPEGMELKKWEY

SEQ ID NO: 172077 - protein, 145 aa, Glycine max
  Coding DNA Sequence Number=SeqID_55299
  Homolog annotation: Hit_ID=Q1RVK8; Match level="QueryCoverage=65%, HitCoverage=18%, E-value=2e-07, Identity=32%"; Hit description =Ribonuclease H
MPCPRIARDMLVISLLLLHVTGVRSEPEESTLHGLRDCPRSKEFWLRMGFGSNTILTCQNIQAWILAVINHRPSALILSTVWCLWKWRNNSIFTTEQWGVPYVCNLTRLTTTELELYCSKLPRVTMHILAQISFCKAKCIWILIA

SEQ ID NO: 172078 - protein, 112 aa, Glycine max
  Coding DNA Sequence Number=SeqID_55300
  Gene Ontology: Mol. function=chromatin binding; Cellular component =chromatin; Biological process=chromatin assembly or disassembly
  Homolog annotation: Hit_ID=Q1SAV4; Match level="QueryCoverage=55%, HitCoverage=16%, E-value=8e-16, Identity=61%"; Hit description =Integrase, catalytic region
  Pfam annotation: Domain name=Chromo; Domain location=21-74; Score =23.8; E_value=0.00062; Accession=PF00385.14; Description='chromo' (CHRromatin Organisation MOdifier
GPSPTTDAPLPPLAVDHHPLVSPLAILDWKWDTSVTPPLRMVLVQWAGLPPEDTSWESWSELQSAYNLEDEVVFGGVGVDSIMQNKATDTNNSSTNRPKRVTHRPTYLEDFV

SEQ ID NO: 172079 - protein, 167 aa, Glycine max
  Coding DNA Sequence Number=SeqID_55301
  Gene Ontology: Mol. function=methyltransferase activity; Biological process=metabolic process
  Homolog annotation: Hit_ID=Q1SW51; Match level="QueryCoverage=96%, HitCoverage=35%, E-value=4e-32, Identity=40%"; Hit description =Generic methyltransferase
  Pfam annotation: Domain name=Methyltransf_11; Domain location=16-111; Score=13.0; E_value=0.0028; Accession=PF08241.2; Description =Methyltransferase domain
  Subcellular localization annotation: CTP_CleavageSite=44; ConfidenceScore=5.53e-01
LFQIAAAAKSVLRLGLDVGGGTGSFAAAMRLRNVTVVTTTMNVVAPNSEAVALRGLVPLHMPLQQRLPLFDGVLDLVRCGRAVNRWIPLTVMEFLLLDVDRVLRGGGYLWVDHFFSKGVDLEKVYAPLIGKLGYKKVKWATGNKTDAGGVKNGEVYLTALLQKPVSR

SEQ ID NO: 172080 - protein, 184 aa, Glycine max
  Coding DNA Sequence Number=SeqID_55302
  Gene Ontology: Mol. function=transmembrane receptor activity; Cellular component=membrane; Biological process=defense response
  Homolog annotation: Hit_ID=Q19QU4; Match level="QueryCoverage=97%, HitCoverage=85%, E-value=4e-18, Identity=26%"; Hit description=Plant cell wall protein SlTFR88
  Pfam annotation: Domain name=Hin1; Domain location=32-167; Score =37.7; E_value=4.1e-08; Accession=PF07320.4; Description=Harpin -induced protein 1 (Hin1)
MAKSIQQERRSGKCFVYLLAAFVILCALVLVFASLLRVKNPYLKLRSATSNKISYSTSPSFNATLIIFLGIKNPNFGAFSYNNNRVSVLYAGVKIADRQINGGRVRFRETKEINVTVKLMSAKAPISENLSIDISSGSLNLTSNVKFSGTVHMLKIINIRKTIEMACAMKLNLTSHTIQGIQCQ

SEQ ID NO: 172081 - protein, 289 aa, Glycine max
  Coding DNA Sequence Number=SeqID_55303
  Gene Ontology: Mol. function=cysteine-type endopeptidase activity; Cellular component=vacuole; Biological process=proteolysis
  Homolog annotation: Hit_ID=Q1KK73; Match level="QueryCoverage=76%, HitCoverage=69%, E-value=8e-80, Identity=63%"; Hit description =Cysteine protease
  Pfam annotation: Domain name=Inhibitor_I29; Domain location=44-100; Score=71.0; E_value=3.8e-18; Accession=PF08246.2; Description =Cathepsin propeptide inhibitor domain (
  Pfam annotation: Domain name=Peptidase_C1; Domain location=126-289; Score=78.7; E_value=1.8e-20; Accession=PF00112.13; Description =Papain family cysteine protease
  Pfam module annotation: Pfam domain module=Inhibitor_I29::Peptidase _C1; Domain location=44-100::126-289
MSHGGIFVINEVINEFYVAKSKTIIRDRLRMAHSGNFSRHALSFARFACRHDKRYHSVGEIRNDFQIFSDNLKLIRSTNRRSLTYTLGVNHFADWTWEEFTRHKLDAPQNCSATLKGNHRLTDVVLPDEKDWRKEALVMCSTTGALEAAYTQAFGKNISLSEQQLVDCAGAFNNFGCNGGLPSRLDTEEAYPYTGKDGVCKFTAKNIAVQVIDSINITLGAEDELKQVVAFVWPVSVAFEVVKDFRFYNNGVYTSTICGSTPMGGPGGRPGFGRGSGGYGAPTSSNFPS

SEQ ID NO: 172082 - protein, 498 aa, Glycine max
  Coding DNA Sequence Number=SeqID_55304
  Gene Ontology: Mol. function=sugar porter activity; Cellular component=integral to membrane; Biological process=carbohydrate transport
  Homolog annotation: Hit_ID=Q1T6J4; Match level="QueryCoverage=98%, HitCoverage=98%, E-value=0.0, Identity=71%"; Hit description=Sugar transporter superfamily; Major facilitator superfamily MFS_1
  Pfam annotation: Domain name=MFS_1; Domain location=22-436; Score =94.4; E_value=3.3e-25; Accession=PF07690.6; Description=Major Facilitator Superfamily
  Pfam annotation: Domain name=Sugar_tr; Domain location=25-476; Score =506.6; E_value=2.8e-149; Accession=PF00083.14; Description=Sugar (and other) transporter
  Pfam module annotation: Pfam domain module=MFS_1::Sugar_tr; Domain location=22-436::25-476
MAGAFIESKGGKAYPGGLTRRVFFTCFVAAFGGLIFGYDLGISGGVTSMDPFLKKFFPEVYEKEHDMKPSDNQYCKFDSQTLTLFTSSLYLAALVASLVASVVTRAFGRRLTMIFGGLLFLFGAGLNFFAAHVWMLIVGRLLLGFGIGCANQSVPIYMSEVAPYNYRGALNMMFQLAITIGIFAANLLNYLFAQYKGVDAWRYSLGCAAVPALMIIFGAFFLPESPSSLIERGLDEKAKTELQKIRGSKVDVDDEFKDLVAASESSKAVKHPWASLLKRHYRPQLTFAIAIPFFQQLTGMNVITFYAPVLFKTIGFGATASLMSALITGACNAVATLVSIFTVDKFGRRTLFLEGGTQMFLCQVLITSLIGIKFGVDGTPGELPKWYATIIVVGIWWLVPSEIFPLEVRSACQSINVAVNMIFTFAIAQIFTTMLCHMKFGLFIFFACFVVGMSIFIYKFLPETKGVPIEEMHVVWQNHPYWRKFVKPTDSKPPSDEV

SEQ ID NO: 172083 - protein, 454 aa, Glycine max
  Coding DNA Sequence Number=SeqID_55305
  Gene Ontology: Mol. function=GTPase activity; Cellular component =microtubule; Biological process=cell division
  Homolog annotation: Hit_ID=Q39821; Match level="QueryCoverage=97%, HitCoverage=72%, E-value=0.0, Identity=90%"; Hit description=SDL12A
  Pfam annotation: Domain name=Dynamin_M; Domain location=222-450; Score=212.1; E_value=1.2e-60; Accession=PF01031.10; Description =Dynamin central region
  Pfam annotation: Domain name=Dynamin_N; Domain location=37-213; Score= 302.6; E_value=7e-88; Accession=PF00350.13; Description=Dynamin family
  Pfam annotation: Domain name=MMR_HSR1; Domain location=35-214; Score =9.5; E_value=0.00013; Accession=PF01926.13; Description=GTPase of unknown function
  Pfam module annotation: Pfam domain module=Dynamin_M::Dynamin_N::MMR _HSR1; Domain location=222-450::37-213::35-214
MENLISLVNKIQRACTALGDHGEASALPTLWDSLPAIAVVGGQSSGKSSVLESIVGKDFLPRGSGIVTRRPLVLQLHKIDEGGREYAEFLHLPRKRFTDFAAVRKEIQDETDRETGRTRQISSVPIHLSIYSPNVVNLTLIDLPGLTKVAVEGQPDSIVQDIENMVRSYIEKPNCLILAITPANQDLATSDAIKISREVDPTGERTFGVLTKIDLMDKGTDAVEMLEGRAYRLKYPWIGVVNRSQADINKNVDMIAARRREREYFSNTPEYNHLANRMGSEHLAKMLSKHLEAVIKSKIPGIQSLISKTIAELEAELSRLGKPIAADDGGKLYSIMEICRSFDHIFKEHLDGVRPGGDKIYNVFDNQLPAALKRLQFDKQLSMENIRKLITEADGYQPHLIAPEQGYRRLIESSLTTVRGPAEAAVDAVHSLLKDLVHKAISETLVWSSLLLCL

SEQ ID NO: 172084 - protein, 383 aa, Glycine max
  Coding DNA Sequence Number=SeqID_55306
MEAFTLLKYWRGGGALGHPPSSDTPSSRTATTTTILTAVENENATESDDDDDGPFFDLEFTVPDEDAHENPNANHTQEEEDEDINIEESDGEREFKFTLSPSSNDRSDPNLSPLSPSDDLFFKGKLVHVDPSEPNSKPQFTASLLKSATKFRVFMLGLKKPKPNDKDSNNGSDSAIPEAHKDKKHFTVKFKVEEVPIVSLFSSKANKNQNQKQTSEDKPSEEKRFSKEVMHKYLKMVKPLYIRVSRRYGEKLSLNPAAKAPPPPPTAEPEGVSVGGGETNVKSSTQGQKLPAGLSVVCKHLGKSRSASSAVAAAAPPAVFVSSKRRDDSLLQQQDGIQGAILHCKRSFNASRPECESSQLPRSVSHPWDEIGINEAKDKRLSA

SEQ ID NO: 172085 - protein, 412 aa, Glycine max
  Coding DNA Sequence Number=SeqID_55307
  Gene Ontology: Mol. function=UDP-glucose 4-epimerase activity; Cellular component=soluble fraction; Biological process=galactose metabolic process
  Homolog annotation: Hit_ID=Q1SI65; Match level="QueryCoverage=99%, HitCoverage=99%, E-value=0.0, Identity=77%"; Hit description=UDP -glucose 4-epimerase
  Pfam annotation: Domain name=3Beta_HSD; Domain location=45-354; Score= -80.5; E_value=4.6e-07; Accession=PF01073.9; Description=3-beta hydroxysteroid dehydrogenaseisomerase family
  Pfam annotation: Domain name=ADH_zinc_N; Domain location=40-166; Score=-10.9; E_value=0.043; Accession=PF00107.16; Description=Zinc -binding dehydrogenase
  Pfam annotation: Domain name=Epimerase; Domain location=44-330; Score= 236.8; E_value=4.7e-68; Accession=PF01370.11; Description=NAD dependent epimerasedehydratase family
  Pfam annotation: Domain name=NAD_binding_4; Domain location=46-301; Score=-57.5; E_value=6.5e-05; Accession=PF07993.2; Description=Male sterility protein
  Pfam annotation: Domain name=Polysacc_synt_2; Domain location=44-235; Score=-180.9; E_value=0.011; Accession=PF02719.6; Description =Polysaccharide biosynthesis protein
  Pfam annotation: Domain name=RmlD_sub_bind; Domain location=43-395; Score=-177.2; E_value=0.012; Accession=PF04321.7; Description=RmlD substrate binding domain
  Pfam annotation: Domain name=adh_short; Domain location=42-235; Score= -28.9; E_value=0.00044; Accession=PF00106.15; Description=short chain dehydrogenase
  Pfam module annotation: Pfam domain module=3Beta_HSD::ADH_zinc _N::Epimerase::NAD_binding_4::Polysacc_synt_2::RmlD_sub_bind::adh _short; Domain location=45-354::40-166::44-330::46-301::44-235::43 -395::42-235
  Subcellular localization annotation: CTP_CleavageSite=45; ConfidenceScore=5.49e-01
MASRVSIGNLTSSAPYINSPHFRSQLKLSSNSSLHKPLMRDKTVLVTGGAGYIGTHTVLQLLLGGCRTVVVDNLDNSSEVSIHRVRELAGEFGNNLSFHKVDLRDRDALEQIFVSTQFDAVIHFAGLKAVGESVQKPLLYYNNNLTGTITLLEVMAAHGCKKNILFKLIEGSSHLTWGEMSEKVRKLVFSSSATVYGWPKEVPCTEEFPLSAMNPYGRTKLIIEEICRDVHRAEPDWKIILLRYFNPVGAHPSGCIGEDPRGIPNNLMPFVQQVAVGRRPALTVFGNDYNTTDGTGVRDYIHVVDLADGHIAALLKLDDPNIGCEVYNLGTGKGTSVLEMVRAFEMASGKKIPLVMAGRRPGDAEIVYASTKKAERELKWKAKYGIDEMCRDQWNWASKNPYGYGDQEDSTV

SEQ ID NO: 172086 - protein, 212 aa, Glycine max
  Coding DNA Sequence Number=SeqID_55308
  Gene Ontology: Mol. function=transmembrane receptor activity; Cellular component=membrane; Biological process=defense response
  Pfam annotation: Domain name=Hin1; Domain location=56-197; Score =14.3; E_value=9.5e-05; Accession=PF07320.4; Description=Harpin -induced protein 1 (Hin1)
MAKSLSSPVANKSSMTTEEVIAMFPSRKEEKESSKCLVYALVVFVAILFIWLVFASIVLRVGDPQIQLKSARLMHNTYNNHSVSSNSSFKVTLLARVSLTNPNLFCRFYYGNTRVSVLYGASSVGAWELEGARLEGRETKEIDFVVHMSFSTKLVVVKRNLTNDTTHSDSAGMLKLRSYAKLSGTVHVLNMGKWGRCEGFDADDASRAFARG

SEQ ID NO: 172087 - protein, 61 aa, Glycine max
  Coding DNA Sequence Number=SeqID_55309
  Gene Ontology: Mol. function=endoribonuclease activity
  Homolog annotation: Hit_ID=Q40382; Match level="QueryCoverage=51%, HitCoverage=13%, E-value=4e-13, Identity=90%"; Hit description=RNase NE precursor
MDNVLNVNYIKYVLGLEEFDFFYFVQQWPGAYCDTKQSCCYPKTGKPAIYHILVLEALMYE

SEQ ID NO: 172088 - protein, 75 aa, Glycine max
  Coding DNA Sequence Number=SeqID_55310
  Gene Ontology: Mol. function=triacylglycerol lipase activity; Biological process=lipid metabolic process
  Homolog annotation: Hit_ID=Q6KA57; Match level="QueryCoverage=98%, HitCoverage=21%, E-value=5e-18, Identity=60%"; Hit description =Lipase class 3-like
MEEIGAGNIEKLATQTSLGCLLMGASGKESDEPLHLIPSASVTVNYTPARDFKEAHGIPQWWKPDLRLESKLYQY

SEQ ID NO: 172089 - protein, 131 aa, Glycine max
  Coding DNA Sequence Number=SeqID_55311
  Gene Ontology: Mol. function=triacylglycerol lipase activity; Biological process=lipid metabolic process
  Homolog annotation: Hit_ID=Q06H29; Match level="QueryCoverage=86%, HitCoverage=94%, E-value=8e-34, Identity=65%"; Hit description =Triacylglycerol lipase
MSSFNYLSSLEILHTDKDSTIVFRDNAYHRKSVAASLVQCVYVLEKDRQEQREGSDALALPWWAFFHIQLLRTLVVDVDASIFAAIHEFKPPSSMCNDTLRRGPRYVIAFRGTITKAGSVSCDIELDINFV

SEQ ID NO: 172090 - protein, 63 aa, Glycine max
  Coding DNA Sequence Number=SeqID_55312
MVGDSTLGKEVRNGEHLTFINASIQKLPHSMFFSPRMHRLVDTAVRNNSFDEMFLLAGGIGTL

SEQ ID NO: 172091 - protein, 768 aa, Glycine max
  Coding DNA Sequence Number=SeqID_55313
  Gene Ontology: Mol. function=protein binding; Cellular component =membrane; Biological process=defense response
  Homolog annotation: Hit_ID=Q1SW19; Match level="QueryCoverage=99%, HitCoverage=83%, E-value=1e-161, Identity=43%"; Hit description =Disease resistance protein
  Pfam annotation: Domain name=LRR_1; Domain location=582-603; Score =6.0; E_value=21; Accession=PF00560.23; Description=Leucine Rich Repeat
  Pfam annotation: Domain name=LRR_1; Domain location=605-626; Score =7.5; E_value=11; Accession=PF00560.23; Description=Leucine Rich Repeat
  Pfam annotation: Domain name=LRR_1; Domain location=628-649; Score =13.1; E_value=1; Accession=PF00560.23; Description=Leucine Rich Repeat
  Pfam annotation: Domain name=NACHT; Domain location=194-347; Score= -25.3; E_value=0.0054; Accession=PF05729.3; Description=NACHT domain
  Pfam annotation: Domain name=NB-ARC; Domain location=158-467; Score =270.8; E_value=2.7e-78; Accession=PF00931.13; Description=NB-ARC domain
  Pfam module annotation: Pfam domain module=LRR_1::LRR_1::LRR _1::NACHT::NB-ARC; Domain location=582-603::605-626::628-649::194 -347::158-467
MAETAVSLAGQHALPKILEAVKMLRGLPKEVIDITDELESFQDFINDADKVAEAEQDDGKRHKIKERVMRLREAAFRMEDIIDEYNISCKDKQPDDPRCAALLCEAVAFIKTQILRLQSAYKIQDVKLLVRAERDGFQRHFPLEKRSTSSRGNQDATWQKLRMDPLFIEEDEVVGLDNDRATLKYWLTNGREQRTVISVVGIAGVGKTTLAKQVYDQVRNNFECHALITVSQSFSAVGLLTHMLNELCKEKNEDPPKDVSTIESLTKEVRNRLRNKRYVVLFDDVWNETFWDHIESAVIDNKNGSRILITTRDEKVAEYCRKSSFVEVHNLEKPLTEEESLKLFCKKAFQYSSDGDCPEELKDISLEIVRKCKDLPLAIVAIGGLLSQKDESAPEWGQFSRDLSLDLERNSELNSITKILGLSYDDLPINLRSCLLYFGMYPEDYEVKSDRLIRQWITEGFVKHETGKSLEEVGQPYLSGLVHRSLVQVSSLRIDGKVKRCRVHDLIHDMILRKVKDTGFCQYIDGRDQSVSSNIVRRLTIATHDFSGSTRSSPIRSILIMTGKDENLSQDLVNKFPTNYMLLKVLDFEGSAFSYVPENLGNLCHLKYLSFRYTWIASLPKSIGKLLNLETLDIRGTGVSEMPEEISKLKKLRHLLAYSRCSIQWKDIGGMTSLQEIPPVIIDDDGVVIREVGKLKQLRELSVNDFEGKHKETLCSLINEMPLLEKLLIDAADWSEEACPIWEVNKVSKLDFTVPKSCATAFARLQVD

SEQ ID NO: 172092 - protein, 54 aa, Glycine max
  Coding DNA Sequence Number=SeqID_55314
MNFREARREDSLLTPTQYEEVENSVPTKTDNFLQRENSRFPQVLSFTAREMVDA

SEQ ID NO: 172093 - protein, 555 aa, Glycine max
  Coding DNA Sequence Number=SeqID_55315
  Homolog annotation: Hit_ID=Q8LR16; Match level="QueryCoverage=71%, HitCoverage=61%, E-value=4e-93, Identity=46%"; Hit description =Membrane protein CH1-like
  Pfam annotation: Domain name=Sad1_UNC; Domain location=179-303; Score= 185.4; E_value=1.4e-52; Accession=PF07738.3; Description=Sad1  UNC -like C-terminal
  Subcellular localization annotation: CTP_CleavageSite=63; ConfidenceScore=5.51e-01
MKLKHEESSSPSSSCSSSSSPIKFLMSRHQCNTSIFGLSFSFIFSLWCLLLFYIKLRLVHGTGAMLEFNESGSSNNSLGQKLSKPSNSIPETTSLEQMFWHVLGNGSNLVCKPQPPQEVNKLKQIPDEKLHHHNYDESRAQEKTKVMDSALVNITHRLESDGSVYNYASESKGAKVVAHNKEAKGAKNILGKDHDKYLRNPCSVEGKFVVIELSEETLVDSVKIANFEHYSSNFKEFDLSGSLSYPTEEWSMLGNFIAANVKHAQSFKLPEPKWARYLKLSLIRHYGSEFYCTLSLVEVYGINAIERMLKDLIVASVASIPDKLPVHNITDHSSLKSEDGQIDRNGKKVDTKNDTVAAEISSNDTAREFDAEAVKTTMTANLILDPVLELRQQLNGRVAGDTVLKILMQKVKSVEVNLSVLEDYIKELNRRQGVKLLDLDKEFSRLSECLGQSKSEIKDLWQWNTNMEKGISEAESWKDAVSSQLNEIARENSMLRSDVRKVASNQANMESKELAVLATSLVFVCLAVLKIVSVHMLTFSASYNADKLGHSIVNV

SEQ ID NO: 172094 - protein, 137 aa, Glycine max
  Coding DNA Sequence Number=SeqID_55316
  Gene Ontology: Mol. function=hydrolase activity, acting on ester bonds; Biological process=lipid metabolic process
  Homolog annotation: Hit_ID=UPI0000162A18; Match level="QueryCoverage =69%, HitCoverage=24%, E-value=2e-15, Identity=54%"; Hit description =carboxylic ester hydrolase/ hydrolase, acting on ester bonds
  Subcellular localization annotation: CTP_CleavageSite=33; ConfidenceScore=5.20e-01
MGRRRFLAKIGTGFLLAFGSRALLQFQDPPPPSTAPFSSHVPLAPALFVIGDSSVDCGTNNFLGTFARAPITFLTEKISTPTNPPEDSPTEGSPSIILRLGLPFVPSYLVQTGVVEDMIKGVNYASAGAGIILSSGS

SEQ ID NO: 172095 - protein, 646 aa, Glycine max
  Coding DNA Sequence Number=SeqID_55317
MATKHSLMSLFHRTSSQGEHNPLNMSDEQILDQIYSTHVHSHTKFDVDSLFILVENTLRRSTLIVDNVVQGSKASLEQVEDKIPQANFNSPLYTLKQIYSEMSCKPPGEEIAHITTMAILVKLSNYEWDAKAVLTLAAFAMEYGEFWLLAQHQPTDPIAKSVAVLKGVPVLTRPAAVQKHRQAITELNNLVKTTLLVIELIFELEKLTTFDTKDVPALLPAIEQIPVDVYWAIITIVAIVTQIDYLTTESGNKQDLSHYGQKINIILSKLRKQIMLCRQQIEEAEYHHRLRKFFQTPTEIMEVFKFLVYSKDAPQLLFDGAAKTTVEITELKKKHVYLLISTLDITEEEISVLRPVYDSIKANDQYKIVWIPIVEEWTEKLHKKFEFLKSKMPWYVVQHSGPIAGYKYIKEEWHFKKKPMVVVLNPQGKVQHANAFHLIHVYGMKAFPFTIADQERIDREIHWIGSVVGDSHPHISTWIREQKYILIYGGSDKEWIHQFTKHATAFANDAALKDAKIHIELFCVEKEDKSFLRRFWSGIESLFVTKAHNTVDAVTQEVQKMLSYKNETGWAVLCKGSSVVMSGHGTTILKTVAEFEKWKEFVVKKGFEPSFKEHHERIRRTHHRCIHLEIPNAAGKLPETIRCSEC

SEQ ID NO: 172096 - protein, 76 aa, Glycine max
  Coding DNA Sequence Number=SeqID_55318
MHGYIANTNSETTCYSVSGSDVFATCCTQGLLVSNIDNLHGNITSKKTWVLCEGIKPISNSYKFNQCYWNVGIPVP

SEQ ID NO: 172097 - protein, 102 aa, Glycine max
  Coding DNA Sequence Number=SeqID_55319
  Homolog annotation: Hit_ID=Q1SXJ8; Match level="QueryCoverage=94%, HitCoverage=77%, E-value=1e-17, Identity=52%"; Hit description=LGC1, related
MVAIVTLKALTAIFLVIAIRVDGQCTLSNLEVHQYDTGRPYQGTSLFAVTIINRCTPLCDQSNVKLNCTGFKTVKPIDPSILNVSGDVCIVKNGQPITIDDP

SEQ ID NO: 172098 - protein, 207 aa, Glycine max
  Coding DNA Sequence Number=SeqID_55320
MAISCSSYITGEEISVFETVYDSIKTSEQYKIVWIPIVEEWTVEYDNKFEDFKCKMPWFAVQHSRTIASLYMVVVLSPQGKVQHSNAFHLIQAHGKRAFPFTFVKQEQINNEIYWVGSEIGNIYPIINTWFTKNVSILASDAAITEANISIEWLCVEKEDKSVMRRFWGGIESLFVTKVHKAVDAVTQEVQKMLSFKNESGWDGSPY

SEQ ID NO: 172099 - protein, 114 aa, Glycine max
  Coding DNA Sequence Number=SeqID_55321
MSMSTKSLLQNAENEQKPLTMHGSHASLEHIDDKIPQLDSPLCLLKQISFEMSCKSPRDEIGHKTTLAILNKLSNYEWNAKAVLTMAAFALEYSEFWMHASSVPTILLQNLWLY

SEQ ID NO: 172100 - protein, 80 aa, Glycine max
  Coding DNA Sequence Number=SeqID_55322
MDAGAAKELMAYLVKLQSSLSEVNQRNGCTGVLENNMIRLESNRFRKVMVSSSSCTNGLLWLTRYISATTAELYDFDDEN

SEQ ID NO: 172101 - protein, 522 aa, Glycine max
  Coding DNA Sequence Number=SeqID_55323
  Gene Ontology: Mol. function=inorganic phosphate transporter activity; Cellular component=integral to membrane; Biological process=phosphate transport
  Homolog annotation: Hit_ID=Q1JUJ0; Match level="QueryCoverage=94%, HitCoverage=96%, E-value=0.0, Identity=79%"; Hit description =Putative phosphate transporter
  Pfam annotation: Domain name=MFS_1; Domain location=28-462; Score =71.7; E_value=2.3e-18; Accession=PF07690.6; Description=Major Facilitator Superfamily
  Pfam annotation: Domain name=Sugar_tr; Domain location=23-504; Score =105.9; E_value=1.2e-28; Accession=PF00083.14; Description=Sugar (and other) transporter
  Pfam module annotation: Pfam domain module=MFS_1::Sugar_tr; Domain location=28-462::23-504
MARDQLQVLNALDVAKTQWYHFTAIVIAGMGFFTDAYDLFCISLVTKLLGRIYYFEGHDKPGSLPSNVSAAINGVAFCGTLAGQLFFGWLGDKMGRKRVYGMTLMLMVICSIASGLSFGKDPKAVMATLCFFRFWLGFGIGGDYPLSATIMSEYANRKTRGAFIAAVFAMQGFGILAGGTVAIVVSSAFKALYPAPAFQVNPVLSTVPQADYVWRIILMFGALPALLTYYWRMKMPETARYTALVAKNAKQAAADMSKVLQVEIEAEQEKVEQLDTRRGNEFGLFTKQFLRRHGLHLVGTATTWFLLDIAYYSQNLFQKDIFSTIGWIPEAKTMNAVEEVFKIARAQTLIALCSTVPGYWFTVALIDKMGRFTIQLMGFFFMTVFMFALAIPYHHWTMKGNQIGFVVLYSLTFFFANFGPNATTFVVPAEIFPARLRSTCHGISAAAGKAGAMVGAFGYLYAQNAIGLRNTLIVLGVINFLGMLFTFLVPESKGKSLEEMSGEAEEETTAATRESAMEAGLE

SEQ ID NO: 172102 - protein, 397 aa, Glycine max
  Coding DNA Sequence Number=SeqID_55324
  Gene Ontology: Mol. function=hydrolase activity; Cellular component =nucleus; Biological process=nurse cell to oocyte transport (sensu Insecta)
  Homolog annotation: Hit_ID=Q1T5K1; Match level="QueryCoverage=90%, HitCoverage=94%, E-value=1e-137, Identity=68%"; Hit description =Serine/threonine-specific protein phosphatase and bis(5-nucleosyl)- tetraphosphatase
  Pfam annotation: Domain name=Metallophos; Domain location=116-304; Score=129.7; E_value=7.9e-36; Accession=PF00149.18; Description =Calcineurin-like phosphoesterase
MERGVLDSIINRLLEVRGRPGKQVQLSEAEIKQLCLVSRDIFLRQPNLLELEAPIKICVWVDYNTNKNLSRNLIIFMGTSGSKSFVDGFVQYGNETIFSMLFCLCNMKKQSGVPRDVHGQYSDLLRLFEYGGLPPRSNYLFLGDYVDRGKQSLETICLLLAYKIKYPNNFFLLRGNHECASINRIYGFYDECKRRYNVRLWKVFTECFNCLPVAALIDEKILCMHGGLSPELHNLNQIKSLPRPIEVPETGLLCDLLWSDPSSDIRGWGENDRGVSYTFGADRVTEFLQKHDLDLICRAHQVMEDGYEFFANRQLVTIFSAPNYCGEFDNAGAMMTVDETLVCSFQILKPVENKKPNKFAFGSTTTVKHSTPTKTKVLAVEIAFPLTWIRLHPSNPP

SEQ ID NO: 172103 - protein, 536 aa, Glycine max
  Coding DNA Sequence Number=SeqID_55325
  Gene Ontology: Mol. function=inorganic phosphate transporter activity; Cellular component=integral to membrane; Biological process=phosphate transport
  Homolog annotation: Hit_ID=Q9AVQ9; Match level="QueryCoverage=99%, HitCoverage=99%, E-value=0.0, Identity=85%"; Hit description =Phosphate transporter
  Pfam annotation: Domain name=MFS_1; Domain location=28-464; Score =81.0; E_value=3.6e-21; Accession=PF07690.6; Description=Major Facilitator Superfamily
  Pfam annotation: Domain name=Sugar_tr; Domain location=23-517; Score =97.4; E_value=4.3e-26; Accession=PF00083.14; Description=Sugar (and other) transporter
  Pfam module annotation: Pfam domain module=MFS_1::Sugar_tr; Domain location=28-464::23-517
MAGGQLGVLNALDVAKTQWYHFTAIVIAGMGFFTDAYDLFCISLVTKLLGRLYYTDITNPKPGVLPPNVQAAVTGVALCGTLAGQLFFGWLGDKLGRKRVYGLTLMLMVVCSVASGLSFGDTPKGVMATLCFFRFWLGFGIGGDYPLSATIMSEYANKKTRGAFIAAVFAMQGFGILAGGIVALIVSSAYDHKYDLPSYKDNPAGSKVDSLDYVWRIILMFGAVPAGLTYYWRMKMPETARYTALVAKNAKQAASDMSKVLQVEVEAEEDKLQHMVESEHQKYGLFSKEFAKRHGLHLVGTTVTWFLLDIAFYSQNLFQKDIFSAIGWIPPAQDMNAIHEVYRIARAQTLIALCSTVPGYWFTVAFIDIMGRFAIQLMGFFFMTVFMFALAIPYNHWKNHNNIGFVVMYSFTFFFSNFGPNATTFVVPAEIFPARLRSTCHGISAAAGKAGAIVGAFGFLYAAQSTNPDKVDHGYPTGIGVKNSLIVLGVINFFGMVFTLLVPESKGKSLEELSGENEDDGAEAIEMAGSARTVPV

SEQ ID NO: 172104 - protein, 168 aa, Glycine max
  Coding DNA Sequence Number=SeqID_55326
  Gene Ontology: Mol. function=protein binding; Biological process =defense response
  Homolog annotation: Hit_ID=Q1SW22; Match level="QueryCoverage=84%, HitCoverage=16%, E-value=1e-13, Identity=38%"; Hit description =Disease resistance protein; AAA ATPase
MAETAVSLASEHALPKIMEGIKMVRDLPKEVRDITNVIDEYNLSCEDKQPGDPRCAALLCEVVAFIKTQILLLQNAYKIQDVKSLVCVERDGFQTHFPLEPRLTSSRGNQNVTWQKLRMDPLFIEEDNVVGLDGLRGTLKNWLTKGREKRTVISVVGIPGVGKTILPS

SEQ ID NO: 172105 - protein, 329 aa, Glycine max
  Coding DNA Sequence Number=SeqID_55327
  Gene Ontology: Mol. function=oxidoreductase activity; Cellular component=membrane; Biological process=electron transport
  Homolog annotation: Hit_ID=O48921; Match level="QueryCoverage=73%, HitCoverage=45%, E-value=1e-131, Identity=92%"; Hit description =Cytochrome P450 97B2
  Pfam annotation: Domain name=p450; Domain location=2-316; Score= -135.4; E_value=8.3e-05; Accession=PF00067.12; Description=Cytochrome P450
MELIIPILMDYIIAPAFHNSYLEAMVKIFTTCSERTILKFNKLLEGEGYDGPDSIELDLEAEFSSLALDIIGLGVFNYDFGSVTKESPVIKAVYGTLFEAEHRSTFYIPYWKIPLARWIVPRQRKFQDDLKVINTCLDGLIRNAKESRQETDVEKLQQRDYLNLKLRDDLMTMLIAGHETTAAVLTWAVFLLAQNPSKMKKAQAEVDLVLGTGRPTFESLKELQYIRLIVVEALRLYPQPPLLIRRSLKSDVLPDSGIALLPNVLHASHKSTIPQHLFPVALETSSWIETEFKARWTDTMFPRQKLPCKKGLATCFRATVELNMNKHQL

SEQ ID NO: 172106 - protein, 473 aa, Glycine max
  Coding DNA Sequence Number=SeqID_55328
  Gene Ontology: Mol. function=transcription factor activity; Cellular component=nucleus; Biological process=regulation of transcription
  Homolog annotation: Hit_ID=Q2QXZ6; Match level="QueryCoverage=91%, HitCoverage=98%, E-value=2e-74, Identity=32%"; Hit description=GRAS family transcription factor containing protein
  Pfam annotation: Domain name=GRAS; Domain location=23-379; Score =337.4; E_value=2.5e-98; Accession=PF03514.5; Description=GRAS family transcription factor
  Subcellular localization annotation: CTP_CleavageSite=41; ConfidenceScore=5.28e-01
MESMFQEEGSSSVTSSSSLQFFSMMSLSLSPSLGSSPYQMKCEERGLVLIHLLLAGANFVATGDLQNANLTLEQISQHASLDGDTMQRIASYFSEALADRILRTWPGIHRALNSNRIPMVSDEILVQKLFFELLPFLKFSYILTNQAIVEAMEGEKMVHVIDLNAAGPAQWIALLQVLSARSEGPPHLKITGVHHQKEVLDQMAHKLTEEAEKLDIPFQFNPVLSKLENLDFEKLGVKTGEALAISSIMQLHSLLALDDDASRRKLPLLSKNSNAIHLQKGLLTNQNTLGDLLDGYSPSPDSASASASSSPASSSASMNSESFLNALWGLSPKVMVVTEQDFNHNCLTMMERLAEALFSYAAYFDCLESTVSRASLDRIKLEKMLFGEEIKNIIACEGCERKKRHERMDRWIQRLDFSGFANVPISYYGMLQGRRFLQTYGCEGYKMKEECGRVMMCWQERPLFFITAWTPRK

SEQ ID NO: 172107 - protein, 562 aa, Glycine max
  Coding DNA Sequence Number=SeqID_55329
  Gene Ontology: Mol. function=transferase activity; Cellular component= integral to membrane; Biological process=glycolysis
  Homolog annotation: Hit_ID=Q56XE8; Match level="QueryCoverage=90%, HitCoverage=87%, E-value=1e-137, Identity=53%"; Hit description =Hexokinase-4
  Pfam annotation: Domain name=Hexokinase_1; Domain location=38-305; Score=159.6; E_value=7.8e-45; Accession=PF00349.11; Description =Hexokinase
  Pfam annotation: Domain name=Hexokinase_2; Domain location=307-562; Score=235.6; E_value=1e-67; Accession=PF03727.6; Description =Hexokinase
  Pfam module annotation: Pfam domain module=Hexokinase_1::Hexokinase _2; Domain location=38-305::307-562
  Subcellular localization annotation: CTP_CleavageSite=29; ConfidenceScore=5.19e-01
MGRVVVGVAVTVAVATCALAAVVVGRRVRSRRKWKKVANVVRELEEGCDTRVGRLRQVVDAMAVEMHAGLASEGGSKLKMLLTFVDNLPNGTERGTYYALHLGGTNFRVLRVQLNGQPSSDFEHEVERQPIPQHVMTSTSEDLFDFIASSLKEFIAKEGDGSNISQDRRELGFTFSFPVKQMSVSSGILIKWTKGFSIVDMVSEQPFNCSDQISFSKLLFVFSPSKQLPPRNRNEESIQVVLGPSVAVCKHNSRVLLRTKSVCCQVGRDVAACLQEALTRKGLDMRVAALVNDTVGTLAVGHYHDPDTVAAIIIGTGTNACYWERVDAIIKCQGLLMTSGRMVVNMEWGNFWSSHLPRTSYDIDLDAESPNPNDQGFEKMISGMYLGDIVRRVILKMSLESDMFGPISPKLSMPFIMRTPLMSAMHEDNSPDLREVARILNDIFEIPDIPLKARKFVVKVCDVVTRRAARLAAAGIVGILKKIGRDGSGGITGGRSRSDMKMRRTVVAIEGGLYSKYALFREYLREALNEILGEDIAKHVILKVTEDGSGIGAALLAASYSS

SEQ ID NO: 172108 - protein, 50 aa, Glycine max
  Coding DNA Sequence Number=SeqID_55330
  Subcellular localization annotation: CTP_CleavageSite=28; ConfidenceScore=5.10e-01
MGGRAFESAPPIMNLSPPQGSRMDKNVLSSSSSNPTHVNPPPNNSSNILY

SEQ ID NO: 172109 - protein, 415 aa, Glycine max
  Coding DNA Sequence Number=SeqID_55331
  Homolog annotation: Hit_ID=Q2R2E7; Match level="QueryCoverage=82%, HitCoverage=83%, E-value=4e-77, Identity=48%"; Hit description=THUMP domain containing protein, expressed
  Pfam annotation: Domain name=THUMP; Domain location=321-407; Score =28.0; E_value=3.2e-05; Accession=PF02926.7; Description=THUMP domain
  Subcellular localization annotation: CTP_CleavageSite=49; ConfidenceScore=5.22e-01
MAPDAAAANGKKRRRYLPHNVSLLLSFVAFVCTSKFLLFILLPRTEVVVFMNFFQKAVKKKGSYPLRPGVQGFFITCDGGREHQASREALNILDSFYEELVDGEHSSVKELPSKPLNKKITFADSDSSSSDDDDDDDEEEEVQEGDEEKGDKKPKLDTSNDDNTSHDDGVPEKSDPHKVDEPHTQEVDETCDNKGANDNLKTTKGTADGLPAVKQCCKTNVPACNFSDKVEQKSIDKLIEEEFKELGDKNKFFSEFPTYAHAHTCATNAERCFVKLDSGCNGVVFVQMRKKDGDRSPKDIVHRIVTSAASTGKHMSRFILRILPIEIACYASKEEISRAIKPLVEQYFPVETQNPHKFAVLYEARANTGVDRMEIIDAVAKSVPGPHKVDLKNPDKTIVVEIARVRKPCCVWNLS

SEQ ID NO: 172110 - protein, 806 aa, Glycine max
  Coding DNA Sequence Number=SeqID_55332
  Gene Ontology: Mol. function=solute:hydrogen antiporter activity; Cellular component=integral to membrane; Biological process =regulation of pH
  Homolog annotation: Hit_ID=Q1SKA0; Match level="QueryCoverage=99%, HitCoverage=100%, E-value=0.0, Identity=75%"; Hit description=Na+/H+ antiporter-like protein
  Pfam annotation: Domain name=MFS_1; Domain location=35-431; Score= -52.4; E_value=0.079; Accession=PF07690.6; Description=Major Facilitator Superfamily
  Pfam annotation: Domain name=Na_H_Exchanger; Domain location=40-427; Score=295.1; E_value=1.3e-85; Accession=PF00999.11; Description =Sodiumhydrogen exchanger family
  Pfam module annotation: Pfam domain module=MFS_1::Na_H_Exchanger; Domain location=35-431::40-427
MASNATSKNACPPPMKATSNGAFQGDDPLDFALPLAILQICLVLVVSRGLAYLLKPLRQPRVIAEIIGGIILGPSALGRNKSYMQNVFPPRSLTVLDTLANIGLIFFLFLAGLELDLKSLRQSGNRVLAIAMAGISLPFVIGIGSSFVLKQTIAKGADSAAFLVFMGVALSITAFPVLARILAELKLLTTNVGRTAMSAAAINDIAAWILLALAVALSGHDRSPLVSLWVFLAGCGFVICAILIVPPIFKWMSQRCHEGEPVEEVYICATLAAVLAAGFVTDAIGIHAMFGAFVVGILVPSDGPFASALVEKVEDLVSGLFLPLYFVSSGLKTNVATIKGAQSWGLLVFVIFTASFGKILGTLVVSLFCKVPFNEALVLGFLMNCKGLVELIVLNIGKDRKVLNDQTFAIMVLMAVFTTFITTPLVTAVYKPARKGKIVDYKYRTIGRKNANSQLRILTCFHGARNIPSMINLIEASRGIRKGDALCVYAMHLKEFSERSSTILMVHKARRNGLPFWNKGHHADSNHVIVAFEAYRQLSQVSIRPMIAISSMNNIHEDICATAERKGAAVIILPFHKHQRLDGSLNITRNDFRWVNKRVLEHAPCSVGIFVDRGLGGTSHVSASNVSYRVTVLFFGGGDDREALAYGARMAEHPGIRLLVIRFVGEPMNEGEIVRVDVGDSTGTKLISQDEEFLDEFKAKIANDDSIIYEEKVVKDGAETVAIICELNSCNLFLVGSRPASEVASAMKRSECPELGPVGGLLASQDYPTTASVLVMQQYQNGAPINFTISDSEMEEHVPDRDSESA

SEQ ID NO: 172111 - protein, 514 aa, Glycine max
  Coding DNA Sequence Number=SeqID_55333
  Gene Ontology: Mol. function=malate transporter activity; Biological process=response to aluminum ion
  Homolog annotation: Hit_ID=Q5FAM2; Match level="QueryCoverage=84%, HitCoverage=78%, E-value=8e-73, Identity=37%"; Hit description =Putative expressed protein
  Pfam annotation: Domain name=UPF0005; Domain location=36-503; Score =461.1; E_value=1.4e-135; Accession=PF01027.11; Description =Uncharacterised protein family UPF0005
MESIEISIPTKPELHESGTKSGANKAWLRDQIQSVWDFCKEDTGREIFALKAGLAVLLVSLLILFEALCQVFGPNIVWAILTAVLVFEDTVGATFNRGFNRALGTLVAGILAIVVAETALSCGHVAEPIIIGLSIFMIAVITSYMKTWPPLVQYEYGFRVALLTYCLIIVSDYRMGNPIRTMFDRLYSIAIGGIISMLVNVSIFPLWAGDQLHKELVKNFHSVADSLEECVKKYLEDVPEKSKVTMASIDAFPDEPAYKRCQSSLNSGSKLETLAKSAKWEPPHGRFMHISYPWAQYVNVGAVLRYCAYEVMALHSIVHAEIQVPYKLRVVFQTEIQEASNQAAEIVRILGRDISRMEWSLKNSHINRLHSSIKRLQRSMYFQYSYLLTSTFEPPILDNSSKSFANNISHIFYHLPYQREMAEQVECYHEITRKQLKRLYSWPPREVDAFEEDSEKNIKLLAGERKAKALESTAILSLTNFAFSLVEFVARVDHLIEAVDKLSKMAKFKPNDGL

SEQ ID NO: 172112 - protein, 435 aa, Glycine max
  Coding DNA Sequence Number=SeqID_55334
  Gene Ontology: Mol. function=protein binding; Cellular component =membrane
  Homolog annotation: Hit_ID=Q00ZR8; Match level="QueryCoverage=49%, HitCoverage=50%, E-value=8e-49, Identity=52%"; Hit description=[S] KOG2318 Uncharacterized conserved protein
  Pfam annotation: Domain name=DUF81; Domain location=210-431; Score= -71.6; E_value=0.068; Accession=PF01925.9; Description=Domain of unknown function DUF81
  Pfam annotation: Domain name=UPF0016; Domain location=223-289; Score =63.9; E_value=5.4e-16; Accession=PF01169.9; Description =Uncharacterized protein family UPF0016
  Pfam annotation: Domain name=UPF0016; Domain location=351-426; Score =105.3; E_value=1.8e-28; Accession=PF01169.9; Description =Uncharacterized protein family UPF0016
  Pfam module annotation: Pfam domain module=DUF81::UPF0016::UPF0016; Domain location=210-431::223-289::351-426
MNKTRDISVIGGTGDFFMARGVATLWTDAFEGEVYFRLRVDINLYECWNPRRPPSRQLVSLDFFVSDIKYVNGGAGLIQGSSRAKEVEMHSHSHPHALPRPHSLLPSSFLLLLPPSSLRISNTKRLQSSTFALSQNETKFPTQPYKNSNNSSQSLAHISNCKFPLARPLVSSSHPASTNSSTKLLNSMLLFAFLTLQPSYPALAASSDFSTIFGDIGDLSTGFASAFLLIFFSELGDKTFFIAALLAARNSAGVVFIGTFGALAAMTLISVVLGRTFHYVDEILPFRFGETDLPIDDIAAVCLLVYFGVSTLLDASSSDGQKSDEEQKEAELAVSEFSGNGAGILSAASTVASTFLLVFVAEWGDKSFFSTIALAAASSPLGVIAGALAGHGVATLLAVLGGSLLGTYLSEKVIAYIGGVLFLVFAAITLFEIVQ

SEQ ID NO: 172113 - protein, 670 aa, Glycine max
  Coding DNA Sequence Number=SeqID_55335
  Gene Ontology: Mol. function=protein serine/threonine kinase activity; Cellular component=membrane; Biological process=regulation of transcription, DNA-dependent
  Homolog annotation: Hit_ID=Q9AXB2; Match level="QueryCoverage=80%, HitCoverage=81%, E-value=1e-132, Identity=46%"; Hit description =Disease resistance protein-like
MDVRFQNLSFTANCSANAFKILGNSMQVEVRGADCSTNNILQLDSHGSSISKGMKRKWDLIDGCMGLSIGSSLSLGLSTSSSDSKESSATACTALSSAKEIDEESSMPMDIELDFTLHLGCEKVKSPKKLASSNLKIFELQPKVDLELSLSTRPSESDITSVCLSPSQAPSFRLNMETPLVFSRTPNADEGSTSCRWKPGLVSLNASASVMLNQAEKKFDHNPIVLDLSSTRPESSVTSTSRLTQQKQPLYCNSNSKTCQVEGCGKGARGASGRCISHGGGRRCQKPGCNKGAEGRTVYCKSHGEGRGCEYLSCTNSVEGHTNFCIAHGGDQRCSHEGCFRAARGKSGSCIRHGGGKRCEIENCTKNSEGLPGLCISRGGGCRCQASGCTEGAQGSTMFCKAHGGGKRCTAPGCTKGAEGTTPLCKGHGGGKCCADHGGGICTKSVHGGTNFCVAHGGGMRCSVPDCMKSARQQSDYCICHGGGKRCKFEGCGKSAPGGTDFCNAHGGRKRCSWGHPGSEYINQQGGSCSSFARGKTGLCALHSGLVLDKRVHGGVTLGPVIQDSHVSKLDEPKQIVINQDIDVDMMKMGSPRAAGVITCSDVKLNEVASTRLPSGEDGHTPMSVAVPEGRVHGGSLMAPLMGSSGLGTSSGRDLLSDQSETIEAGILPQ

SEQ ID NO: 172114 - protein, 331 aa, Glycine max
  Coding DNA Sequence Number=SeqID_55336
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q1SK93; Match level="QueryCoverage=97%, HitCoverage=61%, E-value=1e-144, Identity=79%"; Hit description =EPS15 homology (EH); Protein kinase
  Pfam annotation: Domain name=Pkinase; Domain location=78-331; Score =304.0; E_value=2.7e-88; Accession=PF00069.15; Description=Protein kinase domain
  Pfam annotation: Domain name=Pkinase_Tyr; Domain location=78-331; Score=-21.4; E_value=3.7e-11; Accession=PF07714.7; Description =Protein tyrosine kinase
  Pfam module annotation: Pfam domain module=Pkinase::Pkinase_Tyr; Domain location=78-331::78-331
  Subcellular localization annotation: CTP_CleavageSite=75; ConfidenceScore=5.18e-01
MVSRFSPDRVNTKKQQRSNDTVSMGNCNSEASSQTQPHSDHHPQPRSNSNGITVLPPNSKPSVGRVLGRPMEDVRSTYTFGRELGRGQFGVTYLVTHKHTKQQFACKSIATPKLVHRDDLEDVRREVQIMHHLTGHRNIVELKGAYEDRHSVNLIMELCGGGELFDRIIAKGHYSERAAADLCRQIVTVVHDCHTMGVMHRDLKPENFLFLSKDENSPLKATDFGLSVFFKPGDVFKDLVGSAYYVAPEVLRRSYGPEADIWSAGVILFILLSGVPPFWSKKEQGIFDAILRGHIDFTSDPWPSISSSAKDLVKKMLRADPKQRLSAVEVL

SEQ ID NO: 172115 - protein, 76 aa, Glycine max
  Coding DNA Sequence Number=SeqID_55337
MESFVRPKITCLKILMGIGFEMVWPNMLPLSHGARKSVPAMRKTLKLHQEHGPKPFLFCGPEAGNDLAQCLRVILW

SEQ ID NO: 172116 - protein, 286 aa, Glycine max
  Coding DNA Sequence Number=SeqID_55338
  Gene Ontology: Mol. function=heat shock protein binding
  Pfam annotation: Domain name=DnaJ; Domain location=175-223; Score= -10.1; E_value=0.042; Accession=PF00226.21; Description=DnaJ domain
VLSYADLFEAKACCCFLAFGEVEDESKYSKKCLQSGTDVCIDQKIVVEASDLLQKTHKVSELINHSDELLQRRIAADAERVLKHINEALMMSSYSEKLLEMKAEALFMPVLDNFCFKYQLCRYEEVIQMCDETIGSAEKNSYPLDADCKVRDLNSSQLSKGLYFRLWQCSMMLKSYFHLRKLEEGLSLLEEQEEKVSAINKLFKIIGEAYAILSHPAKRSQYDSEEEMRNSQKKRHANSMNRNNVIDQTDNRRHWKESMATIWNIECGQVSDVLYLMHLRPTCTQI

SEQ ID NO: 172117 - protein, 898 aa, Glycine max
  Coding DNA Sequence Number=SeqID_55339
  Gene Ontology: Mol. function=binding; Cellular component=clathrin coat of trans-Golgi network vesicle; Biological process =intracellular protein transport
  Homolog annotation: Hit_ID=Q10LA0; Match level="QueryCoverage=99%, HitCoverage=99%, E-value=0.0, Identity=82%"; Hit description=Adapter- related protein complex 1 beta 1 subunit, putative, expressed
  Pfam annotation: Domain name=Adaptin_N; Domain location=13-535; Score= 729.5; E_value=2.2e-216; Accession=PF01602.10; Description=Adaptin N terminal region
  Pfam annotation: Domain name=Alpha_adaptinC2; Domain location=670 -777; Score=0.1; E_value=0.0039; Accession=PF02883.10; Description =Adaptin C-terminal domain
  Pfam annotation: Domain name=B2-adapt-app_C; Domain location=786-898; Score=127.6; E_value=3.6e-35; Accession=PF09066.1; Description=Beta2 -adaptin appendage, C-terminal s
  Pfam annotation: Domain name=HEAT; Domain location=118-154; Score =29.5; E_value=1.2e-05; Accession=PF02985.12; Description=HEAT repeat
  Pfam annotation: Domain name=HEAT; Domain location=156-193; Score =16.6; E_value=0.092; Accession=PF02985.12; Description=HEAT repeat
  Pfam module annotation: Pfam domain module=Adaptin_N::Alpha _adaptinC2::B2-adapt-app_C::HEAT::HEAT; Domain location=13-535::670 -777::786-898::118-154::156-193
MSRNDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLESLKDLISDNNPMVVANAVAALAEVQENSSRPIFEISSHTLSKLLTALNECTEWGQVFILDALSRYKAADAREAENIVERVTPRLQHANCAVVLSAVKMILLQMELITSTDVVRNLCKKMAPPLVTLLSAEPEIQYVALRNINLIVQRRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVITDDSNQLEPSLLDELLANIATLSSVYHKPPDAFVTRVHSAQRTEDEDYAEGSETGFSESPANPANGPASPPTARQSAPTSAIGAPATPPPVAPVPDLLGDLMGMDNSIVPIDQPATPTGPPLPILLPAATGLGLQISAQLTRQDGQIFYSLLFENNSQVPLDGFMIQFNKNTFGLAAAGPLQVSQLQPRMSARTLLPMVMFQNMSQGPPSSALQVAVKNNQQPVWYFSDKISLLVFFTEDGRMERSSFLETWRSLPDSNEVSKDFPAIVIGNADATLERLAASNMFFIAKRKNANQDVFYFSAKLPRGIPFLIELTTLIGNPGVKCAIKTPSPEMSALFFEAIETLLMG

SEQ ID NO: 172118 - protein, 183 aa, Glycine max
  Coding DNA Sequence Number=SeqID_55340
  Homolog annotation: Hit_ID=Q8RW34; Match level="QueryCoverage=22%, HitCoverage=11%, E-value=5e-09, Identity=65%"; Hit description=Beta 1,3-glycosyltransferase-like protein I
MDYEYAIEIQRVIPKTLCVTLDHRSKTKRVKQALQGQMMEIKLAQGGLEATPKWDNQVEAPEEKANKMKSFFIYAVGNWDAEFYAKVNDDVYVNLGHKQGTSEAAPVPEARPIPLSAEHLMTTLACTATTEIVRKKRTGGAAFRPPRRPKCSRVSKIAAALMNRRKGNPSGPHSIEELVRDRE

SEQ ID NO: 172119 - protein, 140 aa, Glycine max
  Coding DNA Sequence Number=SeqID_55341
  Gene Ontology: Mol. function=protein binding
  Homolog annotation: Hit_ID=O82343; Match level="QueryCoverage=75%, HitCoverage=22%, E-value=3e-27, Identity=64%"; Hit description =Expressed protein
MYSNTLSRSTSAAVLDVLMMAADKFEVVSCIRYCSRMLRLMPMTCESAVLYLDLPSSILKSDAIQPLIETARLFLAIHYGDITKCLQRMLSMSLCSSGLGYIIHKLSSRKLKKVLTCNDLNPDYVMFTSKVVLQKLSYLI

SEQ ID NO: 172120 - protein, 863 aa, Glycine max
  Coding DNA Sequence Number=SeqID_55342
  Gene Ontology: Mol. function=protein serine/threonine kinase activity; Biological process=protein amino acid phosphorylation
  Homolog annotation: Hit_ID=Q6UY78; Match level="QueryCoverage=95%, HitCoverage=91%, E-value=0.0, Identity=53%"; Hit description=YDA
  Pfam annotation: Domain name=Pkinase; Domain location=395-651; Score =303.7; E_value=3.4e-88; Accession=PF00069.15; Description=Protein kinase domain
  Pfam annotation: Domain name=Pkinase_Tyr; Domain location=395-651; Score=137.1; E_value=4.7e-38; Accession=PF07714.7; Description =Protein tyrosine kinase
  Pfam module annotation: Pfam domain module=Pkinase::Pkinase_Tyr; Domain location=395-651::395-651
  Subcellular localization annotation: CTP_CleavageSite=66; ConfidenceScore=5.01e-01
MSSWWKKSSSKDVKRKEKRKSIIDTIQRKLNRSRGSRRHHSHTISEKGTTFLVPTTSPSPSTHVSRLQSFAERPLAQPLPLPGTHRLSTNRANSGTSVTSKPESTRGSKSSLYFPLPKPGCVFNGGEPTDAEEDIGTASISSGSSIDSDDQCDSHFLSPLASDSENGNRATVHSTVSGVHKDQPPITIPKNSRVSSKPAPQLCNHQILSNTPKGASLHMPNPQIACSGGLWSAPDSSMSSPSRSPLRTFGSEQVLNSGFCTGKPYPDLASGHCSSPGSGHNSVGGDLTVQIFCPQNRCSPECSPIPSPGMKSPGFSSRIHSSAVSPLHPCAGSATLESPTRRPDDVKQQTHRLPLPPITIPNYCPFSPTYSATTTPSAPRSPSIAENLTSPGSRWKKGQLLGRGTFGHVYLGFNSESGEMCAMKEVTLFSDDAKSRESAQQLGQEIALLSHLRHPNIVQYYGSETVDDKLYIYLEYVSGGSIYKLLQQYGQLSEIVIRNYTRQILLGLAYLHAKNTVHRDIKAANILVDPNGRVKLADFGMAKHISGQSCPLSFKGSPYWMAPEVIKNSNGCNLAVDIWSLGSTVFEMATTKPPWSQYEGVAAMFKIGNSKDLPAMPDHLSEDGKDFIRQCLQRNPVHRPSAAQLLLHPFVKKATLGRPILSADPSEAKPDFVNAMRSLAIGPAKHNLALVSEAAGTYLSRSSRTGSGSSEAHTPRNISCPVSPPAGSPLLPPRLLHVTGRLSPSPISSPHTASGSSTPLTGGIGAVPFHLTKQPIFSHEGINVIQRPQNALNSNGSTAYQEPNCDPLWRILKSTFACPDIVSSNNDALGNHNRRVGQGLPREFYDGKSYLADGVSQQLLNDH

SEQ ID NO: 172121 - protein, 73 aa, Glycine max
  Coding DNA Sequence Number=SeqID_55343
  Gene Ontology: Mol. function=isomerase activity; Biological process =carbohydrate metabolic process
  Homolog annotation: Hit_ID=Q1SGQ4; Match level="QueryCoverage=57%, HitCoverage=12%, E-value=2e-07, Identity=64%"; Hit description =Galactose mutarotase-like
MNTTSGESDNRAAATATATATAAGVELTKDKNGIPLLLLRNNRGASATVSLQGGQVLSWKTERREELLFISNK

SEQ ID NO: 172122 - protein, 41 aa, Glycine max
  Coding DNA Sequence Number=SeqID_55344
AMTDEESDPHRPNNNEATISEEAEYTNKKMKPKMLKNEDMM

SEQ ID NO: 172123 - protein, 706 aa, Glycine max
  Coding DNA Sequence Number=SeqID_55345
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=81%, HitCoverage=97%, E-value=0.0, Identity=60%"; Hit description =Putative receptor kinase
  Pfam annotation: Domain name=LRRNT_2; Domain location=139-177; Score =41.9; E_value=2.2e-09; Accession=PF08263.3; Description=Leucine rich repeat N-terminal domain
  Pfam annotation: Domain name=LRR_1; Domain location=207-229; Score =13.5; E_value=0.79; Accession=PF00560.23; Description=Leucine Rich Repeat
  Pfam annotation: Domain name=LRR_1; Domain location=231-252; Score =14.1; E_value=0.52; Accession=PF00560.23; Description=Leucine Rich Repeat
  Pfam annotation: Domain name=LRR_1; Domain location=254-276; Score =17.1; E_value=0.063; Accession=PF00560.23; Description=Leucine Rich Repeat
  Pfam annotation: Domain name=LRR_1; Domain location=278-301; Score =12.3; E_value=1.4; Accession=PF00560.23; Description=Leucine Rich Repeat
  Pfam annotation: Domain name=Pkinase; Domain location=407-675; Score =73.5; E_value=6.9e-19; Accession=PF00069.15; Description=Protein kinase domain
  Pfam annotation: Domain name=Pkinase_Tyr; Domain location=406-675; Score=56.6; E_value=6.1e-16; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=139-177::207-229::231- 252::254-276::278-301::407-675::406-675
MTLALTFGFYLLIHKTIQHKVKKKYRSAYIFGREQRHSPPIQYYPAHITHFVTPIFPTPLKTGILLAFALDAILYDKHRWHNLLCKFLCVRFCFLEKTSGGWLECVQQKQLVLCRMMERILCFIYLVSLILFQANAAEPISDKQALLDLLEKLPPSRSLNWNASSSPCTSWTGVTCNGDRSRVIAIHLPGFGFHGTIPPNTISRVTGLQTLSLRSNFINGHFPCDFSNLKNLSFLYLQYNNFTGPLPDFSAWRNLSVVNLSNNFFTGTIPLSLSNLAQLTAMNLANNSLSGQIPVSLLQRFPNSAFVGNNVSLETSPLAPFSKSAKHGEATVFWVIVAASLIGLAAFVGFIFVCWSRKKKNGDSFALKLQKVDMSPEKVVSRDLDANNKIVFFEGCSYAFDLEDLLRASAEVLGKGTFGAAYKAALEDATTVVVKRLKEVAVGKKDFEQLMEVVGNLKHENVVELKGYYYSKDEKLMVYDYYTQGSLSALLHGKRGEDRVPLDWDTRMKIALGAARGLACIHCENGGKLVHGNIRSSNIFLNSKQYGCVSDLGLATIMSSVAIPISRAAGYRAPEVTDTRKATQPSDVYSFGVVLLELLTGKSPVYTTGSDEIVHLVRWVHSVVREEWTAEVFDLELIRYPNIEEEMVEMLQIAMSCVVRVPDQRPKMLELVKMIENVRQIEIVVNQPSISSENQVESSTQTPLTT

SEQ ID NO: 172124 - protein, 135 aa, Glycine max
  Coding DNA Sequence Number=SeqID_55346
  Gene Ontology: Mol. function=isomerase activity; Cellular component =cytoplasm; Biological process=carbohydrate metabolic process
  Homolog annotation: Hit_ID=Q9LVC5; Match level="QueryCoverage=91%, HitCoverage=39%, E-value=6e-51, Identity=74%"; Hit description =Apospory-associated protein C
MHKHNLVFTVDSEVRVEGLETLDYLDNLHQKERFTEQGDALTFESEVDRVYLDSSNTVAVLDHEKKRTFVIRKEGLPDVVVWNPWERKSKSIVDLGDEEYKQMLCVDGAAVEKSITLRPGEEWTGRLELSVLPCS

SEQ ID NO: 172125 - protein, 87 aa, Glycine max
  Coding DNA Sequence Number=SeqID_55347
MKPSLLQRLLMSQQASALTQDFIAHHTTLTLLRRCFQVDDSIGSNEPYHEFRRFSAQKNLEWKIRSEDLARKLKVIMIKKVRYLALM

SEQ ID NO: 172126 - protein, 50 aa, Glycine max
  Coding DNA Sequence Number=SeqID_55348
ISPVPESVLFYDDDWSSEFLTACEDFGFNRNRDFFQDIDDLFVSDPLLAL

SEQ ID NO: 172127 - protein, 158 aa, Glycine max
  Coding DNA Sequence Number=SeqID_55349
  Gene Ontology: Mol. function=catalytic activity; Cellular component =cellular_component; Biological process=metabolic process
  Homolog annotation: Hit_ID=Q764T8; Match level="QueryCoverage=89%, HitCoverage=18%, E-value=1e-77, Identity=94%"; Hit description =Lupeol synthase
MYICETQNGVQFQEDLYYPHPMIQDMLWGFLHHVGERVMNCWPFSMLRQKALEIAINHVRYEDENSRYLCIGSVEKVLCLIARWVEDPNSEAYKLHLARIPDYFWLAEDGLKIQSFGCQMWDAAFAIQAILACNVSEEYGPTLRKAHSFVKASQKILS

SEQ ID NO: 172128 - protein, 144 aa, Glycine max
  Coding DNA Sequence Number=SeqID_55350
  Gene Ontology: Mol. function=catalytic activity; Cellular component =cellular_component; Biological process=metabolic process
  Homolog annotation: Hit_ID=Q2WGL7; Match level="QueryCoverage=93%, HitCoverage=17%, E-value=2e-68, Identity=85%"; Hit description =Lupeol synthase
MFGSALSYIALRILGEGSQDGEERAMDRARKWILDHGGLVAIPSWGKFWVTVLGVYEWSGCNPLPPEFWLLPKCSPIHPGKMLCYCRLVYMPMSYLYGKKFVGPITSLIRSLREEVYNEPYDQINWNKARNIVAKVHKIFIFHL

SEQ ID NO: 172129 - protein, 89 aa, Glycine max
  Coding DNA Sequence Number=SeqID_55351
MQYTAYFYGQGSRKYLRNIRLRQEGGLRTIGRFELVYGRVEVKAARFLDLAQFLTKLHKISLTSSNVDNRSKEQLCACKVYVAGHLALG

SEQ ID NO: 172130 - protein, 259 aa, Glycine max
  Coding DNA Sequence Number=SeqID_55352
  Gene Ontology: Mol. function=catalytic activity; Cellular component =cellular_component; Biological process=metabolic process
  Homolog annotation: Hit_ID=Q2WGL7; Match level="QueryCoverage=99%, HitCoverage=34%, E-value=1e-137, Identity=88%"; Hit description =Lupeol synthase
  Pfam annotation: Domain name=Prenyltrans; Domain location=139-194; Score=29.4; E_value=1.2e-05; Accession=PF00432.11; Description =Prenyltransferase and squalene oxidase re
  Pfam annotation: Domain name=Prenyltrans; Domain location=90-132; Score=46.0; E_value=1.2e-10; Accession=PF00432.11; Description =Prenyltransferase and squalene oxidase re
  Pfam module annotation: Pfam domain module=Prenyltrans::Prenyltrans; Domain location=139-194::90-132
MATDLVGEEMEAERLYDAVNVILSLQSSNGGFPAWEPQRAYRWLEKFNPTEFFEDTLIEMEYVECTGSAMQGLALFRKLYPKHRRKEIDHCISNAIHYIENTQNPDGSWYGCWGICYTYGTWFAVVGLTACGKNYHNSPSLRKACKFLLSKQLPNGGWGESYLSSQNKVYTNLEGNRANLVQTSWALLSLIDAGQAEIDPTPIHRGIKLLINSQMEDGDFPQQEITGVFMRNCTLNYSSYRNIFPIWALGEYRCRVLCG

SEQ ID NO: 172131 - protein, 613 aa, Glycine max
  Coding DNA Sequence Number=SeqID_55353
  Gene Ontology: Mol. function=oxidoreductase activity; Cellular component=anchored to membrane; Biological process=lignin catabolic process
  Homolog annotation: Hit_ID=Q1EPX7; Match level="QueryCoverage=90%, HitCoverage=92%, E-value=1e-145, Identity=49%"; Hit description=C -terminal peptide-binding protein 1
  Pfam annotation: Domain name=Cu-oxidase; Domain location=179-327; Score=172.8; E_value=8.6e-49; Accession=PF00394.12; Description =Multicopper oxidase
  Pfam annotation: Domain name=Cu-oxidase_2; Domain location=405-549; Score=124.7; E_value=2.5e-34; Accession=PF07731.4; Description =Multicopper oxidase
  Pfam annotation: Domain name=Cu-oxidase_3; Domain location=37-169; Score=130.2; E_value=5.9e-36; Accession=PF07732.5; Description =Multicopper oxidase
  Pfam module annotation: Pfam domain module=Cu-oxidase::Cu-oxidase _2::Cu-oxidase_3; Domain location=179-327::405-549::37-169
MAAGSAGPQLKHVTCAIVLLPFFVTMTTSADIFLDWHVSADFNLKPVSTDQPVITINGMFPGPLINATTNDNIHVNVFNDLDDPLLFTCFRSSAKLKEFWFWCRNGIQQRLDSWQDGVSGTNCPIQPGKNWTYDFQAKDQIGTFFYFPSINFLKAGGGFGPIRVNNRPLISVPFPKPEAEFDLLIGDWYISSYKDIRSRLNTADVPSPDWMLINGKGPYMNNLSQSYETFNVTQGKTYLLRISNVGTAWSFNFRIQNHQLVLVETEGSYVNQIELESLDVHVGQSYSVLVTANQNAVDYYIVASPKLSNATNNNTLVGVAVLHYDNSTTPANGSLPSGPDPFDLQFSINQAKSIRWNLTTGAARPNPQGMFNVTNVTIIETFILNASTATIDGLSRYSVNNVSYLIPDTPLKLADFFSNGTGVYELDAFSKNTSNANAVRGVFVASALHKGWTEIVLENNLDIIDTWHLDGYSFFVVGMGEGDWNPESRSSYNLYDPVARSTVQVYPGGWSSVYVYPDNPGMWNLRSQNLQSWYLGEELYVRVYDADPNPAKEKPPPQNLLLCGKYQPPTPPPSVSPAPNAPSSNAYAYNPHRTRSLIAMITTAICLFYIDLH

SEQ ID NO: 172132 - protein, 59 aa, Glycine max
  Coding DNA Sequence Number=SeqID_55354
  Pfam annotation: Domain name=DUF1070; Domain location=1-50; Score =26.4; E_value=9.8e-05; Accession=PF06376.3; Description=Protein of unknown function (DUF1070)
MLLSLIFTLYIPLAVHAQSLAPATSHGASIDQGIAYIFADDVGFGTHLYHPLLHLLRKK

SEQ ID NO: 172133 - protein, 329 aa, Glycine max
  Coding DNA Sequence Number=SeqID_55355
  Gene Ontology: Mol. function=nucleic acid binding; Cellular component= intracellular; Biological process=regulation of transcription
  Homolog annotation: Hit_ID=Q84K31; Match level="QueryCoverage=98%, HitCoverage=100%, E-value=1e-51, Identity=38%"; Hit description =Putative zinc finger transcription factor
  Pfam annotation: Domain name=zf-C2H2; Domain location=143-165; Score =17.0; E_value=0.069; Accession=PF00096.16; Description=Zinc finger, C2H2 type
  Pfam annotation: Domain name=zf-C2H2; Domain location=220-242; Score =21.8; E_value=0.0025; Accession=PF00096.16; Description=Zinc finger, C2H2 type
  Pfam module annotation: Pfam domain module=zf-C2H2::zf-C2H2; Domain location=143-165::220-242
INMEAPEELSLGGSKDHTNIVKGKRTKRVRPQSPMPFSITSNSSTGEGEKEEGCNNGDDDNNNMKNEDINNINSSPTSSAGLQDSTDEEEDMANCLILLAQGQSRESPKHAEEDAGMNSAKYSSRKFLEAATLGSSRAGYYVYECKTCNRTYPSFQALGGHRASHKKPKALMAIGLEKKQQHLLSTDEEEFQLKTNKSPFSLQLNTKGNLYSNNNKSKVHECSICGAEFTSGQALGGHMRRHRAPVGTTTPATLSFTPLALEPEEDHPRKKRNVLNLDLDLNLPAPEDDHRESKFAFTSKQQQHQQPQQQQQPQTSLVFPAPALVDCHY

SEQ ID NO: 172134 - protein, 224 aa, Glycine max
  Coding DNA Sequence Number=SeqID_55356
  Gene Ontology: Mol. function=protein kinase activity; Cellular component=nucleus; Biological process=protein amino acid phosphorylation
  Homolog annotation: Hit_ID=Q0WP97; Match level="QueryCoverage=71%, HitCoverage=14%, E-value=2e-73, Identity=78%"; Hit description=COP1 like protein
  Pfam annotation: Domain name=WD40; Domain location=120-158; Score =4.5; E_value=11; Accession=PF00400.22; Description=WD domain, G-beta repeat
  Pfam annotation: Domain name=WD40; Domain location=28-66; Score=16.9; E_value=0.075; Accession=PF00400.22; Description=WD domain, G-beta repeat
  Pfam annotation: Domain name=WD40; Domain location=71-108; Score =35.0; E_value=2.7e-07; Accession=PF00400.22; Description=WD domain, G-beta repeat
  Pfam module annotation: Pfam domain module=WD40::WD40::WD40; Domain location=120-158::28-66::71-108
MNLPYSYQEDIESKKKSVFAKPIIWRKRNCLGTIRNAANVCCVQFSAHSSHLLAFGSADYSTYCYDLRNLRSPWCVLAGHRKAVSYVKFLDSETLVSASTDNTLKIWDLNKTSPVGASINACSLTLSGHTNEKNFVGLSVADGYIACGSETNEVYTYYRSLPMPVTSHKFGSIDPISGKDTDDDNDGLKKRFHVTATFLHLRVPGVLRLSLKHSGQSHQPAGSI

SEQ ID NO: 172135 - protein, 977 aa, Glycine max
  Coding DNA Sequence Number=SeqID_55357
  Gene Ontology: Mol. function=protein kinase activity; Biological process=protein amino acid phosphorylation
  Homolog annotation: Hit_ID=Q0WP97; Match level="QueryCoverage=100%, HitCoverage=76%, E-value=1e-138, Identity=41%"; Hit description=COP1 like protein
  Pfam annotation: Domain name=WD40; Domain location=843-881; Score =11.5; E_value=1.7; Accession=PF00400.22; Description=WD domain, G -beta repeat
  Pfam annotation: Domain name=WD40; Domain location=892-931; Score =18.8; E_value=0.019; Accession=PF00400.22; Description=WD domain, G -beta repeat
  Pfam annotation: Domain name=WD40; Domain location=935-974; Score =35.2; E_value=2.3e-07; Accession=PF00400.22; Description=WD domain, G-beta repeat
  Pfam module annotation: Pfam domain module=WD40::WD40::WD40; Domain location=843-881::892-931::935-974
MDEDFVDEATQLEVAEESQRQNKDSPHPECRKILKSLEAFIPVKQDYSQIPPREYDGILHGKNVVEGIDHADTSQHPHVSLFMDDADVMVEELTVKSYNGSSLDIGTSNNREQIYNRQNHWQNLYQLASNSGIGNSLSDIGTRNSVPATSSAREDIGSSSFPEMLARKSLSDGQSNVMEHLASAENKEGAGDVRQGTRKKIISQSGFAEFFIKNTLRGKGIVYKGPSSDGFCVQSREQNWMKIGIDADQNRMKTGIGADQNRLKTVIDADQNQLKTGIDADQNRLKTGIDADQNQMKASIGTDQNQMKNHSGTDQKQMKTGIVTHLNSNQSVGYGSKTAKFPSYCGAMPRSGRSDCVGVTLREWLKHGHHKASKVESLNIFRKIVDLVDICHSQGVALHNLCPSYIKLSPSNQIMYLGLPVQKQMVDSVVNSEVVHLDNSFIRKRLSEQVTFPSLDMGSKKKKFNENVRVTGGDLCLETASDRKLHSHTVGSQDYYNEYEEGTQFSKYNIGRMSSIPRVSNAGQMPLTSCEKFENKWYTSPEGGYTTSSNIYCLGVLLFELLGHFDSERTHIAAMSDLRHRILPPIFLSENPKEAGFCLWLLHPEPSSRPSTRVKGNKWANLLISLVTGNTFGKFIPGGRGTCIEKVQGWEILQSELINGLQELFSEELSSSIDQEDAESELLLHFLVLLKEQKQNNAFKLVEEIKCLESDIEEVERRHDSRKSLVSSGLQNDYSCQKEIMPLKKESLSLEMLPSISPISNSNKVRLMRSICHLEGAYFSTRSKLQLSETDASTHPDKDILRNRENQNVAQKSEEQPKKDTLGVFFDGLCKYARYCKFEVRGVLRNVDFNNPANVICSLSFDRDADYFASAGISRKIKIFEFSALCNDSVDIHYPAVEMSNRSKLSCVCWNNYIKNYLASTDYDGIVKLWDASTGQEFSQFTEHEKRAWSVDFSAVCPTKFASGSDDCTVKLWSISE

SEQ ID NO: 172136 - protein, 330 aa, Glycine max
  Coding DNA Sequence Number=SeqID_55358
  Gene Ontology: Mol. function=transporter activity; Cellular component= mitochondrial inner membrane; Biological process=transport
  Homolog annotation: Hit_ID=Q2PYY0; Match level="QueryCoverage=97%, HitCoverage=91%, E-value=1e-135, Identity=73%"; Hit description =Mitochondrial carrier-like protein
  Pfam annotation: Domain name=Mito_carr; Domain location=119-211; Score=131.2; E_value=2.9e-36; Accession=PF00153.17; Description =Mitochondrial carrier protein
  Pfam annotation: Domain name=Mito_carr; Domain location=16-107; Score= 121.6; E_value=2.2e-33; Accession=PF00153.17; Description =Mitochondrial carrier protein
  Pfam annotation: Domain name=Mito_carr; Domain location=223-326; Score=119.6; E_value=9.1e-33; Accession=PF00153.17; Description =Mitochondrial carrier protein
  Pfam module annotation: Pfam domain module=Mito_carr::Mito_carr::Mito_ carr; Domain location=119-211::16-107::223-326
MASDDGVKPPTHELLSICKSLVAGGVAGGVSRTAVAPLERLKILLQVQNRQDIKYNGTIQGLKYIWKTEGFRGMFKGNGTNCARIVPNSAVKFFSYEQASLGILWLYQRQPGNEEAQLTPILRLGAGACAGIIAMSATYPMDMVRGRLTVQTEASPRQYRGIFHALSTVFREEGPRALYKGWLPSVIGVIPYVGLNFSVYESLKDWLIRSKPFGMKAQDSELSVTTRLACGAAAGTVGQTVAYPLDVIRRRMQMVGWKDAASVVAGEGKSKLEYTGMVDAFRKTVQHEGFGALYKGLVPNSVKVVPSIAIAFVTYEMVKDILGVEMRISD

SEQ ID NO: 172137 - protein, 109 aa, Glycine max
  Coding DNA Sequence Number=SeqID_55359
  Gene Ontology: Cellular component=plastid
  Homolog annotation: Hit_ID=Q8LDF5; Match level="QueryCoverage=80%, HitCoverage=19%, E-value=5e-40, Identity=86%"; Hit description=Amino acid permease-like protein
MAFPEKDAGANFVLQSKGEWWHAGFHLTTAIVGPTILTLPYALRGLGWGLGLFCLTAMGLVTFYSYYLMSKVLYHCENAGRRHIRFRELAAHVFEQLNPDFFLQICVSL

SEQ ID NO: 172138 - protein, 695 aa, Glycine max
  Coding DNA Sequence Number=SeqID_55360
  Gene Ontology: Mol. function=binding; Cellular component =intracellular; Biological process=RNA processing
  Homolog annotation: Hit_ID=Q8GTX9; Match level="QueryCoverage=99%, HitCoverage=99%, E-value=0.0, Identity=78%"; Hit description=Cell cycle control crn (Crooked neck) protein-like
  Pfam annotation: Domain name=HAT; Domain location=105-137; Score =23.4; E_value=0.00083; Accession=PF02184.7; Description=HAT (Half-A -TPR) repeat
  Pfam annotation: Domain name=HAT; Domain location=139-171; Score =12.4; E_value=0.18; Accession=PF02184.7; Description=HAT (Half-A -TPR) repeat
  Pfam annotation: Domain name=HAT; Domain location=173-204; Score =15.8; E_value=0.044; Accession=PF02184.7; Description=HAT (Half-A -TPR) repeat
  Pfam annotation: Domain name=HAT; Domain location=206-237; Score =48.7; E_value=2e-11; Accession=PF02184.7; Description=HAT (Half-A -TPR) repeat
  Pfam annotation: Domain name=HAT; Domain location=239-274; Score=7.9; E_value=1.1; Accession=PF02184.7; Description=HAT (Half-A-TPR) repeat
  Pfam annotation: Domain name=HAT; Domain location=276-310; Score=7.1; E_value=1.6; Accession=PF02184.7; Description=HAT (Half-A-TPR) repeat
  Pfam annotation: Domain name=HAT; Domain location=354-395; Score=2.6; E_value=10; Accession=PF02184.7; Description=HAT (Half-A-TPR) repeat
  Pfam annotation: Domain name=HAT; Domain location=469-501; Score =16.3; E_value=0.036; Accession=PF02184.7; Description=HAT (Half-A -TPR) repeat
  Pfam annotation: Domain name=HAT; Domain location=503-537; Score=3.4; E_value=7; Accession=PF02184.7; Description=HAT (Half-A-TPR) repeat
  Pfam annotation: Domain name=HAT; Domain location=539-570; Score =23.9; E_value=0.00057; Accession=PF02184.7; Description=HAT (Half-A -TPR) repeat
  Pfam annotation: Domain name=HAT; Domain location=71-103; Score=4.0; E_value=5.6; Accession=PF02184.7; Description=HAT (Half-A-TPR) repeat
  Pfam annotation: Domain name=Mad3_BUB1_I; Domain location=505-600; Score=-47.1; E_value=0.011; Accession=PF08311.2; Description =Mad3BUB1 homology region 1
  Pfam annotation: Domain name=TPR_2; Domain location=125-158; Score =7.9; E_value=4; Accession=PF07719.7; Description=Tetratricopeptide repeat
  Pfam annotation: Domain name=TPR_2; Domain location=225-258; Score =11.6; E_value=1.5; Accession=PF07719.7; Description=Tetratricopeptide repeat
  Pfam annotation: Domain name=TPR_2; Domain location=422-455; Score =6.3; E_value=6.1; Accession=PF07719.7; Description=Tetratricopeptide repeat
  Pfam annotation: Domain name=TPR_2; Domain location=91-124; Score =18.9; E_value=0.019; Accession=PF07719.7; Description=Tetratricopepti de repeat
  Pfam module annotation: Pfam domain module=HAT::HAT::HAT::HAT::HAT::HA T::HAT::HAT::HAT::HAT::HAT::Mad3_BUB1_I::TPR_2::TPR_2::TPR_2::TPR_2; Domain location=105-137::139-171::173-204::206-237::239-274::276 -310::354-395::...
  Pfam module annotation: Domain location=469-501::503-537::539-570::71- 103::505-600::125-158::225-258::422-455::91-124
MSSSKDADPSLGYLTRKDTEVKLPRPTRVKNKTPAPIQITAEQILREARERQEAEIRPPKQKITDPTELGEYRLRKRKEFEDLIRRVRWNIGVWIKYAQWEESQKDFKRARSVWERALEVDYKNHTLWLKYAEVEMKNKFINHARNVWDRAVTLLPRVDQLWYKYIHMEEMLGNVAGARQVFERWMKWTPDQQGWLSYIKFELRYNEIERARGIFERFVECHPRVGAWIRYAKFEMKNGEVVRSRNVYERAVDKLSDDEEAEQLFVAFAEFEERCKETERARAIYKFALDHIPKGRAEDLYRKFVAFEKQYGDREGIEDAIVGKRRFQYEDEVKKNPLNYDSWFDYIRLEESVGDKERIREVYERAIANVPPAEEKRYWQRYIYLWINYALYEELDAGDMERTRDVYKECLNQIPHQKFSFAKIWLLAAQFEIRQLNLRAARQILGNAIGKAPKDKIFKKYIEIELQLGNIDRCRKLYEKYLEWSPENCYAWSKYAELERSLSETDRARAIFELAIAQPALDMPELLWKAYINFETAEGEFERARALYERLLDRTKHLKVWISYAEFEATAMAMDNLDLTEEEQKKQCIQSARRVFEKALNYFRSSAPDLKEERAMLLEKWLNMEATSGELGDVSLVQSKLPKKLKKRRHVATEDGSTRIEEFIDYLFPEESQTTNLKILEAAYKWKKQKLSSDD

SEQ ID NO: 172139 - protein, 363 aa, Glycine max
  Coding DNA Sequence Number=SeqID_55361
  Homolog annotation: Hit_ID=Q6K6Z8; Match level="QueryCoverage=99%, HitCoverage=83%, E-value=5e-51, Identity=36%"; Hit description =Hydroxyproline-rich glycoprotein-like
  Subcellular localization annotation: CTP_CleavageSite=35; ConfidenceScore=5.04e-01
WGSWLNMYWCFGHGNNRKRIGHAVLVTGRTASGTDAAATVNSTQAPIIPFHFSAPPSSPASFLHSEPPSVAQSPCGPFSIFAIGPYAHETQLVSPPVFSTFTTEPSTAPFTPPPESVHLTTPSSPEVPFAQLLDPNTKNSETYQRFQISQYDFHSYQLHPGSPVGQLISPRSAFSPSGTSSPFPDTDFNSRGSLLLDFQIGDPTKLLNFDKPSTNENHKSHQGSGSLTPDSIRSTTQAGFLPSHWVSDIIMSPRPRKNHPNEISVNHRVSIEVSAQEVLKCVENKAVALSKLKTDAPGEDKKDNSIEVLVSETPNDAPQQTADNGDVERAHHKDECIIFSAAKEFNFDNAEGGDSPAPNIVAD

SEQ ID NO: 172140 - protein, 295 aa, Glycine max
  Coding DNA Sequence Number=SeqID_55362
  Gene Ontology: Mol. function=amino acid transporter activity; Cellular component=integral to membrane; Biological process =peroxisome organization and biogenesis
  Homolog annotation: Hit_ID=Q8LDF5; Match level="QueryCoverage=99%, HitCoverage=65%, E-value=1e-130, Identity=77%"; Hit description =Amino acid permease-like protein
  Pfam annotation: Domain name=Aa_trans; Domain location=1-274; Score= -70.7; E_value=6.2e-05; Accession=PF01490.8; Description =Transmembrane amino acid transporter protein
  Pfam annotation: Domain name=DUF540; Domain location=124-294; Score= -63.8; E_value=0.072; Accession=PF04401.4; Description=Protein of unknown function (DUF540)
  Pfam module annotation: Pfam domain module=Aa_trans::DUF540; Domain location=1-274::124-294
MVTVIMIVLSQLPSFHSLRHINLCSLFLSLGYTALVVGACIHAGTSENVPPRDYSLEPKMSSRAFSAFTSISILAAIFGNGILPEIQATLAPPAAGKMVKGLVMCYAVIGVTFYSAAVSGYWIFGNKSSSNIFNSLMPDDGPSLAPTWVLGLAVIFVLLQLFAIGLVYSQVAYEIMEKKSADVNQGMFSKRNLIPRIILRSIYMILCGYVAAMLPFFGDINGVVGAIGFIPLDFVLPMLMYNMTYKPPKSSFTYWINTSIMVVFTGVGIMGAFSSIRKLVLDAHQFKLFSDDVVD

SEQ ID NO: 172141 - protein, 82 aa, Glycine max
  Coding DNA Sequence Number=SeqID_55363
  Subcellular localization annotation: CTP_CleavageSite=54; ConfidenceScore=5.15e-01
MTAWWIHHMVGTADVGLKGSHQHARRDSGGGDAWRMMKSLPCMVQTRQTRARCRAQLGTVALATFTGGTTCWSRSWDWRVWS

SEQ ID NO: 172142 - protein, 328 aa, Glycine max
  Coding DNA Sequence Number=SeqID_55364
  Gene Ontology: Mol. function=sequence-specific DNA binding; Cellular component=nucleus; Biological process=regulation of transcription
  Homolog annotation: Hit_ID=Q6R7N3; Match level="QueryCoverage=99%, HitCoverage=98%, E-value=3e-53, Identity=39%"; Hit description =Putative WRKY transcription factor 30
  Pfam annotation: Domain name=WRKY; Domain location=133-195; Score =120.2; E_value=5.8e-33; Accession=PF03106.6; Description=WRKY DNA -binding domain
MESDRNWEQNALISELIQGLEVARKLKEDLSSASSVDARDSHSLLQRILSSYDKALLFLRWNESVSMQQPTKTSSPQSPLSIDKTPLREDAEEDHQELKHNSKKRQQFCFRKMMPKWTEHIRVKIENGVEGPLEDGYSWRKYGQKDILSAKYPRSYYRCTFRKTKGCFATKQVQRSEEDHTIFDITYRGSHTCKRNDAVLPPKSPDYTQDGSLTVKTDNITAPSASFGCMAQDNYHDLFPSLVLENDPFFSTLSQTSSLSANTPESNYFVSPTFLEHEFDGVCNKPCPDSELARLVSADTSITSSPIFDFNFSLDAVGIDYPNFPFNI

SEQ ID NO: 172143 - protein, 46 aa, Glycine max
  Coding DNA Sequence Number=SeqID_55365
MEKGLCFSSAATSKRLPLTVFSFRQRGWTRFGPVEQTFELLERLYI

SEQ ID NO: 172144 - protein, 59 aa, Glycine max
  Coding DNA Sequence Number=SeqID_55366
MGQIASKGLLLQTTRGGRKSPVALARYMHEEIASQTSDLRLTWQVSPGAMARPNCCSSG

SEQ ID NO: 172145 - protein, 237 aa, Glycine max
  Coding DNA Sequence Number=SeqID_55367
  Homolog annotation: Hit_ID=Q6ZBW8; Match level="QueryCoverage=97%, HitCoverage=98%, E-value=7e-47, Identity=46%"; Hit description =Putative LOB domain protein 17
  Pfam annotation: Domain name=DUF260; Domain location=7-108; Score =236.5; E_value=5.6e-68; Accession=PF03195.5; Description=Protein of unknown function DUF260
MTGSGSPCGACKFLRRKCVRGCVFAPYFCHEQGATHFAAIHKVFGASNVSKLLAHLPVSDRCEAAVTISYEAQARLQDPIYGCVSHIFALQQQVVNLQAQLAYLKEQAAQSCLDGSINENPSEKLFEKSSSALPQDLQSWFNQVGNSNLGPEFLPNMCTNLSTQHYGNNALMEDLNPIGINYETSGAMEGNNSSSFDDSSNNYSMSYDMQTNRRTWGFHEVEDLHSVAFGYGTRSHS

SEQ ID NO: 172146 - protein, 396 aa, Glycine max
  Coding DNA Sequence Number=SeqID_55368
  Gene Ontology: Mol. function=transcription factor activity; Cellular component=nucleus; Biological process=regulation of transcription, DNA-dependent
  Homolog annotation: Hit_ID=Q9C7W2; Match level="QueryCoverage=73%, HitCoverage=94%, E-value=4e-44, Identity=39%"; Hit description=AP2 -containing DNA-binding protein; 51686-52693
  Pfam annotation: Domain name=AP2; Domain location=114-178; Score =135.7; E_value=1.2e-37; Accession=PF00847.10; Description=AP2 domain
MEGMRDRNSQLELQDQEGTNIGSSLSKLILTSGTNTLDSIFSNCPTTTNGSTRSNSVLDYLEPFGSLGYEPLGSSVYLRQRDILQKFYQESRGNGSYNVPTSSLSNSLTNPCKKKLYRGVRQRHWGKWVAEIRLPQNRMRVWLGTYDTAEAAAYAYDRAAYKLRGEYARLNFPNLKDPTKLGFGDSARLNALKSSVDAKIQAICQKVKRERAKKNAAKKLHNSTDPKRGQSEKPSSSSSPSPSPSPSIFNDNWANQLFSPAVSEDGFWKGENSHSPASVLTECQTEETELLFEGCSLARLPSFDPELIWEDIRYFTDLLTLIGTPLVNILFGCVAAWERGMTKHIFHQDEQQNTCIFRQQEQRNKCRSGQVQCAARRGAVCRVNFVIRIGEIGAVC

SEQ ID NO: 172147 - protein, 90 aa, Glycine max
  Coding DNA Sequence Number=SeqID_55369
MEKKENPSLQRFHCNLLLPSNLQSHNGVQIERQRVDRFVERGIDSEKGVIWQYMINKCQDGSIRRSTPTPSPFLSPRSTLISAKYDLNFS

SEQ ID NO: 172148 - protein, 116 aa, Glycine max
  Coding DNA Sequence Number=SeqID_55370
MKNVLIVACLQAQVMQMKAQLDQNQMESRNLENHGPDNVIRQPFNPFCFTSMNNPTSPQSSLDSIDYSSINDGMSMRDVQRREDFSLQACNFKKRSYNNDLDELQELALRMMRNCD

SEQ ID NO: 172149 - protein, 107 aa, Glycine max
  Coding DNA Sequence Number=SeqID_55371
  Gene Ontology: Mol. function=histone-lysine N-methyltransferase activity; Cellular component=nucleus; Biological process =multicellular organismal development
  Homolog annotation: Hit_ID=Q9SLB7; Match level="QueryCoverage=76%, HitCoverage=33%, E-value=2e-34, Identity=84%"; Hit description=LOB domain-containing protein 16
  Pfam annotation: Domain name=DUF260; Domain location=21-106; Score =185.6; E_value=1.2e-52; Accession=PF03195.5; Description=Protein of unknown function DUF260
  Subcellular localization annotation: CTP_CleavageSite=43; ConfidenceScore=5.22e-01
MTSATGNDTGSAGSSSGFGSPCGACKFLRRKCAADCIFAPYFCSEQGAARFAAIHKVFGASNVSKLLLRIPAHQRFEAMLTLAYEAQARVRDPVYGCVSHIFTLQQQ

SEQ ID NO: 172150 - protein, 76 aa, Glycine max
  Coding DNA Sequence Number=SeqID_55372
MGILECDGGLDAEIYEVLMVVIGGCEITMVSMMLMRKVIDGVECMSFKVEDVYLVVAIKYYHGCPKMERKDRGLGS

SEQ ID NO: 172151 - protein, 54 aa, Glycine max
  Coding DNA Sequence Number=SeqID_55373
MTTTAKQTEWWRLRLVGTAKMATKSGSNYRETENEKALVSDERRSDGFRLKVTS

SEQ ID NO: 172152 - protein, 98 aa, Glycine max
  Coding DNA Sequence Number=SeqID_55374
  Gene Ontology: Cellular component=outer membrane
  Homolog annotation: Hit_ID=Q6H7M7; Match level="QueryCoverage=45%, HitCoverage=8%, E-value=6e-08, Identity=60%"; Hit description =Putative outer envelope membrane protein OEP75
  Subcellular localization annotation: CTP_CleavageSite=41; ConfidenceScore=5.22e-01
MSGGTVMGSFAPYQAFAVGGPSSVRGYGEGAVGVGQSCLVSTSELSSIPLCSLCKSTVKGRSHSSITSSYGDGNDASTHTVSLDAVIAKRSSFFSGGR

SEQ ID NO: 172153 - protein, 104 aa, Glycine max
  Coding DNA Sequence Number=SeqID_55375
MEGIVTKCNGPFTFTDERDCYNNEVGHATKGIQNEGDEMQASNKQQTPKLYQLSPQLDWWRGSLFGQSHDQWCQLDLQWVSIFMVLMQYSGTGILAQALASFST

SEQ ID NO: 172154 - protein, 161 aa, Glycine max
  Coding DNA Sequence Number=SeqID_55376
  Gene Ontology: Cellular component=endoplasmic reticulum; Biological process=ER to Golgi vesicle-mediated transport
  Homolog annotation: Hit_ID=Q9M2J9; Match level="QueryCoverage=77%, HitCoverage=99%, E-value=8e-47, Identity=77%"; Hit description=Bet1 -like SNARE 1-1
  Pfam annotation: Domain name=SNARE; Domain location=76-138; Score =58.1; E_value=3e-14; Accession=PF05739.9; Description=SNARE domain
MDMDTENNDVVDAHRETSFMQVFPCTQKTMMKLWLDNGYEDGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 172155 - protein, 97 aa, Glycine max
  Coding DNA Sequence Number=SeqID_55377
  Subcellular localization annotation: CTP_CleavageSite=65; ConfidenceScore=5.66e-01
MGAGQAMKRIPRIKFPQRHPKPSSVSIKLRTPLPGGSSLCEGSTPETQASSSTTDVSLAFFSSSNASTSVGGKASLQPKRTPVSKEEIEAILLGGCF

SEQ ID NO: 172156 - protein, 93 aa, Glycine max
  Coding DNA Sequence Number=SeqID_55378
MSLYQMATKPLTTEAIALTEKKMDMTLDDIIKMSKNTKNKKPRRVLGALAKRRSNFQGNQFPAAVEVARKAVTAPLHNRVPNRNRVANWNKTR

SEQ ID NO: 172157 - protein, 143 aa, Glycine max
  Coding DNA Sequence Number=SeqID_55379
  Gene Ontology: Mol. function=phosphotransferase activity, alcohol group as acceptor; Biological process=protein modification process
  Homolog annotation: Hit_ID=Q1SI70; Match level="QueryCoverage=97%, HitCoverage=19%, E-value=2e-43, Identity=65%"; Hit description =Phosphatidylinositol 3-and 4-kinase, catalytic; Ubiquitin
MASAGNILFRKEADGHTLLIPIDHGYCLLEKVSSPRSFPCNLISPALPCASACASDTRSIVDDCTFDWLYWPQARQHYSPDTVDYIKSLDAEKDIELLKYYKWDVPIECAQTLCISTMLLKKEVERGLTPFDIGSIMGMENLN

SEQ ID NO: 172158 - protein, 415 aa, Glycine max
  Coding DNA Sequence Number=SeqID_55380
  Gene Ontology: Mol. function=UDP-glucose 4-epimerase activity; Cellular component=soluble fraction; Biological process=galactose metabolic process
  Homolog annotation: Hit_ID=Q1SI65; Match level="QueryCoverage=99%, HitCoverage=100%, E-value=0.0, Identity=78%"; Hit description=UDP -glucose 4-epimerase
  Pfam annotation: Domain name=3Beta_HSD; Domain location=49-358; Score= -83.1; E_value=7.1e-07; Accession=PF01073.9; Description=3-beta hydroxysteroid dehydrogenaseisomerase family
  Pfam annotation: Domain name=ADH_zinc_N; Domain location=44-170; Score=-13.9; E_value=0.07; Accession=PF00107.16; Description=Zinc -binding dehydrogenase
  Pfam annotation: Domain name=Epimerase; Domain location=48-334; Score= 237.9; E_value=2.1e-68; Accession=PF01370.11; Description=NAD dependent epimerasedehydratase family
  Pfam annotation: Domain name=NAD_binding_4; Domain location=50-305; Score=-64.2; E_value=0.00018; Accession=PF07993.2; Description=Male sterility protein
  Pfam annotation: Domain name=Polysacc_synt_2; Domain location=48-263; Score=-171.9; E_value=0.0035; Accession=PF02719.6; Description =Polysaccharide biosynthesis protein
  Pfam annotation: Domain name=RmlD_sub_bind; Domain location=47-399; Score=-170.7; E_value=0.0051; Accession=PF04321.7; Description=RmlD substrate binding domain
  Pfam annotation: Domain name=adh_short; Domain location=46-207; Score= -22.1; E_value=0.00016; Accession=PF00106.15; Description=short chain dehydrogenase
  Pfam module annotation: Pfam domain module=3Beta_HSD::ADH_zinc _N::Epimerase::NAD_binding_4::Polysacc_synt_2::RmlD_sub_bind::adh _short; Domain location=49-358::44-170::48-334::50-305::48-263::47 -399::46-207
  Subcellular localization annotation: CTP_CleavageSite=33; ConfidenceScore=5.43e-01
MASRVSIGNLTSSAPYINSPHFRSPLKISNNPSLQNASHKVLMRDKTVLVTGGAGYIGSHTVLQLLLGGFRAVVLDNLENSSEVAIHRVRELAGEFGNNLSFHKVDLRDRAALDQIFSSTQFDAVIHFAGLKAVGESVQKPLLYYNNNLTGTITLLEVMAAHGCKKDVLFKLIQVISHLTWDEMSEKVRKLVFSSSATVYGWPKEVPCTEEFPLSAMNPYGRTKLIIEEICRDVHCAEPDCKIILLRYFNPVGAHPSGYIGEDPRGIPNNLMPFVQQVAVGRRPALTVFGNDYNTSDGTGVRDYIHVVDLADGHIAALLKLDEPNIGCEVYNLGTGKGTSVLEMVRAFEMASGKKIPLVMAGRRPGDAEIVYASTKKAERELKWKAKYGIDEMCRDQWNWASKNPYGYGDQGSTD

SEQ ID NO: 172159 - protein, 457 aa, Glycine max
  Coding DNA Sequence Number=SeqID_55381
  Gene Ontology: Mol. function=GTPase activity; Cellular component =microtubule; Biological process=cell division
  Homolog annotation: Hit_ID=Q39821; Match level="QueryCoverage=97%, HitCoverage=72%, E-value=0.0, Identity=90%"; Hit description=SDL12A
  Pfam annotation: Domain name=Dynamin_M; Domain location=222-457; Score=214.8; E_value=2e-61; Accession=PF01031.10; Description =Dynamin central region
  Pfam annotation: Domain name=Dynamin_N; Domain location=37-213; Score= 302.7; E_value=7e-88; Accession=PF00350.13; Description=Dynamin family
  Pfam annotation: Domain name=MMR_HSR1; Domain location=35-214; Score =8.5; E_value=0.00016; Accession=PF01926.13; Description=GTPase of unknown function
  Pfam module annotation: Pfam domain module=Dynamin_M::Dynamin_N::MMR _HSR1; Domain location=222-457::37-213::35-214
MENLISLVNKIQRACTALGDHGEASALPTLWDSLPAIAVVGGQSSGKSSVLESVVGKDFLPRGSGIVTRRPLVLQLHKIDEGGREYAEFLHLPRKRFTDFAAVRKEIQDETDRETGRTRQISSVPIHLSIYSPNVVNLTLIDLPGLTKVAVEGQPDSIVQDIENMVRSYIEKPNCIILAITPANQDLATSDAIKISREVDPTGERTFGVLTKIDLMDKGTDAVEMLEGRAYRLKYPWIGVVNRSQADINKNVDMIAARRREHEYFSNTPEYKHLAHRMGSEHLAKMLSKHLEAVIKSKIPGIQSLISKTIAELEAELSRLGKPVAADDGGKLYAVMEICRSFDHIFKEHLDGVRPGGDKIYNVFDNQLPAALKRLQFDKQLSMENIRKLITEADGYQPHLIAPEQGYRRLIESSLTTVRGPAEAAVDVVHSLLKDLVHKAISETLFNRFGPPCSQRL

SEQ ID NO: 172160 - protein, 162 aa, Glycine max
  Coding DNA Sequence Number=SeqID_55382
  Gene Ontology: Mol. function=RNA-directed DNA polymerase activity; Biological process=RNA-dependent DNA replication
MRMLRWMCGKTRQDKIRNGAIRERVGVAPIVEKMVENRLRWFVHVERRPVDSVVRRVDQMERRQTIRGIGRPKKTIREVIKKDLELNDLDKSMHTHLYHIYLDHATASISACALRYNSSLFERALRLSMIAGSSFSNEDRRLGCKDDLCRLSVFNLSGKYIN

SEQ ID NO: 172161 - protein, 545 aa, Glycine max
  Coding DNA Sequence Number=SeqID_55383
  Homolog annotation: Hit_ID=Q8LR16; Match level="QueryCoverage=75%, HitCoverage=64%, E-value=1e-91, Identity=45%"; Hit description =Membrane protein CH1-like
  Pfam annotation: Domain name=Sad1_UNC; Domain location=173-297; Score= 183.9; E_value=4e-52; Accession=PF07738.3; Description=Sad1  UNC-like C-terminal
  Subcellular localization annotation: CTP_CleavageSite=52; ConfidenceScore=5.08e-01
MKLKHEESSSSSCSSPIKFQMLRHQCNTSIFGLSFSFIFSLWCLLFFYIKLRLVHGTGAMLELNESGSSNNSLGQKLAKPSYSIPETTSLEQMFWHVLGNGSNLVCKLQPPQDVKKLNQIPDEKLHHNYDEFRAQEKTKGMNSALVNITHRLESDGSVYNYASESKGAKVVAHNKEAKGAKNILGKDHDKYLRNPCSVEGKFVVIELSEETLVDSVKIANFEHYSSNFKEFDLAGSLNYPTEEWNMLGNFIAANVKHAQIFKLPEPKWARYLKLSLISHYGSEFYCTLSVVEVYGINAIERMLKDLIVASVASIPDKLPVHNITDTSSLKSEDGQIDRNGKKVDTKNDTVAAEITSNDTAREFDTEAVKTTMTANLIPDPVLELRQQLNGRVAGDTVLKILMQKVKSVEVNLSSLEDYIKELNSRQRVKIPDLEKELSRLSESLGQSKSEIKDLWQWNTNMEKGISEVESWKDAVSSQLNEIARENSMLRSDVRKVASNQVNMETKELAVLATSLVFVCLAVLKIVSVHMLTFSASYNADKIGIL

SEQ ID NO: 172162 - protein, 268 aa, Glycine max
  Coding DNA Sequence Number=SeqID_55384
  Gene Ontology: Mol. function=hydrolase activity, acting on ester bonds; Biological process=lipid metabolic process
  Homolog annotation: Hit_ID=UPI0000162A18; Match level="QueryCoverage =80%, HitCoverage=53%, E-value=5e-73, Identity=60%"; Hit description =carboxylic ester hydrolase/ hydrolase, acting on ester bonds
  Pfam annotation: Domain name=Lipase_GDSL; Domain location=51-263; Score=108.3; E_value=2.2e-29; Accession=PF00657.12; Description=GDSL- like LipaseAcylhydrolase
  Subcellular localization annotation: CTP_CleavageSite=72; ConfidenceScore=5.20e-01
MMSVRVIVYLLSTVLVVSSTFVESRALLQFQDPSPPSTAPSSSPVPLAPALFVIGDSSVDCGTNNFLGTFARADHLPYGKDFDTHQPTGRFSNGRIPVDYLALRLGLPFVPSYLGQTGAVEDMIQGVNYASAGAGIILSSGSELGQHISLTQQIQQFTDTLQQFILNMGEDAATNHISNSVFYISIGINDYIHYYLLNVSNVDNLYLPWHFNHFLASSLKQEIKNLYNLNVRKVVITGLAPIGCAPHYLWQYGSGNGECVEQINDMAR

SEQ ID NO: 172163 - protein, 569 aa, Glycine max
  Coding DNA Sequence Number=SeqID_55385
  Gene Ontology: Mol. function=phosphotransferase activity, alcohol group as acceptor; Biological process=protein modification process
  Homolog annotation: Hit_ID=Q1SI70; Match level="QueryCoverage=99%, HitCoverage=100%, E-value=0.0, Identity=74%"; Hit description =Phosphatidylinositol 3-and 4-kinase, catalytic; Ubiquitin
  Pfam annotation: Domain name=PI3_PI4_kinase; Domain location=263-524; Score=296.4; E_value=5.2e-86; Accession=PF00454.17; Description =Phosphatidylinositol 3- and 4-kinase
  Pfam annotation: Domain name=ubiquitin; Domain location=108-182; Score=9.5; E_value=0.029; Accession=PF00240.13; Description =Ubiquitin family
  Pfam annotation: Domain name=ubiquitin; Domain location=31-100; Score= 51.4; E_value=3.1e-12; Accession=PF00240.13; Description=Ubiquitin family
  Pfam module annotation: Pfam domain module=PI3_PI4_kinase::ubiquitin:: ubiquitin; Domain location=263-524::108-182::31-100
MSVSEVAVRPILKKSVHWQGRCSGESIRIYLTVDGALRPMRVLESDSIASVKMRIQACKGIAGKKHKLVYGGRELARKDALIKDYGVTAGNVLHLVLRLSDMIFIVVRTACGKEFEFQIDRHRNVGYLKQRIKKKKGEGFIDLEGDQELFCGGEELHDQRLFRDICNTDDADGVIHLVVRNSAKVNAKPVHKDLELSVVADGSAEGEKENQVTPKIPPPGLDFWLEPVFVNPKVSFFPFLWDLIGSTFDGLKKGNNPIRSSEGTGGTYFMQDSAGMEYVSVFKPMDEEPNAVNNPQGLPVSSNGEGLKIGTKVGEGAMREVAAYILDHPKAGPRLVTGEALGFAGVPPTVMVQCLHQAFNHPDGFDYSSKHSKVGSLQMFMSNDGNCEDLGPGAFSAEEVHKITVLDLRMANADRHAGNILFRKEAGGHTLLIPIDHGYCLPEKFEDCTFDWLYWPQARQPYSPDTVDYIKSLDAEKDIELLKYFGWDVPVECARTLRISTMLLKKGVERGLTPYDIGSIMCRENLNKESVIEEIICEAQESLLPGMEESVFLESVSQIMDSRLDKLSK

SEQ ID NO: 172164 - protein, 152 aa, Glycine max
  Coding DNA Sequence Number=SeqID_55386
  Gene Ontology: Mol. function=phosphoinositide phospholipase C activity; Biological process=intracellular signaling cascade
  Homolog annotation: Hit_ID=Q1S1N3; Match level="QueryCoverage=69%, HitCoverage=37%, E-value=2e-10, Identity=33%"; Hit description =Calcineurin-like phosphoesterase family protein, related
MSALVEHWRPETHFSHANWLPVDGEAVICRGCPNWGQLCEQFLGVRPTYPDIKGSRVKLSWLKKHFNNVKEHAHSQLQLEHFTRAYILHLFGGWLFSDHSGIYASLSAWHQSNRVLCQFKMQQHILAPPLHQENLHGVTPKGKNTKDWAHVH

SEQ ID NO: 172165 - protein, 328 aa, Glycine max
  Coding DNA Sequence Number=SeqID_55387
  Gene Ontology: Mol. function=oxidoreductase activity; Cellular component=membrane; Biological process=electron transport
  Homolog annotation: Hit_ID=O48921; Match level="QueryCoverage=98%, HitCoverage=68%, E-value=1e-165, Identity=76%"; Hit description =Cytochrome P450 97B2
  Pfam annotation: Domain name=p450; Domain location=1-327; Score= -53.6; E_value=1.6e-08; Accession=PF00067.12; Description=Cytochrome P450
MGKGLIPADLDTWKQRRRGEGYDGPNSIELDLEAEFSSLALDIIGIGVFNYDFGSVTKESPVIKAVYGTLFEAEHRSTFYIPYWKIPLARWIIPRQRKFQDDLKVINTCLDGLIRNAKESRQIRYYFDFMETDVEKLQQRDYLNLKDASLLRFLVDVRGADVDDRQLRDDLMTMLIAGHETTAAVLTWAVFLLAQNPNKMKKAQAEVDLVLGGHKGDKDGYAIPAGTDVFISVYNLHRSPYFWDRPHDFEPERFLVQNKNEEIEGWGGLDPSRSPGALYPNEVISDFAFLPFGGGPRKCVGDQFALMECTVALTLLLQNFDVELNRWN

SEQ ID NO: 172166 - protein, 360 aa, Glycine max
  Coding DNA Sequence Number=SeqID_55388
  Gene Ontology: Mol. function=nucleoside-triphosphatase activity; Cellular component=chloroplast; Biological process=chlorophyll biosynthetic process
  Homolog annotation: Hit_ID=O22437; Match level="QueryCoverage=89%, HitCoverage=42%, E-value=1e-122, Identity=71%"; Hit description =Magnesium-chelatase subunit chlD, chloroplast precursor
  Pfam annotation: Domain name=AAA_2; Domain location=99-293; Score= -50.4; E_value=0.062; Accession=PF07724.4; Description=ATPase family associated with various
  Pfam annotation: Domain name=AAA_3; Domain location=152-276; Score= -18.9; E_value=0.038; Accession=PF07726.2; Description=ATPase family associated with various
  Pfam annotation: Domain name=Mg_chelatase; Domain location=79-288; Score=-100.4; E_value=2.2e-06; Accession=PF01078.11; Description =Magnesium chelatase, subunit ChlI
  Pfam module annotation: Pfam domain module=AAA_2::AAA_3::Mg _chelatase; Domain location=99-293::152-276::79-288
  Subcellular localization annotation: CTP_CleavageSite=54; ConfidenceScore=5.53e-01
MGFALAFTASSTCCSNLQSQSLLFAAAALRSKPCLSLCNTYRPKRIRKRSPIVGAQSENGALVTSEKPGTNYGRQYFPLAAVVGQDAIKTALLLGAIDPGIGGIAISGKRGTAKTVMARGLHAILPPIEVVVGSIANADPTCPEEWEDGLTECLEYDSAGNIKTRIIKSPFVQIPLGITEDRLIGSVDVEESVKTGTTVFQPGLLAEAHRGVLYVDEINLLDEGISNLLLNVLSEGVNTVEREGISFKHPCRPLLIATYNPEEGAVREHLLDRIAINLSADLPMSFENRVAAVGIATEFQENSSQVFEMVEEETDNAKTQSIKFLCSTTHDVGVIKLARWLKGEGGREWSWVQISPTNKN

SEQ ID NO: 172167 - protein, 531 aa, Glycine max
  Coding DNA Sequence Number=SeqID_55389
  Gene Ontology: Mol. function=transcription factor activity; Cellular component=nucleus; Biological process=regulation of transcription
  Homolog annotation: Hit_ID=Q2QXZ6; Match level="QueryCoverage=87%, HitCoverage=97%, E-value=2e-84, Identity=34%"; Hit description=GRAS family transcription factor containing protein
  Pfam annotation: Domain name=GRAS; Domain location=18-371; Score =328.8; E_value=9.4e-96; Accession=PF03514.5; Description=GRAS family transcription factor
  Subcellular localization annotation: CTP_CleavageSite=26; ConfidenceScore=5.15e-01
MFQEEGLSSVTSSPLQFFSMMSLSVSPSLGSPYQMKCEQRGLVLIHLLLAGANFVATGDLQNANLTLEQISQHASLDGDTMQRIASYFSEALADRILKTWPGIHRALNSSRITMVSDEILVQKLFFELLPFLKFSYILTNQAIVEAMEGEKMVHIVDLYGAGPAQWISLLQVLSARPEGPPHLRITGVHHKKEVLDQMAHKLTEEAEKLDIPFQFNPVLSKLENLDFDKLRVKTGEALAISSILQLHSLLALDEDASRRKSPLLSKNSNAIHLQKGLLMNHNTLGDLLDGYSPSPDSASSSPAASSSALMNSESFLNALWGLSPKVMVVTEQDFNHNCLTMMERLAEALFSYAAYFDCLESTVSRASMDRLKLEKMLFGEEIKNIIACEGCERKERHEKMDRWIQRLDLSGFANVPISYYGMLQGRRFLQTYGCEGYKMREECGRVMICWQERSLFSITAWRPRKIELFSFPQVANPIAPNHEHHFRQFLHYLIRWQRFTGTAKRTRLGKEKDSAHVCHFMRHWELYEKLD

SEQ ID NO: 172168 - protein, 436 aa, Glycine max
  Coding DNA Sequence Number=SeqID_55390
  Gene Ontology: Mol. function=RNA-directed DNA polymerase activity; Cellular component=chromatin; Biological process=RNA-dependent DNA replication
VEPVPDKVRAIHQWPTPRSFRTLHGFLGLVGFYCHFIKGYATLAAPLTNALTQPHLVWFPEAETAFQKLKCVVSTTLVLQLLNFLIPFTMETNASGVGMGAVLSQSGHPLAFFSKQFCPKPHLASAYVRQLAAITTAIKKWRQYLLGHAFVILTDHCIADALSRIPKETHASLLVHPEFIALKQALQDNPTTGVPTLPIASALTTVGRPIIRFIVGLPPYRGHTTILMVVDKFSKGVHLGMLPPNYTTHIVALLFLEMVGKLHGMPRTYHPQMDVQMEVIKRVVEQYLRAFVHSRPTTWGKFLMWAEWSYNTSIHSATGVSPFEITFGRKPPNIPQYITGSAQVIAVDELLINREIVFASLQKKLLKSQARMKSLADTHRREVHFEVGQWVMEAYHLEDKVLLDGVGNDGPKFNDQGNMLACLSVIEYYVSACCSG

SEQ ID NO: 172169 - protein, 89 aa, Glycine max
  Coding DNA Sequence Number=SeqID_55391
MLTDQVIRKQPSNFPIAISAIAGNNGGRSRNAKEKLTSKKKKKREEEADPHLPPNHDNNGGNGLGASLGRRRRRRRTKKMQNLEEEAEE

SEQ ID NO: 172170 - protein, 372 aa, Glycine max
  Coding DNA Sequence Number=SeqID_55392
  Gene Ontology: Mol. function=RNA-directed DNA polymerase activity; Cellular component=chromatin; Biological process=chromatin assembly or disassembly
  Pfam annotation: Domain name=RVP_2; Domain location=210-328; Score= -61.5; E_value=0.061; Accession=PF08284.2; Description=Retroviral aspartyl protease
MSRNGQLSSWPGLLHALEARFALSQYDDPFDTLFKLTQRGTVSEYLAEFESLANHIIGLPPTFLINCFVSGLTSKICREVQASQPLTMVQVATLARLHEEKLEDSRHLFRRRPPGPTLSPGPLSSRTTPLLPAPALLPTPPKSPAIPFKRLSPEELASRREKDKEDNLSSDFSFDLSDDNDEANGPSPAQISLHALSGHMAPETLRLLGRINRHKVWILIDVGSTHNFIQECLVSILGLNAQFTQPLMVMVGNSHELKCSKWCRDISLQVQDQSFIINFHVLSLCGADLILNVEWLKLLGPILTDYNDLTMKFLHDGRVVELRGEQEGVVHSITAHQLQRLIRTDGASQFFHLHIEPPSTQMSYTPHQNPEI

SEQ ID NO: 172171 - protein, 360 aa, Glycine max
  Coding DNA Sequence Number=SeqID_55393
  Homolog annotation: Hit_ID=Q2R2E7; Match level="QueryCoverage=88%, HitCoverage=74%, E-value=8e-58, Identity=42%"; Hit description=THUMP domain containing protein, expressed
MAPDAAAAVAANGKKRRRYLPHNKAVKKKGSYPLRPGVQGFFITCDGGREHQASREALNILDSFYEELVDGEKELPSKPLNKKITFADSDSSSSDGEEEEEEEEEEEEEEEEAVHDGDEEKGDKKPKLDTSSDDNASHDDGAGEKSDPHNVDEPHTQEENKTCDNKGNNGNLKTTKGTADDLPAVKQCCKTNVPACNFSDKVEHKSIDKLIEEEFKELGDKNKHSETREHICATNAERRFVKLDSGCNGVVFVQMRKKDGDRSPKDIVHRIVTSAASTGKHMSRNTNAVLTTSRFILRILPIEVSCYASKEEISRTIKPLVEQYFPVETQNPLKPYLTMIFLPNAPTSTLSETYCQGCED

SEQ ID NO: 172172 - protein, 43 aa, Glycine max
  Coding DNA Sequence Number=SeqID_55394
MTMAAMCNGSFGNSANSTRDNIGGADRGHREHSDNQLLNGALR

SEQ ID NO: 172173 - protein, 183 aa, Glycine max
  Coding DNA Sequence Number=SeqID_55395
  Subcellular localization annotation: CTP_CleavageSite=63; ConfidenceScore=5.46e-01
MKYSGKGSLLADIALRSVNNNPLSNTSPRLAVSSRLARIRPTKKPKGALNAKVHAKRKIADTRGAESEKIKSNKDILFSVSKLPSAQDLRRYDFLWWTIQIIMMMIWQLWSLRWTCSLFSILEDLLSNDIVTGNLEDEVIIGDCSQVDVSVKDLAADPDDWSDQLQDLGSKHRGMRSVLLSCP

SEQ ID NO: 172174 - protein, 238 aa, Glycine max
  Coding DNA Sequence Number=SeqID_55396
  Gene Ontology: Mol. function=transferase activity; Cellular component= integral to membrane; Biological process=glycolysis
  Homolog annotation: Hit_ID=Q6Q8A0; Match level="QueryCoverage=78%, HitCoverage=37%, E-value=1e-76, Identity=77%"; Hit description =Hexokinase 6
  Pfam annotation: Domain name=Hexokinase_1; Domain location=38-232; Score=194.6; E_value=2.3e-55; Accession=PF00349.11; Description =Hexokinase
  Subcellular localization annotation: CTP_CleavageSite=29; ConfidenceScore=5.27e-01
MGRVVLGVAVTVAVATCALAAVVVGRRVRSRRKWKKVANVVRELEEGCATRVGRLRQVVDAMAVEMHAGLASEGGSKLKMLLTFVDNLPNGTERGTYYALHLGGTNFRVLRVQLNGQPSSDFEHEVERQPIPQHVMTSTSEDLFDFIASSLKEFIAKEGDGSNISQDRRELGFTFSFPVKQMSVSSGILIKWTKGFSIGNMVGRDVATCLQEALARKGLDVRVAALVRKYFHLPTVML

SEQ ID NO: 172175 - protein, 267 aa, Glycine max
  Coding DNA Sequence Number=SeqID_55397
  Gene Ontology: Mol. function=oxidoreductase activity; Cellular component=membrane; Biological process=metabolic process
  Homolog annotation: Hit_ID=Q6DLW2; Match level="QueryCoverage=98%, HitCoverage=96%, E-value=1e-102, Identity=68%"; Hit description =Short-chain dehydrogenase/reductase
  Pfam annotation: Domain name=3Beta_HSD; Domain location=9-232; Score=- 139.1; E_value=0.01; Accession=PF01073.9; Description=3-beta hydroxysteroid dehydrogenaseisomerase family
  Pfam annotation: Domain name=KR; Domain location=7-169; Score=-82.6; E_value=0.014; Accession=PF08659.1; Description=KR domain
  Pfam annotation: Domain name=adh_short; Domain location=6-174; Score =87.2; E_value=4.9e-23; Accession=PF00106.15; Description=short chain dehydrogenase
  Pfam module annotation: Pfam domain module=3Beta_HSD::KR::adh_short; Domain location=9-232::7-169::6-174
MGLLGKVALVTGGASGIGESIVRLFHIHGAKICIADVQDNLGKQICESLGDEANVVFVHCDVTVEDDVSHAVNFTVGKFGTLDIIVNNAGISGSPCPDIRDADLSEFDKVFSINAKGVFHGMKHSARVMIPNKKGSIISLSSVASALGGIGIHAYTGSKHAVLGLTKSVAAELGKHSIRVNCVSPYAVATGLALAHLPEDQRTEDALAGFRDFTGRMANLQGVELTTHDIANAVLFLASDEARYISGENLMVDGGFTSVNHSLQVFK

SEQ ID NO: 172176 - protein, 147 aa, Glycine max
  Coding DNA Sequence Number=SeqID_55398
  Gene Ontology: Mol. function=heat shock protein binding; Cellular component=integral to membrane; Biological process=protein folding
  Homolog annotation: Hit_ID=UPI0000016B45; Match level="QueryCoverage =59%, HitCoverage=15%, E-value=5e-10, Identity=37%"; Hit description =Homolog of Homo sapiens "DnaJ homolog subfamily C member 7
  Pfam annotation: Domain name=DnaJ; Domain location=11-87; Score=74.6; E_value=3.2e-19; Accession=PF00226.21; Description=DnaJ domain
ASADSDYDGRGVEHSVSSSEIKKAYHKAALRHHPDKAGQSLARSDNGDDQIWKDIVEEISKDADRLFKIIGEAYAVLSDTAKRSQYDSEEEMRNSQKKRHGNSINRNNVIDQTDNRRHWKETNGNAVEQARFIGSWDFFGILEEFFF

SEQ ID NO: 172177 - protein, 905 aa, Glycine max
  Coding DNA Sequence Number=SeqID_55399
  Gene Ontology: Mol. function=binding; Cellular component=clathrin coat of trans-Golgi network vesicle; Biological process =intracellular protein transport
  Homolog annotation: Hit_ID=Q10LA0; Match level="QueryCoverage=94%, HitCoverage=96%, E-value=0.0, Identity=81%"; Hit description=Adapter- related protein complex 1 beta 1 subunit, putative, expressed
  Pfam annotation: Domain name=Adaptin_N; Domain location=1-506; Score =680.5; E_value=1.2e-201; Accession=PF01602.10; Description=Adaptin N terminal region
  Pfam annotation: Domain name=Alpha_adaptinC2; Domain location=634 -741; Score=-3.0; E_value=0.0082; Accession=PF02883.10; Description =Adaptin C-terminal domain
  Pfam annotation: Domain name=B2-adapt-app_C; Domain location=750-862; Score=122.8; E_value=9.6e-34; Accession=PF09066.1; Description=Beta2 -adaptin appendage, C-terminal s
  Pfam annotation: Domain name=HEAT; Domain location=127-164; Score =16.6; E_value=0.092; Accession=PF02985.12; Description=HEAT repeat
  Pfam annotation: Domain name=HEAT; Domain location=89-125; Score =29.5; E_value=1.2e-05; Accession=PF02985.12; Description=HEAT repeat
  Pfam module annotation: Pfam domain module=Adaptin_N::Alpha _adaptinC2::B2-adapt-app_C::HEAT::HEAT; Domain location=1-506::634 -741::750-862::127-164::89-125
DKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLESLKDLISDNNPMVVANAVAALAEVQENSSRPIFEITSHTLSKLLTALNECTEWGQVFILDALSRYKAADAREAENIVERVTPRLQHANCAVVLSAVKMILLQMELITSTDVVRNLCKKMAPPLVTLLSAEPEIQYVALRNINLIVQRRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLESFPEEPAQVQLQLLTATVKLFLKKPTEGPQQMIQVVLNNATVETDNPDLRDRAYIYWRLLSTDPEAAKDVVLAEKPVITDDSNQLEPSLLDELLANIATLSSVYHKPPDAFVTRVHSAQRTEDEDFAEGSETGFSESPANPANGPASPPTSATGAPATPPSVAPVPDLLGDLMGMDNSIVPVDQPVTPTGPPLPILLPASTGQGLQISAQLTRQDGQIFYSLLFENNSQVSLDGFMIQFNKNTFGLAAAGPLQVPQLQPGMSARTLLPMVMFQNMSQGPPSSVLQVAVKNNQQPVWYFSDKISLLVFFTEDGRMERSSFLETWRSLPDSNEVSKDFPAIVIGSADATVERLAASNMFFIAKRKNANQDVFYFSAKLPRGIPFLIELTTLTGNPGVKCAIKTPSPEMSALFFEAIETLLMEYLINILDRFFIGDTSCENGCSGGWWKIKPMPSHPNAKKWIRGN

SEQ ID NO: 172178 - protein, 95 aa, Glycine max
  Coding DNA Sequence Number=SeqID_55400
MVTRLEKRHNATWGREGETNNEEKRLDLGVLGLDMDDDDILWADLVGDDNNEGEKEDTYMETKSNCFRCSSFRIDVLDQNEVVTMMMEYPQSEEA

SEQ ID NO: 172179 - protein, 698 aa, Glycine max
  Coding DNA Sequence Number=SeqID_55401
  Gene Ontology: Mol. function=heat shock protein binding; Biological process=protein folding
  Homolog annotation: Hit_ID=Q6NUX7; Match level="QueryCoverage=67%, HitCoverage=76%, E-value=3e-16, Identity=23%"; Hit description=DnaJ (Hsp40) homolog, subfamily C, member 7
  Pfam annotation: Domain name=TPR_1; Domain location=232-265; Score =2.6; E_value=2.6; Accession=PF00515.18; Description=Tetratricopeptide repeat
  Pfam annotation: Domain name=TPR_1; Domain location=276-309; Score =24.0; E_value=0.00053; Accession=PF00515.18; Description =Tetratricopeptide repeat
  Pfam annotation: Domain name=TPR_1; Domain location=438-471; Score =3.7; E_value=2; Accession=PF00515.18; Description=Tetratricopeptide repeat
  Pfam annotation: Domain name=TPR_1; Domain location=551-584; Score =12.7; E_value=0.16; Accession=PF00515.18; Description=Tetratricopepti de repeat
  Pfam annotation: Domain name=TPR_1; Domain location=589-622; Score =27.6; E_value=4.3e-05; Accession=PF00515.18; Description =Tetratricopeptide repeat
  Pfam annotation: Domain name=TPR_1; Domain location=623-656; Score =12.3; E_value=0.18; Accession=PF00515.18; Description=Tetratricopepti de repeat
  Pfam annotation: Domain name=TPR_2; Domain location=232-265; Score =12.4; E_value=1.2; Accession=PF07719.7; Description=Tetratricopeptide repeat
  Pfam annotation: Domain name=TPR_2; Domain location=276-309; Score =19.2; E_value=0.015; Accession=PF07719.7; Description=Tetratricopepti de repeat
  Pfam annotation: Domain name=TPR_2; Domain location=438-471; Score =5.2; E_value=8.2; Accession=PF07719.7; Description=Tetratricopeptide repeat
  Pfam annotation: Domain name=TPR_2; Domain location=551-584; Score =10.9; E_value=1.8; Accession=PF07719.7; Description=Tetratricopeptide repeat
  Pfam annotation: Domain name=TPR_2; Domain location=589-622; Score =16.4; E_value=0.1; Accession=PF07719.7; Description=Tetratricopeptide repeat
  Pfam annotation: Domain name=TPR_2; Domain location=623-656; Score =13.9; E_value=0.57; Accession=PF07719.7; Description=Tetratricopeptid e repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2; Domain location=232-265::276-309::438-471::551-584::589-622::623-656::232 -265::276-309::...
  Pfam module annotation: Domain location=438-471::551-584::589 -622::623-656
MASEDMANLKIEDSKDQRDGGFVFTSKQDNNNSSGSSFLQLGDAHAHAIDKFKFGARKEQSGNNKSRPKLKLSTPPQGYHDFIWKPKNESFGFFSVDATSIDQCSNKNECEVVDIENKEEASDCGGSFKSANDEVDITNDGSRHMSGFTFSASQVQSSSSSLKRHPNKINWVKVGHAHQNDTYNSTPNPLSFSGTSSLFTSGQANTRGSEVQGIKDEFASISATTLAAEEACEKWRLKGNQAYKNGNLSVAEDCYTQGVSCASKVEASQRCRRALMLCYSNRAATRMSLGRMRDAVEDCRLAAEIDPNFLRVRLRAAKPPILCQRGLALMGKLKGINKKIINYILPTGCLSLESYHCFLAMGEAEDASKYSKRCLQSGTDFCVDKKIVVEASDLLQKTQKVSELINHSDELLQRRTAADAERALELINEALVISSYSEKLLEMKAEALFMLCRYEEVIQLCDQTVGSAEKNSYPLDADCEVRDLDSSQLSKGLYFRLWRCSMMLKSYFHLGKLEEGLSLLEEQEEKVSAINMSGSKVLESLMPLAVTVRELLHHKTAGNEAFQAGKHEEAVEHYTAALSCNVESLLFASVCFGNRAAAYKALGQITDAIADCNLAIALDGRYLKALSRRATSYEMIRDYDQAASDIRRVVSLLINRNQHGISDRSISYANDLKHNQIWLSEIEEEAKKGIPLDMYLIL

SEQ ID NO: 172180 - protein, 372 aa, Glycine max
  Coding DNA Sequence Number=SeqID_55402
  Gene Ontology: Mol. function=ARF guanyl-nucleotide exchange factor activity; Cellular component=intracellular; Biological process =regulation of ARF protein signal transduction
  Homolog annotation: Hit_ID=UPI0000162BB6; Match level="QueryCoverage =98%, HitCoverage=21%, E-value=1e-148, Identity=71%"; Hit description= guanyl-nucleotide exchange factor
  Pfam annotation: Domain name=Sec7; Domain location=120-310; Score =302.1; E_value=1e-87; Accession=PF01369.11; Description=Sec7 domain
MVYLEHCLLPRVNAYSRIVNGLLKTALGPPTGSTTALSPAQDITFRHESVKCLVSIIKSMGAWMDQQIRIGDLDLAKSPESSSAAENHLILNVEEGNASDHELHSDVNSEFSDAATLEQHRAYKIELQKGISLFNRKPPKGIEFLISNKKIGCSPEQVALFLKNTAGLDETKIGDYLGEREEFSLKVMHAYVDSFNFKGMDFGEAIRFFLQGFRLPGEAQKIDRIMEKFAERYCKCNPSSFSSADTAYVLAYSVIMLNTDAHNNMVKDKVVVVMMTKADFVRNNRGIDDGKDLPEEYLGALYDQIVKNEIKMNADSSAPQNKQANSFNRLLGLEGILNLVNWKQSEEKAVGANGLLIRHIQEQFKTNSRKSE

SEQ ID NO: 172181 - protein, 201 aa, Glycine max
  Coding DNA Sequence Number=SeqID_55403
  Gene Ontology: Mol. function=ionotropic glutamate receptor activity; Cellular component=membrane; Biological process=ion transport
  Homolog annotation: Hit_ID=Q7XAV6; Match level="QueryCoverage=58%, HitCoverage=24%, E-value=4e-19, Identity=64%"; Hit description =Glutamate receptor
MRSKALNLVHVLDSAAATTTAPALDFGALSVSDGGKQLLDNILCINMSGLTGPIQFVLDRSPLNPSYGILNVIATVQYKFILFGDGHKNPSYCDLVNMITSDVFDAAVGDIAIVSVRTKIVDFTRPYIESGLVVVAPKTHLVHLVELCPSMSCIYILTSLTCISPPKVTDMLNWATFVVDPPHHRSTDITLTLDVFSMQFP

SEQ ID NO: 172182 - protein, 169 aa, Glycine max
  Coding DNA Sequence Number=SeqID_55404
MHRSTEENSLRGLGTSIREKDKEEKLYYFSAVLYYILSIPYIEALAKGATMKTEAQHLLTDSVKGNPPRVCARSGAFAGGLVLLLGLPSWVSGLSSSIAWASVNKFKETRKDMRAEDAEGHGAASEEADRERPYEKPMDVEEWGRTDGDAAENHGWRGEGNDGVLRGDW

SEQ ID NO: 172183 - protein, 244 aa, Glycine max
  Coding DNA Sequence Number=SeqID_55405
MYLKRVAMYVPFPESTKLSRTVYVYADTCKGVSYVHFILFSPTLFYAGARMLYNPHDILLRRKIEEQAELQQVLELQERRLKNLQLPDFKNNPIHHHQRSLSVGTPLVLPHQLHSHINDAGLSPDSIKGDITGYSGSFTSTNSLGIASEQQQQLQKEVDPAHIDDSESRNLMESGNAEGVDLSNRSVGQALPDSLFASPTKAAGGYHADFSTLAEVNESAVFSASSSSQDKLEPTTSSSDVASH

SEQ ID NO: 172184 - protein, 106 aa, Glycine max
  Coding DNA Sequence Number=SeqID_55406
  Homolog annotation: Hit_ID=Q69MM1; Match level="QueryCoverage=42%, HitCoverage=3%, E-value=3e-10, Identity=68%"; Hit description =Putative BRCA1 interacting protein C-terminal helicase 1
MWGYLTTLTTRPSKLLLKDHATGCPEFKNAHKVKGHLSLQKGGCNEVHDIEDLVKVGQLTSSAVAKVCRRSRVVSPDKPGSSNIKHGSEKKKWCCHDECSQLLLKS

SEQ ID NO: 172185 - protein, 467 aa, Glycine max
  Coding DNA Sequence Number=SeqID_55407
  Gene Ontology: Mol. function=nucleic acid binding; Cellular component= spliceosome; Biological process=mRNA processing
  Homolog annotation: Hit_ID=Q10M01; Match level="QueryCoverage=95%, HitCoverage=68%, E-value=4e-70, Identity=37%"; Hit description=Zinc finger C-x8-C-x5-C-x3-H type family protein, expressed
  Pfam annotation: Domain name=RRM_1; Domain location=337-405; Score =22.7; E_value=0.0011; Accession=PF00076.12; Description=RNA recognition motif. (a.k.a. RRM, R
  Pfam annotation: Domain name=zf-CCCH; Domain location=215-240; Score =28.8; E_value=1.9e-05; Accession=PF00642.15; Description=Zinc finger C-x8-C-x5-C-x3-H type (and similar)
  Pfam module annotation: Pfam domain module=RRM_1::zf-CCCH; Domain location=337-405::215-240
MGSCEATNVVLSKIKNFDPENASKIMGYLLMNLEESELIRVACSPDTVLQTLVLRVKSHLGLTLSTPSSPSQFPPSPLNPIARLTGTSSNPFSRGGPTNGFDFTRNPASPSSHSHAWNFPNNNPISPKSTPLLSYDNIRALSPRVNGDCDFVDEQQVNEYFPFLNDSSKNEDLVDPRLELGVGAQNWHSGDSHLHRRSYSASDVGFGCDEAAPGLGYKPCLYFARGFCKNGTNCKFLHGAFTDSLDAIVGSPSKLEGMEQREEFVRFKAPQLQRIASGPSAAAREKYYEFLMQESQRAAAAFMMGEEFYNFGWDRPERNDFLGAISGEKPNSASRQIYLTFPAESTFKDEDVSEYFSKFGPVQDVRIPYQQKRMFGFVTFVYPETVRLILSKGNPHFICDSRVLVKPYKEKGKVPDKRQQQQQQQLERGDLSPCLSPSGFGSKEPYDFHLGNQISHIDIVEILHQLR

SEQ ID NO: 172186 - protein, 187 aa, Glycine max
  Coding DNA Sequence Number=SeqID_55408
  Gene Ontology: Mol. function=nucleic acid binding; Cellular component= chromatin; Biological process=DNA integration
  Homolog annotation: Hit_ID=Q1T010; Match level="QueryCoverage=83%, HitCoverage=11%, E-value=1e-47, Identity=55%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MRCGGKRDRVERGGCCKKKKFRERGRKDESLHLEAYSDSDWSDDLVDRRSTIGQIFLLSGSPISWSLKKQTVVTLSTGKAEYIAMCSTACQALWLTSLLNELKVSVGNVVDLLVDNKSTIALAKNPVSHGRSKHIDTKFHFLRDQVNKGKVKLKHCKIEVQLADIMTKSLKIERFKKLRGSLNIVCF

SEQ ID NO: 172187 - protein, 212 aa, Glycine max
  Coding DNA Sequence Number=SeqID_55409
MAIGDFVSSKEQIDIILEGNLTEQGLSQFFDSNGGNRCVACPTGRGGCRPAVAVMVVMEAMADIQVFNVKFVANLDMMLLFAIIILMKTVPTMSLNPSSVNPPLHQGHVSVALHAIPPQAPFINPNFSNNFLHPTPQAMLTSTNLKVQQVGTLTQDDLDKNIRKLMNELECANRKCEIYRSNLLSVLKAVEDHKLELSVKVENIKISMKDGI

SEQ ID NO: 172188 - protein, 533 aa, Glycine max
  Coding DNA Sequence Number=SeqID_55410
  Gene Ontology: Mol. function=nucleotide-sugar transporter activity; Cellular component=integral to membrane; Biological process =nucleotide-sugar transport
  Homolog annotation: Hit_ID=Q6ZL17; Match level="QueryCoverage=57%, HitCoverage=75%, E-value=1e-101, Identity=64%"; Hit description =Putative CMP-sialic acid transporter
  Pfam annotation: Domain name=Nuc_sug_transp; Domain location=155-343; Score=-10.7; E_value=1.2e-12; Accession=PF04142.6; Description =Nucleotide-sugar transporter
  Pfam annotation: Domain name=UAA; Domain location=99-363; Score= -145.7; E_value=0.0039; Accession=PF08449.2; Description=UAA transporter family
  Pfam module annotation: Pfam domain module=Nuc_sug_transp::UAA; Domain location=155-343::99-363
MEYRKIKDEDEVRDAGVEDVGKSFLLSVPDNDLTSEGETKIDSHREKVKWKRKSVVTLALTVLTSSQGILIVWSKRAGKYEYSVTTANFMVETLKCAISLVALGRIWKKDGVNEDNRKKVVVYFVNLIENLILHPILLSTVALGNQNIWLYGLTRLTTTLDEVIVYPIPAALYLVKNLLQYYIFAYVDAPGYQILKNFNIISTGVLYRIILKKRLSEIQWAAFVLLAAGCTTAQLNSNSDRVLQTPFQGWVMAIVMALLSGFAGVYTEAIIKKRPSRNINVQNFWLYVFGMCFNAVAMLVQDFDAVMNKRGLVKDESASLSLKSVSLGGAQSRMSLLLSFTIGRKKSFVSRPVTRSYANGILPWIFIHYSSHDFQPCTQALEQIQDSRGICYAELTNQLGVEWEYKEEEWVRGMLGFLPAVHSLVASLYELRLSSFELAKSRTLASVLGVLLFNHFPSFAWMLLLFLPEMKGYLRCGLWSMSDKKMKQLLMVDETVNKQISGSGIAVSMVMKYADNIVKTPTILYGQNFSDAR

SEQ ID NO: 172189 - protein, 614 aa, Glycine max
  Coding DNA Sequence Number=SeqID_55411
  Homolog annotation: Hit_ID=Q1RVN3; Match level="QueryCoverage=20%, HitCoverage=19%, E-value=6e-11, Identity=29%"; Hit description =Nucleotide-binding, alpha-beta plait
MARIWNKERRFRSKYYLQIRRRAARDSNQPTPGLMDSSEGGSSSSWRDRPDITSFYFSHFPDYVREKDLWKIFQEWGKVWEVFIPTKRNKQGHRVDNTQPGTQGRAGVKLMEYVVNEQTKHHNILPPKLKSYAEVVRHNRTQEGKELHGTPEGNELQGLTTGNVAESIIIQTKKEKTKWLDNVWVGRLKNKGMFEKVEEEMQGMFGMDVKPAYWGEDMVIFHEMDDDTADKINQQELGKGGTPFSSIQKWTPELMPSYRLTWLLIWGVPLQAWETEHFATIVETCGELVELDAATEDKVRMDIARVLVRTKEKPSIALSVNVVVDRSRHCLEIREDMASGWSRTARFKPEEGFPPSPFSTEMDASDAEPNNLVPCGVPPERSSGDYFGDSPTQWPSPGMVETGRRCWDHGSRRWRNHGDPKTGDDVSTCRWYKSAHGPVKLTPRREDQQHCNGHFPVDLHGKGMPDLRLSCTSQNQMPFAEIVAAEKVKDVSEEGSIHRVLEEYPVVMNSEEYPAVNHDSKLPGLTETDNSSQDLQGEGVKKLLGLENSGPGTNGGKTSFVFKVYRRKKECGTAKSTAQLNLNPVFNKTGEGGESEKLGTISKTKLNNEGGISR

SEQ ID NO: 172190 - protein, 484 aa, Glycine max
  Coding DNA Sequence Number=SeqID_55412
  Subcellular localization annotation: CTP_CleavageSite=40; ConfidenceScore=5.32e-01
MAKRDGVSVGDQTPRKVMMLQIVSRNRVATLNALGRLVMKSSERSSQMPDGSRRVLDEGLGVLPEMLPGVRQGESNETSLGGNCEKDYRHQAKCYPCVKSTDHAIGSQGTPLEVFPSNIAAPASKLFGSSIPSSFDVEARCNFGVNCLLKKAIGLSCCINTMPMVVPDASISISKACEKSGGINTGACVIADFNASKASWDSGDNLNCSWHRRAVKGGVTEDKDIIKKHRDELTQKWLKHRVHGSLKDRGEIWWTIWRGGGREDGLRKIASYLDDVDPVWIRRQRCLGDVGNGPTGTSVRSSAGKPKWWNFIDKGQVFGHPWLDEVVGAATVDEDGEAIRADEAIYTKGGWCRDTRRGMQADRRGGVVGVRRIGKVRVREVGCCCLGFLGVGDEEEDTAVASGCRGLGRGRSGWGGFGFGWGGLKTRRLSWILSSWSLARAVAYGREMGCRYVGANCVSSACKNPDQDATMLVLVEEVVPRVRD

SEQ ID NO: 172191 - protein, 153 aa, Glycine max
  Coding DNA Sequence Number=SeqID_55413
  Gene Ontology: Mol. function=catalytic activity; Biological process =guanosine tetraphosphate metabolic process
  Homolog annotation: Hit_ID=Q76JT3; Match level="QueryCoverage=98%, HitCoverage=27%, E-value=2e-30, Identity=42%"; Hit description=RelA -SpoT like protein PsRSH1
  Subcellular localization annotation: CTP_CleavageSite=49; ConfidenceScore=5.69e-01
SSWKRDQSPVLAFHGLVSSSSSGRSFMGSLTPIRSFRGGTSGLLDGFVRNALRSSCLDFDLDVGDSFAMFDELTFNLEDDFVEVEKAHKGQMRASTDPYLQHCLETVVLLALIGANSTIVVVGLLHDLLDDVFLTYDYIVGMFGVDVADLVEG

SEQ ID NO: 172192 - protein, 351 aa, Glycine max
  Coding DNA Sequence Number=SeqID_55414
  Gene Ontology: Mol. function=oxidoreductase activity; Cellular component=endoplasmic reticulum membrane; Biological process =metabolic process
  Homolog annotation: Hit_ID=Q8LKV5; Match level="QueryCoverage=96%, HitCoverage=94%, E-value=1e-139, Identity=69%"; Hit description =Steroleosin-B
  Pfam annotation: Domain name=adh_short; Domain location=48-224; Score= 18.7; E_value=3.3e-07; Accession=PF00106.15; Description=short chain dehydrogenase
MDFLNFMLNLLVPPGSMLTLAFSWPALCFLNVCEWLYNSIYGEDIDNKVVIITGASSGIGEASSLYIMHQIAYEYALRRANLTLVARREHRLRGIAENAKRLGARHVMIMAADVVKEEDCRRFVNETINVFGRVDHLVNTVSLGHTFCFEEVTDTSVFPVLLDINFWGNVYPTFVALPYLHQSNGRIIINASVESWLPMPRMSLYAAAKAALVNFYETLRFELKDEVGITIATHGWIGSEMTRGKFMLEEGAEMQWKEEREVHVMGGPVEEFARLIVSGACRGDAYVKVFAPRVLNWAFRFLISPQGTRRASSYVGTGKHIEAVGMVRPMAMLEGTSPTHTGQLISQHKLD

SEQ ID NO: 172193 - protein, 350 aa, Glycine max
  Coding DNA Sequence Number=SeqID_55415
  Gene Ontology: Mol. function=3'-5'-exoribonuclease activity; Cellular component=exosome (RNase complex); Biological process=RNA processing
  Homolog annotation: Hit_ID=Q9M209; Match level="QueryCoverage=98%, HitCoverage=81%, E-value=1e-118, Identity=59%"; Hit description =Nucleolar autoantigen-like protein
  Pfam annotation: Domain name=RNase_PH; Domain location=36-168; Score =111.8; E_value=1.9e-30; Accession=PF01138.11; Description=3' exoribonuclease family, domain 1
  Pfam annotation: Domain name=RNase_PH_C; Domain location=197-265; Score=36.2; E_value=1.1e-07; Accession=PF03725.5; Description=3' exoribonuclease family, domain 2
  Pfam module annotation: Pfam domain module=RNase_PH::RNase_PH_C; Domain location=36-168::197-265
MEQRLANTWRMPRNDNKFIETALLSDLRVDGRRPSDYRKLTIKLAKQDGSAEVHLGQTHVITFVTAQLVRPYRDRPNEGSLSIFTEFSPMADPSFEPGRPTDAAVELGRVVDRGLRESRAIDTESLCVLSGKLVWAIRVDIHILDNAGNLVDAANIAALVSLLTFRRPECSLTGEDGQDVVVHPPEERDPIPLIIHHLPIAVTFGFFSNENLLVIDPTHHEECVMTGRMTATLNSNGDVCAIQKPGGESVSQSVIMHCLKLAHVKATDITTKIKDAVEIHNNERMLRKIKRHSSSAAVDVCGATAGFGGKQNPLDGDDLECRATPSGQQHSKDGASKNFTGGPSSWYDTS

SEQ ID NO: 172194 - protein, 78 aa, Glycine max
  Coding DNA Sequence Number=SeqID_55416
MCCTYRCVYSVPKMFAFPIRFCNRRVVGKKEGDERRNELNKKKESKRLGGVGIETIGRCGNQDVFYKQQEAVGLKCSA

SEQ ID NO: 172195 - protein, 634 aa, Glycine max
  Coding DNA Sequence Number=SeqID_55417
  Gene Ontology: Mol. function=protein serine/threonine kinase activity; Cellular component=nucleus; Biological process=protein amino acid phosphorylation
  Homolog annotation: Hit_ID=Q6ZCC7; Match level="QueryCoverage=84%, HitCoverage=78%, E-value=1e-161, Identity=53%"; Hit description =Putative CRK1 protein
  Pfam annotation: Domain name=Pkinase; Domain location=145-430; Score =330.2; E_value=3.4e-96; Accession=PF00069.15; Description=Protein kinase domain
  Pfam annotation: Domain name=Pkinase_Tyr; Domain location=145-429; Score=41.9; E_value=4.8e-15; Accession=PF07714.7; Description =Protein tyrosine kinase
  Pfam module annotation: Pfam domain module=Pkinase::Pkinase_Tyr; Domain location=145-430::145-429
MGCICSKNSSDKDNVDEYEKEKEKEKESNKSSVQLVAPAVSTAQLDGGSMDGSTPRMAKSSSQVTRGFVKVPSDDKSNHFDATRSQHQRCNTMSGGVGERKPLMSRILSVQNFAGEHVDADWPVWLSLVAAEAIKGWVPRRADSFEKLDQIGQGAYSSVHKARDLETGKIVALKKVRFSSTEPESVRFMAREIYILRQLDHPNVMKLEGIVTSKTSTSLYLVFEYMEHDLAGLATIHGVKLTEPEIKCYMQQLLRGLEHCHSRGVLHRDIKGSNLLIDNNGNLKIADFGLSTVYDPDKKQPLTSRVVTLWYRAPELLLGATDYGAAIDMWSVGCILAELLVGKPIMPGRTEVEQMHKIFKLCGSPSEDYWQRTKLPHATSFKPQHPYNRQVSETFNKNFSPTALALVDTLLTIEPEGRGSATSALESEFFTTNPLPCNPSSLPKFSPSKDFDSKRREKEATRKNVESVKGCGPASVFREAADTKVLGSPDYMARGNISMRGKSNTRMSRLKYQSEEDGESKDNGEASMISLHNKGYTHSTSMMHSRMAAGPTSLRKNSELQTQSSHVNHAAAELSTSSVKKEPGMSVREPGMGYMPKKNRIHCSGPLCGNIDDMLKEHERLMQDVFRSVKKTNP

SEQ ID NO: 172196 - protein, 939 aa, Glycine max
  Coding DNA Sequence Number=SeqID_55418
MSMFHLTFAIWGLLSVSCFIVVVCASWCPYQIFQQSNQRFQQKTDKFWVFSEQTETWVEAKLPYDLLSCVNGDCRKVGSILQTDKKSTQEVLELKHKLDEQKRSVENKDSKLEAEDVVLPQRKRISLSKISETSVWITGESGSIYERFWNGMEWVIVPHDLPVSAGSAISIFVINQTILALSEAGKLYQIRVQLGESSQPIWVEFTPTDPEKNLLMKSGVASRDEQRAYFCTKNGSLVELAWVEPSRWINHGQPAGANVAAIADASSTREVVYTISSAGDLYEYDRKSKPSWKRHIWHERTAQAAPLMPSKGCSLPGLSDDHSESLFLLTKEGTLVERKLHQRKWKWVVHGRPQDQNLTCITPALQDESSETSSISLFFTTSFGSVFEYQIVKQLGLVPNNQFPGAWKSHQHPLHAKAARGIAGLQLYIGRILFPLNDGRIAELHPLGQGGESSGPSQPQNIRRKASTKYVWSILDVPESEGWNAEYCTNERGLRNCLTGIKDESEESVISLVTGRRKQSQTQNHYLSVGTSGGGRLIQSSEEYNTPDDWIISNFRLRLMDLGKSFFLITDDGLIFEYISIESAWIWLKHESSTAMKGILSNYNGSLFMVDAYGSLLLRERSGKELAWRNCTAVRKGRNVIGGQPWDGLPGQERKVTTEDTLFFVSKTGRLMKLMVSLKKLKWKDCRNPPDAKVACIVDQELFRKNIVFVIGINGRLYQYNKVTDLWHEHYHSQHLVLSQFSGTVIRPSLKTLSGSLFMLSREGGLVEYQWSSLYGWNWVEHGTPNRGVTLVGSTGPSFEGNQLFLIGSDGKVYLRYMDKMAWKWKDCGFPYVGNKLVEAHRHGGFQKEKVDCIDEDSASYLKKDQGNFGDLSIKCDSKVASTRPIPFSEGSVLFELRDGRLAEIQLVGKREWVWSRIIGTPASLCLENYWTTVAYNLS

SEQ ID NO: 172197 - protein, 330 aa, Glycine max
  Coding DNA Sequence Number=SeqID_55419
  Gene Ontology: Mol. function=transcription factor activity; Cellular component=transcription factor complex; Biological process =regulation of progression through cell cycle
  Homolog annotation: Hit_ID=Q7XZI4; Match level="QueryCoverage=87%, HitCoverage=78%, E-value=1e-111, Identity=72%"; Hit description=DP1
  Pfam annotation: Domain name=DP; Domain location=172-329; Score =238.9; E_value=1.1e-68; Accession=PF08781.1; Description =Transcription factor DP
  Pfam annotation: Domain name=E2F_TDP; Domain location=64-165; Score =125.9; E_value=1.2e-34; Accession=PF02319.11; Description =Transcription factor E2Fdimerisation partner (TDP)
  Pfam module annotation: Pfam domain module=DP::E2F_TDP; Domain location=172-329::64-165
MVILAFKSFFKFVFAYVWRASPGAAVKLCLGDLLVMGSNPETASLHMQGSKKKKRGQRAIGGDKSGRGLRQFSMKGHDDIFPYWLYFPSIGCPVCEKVESKGRTTYNEVADELVAEFADPINGVSTPDQQQYDEKNIRRRVYDALNVLMAMDIISKDKKEIQWKGLPRTSLSDMEELKSERLGLRNRIEKKAAYLQELEEQYIGLQKLIQRNEQLYSSGNAPNGGVSLPFILVQTRPHATVEVEISEDMQLVHFDFNSTPFELHDDNYVLKAMKLCEGSHNDNTTDNPTDGGEGSSIYAQVPTSVSNPPNRPPSSPPLPGILKARVKNEH

SEQ ID NO: 172198 - protein, 165 aa, Glycine max
  Coding DNA Sequence Number=SeqID_55420
  Subcellular localization annotation: CTP_CleavageSite=53; ConfidenceScore=5.15e-01
MKHLDLLLNLAQKHLTKASLDSMREQTSPENIALSKQQSIMFGSTKASSLPVSSRSEEGGLRRRLSSLSLKIQDSPTWSFSRSKSLSSMGDYVRTCWAWILSRKLIFATDLEMNDQKTKLLGSPNRGTWSHVFYKLRSEIRRFISTSDHATLPKTYHRSSPQVFS

SEQ ID NO: 172199 - protein, 121 aa, Glycine max
  Coding DNA Sequence Number=SeqID_55421
MKSCQIQAVGKTKVAAAVEEMNGCQCKETILWQMQSNMYPDYDVLVSGKYVGNRPIKLRKSKWKEMTHYEALEKQKVTTFFVNDLKLLSIITFKRNRNCQGKCAAQVTKGQNLCKSDYYFN

SEQ ID NO: 172200 - protein, 317 aa, Glycine max
  Coding DNA Sequence Number=SeqID_55422
  Gene Ontology: Mol. function=sugar porter activity; Cellular component=integral to membrane; Biological process=carbohydrate transport
  Homolog annotation: Hit_ID=Q1T5Y7; Match level="QueryCoverage=91%, HitCoverage=41%, E-value=1e-120, Identity=76%"; Hit description =Sugar transporter superfamily; Major facilitator superfamily MFS_1
MANQSALVDPLVKLFGSVHEKLPETGSTLFPHFGSMFSVGGNQPRNEDWDEESIAREGDDYVSDAADTDDSDDNLQSPLISRQATSAERDMPAPAQGSMRQGSLLQGEPAGNSGIGGGWQLAWKWSETEGVFKRIYLHQEGGPGSRRGSIISLPGCDAPTLTDGEIVQAAALVSQSALYNKELMHQQPVGPAMIHPSQTAAKGPSWSDLLEPGVKHALIVGVGIQILQQFSGINVVLYYTPQILEQAGVGYLLSNLGLGSTSASFLISSVTTLLMLPCIAVAMRLMDISGRRWMYPGDDFLMVILFPLHIFPMRLLR

SEQ ID NO: 172201 - protein, 452 aa, Glycine max
  Coding DNA Sequence Number=SeqID_55423
  Gene Ontology: Mol. function=zinc ion binding; Cellular component =endoplasmic reticulum; Biological process=ER-associated protein catabolic process
  Homolog annotation: Hit_ID=Q1SB35; Match level="QueryCoverage=90%, HitCoverage=96%, E-value=1e-103, Identity=74%"; Hit description=Zinc finger, RING-type; RINGv
  Pfam annotation: Domain name=PHD; Domain location=188-229; Score= -0.4; E_value=0.062; Accession=PF00628.19; Description=PHD-finger
  Pfam annotation: Domain name=zf-C3HC4; Domain location=189-226; Score= 40.5; E_value=5.8e-09; Accession=PF00097.15; Description=Zinc finger, C3HC4 type (RING finger)
  Pfam module annotation: Pfam domain module=PHD::zf-C3HC4; Domain location=188-229::189-226
MKLKTYAGLSIIATLAIIYHAFNSRGQFYPAMVYLSTSKISLVLLLNMGLVFMCILWQLTKKVFLGSLREAEVERLNEQSWREVMEILFAITIFRQDFSVTFLAMVTALLLIKALHWLAQKRVEYIETTPSVPINYGIPLHLIRELYETFRNFKVRVADYIRYRKITSNMNDRFPDATLEELNASDATCIICREEMTTAKKLVCGHLFHVHCLRSWLERQHTCPTCRALVVPPENGTTSAAGQQGSQSDAHQQGTTGTGSGSTAQTEATDSLSRHQARLQAAAAAASIYEKSYVYPSMNSFVCSPGYTLHPPVQIYMAESSDKDRNGEQTSSEEAQRQFLIAGRPPNLSFPPMQNFHFLPSQAHASPVNYGEGFENDPNIPNSQLEAYRKLLQCQIQNLQILQNQLEMLQRIKADRSVDEGTPSSDSRGKSVISSSSGSGHGYREDIRDGKA

SEQ ID NO: 172202 - protein, 375 aa, Glycine max
  Coding DNA Sequence Number=SeqID_55424
  Homolog annotation: Hit_ID=UPI000054763C; Match level="QueryCoverage =84%, HitCoverage=66%, E-value=4e-13, Identity=23%"; Hit description =PREDICTED: similar to gluconokinase like (43.8 kD) (2P34) isoform 1
  Pfam annotation: Domain name=MMR_HSR1; Domain location=75-181; Score=- 19.7; E_value=0.063; Accession=PF01926.13; Description=GTPase of unknown function
MAGSEPSPKILLAKPGLVTGGPVAGKFGRGGGGDDDSPQLRSRLPSVASLNLLSDSWDFHIDRFLPFLTENTDFTVIGVIGPPGVGKSTIMNELYGFDSSSPGMLPPFAIQSEETRAMARHCSTGIEPRISTERIILLDTQPVFSASVLAEMMRPDGSSTISVLSGETLSAELAHELIGIQGVHDDSLWHLMLTVDLLKHGISDPSLMTSSLSQSSSSGLEKDKLPEHEEYMATPVFVHTKLQDQDFTPSNFVQLRKALMQYFRPSSFVREQNKPEEHVSSSLVRGSQMDSNLIKFYAIPLKKKDENPSAQHESYVSALWKLRDQILSMKSPSFTRPVSEREWLKNSAKIWEQVKNSATILEYCRTLQHSGMYRR

SEQ ID NO: 172203 - protein, 266 aa, Glycine max
  Coding DNA Sequence Number=SeqID_55425
MLDKQGAVRPAKPADRPDDEVDDPLYLMTLTIPQLFLKPLQVMWDATLFGLFNENFPLYIKHEDLSEIAHGGQCLSISVIQLWILHMTETSMRAGNIDVYGFLEPQSIQRSGQSQFESENYIKNWMQNSKRDVYLGAYLNGAHWQMVVILPKENVVIWFCSLHNKPDNYLKGMINRSVLFFNIFALALVSALKGLDDTQQSKSKTPARWIVVKCNRQKGSTECGYYVMHWMSTIILGNFQNNWEMYFTDPRPLEPERLKALRIQWA

SEQ ID NO: 172204 - protein, 191 aa, Glycine max
  Coding DNA Sequence Number=SeqID_55426
YQGFNRLRSLSQHIGGYILCGTSRGYIYLGLTENKRGYISYGSVLVEGTSTRFKENKRGYIPCGSLLVKGFLQGDHWESSDCSMHSEAEALEHMKKRDRGHQSVSLDNKIGDSTVVKMSEKNNNVDVGDCMILNDHEGEEHCCGKGTNARRFSFLPRSQEKIGDSAKVVIKQDMKGGEHKYGFNNNKRDKP

SEQ ID NO: 172205 - protein, 132 aa, Glycine max
  Coding DNA Sequence Number=SeqID_55427
MGETHEIPHHNLADFEPWLGYATEGQAVGGIPFENTLEGPQFRPQPQPLRFVVGRAPPAMAEKGKADHLKERLRAIEGGEDYAFANLEELFLIPKHGHSQVQGAGLWQVQGDYSLQEPSKDVLSEDGGIRKR

SEQ ID NO: 172206 - protein, 60 aa, Glycine max
  Coding DNA Sequence Number=SeqID_55428
MEERERKIFRPDKFSARLPFSTGDIPPHMNKEEKTETPSFLSKNTSLEKILLVRDRTFDL

SEQ ID NO: 172207 - protein, 146 aa, Glycine max
  Coding DNA Sequence Number=SeqID_55429
  Gene Ontology: Mol. function=RNA-directed DNA polymerase activity; Biological process=RNA-dependent DNA replication
AMVALFHDMMHKEIEVYVNDMIAKSKTEDQKEIEVDRDKVKVILEMPEPHTEKQDQTVLHESFCARFPGARKAPCLQEVHDMRDELIFARKDVLCLGVGGSPFKAVHVELHHLVGIQNGSSQAIKGSALADCLAQQPINNYQHMHP

SEQ ID NO: 172208 - protein, 40 aa, Glycine max
  Coding DNA Sequence Number=SeqID_55430
MDFMVTTKEPEFLRDVDGTEHSSNSAEQLIAETFDWSHDA

SEQ ID NO: 172209 - protein, 101 aa, Glycine max
  Coding DNA Sequence Number=SeqID_55431
MDLTLEELQFLNIPDILRESISFPKSSLPPHTSSHIATIPKNCIITYMSWPDNNTLVRMMLISCYKIEPLVILHCKNTAGKITLTKCDCHIIFKVALDRNN

SEQ ID NO: 172210 - protein, 71 aa, Glycine max
  Coding DNA Sequence Number=SeqID_55432
  Gene Ontology: Mol. function=metal ion binding
  Homolog annotation: Hit_ID=Q2HTH7; Match level="QueryCoverage=50%, HitCoverage=11%, E-value=5e-15, Identity=94%"; Hit description=Zinc finger, RING-type
  Pfam annotation: Domain name=zf-C3HC4; Domain location=25-59; Score =14.1; E_value=0.0055; Accession=PF00097.15; Description=Zinc finger, C3HC4 type (RING finger)
MRLLEETEGGDAEKGGGGVGNDWVCCVCMGRKKGAAFIPCGHTFCRVCSRELWLNRVEKAATNNKAKSRIF

SEQ ID NO: 172211 - protein, 81 aa, Glycine max
  Coding DNA Sequence Number=SeqID_55433
MPFPPQKRKKTQTEWSRHSCHLLRKRKRNKREKDKRLANSGLVNADQNYTPVKRITFGVLSLCHKEYNAIVGKPTKLVPDQ

SEQ ID NO: 172212 - protein, 302 aa, Glycine max
  Coding DNA Sequence Number=SeqID_55434
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=99%, HitCoverage=78%, E-value=1e-142, Identity=84%"; Hit description =Serine/threonine-protein kinase HT1
  Pfam annotation: Domain name=Pkinase; Domain location=77-302; Score =154.7; E_value=2.4e-43; Accession=PF00069.15; Description=Protein kinase domain
  Pfam annotation: Domain name=Pkinase_Tyr; Domain location=77-302; Score=152.9; E_value=8.6e-43; Accession=PF07714.7; Description =Protein tyrosine kinase
  Pfam module annotation: Pfam domain module=Pkinase::Pkinase_Tyr; Domain location=77-302::77-302
MGGSCFHALRLRRFKSKALPEPCSSSKTRLDSDLENMERRRFDSLESWSMILDSENVETWEASKEDQEEWTADLSQLFIGNKFASGAHSRIYRGIYKQRAVAVKMVRIPTQNEERRGLLEQQFKSEVALLSRLFHPNIVQFIAACKKPPVYCIITEYMSQGTLRMYLNKKEPYSLSIETILRLALDISRGMEYLHSQGVIHRDLKSNNLLLNDEMRVKVADFGTSCLETRCRETKGNMGTYRWMAPEMIKEKPYTRKVDVYSFGIVLWELTTALLPFQGMTPVQAAFAVAEKVRSQIPIPKF

SEQ ID NO: 172213 - protein, 131 aa, Glycine max
  Coding DNA Sequence Number=SeqID_55435
  Gene Ontology: Mol. function=phosphoric monoester hydrolase activity; Cellular component=cytoplasm; Biological process=dephosphorylation
  Homolog annotation: Hit_ID=Q32W70; Match level="QueryCoverage=65%, HitCoverage=40%, E-value=4e-26, Identity=62%"; Hit description =Tyrosine specific protein phosphatase family protein
  Pfam annotation: Domain name=Y_phosphatase2; Domain location=29-131; Score=-0.9; E_value=7.5e-06; Accession=PF03162.4; Description =Tyrosine phosphatase family
MKLDCSNGQAPLAADVSPPQEDGSEEEIFVPPLNFAMVDNGIFRAGFPDSANFGFLKSLRLRSVMCLCPEPYPETTSEFLKANGIRLYQFGIDGCKGWLLLSFRLNSILKVNSLTMKTSQTRAIDGNFQLN

SEQ ID NO: 172214 - protein, 769 aa, Glycine max
  Coding DNA Sequence Number=SeqID_55436
  Gene Ontology: Mol. function=binding; Cellular component=thylakoid; Biological process=photosynthesis
  Homolog annotation: Hit_ID=Q6K464; Match level="QueryCoverage=61%, HitCoverage=85%, E-value=1e-137, Identity=56%"; Hit description =Putative octicosapeptide/Phox/Bem1p (PB1) domain-containing protein
  Pfam annotation: Domain name=PB1; Domain location=283-375; Score =76.8; E_value=6.8e-20; Accession=PF00564.15; Description=PB1 domain
  Pfam annotation: Domain name=TPR_1; Domain location=116-149; Score =17.2; E_value=0.047; Accession=PF00515.18; Description =Tetratricopeptide repeat
  Pfam annotation: Domain name=TPR_1; Domain location=42-75; Score =10.9; E_value=0.27; Accession=PF00515.18; Description=Tetratricopepti de repeat
  Pfam annotation: Domain name=TPR_1; Domain location=80-115; Score =11.9; E_value=0.21; Accession=PF00515.18; Description=Tetratricopepti de repeat
  Pfam annotation: Domain name=TPR_2; Domain location=116-149; Score =14.9; E_value=0.3; Accession=PF07719.7; Description=Tetratricopeptide repeat
  Pfam annotation: Domain name=TPR_2; Domain location=42-75; Score =23.8; E_value=0.0006; Accession=PF07719.7; Description =Tetratricopeptide repeat
  Pfam annotation: Domain name=TPR_2; Domain location=537-569; Score =2.5; E_value=17; Accession=PF07719.7; Description=Tetratricopeptide repeat
  Pfam annotation: Domain name=TPR_2; Domain location=80-115; Score =1.1; E_value=24; Accession=PF07719.7; Description=Tetratricopeptide repeat
  Pfam module annotation: Pfam domain module=PB1::TPR_1::TPR_1::TPR _1::TPR_2::TPR_2::TPR_2::TPR_2; Domain location=283-375::116-149::42 -75::80-115::116-149::42-75::537-569::80-115
MGKSGGRRKKGGSNANQGGGVDNSGSGAAAPTANGGVEVKKANELKEEGNRRFQNKDYAGALEQYESALRLTPKTHPDRAVFHSNRAACLMQMKPIDYEAVIAECTMALQVQPRFVRALLRRARAFEALGKYEMSVQDVQFLLAADPSNRDALEIAQRLRTALGSRQEAQQDLHSRPSPAALGASAVRGAPIAGLGPCLPARPVAKKGAHSAVGSVVSPNNNKPDKSQPVLPTENGSDTKSQLPKLVLKSSNGSAKPPNPKKEDHKELSSTIHGQRSDVAIRWRPLKLVYDHDIRLAQMPVNCNFRGLRDVVSKRFPSSSSVLIKYKDCDGDLVTITSTDELRLAESSVDSHLVKEPGEDKSDSVAMLRLHIVEVSPEQEPPLLEEEEEKPVENEGGMGEENGSHSSLGESVSEVADTVKVDKTVKDTPKEKPGTTGDTECKEVEMDDWLFEFAQLFRSHVGIDPDAHIDLHELGMELCSEALEETVTSEEAQDLFDKAASKFQEVAALAFFNWGNVHMCAARKRIPLDESAGQVVVAEQLQVAYEWVKEKYSLAREKYVEALSIKPDFYEGLLALGQQQFEMAKLHWSFALAKKIDLSGWDSKETLQLFDSAEEKMKAATDMWEKLEEQRAKELKDSNATKKEELLRRRKKQGATEGESSSVGGQGEISAEEAAEQAAVMRSQIHLFWGNMLFERSQVECKLGMTGWKENLDAATERFKLAGASEADVSMVLKNHCSNGDAKDGDDKKVENPQHNKTVKPEINKAHQV

SEQ ID NO: 172215 - protein, 82 aa, Glycine max
  Coding DNA Sequence Number=SeqID_55437
  Gene Ontology: Mol. function=protein serine/threonine kinase activity; Cellular component=membrane; Biological process=protein amino acid phosphorylation
  Homolog annotation: Hit_ID=Q2MHE4; Match level="QueryCoverage=98%, HitCoverage=22%, E-value=4e-29, Identity=71%"; Hit description =Serine/threonine-protein kinase HT1
NERPPLPASCQPALAHLIKRCWSANPSKRPDFSDIVCTLEKYDECVKEGLPLTHHSGLVNKNVIIERLKGCVPMSSSIPVQA

SEQ ID NO: 172216 - protein, 59 aa, Glycine max
  Coding DNA Sequence Number=SeqID_55438
MTEIWNKHCSQEDEEANAKRKRKKWRQEMKRRSKCVGEGLLCLFTTPTGCPSKIVRCTK

SEQ ID NO: 172217 - protein, 68 aa, Glycine max
  Coding DNA Sequence Number=SeqID_55439
NQLALAKDLSSALSKQLAWASCNSPEQVDAFKIMHLWKKGDPIAFSSEENTQRLRKKKEKRKSGVEVL

SEQ ID NO: 172218 - protein, 125 aa, Glycine max
  Coding DNA Sequence Number=SeqID_55440
  Gene Ontology: Mol. function=hydrolase activity, acting on carbon -nitrogen (but not peptide) bonds, in linear amides; Cellular component=endoplasmic reticulum membrane; Biological process =ceramide metabolic process
  Homolog annotation: Hit_ID=Q2HVG4; Match level="QueryCoverage=67%, HitCoverage=33%, E-value=1e-31, Identity=80%"; Hit description =Alkaline phytoceramidase
  Pfam annotation: Domain name=aPHC; Domain location=6-121; Score= -49.0; E_value=1.4e-07; Accession=PF05875.3; Description=Alkaline phytoceramidase (aPHC)
MAESISSFWGPVTSTKECCEINYAYSSYIAEFFNTISNIPTILLALIGLINALRQRFEKRFSVLHVSNMTLAIGSMLYHATLQHVFRFRTYAMTTQTDWSYKCMSDSGLLNFIHTKVGAAAMAAI

SEQ ID NO: 172219 - protein, 346 aa, Glycine max
  Coding DNA Sequence Number=SeqID_55441
  Homolog annotation: Hit_ID=Q2R5G9; Match level="QueryCoverage=65%, HitCoverage=79%, E-value=3e-27, Identity=32%"; Hit description =Uncharacterized plant-specific domain TIGR01615 family protein, expressed
  Pfam annotation: Domain name=DUF506; Domain location=41-237; Score =226.9; E_value=4.5e-65; Accession=PF04720.3; Description=Protein of unknown function (DUF506)
MGRTPVRFERVAAAFDADVARVRLCNSSENEQHSPEDSADLSDLVKSFMERGGEGEDAVGVRSDDGVENFDSEKREILEGIFDDDDGDAKEKIRREVQLAWGLVAEKDNSSPQFKQQLMSLLRYRGFDAGLCKCKWEKNTRFPAGDYEYIDVNFAGNRYIVEISLVTEFEIARSTDQYAALLDVSPLIFVGKMEELKQVVRLMCTAIKGSMKSMNMYIPPWRRIGYMQAKWFSSYKRITDEVATNRASSAFFTTRSIGFDARPANRQEVMLDSESTMGTAFAVKKYSKKGICKCTHCNRDNHVVETCFKLHGYPDWHPKGKTTPSTKVDATSKSHISTAVGFVTKS

SEQ ID NO: 172220 - protein, 112 aa, Glycine max
  Coding DNA Sequence Number=SeqID_55442
SRGKKRRIEEEEEEEEEEEEVRSEIKGSNKEVERKYLVEETHVLYHCSSRESKKRIEEEEEIRSERKGSEANGNGKGKMRSERKGLEENGNGKGCHNEKQQPVGQVSTGHSS

SEQ ID NO: 172221 - protein, 359 aa, Glycine max
  Coding DNA Sequence Number=SeqID_55443
  Gene Ontology: Mol. function=transferase activity; Cellular component= endoplasmic reticulum; Biological process=polysaccharide biosynthetic process
  Homolog annotation: Hit_ID=Q9M2M5; Match level="QueryCoverage=78%, HitCoverage=64%, E-value=1e-106, Identity=68%"; Hit description=UDP -GlcNAc:dolichol phosphate N-acetylglucosamine-1-phosphate transferase-like protein
  Pfam annotation: Domain name=Glycos_transf_4; Domain location=154 -342; Score=253.9; E_value=3.4e-73; Accession=PF00953.11; Description= Glycosyl transferase
MGARKRLSSSEPPSSSPPATNENTNTTAKPTITDPPIAPPKWGLLLKLSLFLLPYLYLLFHHYPIEPELRSSILINAGMSLAGLFVTVKMIPVASRYVQKRNLFGYDINKKGTPQGTVKVPESLGIVVGIVFLVVAILFQYFNFTADSNWLVEYNAALACICFMTLLGFVDDVLDVPWRVKLLLPSIAALPLLMAYAGHTTIVIPKPLVPHIGIEVLDLGWMYKLYMGLLAVFCTNSINIHAGINGLEVGQTVVIASAEIDNTVDVQILIHNIMQIGASTDPEYKLAHAFSIYLAQPLLATSLALLSYNWYPSSVFVGDTYTYFAGMTMAVIGILGHFRHRIIDIQGILNLELQSCFLF

SEQ ID NO: 172222 - protein, 64 aa, Glycine max
  Coding DNA Sequence Number=SeqID_55444
  Gene Ontology: Mol. function=RNA-directed DNA polymerase activity; Biological process=RNA-dependent DNA replication
MDPSKVCPVLEWPTPTTTKEIRGFLGLVGYYRRFIYDYGRGIEAVLMQNRQAIAYFSKALAPKT

SEQ ID NO: 172223 - protein, 156 aa, Glycine max
  Coding DNA Sequence Number=SeqID_55445
  Gene Ontology: Mol. function=nucleic acid binding
  Homolog annotation: Hit_ID=Q1RVR4; Match level="QueryCoverage=84%, HitCoverage=38%, E-value=1e-13, Identity=27%"; Hit description =Peptidase aspartic, active site; Aldehyde dehydrogenase
  Pfam annotation: Domain name=RVP_2; Domain location=10-131; Score= -63.8; E_value=0.093; Accession=PF08284.2; Description=Retroviral aspartyl protease
MDYRALAPRDLAKSRTIKLEGELIGYSIFLLVESGATHNFIARELLSSLNMEVTPTDLFNVGLANGSKCSSQGICHVVCVKVGSYTVVVDACLLDLGGVDIILGRAWLETVGQTTNDWQRKTISFDNHNQTISLQGYHLHEHPQTFALQGLLQSLA

SEQ ID NO: 172224 - protein, 68 aa, Glycine max
  Coding DNA Sequence Number=SeqID_55446
MADKKVNELALVLEDAKDDVVESFTKGLDAAKDQVNFFHKGIDLSRLGYFKVVQGNQIIDHMATIEDN

SEQ ID NO: 172225 - protein, 322 aa, Glycine max
  Coding DNA Sequence Number=SeqID_55447
  Gene Ontology: Mol. function=RNA-directed DNA polymerase activity; Cellular component=chromatin; Biological process=chromatin assembly or disassembly
  Pfam annotation: Domain name=Chromo; Domain location=231-284; Score =15.2; E_value=0.016; Accession=PF00385.14; Description='chromo' (CHRromatin Organisation MOdifier
MAIGGHSGFTKTYRHLGTLLRMSTTYHPQTDSQTEVANMCLETYLRCFASKQPTKWHLWLSWAGYWYNTSFYSAIGKTPFEVVYGLAPPSLLPFLPGETSVDSIASVLFDRDKALCQLKVHLHYAQQSMKREADKHCREVSFVEGEWVFVKLRLHRQLTVARYINPKLSTHYFGPFQILSQVREVAYKLKLPKSMKVHPVFHVSQLKKSMTANSNASALPLVRPMEESDSPFPKSVLATHEGKSDGSCTEWLILWKSQLVEEATWESESSTWTRFPSFSLEDKANVLRGGTTDTECIKDSYEMPLKALSHHTSHDNSHLPEK

SEQ ID NO: 172226 - protein, 230 aa, Glycine max
  Coding DNA Sequence Number=SeqID_55448
MREEKELLNKKLKLVEAKLKKVEDKVNEFSLALKDAKDDVVESFTKGFDAAKDQVKFFHKDIDLTGLGYFKMIQYNQIIDHMIKHQSLKINDCLRDQLNRAFITRIGIQSGSTTLQPQALEGVKTKLRVQKPNGNNGCQGLQPIILESHVSRLQSLPWKAYKFRFASVGVLVVKFTTTHQVFGNKTGARYSLDQQGGRSSHTRREVAIEGRYWRRELIFQTLSLCEGGCS

SEQ ID NO: 172227 - protein, 153 aa, Glycine max
  Coding DNA Sequence Number=SeqID_55449
  Gene Ontology: Mol. function=RNA-directed DNA polymerase activity; Biological process=RNA-dependent DNA replication
  Pfam annotation: Domain name=rve; Domain location=2-151; Score=-10.1; E_value=0.042; Accession=PF00665.16; Description=Integrase core domain
MDYFRKWIEVGPIATITSDKSEEKRGKSQGTARDAAIAVERHVSPLRGVEGVTPHTIITNNGTQSASLMVKKFCAKKGVRLVFSSVKHPRTNGQVEAANKVALNKLKKMIEKSDFNWVDELPQIYEPTFKETIFDENTVKIDHLVQLDMIHET

SEQ ID NO: 172228 - protein, 178 aa, Glycine max
  Coding DNA Sequence Number=SeqID_55450
MEVWVGVGEDFIPVPCHALHTNLSKGNTHFWLGCVGLKNRSPLWLTTQQGQCRKMGVVPRRTKRTSGGGRMRLTHFSTKEGDKVRELTNGVEDFGPTVIQFEGLIPFRSLIPNSVVVVFLLFLSTISTRWSLEGMSVNQRENFYLPESFPCEVNALANQIKVLDMEVEHVTMICQDYV

SEQ ID NO: 172229 - protein, 255 aa, Glycine max
  Coding DNA Sequence Number=SeqID_55451
  Homolog annotation: Hit_ID=Q2R3X6; Match level="QueryCoverage=65%, HitCoverage=60%, E-value=8e-23, Identity=36%"; Hit description =Expressed protein
METKSHSGSGISPSASPEFEFWMVRNPSFPQPNILSADQLIVNGVLLPLHLLNKPDPSPAITDSSSSSSSAATASKRWKDIFKKSDKKNTDAKKLKEKKSGVTTSAELNINIWPFSRSKSAGNAATRPKPFVPATRKANSAPCSRSNSAGESKSRKWPSSPARPGVHLGRSSPVWQVRRPKNPVPEPLNPDINKSKRESHRSKVVGGSGSSKTKVLNLNVPMCIGYRHHFTCRSDENSAIRVSNPNPPHAHANVG

SEQ ID NO: 172230 - protein, 82 aa, Glycine max
  Coding DNA Sequence Number=SeqID_55452
MSEQQYHETMEIWKSEYRNCGTITSGHPVGPHQKDMIRKWLEASVVCVWPVGTNSIGEMWKKHQSKNRVEAVNGVCLEAKAK

SEQ ID NO: 172231 - protein, 116 aa, Glycine max
  Coding DNA Sequence Number=SeqID_55453
RAREAEGGFKGSEVEGIERKEKEEEEKRRKEAKALPNRDRDHSLHHSYGSNAFQDYFDDAKESRVKQVPKNKESKSFNNQVFKIQDSRTIKFQESRFKNNQDQDSRIKRRLNQDKY

SEQ ID NO: 172232 - protein, 94 aa, Glycine max
  Coding DNA Sequence Number=SeqID_55454
  Homolog annotation: Hit_ID=Q9SLT8; Match level="QueryCoverage=62%, HitCoverage=19%, E-value=2e-09, Identity=53%"; Hit description=ZCW7 protein
MDEGHDTRNVVLVPTAREYRCARSYYPVLVCSLFQLTEKLNEIELNLEGVKFKLARYYSCFGYFQGLKKDWEEHSTFRSRREPDTVVLRGMSSR

SEQ ID NO: 172233 - protein, 196 aa, Glycine max
  Coding DNA Sequence Number=SeqID_55455
  Pfam annotation: Domain name=DUF623; Domain location=91-150; Score =79.5; E_value=1e-20; Accession=PF04844.4; Description=Protein of unknown function, DUF623
  Subcellular localization annotation: CTP_CleavageSite=30; ConfidenceScore=5.13e-01
MNNSKQQKQQHQLQQRGCKALCCSCRFSVSSSEEAESSSASDRFPSVSSLAHAMVQERLDQMIRARHVERRRQQSREGTKFVVMVAMEKSSYDPREDFRESMMEMITANRLQDAKDLRSLLNYYISMNSDEYHSLILEVFHEKRRGLSGCYSLAQNKQKIIQKLVDHINPGKVMPLQHLSVKWEGPFLILTRSIGY

SEQ ID NO: 172234 - protein, 153 aa, Glycine max
  Coding DNA Sequence Number=SeqID_55456
  Homolog annotation: Hit_ID=Q9SLT8; Match level="QueryCoverage=40%, HitCoverage=21%, E-value=4e-10, Identity=51%"; Hit description=ZCW7 protein
  Subcellular localization annotation: CTP_CleavageSite=28; ConfidenceScore=5.27e-01
MSGTFAIANTSATNMLRHRSYSSLPPPRCASRTNICEEQQQKNNNEEEEEEASKLLEIENGLRLVPRVKLNLTVYPSTPLTLSHPIDEWKMKHALIDFLHSSHSLTLPEDEDLQKRKRGNPEGALGRGRVEAAWCHSSRKGKELCSMEGGRRE

SEQ ID NO: 172235 - protein, 44 aa, Glycine max
  Coding DNA Sequence Number=SeqID_55457
MAACGGHRWSMELCLARLSHCARCLKAFYLNPNYESVKTWVMNL

SEQ ID NO: 172236 - protein, 55 aa, Glycine max
  Coding DNA Sequence Number=SeqID_55458
MVYSVFKSLRPVALKPEISVVSDEISAGRGVNTDSQSAGTAKPPLATTQRHPPPP

SEQ ID NO: 172237 - protein, 307 aa, Glycine max
  Coding DNA Sequence Number=SeqID_55459
  Homolog annotation: Hit_ID=Q47522; Match level="QueryCoverage=20%, HitCoverage=83%, E-value=1e-21, Identity=75%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSIQGWSVLLWVPLPATNQRLFNSRDPPHESSSLCSKGRVFQVELFRWRLVKSGAVYLRPFFQATVIHWIKVMGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 172238 - protein, 162 aa, Glycine max
  Coding DNA Sequence Number=SeqID_55460
  Gene Ontology: Mol. function=sequence-specific DNA binding; Cellular component=nucleus; Biological process=regulation of transcription, DNA-dependent
  Homolog annotation: Hit_ID=Q9FJK3; Match level="QueryCoverage=59%, HitCoverage=28%, E-value=2e-14, Identity=44%"; Hit description =Similarity to MADS-box DNA-binding protein
  Pfam annotation: Domain name=SRF-TF; Domain location=68-117; Score =12.1; E_value=0.017; Accession=PF00319.9; Description=SRF-type transcription factor (DNA-binding and dimerisation domain)
  Subcellular localization annotation: CTP_CleavageSite=70; ConfidenceScore=5.53e-01
MALKDMWAPLEGLVKTFFSSSSFSHSLSAFPSSDWSLSTFSSSPCALLWLLEVFFAIQTTSAVKFICQIMESAGWRETYKKRKKQMLKKVEELNTLYGIEACAIVYGHNDLDRARVLAIPLGEWGVQRVVEKLRIMPELERSKKMVNQAGFIGQRILKGNEQ

SEQ ID NO: 172239 - protein, 62 aa, Glycine max
  Coding DNA Sequence Number=SeqID_55461
MTLQGLLETSLALGITTLATHGEKKWHHNYRCDRGTLFSRVSYLLIFVPLCPNFGNIRFEHL

SEQ ID NO: 172240 - protein, 320 aa, Glycine max
  Coding DNA Sequence Number=SeqID_55462
  Gene Ontology: Cellular component=nucleus
  Homolog annotation: Hit_ID=Q43180; Match level="QueryCoverage=34%, HitCoverage=22%, E-value=2e-22, Identity=54%"; Hit description =Fumarase
  Pfam annotation: Domain name=Lyase_1; Domain location=104-313; Score=- 126.3; E_value=0.019; Accession=PF00206.10; Description=Lyase
  Subcellular localization annotation: CTP_CleavageSite=64; ConfidenceScore=5.54e-01
MPQSSKPTVTPLSFSLHTCYLHTHCSACFSSLPILNPNSLFYSSPPCSTALSPLYRSSAKRHLRPSAHSSNLRTALRLLLFHRPTSSSSSRLADLLSNRHILTGVMAEAIAKQRGVPNNDAILEEVTIALSTVLTNVMEVHNNEWRALGISVFYHIFSWINHSCSPNACYHFVLSSSSHSKEAKLGIAPHLQVNFYLNFCLFLKKYQSIEFKDIVNIGRTHTQDATPLTLGFTTQVKYGIDRVIDTLSCMYQLAQGGTAVGTGLNTKKGYHDSIPKRKDIIWNDEHAHIPPLILIYYGSDGANSAKYTMAVVGGRALVQP

SEQ ID NO: 172241 - protein, 135 aa, Glycine max
  Coding DNA Sequence Number=SeqID_55463
MTAVGVHDCRESEHPPLESDINTRYPTTPTLNFQHFRNRNRNLHTPQFLSQMGETYLSIFHHLSGHLRPNHITIRKNTSQEVVRRDESEFDASPESHPWEYYEGQNNQHMDLETEALHLQRSDTMRHVDLVHYVT

SEQ ID NO: 172242 - protein, 71 aa, Glycine max
  Coding DNA Sequence Number=SeqID_55464
MAVANVTVSNIKGRLKLGGINIGASVMALFKVSKASWASSDQLSWSFLKSKVNGLAMEVKFVLSQHVEDFL

SEQ ID NO: 172243 - protein, 117 aa, Glycine max
  Coding DNA Sequence Number=SeqID_55465
MTTPSSQCLTLTMPNFVFMDQFRQSLHNNSEFRHLLQQICNAPTVHSNFTIQHDLIFYHRKLWLPFVDSFVLTLAEFHTTPLGRHLGIAKTLRCLQDNFFWPNMQKDVRAFASKILN

SEQ ID NO: 172244 - protein, 89 aa, Glycine max
  Coding DNA Sequence Number=SeqID_55466
MKGDLKLEETTMVVKKMRKRNMEEEAKGPTFTFDLTTYSAIKEEKKTGPFWMLKSCLSLSAASPIPVLRVSLHPSGPVFKGRQCIYQNA

SEQ ID NO: 172245 - protein, 62 aa, Glycine max
  Coding DNA Sequence Number=SeqID_55467
  Homolog annotation: Hit_ID=Q2HWT8; Match level="QueryCoverage=55%, HitCoverage=4%, E-value=8e-08, Identity=74%"; Hit description =Phospholipase D alpha 2
MPFPLLLLGKLMAQILLHGTLHATIYEVDKLKIGGGNFLTKFIDNLAMVSALPLSLPSPNRE

SEQ ID NO: 172246 - protein, 204 aa, Glycine max
  Coding DNA Sequence Number=SeqID_55468
  Gene Ontology: Mol. function=RNA-directed DNA polymerase activity; Biological process=RNA-dependent DNA replication
MGRTHEASRDHNLVDSKPHLECAAEGQAFCIVPLPNSLKGPQFRPQLQPLHFAVGRVPPTVVERGKFDHIEERLRAIEGGRDYAFVDMAELCLVPDVIIPPKFKVPNFDKYKGTTCPKNHLKMYNRKMGAYSKNEKMLMHFFQESLTGAAVTWYANLEPSRVHSWKDLMVTFIRKYQYNSDMAPDRMQQQNLCKKEHESFKEYA

SEQ ID NO: 172247 - protein, 72 aa, Glycine max
  Coding DNA Sequence Number=SeqID_55469
  Homolog annotation: Hit_ID=Q1S9J2; Match level="QueryCoverage=64%, HitCoverage=4%, E-value=5e-07, Identity=57%"; Hit description =Kinesin, motor region; Zinc finger, RING-type; tRNA-binding arm; RINGv
MAKKRRGVNRRTGKEANRQECEEESSSPFSHRKPLTPHSSASSSTSSFTNGRIMPRSCSPLTSSFYNFGGGG

SEQ ID NO: 172248 - protein, 94 aa, Glycine max
  Coding DNA Sequence Number=SeqID_55470
MGEEWVINHLQNLSMHLRLPCLLLQHHALLVHHLHGVEVGVVEVVVVMAEVAKADTVDVVNIDIRDREGGSHKRVGLEVTPCLWLLKFEEDEKG

SEQ ID NO: 172249 - protein, 196 aa, Glycine max
  Coding DNA Sequence Number=SeqID_55471
  Gene Ontology: Mol. function=protein binding; Biological process =multicellular organismal development
  Homolog annotation: Hit_ID=Q2HW32; Match level="QueryCoverage=73%, HitCoverage=17%, E-value=6e-63, Identity=63%"; Hit description =Lissencephaly type-1-like homology motif; CTLH, C-terminal to LisH motif; Nitrous oxide ...
  Homolog annotation: Hit description=reductase, N-terminal; WD40-like; Quinonprotein alcohol dehydrogenase-like
  Pfam annotation: Domain name=WD40; Domain location=36-76; Score=23.8; E_value=0.0006; Accession=PF00400.22; Description=WD domain, G-beta repeat
  Pfam annotation: Domain name=WD40; Domain location=80-133; Score =11.5; E_value=1.7; Accession=PF00400.22; Description=WD domain, G -beta repeat
  Pfam module annotation: Pfam domain module=WD40::WD40; Domain location=36-76::80-133
MKPHPLHYRKPTIPYPISVSAHSESFPKTTIELEKNEKNDIFEGHEATVYSVCPHHKESIQFIFSTAIDGKIKAWLYDNMGSRVDYDAPGHWCTTMLYSADGSRNKSTGVVQFDITQNQFLAAGEDGQVKFWDMDNINLLTSTDAEGGLQGFKILANANGLRSLRTVETPRFEALRSPIESSVVKVVIFSSLFLVF

SEQ ID NO: 172250 - protein, 75 aa, Glycine max
  Coding DNA Sequence Number=SeqID_55472
MQVGYFTMKLFSGPRLQCPPFSILWDFKAPVTAQGQGVAQGFDGCLSVPETKATMKGQNGHFLEFSDPKLAQASI

SEQ ID NO: 172251 - protein, 121 aa, Glycine max
  Coding DNA Sequence Number=SeqID_55473
  Gene Ontology: Mol. function=protein serine/threonine kinase activity; Cellular component=membrane; Biological process=protein amino acid phosphorylation
  Homolog annotation: Hit_ID=Q2R4L1; Match level="QueryCoverage=60%, HitCoverage=11%, E-value=2e-25, Identity=74%"; Hit description =Protein kinase domain containing protein, expressed
MEDRDIKSSNILLDKELQPKFADFGSVKLLPGDQSHLSTRLAGTLGYTAPEYALHSQLSEKGDTYSFGIVVLEIISGKKNSDVKVVDDDAEWRRNRERRRHFKEKMSLEEAHHHRRPWIRA

SEQ ID NO: 172252 - protein, 78 aa, Glycine max
  Coding DNA Sequence Number=SeqID_55474
MAFSINSHTGGEFDGRGTEEGEEEMQKEKEKKKRRKKKSTVEALLNHNRGSFPTSFLSLALYPVQQSAITPCDGHVGC

SEQ ID NO: 172253 - protein, 213 aa, Glycine max
  Coding DNA Sequence Number=SeqID_55475
MLESFQQQDQMSVMELYIEKDVTGGSMFHSANSLTSCGNNLSNNEAQPLRNMSNLHGDEDDDDDDNYLVSKSYVEESLDEDDSIDGISDTDDEVTHDSTPKNCSPSRRYNFLYKKIGVQGIQNPFWNDALHYNNINWSHPDEEDICGLEMPSSFNVGQELYVGMDFDSKDAVKNAVKQYVMKVHQSFKVVESKSNKHDQRRSINKSFFDSRKD

SEQ ID NO: 172254 - protein, 107 aa, Glycine max
  Coding DNA Sequence Number=SeqID_55476
  Gene Ontology: Mol. function=RNA-directed DNA polymerase activity
  Homolog annotation: Hit_ID=Q1S1X7; Match level="QueryCoverage=57%, HitCoverage=4%, E-value=5e-15, Identity=62%"; Hit description =Integrase, catalytic region; Zinc finger, CCHC-type; Peptidase aspartic, catalytic
MLDKFNISNVKPESTPLAKHFKFFIDQCPKTDAKVEYMPKVPYASAVGCLMYNMVCTRLDLACVMTESLQQGMSLLLEDKVEVECKGHMLLGYKWGWGAGAKLPQNA

SEQ ID NO: 172255 - protein, 203 aa, Glycine max
  Coding DNA Sequence Number=SeqID_55477
  Gene Ontology: Mol. function=RNA-directed DNA polymerase activity; Biological process=RNA-dependent DNA replication
MENRIDTMEERLGNVEATVVEIRQLLREQNERPRRRQGRPLGRGDPRNNDDDGSDSSTLSHGSRFRPRRHGGGNERRYFGGRRKLEIPVFKGDDAYGWLVRVERYFRLNEVREHDKVDAVMIAMEDRALNWFQWWEDQTPLRSWEEFKEAVIRRFQPGILHNPLGPLLSLKQDSTVMEYREKFEMLVAPLRREERGMLDIYSS

SEQ ID NO: 172256 - protein, 623 aa, Glycine max
  Coding DNA Sequence Number=SeqID_55478
  Gene Ontology: Mol. function=protein serine/threonine kinase activity; Cellular component=mitochondrion; Biological process =protein amino acid phosphorylation
  Homolog annotation: Hit_ID=Q2R4L1; Match level="QueryCoverage=94%, HitCoverage=95%, E-value=1e-152, Identity=48%"; Hit description =Protein kinase domain containing protein, expressed
  Pfam annotation: Domain name=DUF26; Domain location=195-248; Score =44.8; E_value=2.9e-10; Accession=PF01657.8; Description=Domain of unknown function DUF26
  Pfam annotation: Domain name=DUF26; Domain location=84-138; Score =50.3; E_value=6.6e-12; Accession=PF01657.8; Description=Domain of unknown function DUF26
  Pfam annotation: Domain name=Pkinase; Domain location=325-578; Score =114.2; E_value=3.8e-31; Accession=PF00069.15; Description=Protein kinase domain
  Pfam annotation: Domain name=Pkinase_Tyr; Domain location=325-578; Score=120.0; E_value=6.7e-33; Accession=PF07714.7; Description =Protein tyrosine kinase
  Pfam module annotation: Pfam domain module=DUF26::DUF26::Pkinase::Pkin ase_Tyr; Domain location=195-248::84-138::325-578::325-578
MILQQIIKLLTLTLIWWSSINVECAVAGTRDTRVINSGCSTINASNPGSFFGNVNETISELRGEIRNQSLHFGTSLKSKGDVNTYTMFQCRNYLSRNDCLACINTASTQIRDICKKANGARLIYNDCFLRYESERFYQQTNEIGGGVTCGNKSTNATGFREVGQQALLDLQKATPKIKGFYAATKTQVAGGSANIYAIAQCVETASPQKCLDCMQVGYNNLQSCLPSTDGSAYDAGCFMRFSTTPFFADNQTINIRPYLKEGGSSKKWAIIGGVVGGVVLLLVLFAWRLFTKPKRAPKADILGATELKGPVSFKYKDLKAATKNFSADNKLGEGGFGAVYKGTLKNGKVVAVKKLMLGKSSKMEDDFESEVKLISNVHHRNLVRLLGCCSRGPERILVYEYMANSSLDKFLFARGLAYLHEEFHVSIIHRDIKTGNILLDDYLQPKIADFGLARLLPRDRSHLSTKFAGTLGYTAPEYAMQGQLSEKADTYSYGIVVLEILSGQKSTNVKVDDEGREYLLQRAWKLYERGMQLELVDKDIDPNEYDAEEAKKIIEIALLCTQASAAARPTMSELIVLLKSKSLVEHLRPTMPVFVETNMMNQEGGSSPGTSNATISISVLSAR

SEQ ID NO: 172257 - protein, 144 aa, Glycine max
  Coding DNA Sequence Number=SeqID_55479
  Pfam annotation: Domain name=Chromo; Domain location=9-61; Score =47.5; E_value=4.4e-11; Accession=PF00385.14; Description='chromo' (CHRromatin Organisation MOdifier
MNENWQLEPEPEEALDTRKNEQGVVEVLVKWKDLPDFENSWEPVEKLRSEFPGFLLEGKKSFEGGGIDKQQIVYTRKHGKGSVGDHPTRGVAERERRAVTLYAEGIISSGGHVWIQLETAWEFSKQLEMLSLFSAFFISIVHPL

SEQ ID NO: 172258 - protein, 136 aa, Glycine max
  Coding DNA Sequence Number=SeqID_55480
MKCHHLVDYKFLYGVLASRFINNFNVDVSIKIVDFTKASSEITKRHLKKLGMRFVDHEWIMGGIQNHAKIEGQKGHVCNILEYHLPSLATNSHGLVKFLQTYSNKPVARNIEGMEEDAKDEAPQGLHINGVLLSPL

SEQ ID NO: 172259 - protein, 141 aa, Glycine max
  Coding DNA Sequence Number=SeqID_55481
MLVFDAYSLEKVTKVMEMTTKLALNNSDTGESPLSVPITTKKLVVSKMPQTNTSSKTPKPRNQGVGSGYILCGTSKAYIYLGCNTENKRGYISCGSAQVERTSTWLFKENKGGYIPCGSLLVKDFIRLLEISRTVGCLGTG

SEQ ID NO: 172260 - protein, 43 aa, Glycine max
  Coding DNA Sequence Number=SeqID_55482
MAVLLLGGPVATSAAAISQEDEKKACCSLAECSLFCNANQQVY

SEQ ID NO: 172261 - protein, 101 aa, Glycine max
  Coding DNA Sequence Number=SeqID_55483
MVSSHWHKWHVHRCGMTELEGGRGSLQQQGFSNVGMRRVAKEEEEEDEESEMETEIGTEGLWWKKCEPFGEAWSFSGSAVGMLNESSERPVTKVLWWWQGK

SEQ ID NO: 172262 - protein, 63 aa, Glycine max
  Coding DNA Sequence Number=SeqID_55484
MKRVATFETGSLRKKVCLCDTDYRRNAALCRLSVCSMLLRWVEDAVVRYLTRKNARSDAPGNI

SEQ ID NO: 172263 - protein, 46 aa, Glycine max
  Coding DNA Sequence Number=SeqID_55485
MMLMCHMTLVALKLAKVINFRLTDGYLMGEAWSLELLAWRKIKVVL

SEQ ID NO: 172264 - protein, 61 aa, Glycine max
  Coding DNA Sequence Number=SeqID_55486
MQNYQHAKRSNSAKARINRKLIASDSSESVNFESTQGSDSNFLTAYEDCQSPTNQPVINTE

SEQ ID NO: 172265 - protein, 464 aa, Glycine max
  Coding DNA Sequence Number=SeqID_55487
  Gene Ontology: Mol. function=transcription coactivator activity; Cellular component=nucleus; Biological process=chromatin modification
  Homolog annotation: Hit_ID=Q1T094; Match level="QueryCoverage=97%, HitCoverage=87%, E-value=1e-127, Identity=52%"; Hit description =SWIB/MDM2
  Pfam annotation: Domain name=SWIB; Domain location=270-345; Score =81.3; E_value=3e-21; Accession=PF02201.9; Description=SWIBMDM2 domain
MNHLLSQTQPQPQGATSHFHGHFQLSQPQTHVLAPQQQPHPHPHPQVHNNANTNAHVAAPTPPKRASQKPPSRPQGSSNASQSSAFKTMELTVAPPRKKRSFPYNKVVPEKVAKLVPESAIYAKLLGLETQIDSALARKKIDVQENVRNPRCVRKTLRVYVYNTFSNQVKVEPGKNGVEEPSWALRITGRVLEDGKDSVAEGISTKEYPKFSAFFKKITIYLDQGLYQDNHVVVWDSARSAAAQQRDGFEVKRKGDKEFTAVVRMAMNYSPDKFVVSPQLARVLGVEFDSRARIIAALWHYVKAKKLQSPNDPSFFMCDTSLQKVFGEDKMKFSVASQKISQHLSQPRPIHLEHKIKLSGNGPAGSTCYDVQVDVPLPLEKDMSAFLASTERHKDIDAFDELICDSIKKIHEHHRRRAFFLGFSQSPAEFINALIASQSKDLKLVAGDVSQNTENANVLILHQP

SEQ ID NO: 172266 - protein, 42 aa, Glycine max
  Coding DNA Sequence Number=SeqID_55488
MEGNYGVGRFQTEEKGATVVAVLDGGSMEDSRGIFENKEVQE

SEQ ID NO: 172267 - protein, 288 aa, Glycine max
  Coding DNA Sequence Number=SeqID_55489
ERVRPRFCRGSPRVDLGFDEPPWVFLALLFLEKQPPCRRFPDLDKDHDICVGYKSKRNFVGFKDDLVSYLRLTVGLGVFDRGYEMLDTQTVPRGAHAMEIIRRGAWNVCEFLASSAPLCEIEDLFMKFSHDIVWLLAVQAFKQGLECSLNDGLEMPSLFGASQLGEQSNIYWQLALGQAGSFDVELESLLQSEIVKPFKDDACSTSLHIGHFVHVEVPPVWGGLVIASKVCHELGLHGVVQFILEAPSRGNKFQRYLLNHLVPLLGIMEDVAGEIDGKLMFHVFLYEG

SEQ ID NO: 172268 - protein, 51 aa, Glycine max
  Coding DNA Sequence Number=SeqID_55490
DSLEEQASQGSFVPHGRQDVLTVAIGRPEHPCRVRAAGADVTIKQYFGFAP

SEQ ID NO: 172269 - protein, 109 aa, Glycine max
  Coding DNA Sequence Number=SeqID_55491
MVHNLSNFYRAKSKCLCKVTETIQFIWKRLCEGCYRMWFIFQPAFKLISSLLLTKFKCFEGKLMEKVEEKVEDWDSLLSVQDRPNTFPRIAASSRLVQKPALSARSHEN

SEQ ID NO: 172270 - protein, 141 aa, Glycine max
  Coding DNA Sequence Number=SeqID_55492
  Gene Ontology: Mol. function=hydrolase activity, hydrolyzing O -glycosyl compounds; Biological process=carbohydrate metabolic process
  Homolog annotation: Hit_ID=Q6ZI46; Match level="QueryCoverage=84%, HitCoverage=29%, E-value=1e-24, Identity=46%"; Hit description =Putative cellulase
MPKGAEAVHAANPDVLMILSGLNFDMNLSFIRNEAVKLSFNGKLMFEVHYYSFSDGQALTSGNPNQVCGQVTENVMTRAGFSLDQGWPLFVSEFGVDLRATSVNNNRHEAYLEWQPEAMQSGTEKEESRGNVVAVTIGFQR

SEQ ID NO: 172271 - protein, 115 aa, Glycine max
  Coding DNA Sequence Number=SeqID_55493
MVEEGNVTDILDSKVETYENDQRLLPARNNTNYQQSWSLWHLLDYRLPNMPVLNRSIFSSRIRAGVDPPKNKNLAGKFKQESVSALKPEYLDHALPNFKTLLSCLKLEQMLNYIG

SEQ ID NO: 172272 - protein, 58 aa, Glycine max
  Coding DNA Sequence Number=SeqID_55494
MGNDLGSLPSYCILILIISAFMATSLSFACFSTAALVARRKEYLYCLLLGSPCHHCES

SEQ ID NO: 172273 - protein, 203 aa, Glycine max
  Coding DNA Sequence Number=SeqID_55495
  Homolog annotation: Hit_ID=Q84VH5; Match level="QueryCoverage=79%, HitCoverage=27%, E-value=3e-69, Identity=73%"; Hit description =Envelope-like protein
HQIAKGITAKQVQHWPKKGKLSAGKLSVKYAILHRIGAANWVPTNHTSTIATESFAVKLPIAFPTVLCGIMLSQHPDMLNYTDSVMKRESPLSLHYKLFEGTHVPDIVSTSGKAAASGAVSKDALIAELKDTCKVLEATIKATTEKKMELERLIERFSESGIDDEEAAEEEGEAAEEEEEAAEEEEDAAEDTESDDDDSEATP

SEQ ID NO: 172274 - protein, 323 aa, Glycine max
  Coding DNA Sequence Number=SeqID_55496
  Gene Ontology: Mol. function=nucleotide binding; Biological process =fatty acid biosynthetic process
  Homolog annotation: Hit_ID=Q7XYY0; Match level="QueryCoverage=80%, HitCoverage=62%, E-value=1e-126, Identity=86%"; Hit description=AKIN gamma
  Pfam annotation: Domain name=CBS; Domain location=162-300; Score =94.5; E_value=3.3e-25; Accession=PF00571.18; Description=CBS domain
  Subcellular localization annotation: CTP_CleavageSite=37; ConfidenceScore=5.30e-01
MPRIESSTTIISAMNVQLSEPTSPRCPSTPSSARAIAAAANGAAFALELEALGLGSAATTAGNFFEDLTSSELYKNTKVRDISGTFRWAPFLALERSNSFLTMLLLLSKYKMKSVPVLDLGSGTIDNIITQSAVIHMLAECAGLQWFESWGTKKLSEVGLPLVTGNQIIKVYEDEPVLQAFKVMRKKRVGGVPVIERETKKAVGNISLRDVQFLLTAPEIYHDYRGITVKNFLTEVRSYLEKNKNASPMLSEYVTCKKDCTIKELIQLLDQEKIHRVYVVEDDGDLQGLITLRDIISRLVHEPRGYFGDFFDGVLPLPANTRV

SEQ ID NO: 172275 - protein, 379 aa, Glycine max
  Coding DNA Sequence Number=SeqID_55497
  Gene Ontology: Mol. function=hydrolase activity
  Homolog annotation: Hit_ID=Q8VXF4; Match level="QueryCoverage=97%, HitCoverage=65%, E-value=1e-148, Identity=63%"; Hit description =Putative metallophosphatase
MKIEERVNMNLVLVVAWLVQLNIVYGFAHIHGFGEQPLSRIAIHKAVVSLHSSASITATPSLLGTKGEDTQWVTVDIDYPDPSADDWVGVFSPAKFNASTCPPVNDPKEVIPYICSAPIKPKLVAVSNFISFVNPKVPLYPRLAQGKSWDEMTVTWTSGYDINEATPFVEWGPKGKTQVQSPAGTLTFGRNSMCAGSSPARTVGWRDPGFIHTSFLKNLWPNLVYTYQLGHLLSNGSYIWSKKYSFKSSPYPGQDSLQRVIIFGDMGKAERDGSNEYNAYQPGSLNTTDQLIKDLENIDIVFHIGDITYANGYLSQWDQFTAQVEPIASTVPYMIASGNHERDWPNTGSFYSTTDSGGECGVLAQNMFFVPAENRANFW

SEQ ID NO: 172276 - protein, 140 aa, Glycine max
  Coding DNA Sequence Number=SeqID_55498
SHVQPGSYECGYYVMHWMWCIVSGGLKNKWNKFFSDGTPLDEETMTTLRKKWAAYFLQLQKMDVSGIRIMVLHFTHCVIKNNKNKLKKRIPWMVYTTGKEVNLEHFIKSPTNIVVLEGECLDAGGDGGELESFLLSMTDL

SEQ ID NO: 172277 - protein, 106 aa, Glycine max
  Coding DNA Sequence Number=SeqID_55499
  Gene Ontology: Mol. function=identical protein binding; Cellular component=cytoplasm; Biological process=negative regulation of enzyme activity
  Homolog annotation: Hit_ID=Q9ZSP5; Match level="QueryCoverage=86%, HitCoverage=13%, E-value=5e-24, Identity=72%"; Hit description =Subtilisin-like protease
MVERKDPIKDARQVFGLNPRILVMKGEDPSQNGGVESVKQKINFTATGSLLEQDISTKSLVYVTMNVAGSHTLSTAGGNFVPGASVFGFGNGIASAGSPKARVAVL

SEQ ID NO: 172278 - protein, 161 aa, Glycine max
  Coding DNA Sequence Number=SeqID_55500
  Gene Ontology: Mol. function=identical protein binding; Cellular component=cellulose and pectin-containing cell wall; Biological process=negative regulation of enzyme activity
  Homolog annotation: Hit_ID=Q1S4Q1; Match level="QueryCoverage=74%, HitCoverage=15%, E-value=1e-25, Identity=46%"; Hit description =Protease-associated PA; Proteinase inhibitor I9, subtilisin propeptide
MYPLSILAALIATMELLFLRRQREKCWSVLVVELTRATTVPSLFYGKPYTCPKSFSLADFNYPAITIPQLDPGHSLNVTRTVTNVGSPRTYRVHIKAPPQVVVTVEPRKLRFKKKGERKELRVTLTLKPQTKNTTDYVFGWLTWTDHKHHVRSPIAVKIAH

SEQ ID NO: 172279 - protein, 184 aa, Glycine max
  Coding DNA Sequence Number=SeqID_55501
  Gene Ontology: Mol. function=catalytic activity; Cellular component =cytoplasm; Biological process=ubiquitin cycle
  Homolog annotation: Hit_ID=Q6K6K7; Match level="QueryCoverage=78%, HitCoverage=29%, E-value=5e-39, Identity=62%"; Hit description =Putative Ubiquitin activating enzyme
  Pfam annotation: Domain name=ThiF; Domain location=84-167; Score =10.8; E_value=4.3e-07; Accession=PF00899.11; Description=ThiF family
MEVELKELHADLQSLSQSLPDPSHHDLLRKIQLRVGDLAKLAEAAPVRRSKVEDMSAEVVDSNPYSRLMALQRMGIVDNYERIRDFSVAIVGVGGVGSVAAEMLTRCGIGRLLLYDYDKVELANMNRLFFRPDQFQELPCIHTIIAQYNVLTFQVGMTKTDAAVQTLSDINPDVALEASILHCI

SEQ ID NO: 172280 - protein, 1282 aa, Glycine max
  Coding DNA Sequence Number=SeqID_55502
  Gene Ontology: Mol. function=nucleoside-triphosphatase activity; Cellular component=integral to membrane; Biological process=transport
  Homolog annotation: Hit_ID=Q1SFG0; Match level="QueryCoverage=95%, HitCoverage=99%, E-value=0.0, Identity=59%"; Hit description =Glycoside hydrolase, family 10; DNA repair protein RadA
  Pfam annotation: Domain name=ABC2_membrane; Domain location=541-739; Score=163.0; E_value=7.5e-46; Accession=PF01061.14; Description=ABC -2 type transporter
  Pfam annotation: Domain name=ABC_tran; Domain location=216-439; Score= 61.2; E_value=3.5e-15; Accession=PF00005.17; Description=ABC transporter
  Pfam annotation: Domain name=ABC_tran; Domain location=894-1081; Score=87.8; E_value=3.3e-23; Accession=PF00005.17; Description=ABC transporter
  Pfam annotation: Domain name=DUF258; Domain location=105-306; Score= -182.2; E_value=0.094; Accession=PF03193.7; Description=Protein of unknown function, DUF258
  Pfam annotation: Domain name=PDR_assoc; Domain location=744-790; Score=61.3; E_value=3.2e-15; Accession=PF08370.2; Description=Plant PDR ABC transporter associated
  Pfam module annotation: Pfam domain module=ABC2_membrane::ABC _tran::ABC_tran::DUF258::PDR_assoc; Domain location=541-739::216 -439::894-1081::105-306::744-790
FFDHINEDSNNQSDDQSDDEGAGRPTTPPSPPLQYHQPRSMESSDISRVDSARASGSNIWRNNSMDVFSTSEREDDEEALKWAAIERLPTYLRIRRSILNNEDGKGREVDIKQLGLTERKIIVERLVKIAEEDNERFLLKLRERMDRVGLDIPTIEVRFEHINVEAQVYVGGRALPSMLNFFANVIEGFLNYLHIIPSPKKPLRILQNVSGIIKPRRMTLLLGPPGSGKTTLLLALAGKLDKDLNHSGRVTYNGHGLEEFVPQRTSAYISQYDNHIGEMTVRETLAFSARCQGVGQNYEMLAELLRREKHAKIKPDPDIDAYMKAAALGRQRTSVVTDYILKILGLEVCADIMVGDGMIRGISGGQKKRVTTGEMLVGPIKVLFMDEISTGLDSSTTFQIINSIRQSIHILNGTALVSLLQPAPETYELFDDIILLTDGQIVYQGPRENVVEFFESMGFKCPERKGVADFLQEVTSIKDQWQYWARKDEPYSFVTVKEFTEAFQLFHIGQNLGEELACPFDKSKCHPNVLTTKKYGVNKKELLRACASREFLLMKRNSFVYIFKVTQLIYLAVMTTTLFLRTKMHRNTVEDGGTYMGALFFAVTVAMFNGISELNMAIMKLPVFYKQRDLLFYPAWAYSLPPWILKIPIALIEVAIWEGISYYAIGFDPNFMASSLFRLMAAFGRDVIVANTVGSFALLIVLVLGGFVISRENVHKWFVWGYWSSPLMYGQNAIAVNEFLGHSWRKVTPNSNETLGVLILKTRGFFPEAYWYWIGVGALIAFRKDQAGLSQEKLIERNASTAEELIQLPNGKISSETKIVEEANLPSRSFSGRLSDDKANRSGRKGMVLPFQPLSLTFDEIKYSVDMPQEMKKQGVFEERLELLKGVSGVFRPGVLTALMGVSGAGKTTLMDVLAGRKTGGYIEGGITISGYPKRQETFARISGYCEQFDIHSPNVTVYESLLYSAWLRLPREVDHATRKVQMFIEEVMELVELNSIREALVGLPGENGLSTEQRKRLTIAVELVANPSIIFMDEPTSGLDARAAAIVMRTVRNTVNTGRTVVCTIHQPSIDIFDAFDELGGEQIYAGPLGHHCSDLIQYFEAIQGVPKIKEGYNPATWMLEVTSAGTEASLKVNFTNVYRNSELYRRKEQDLFNAMGSMYAAVTFIGVQNGASVQPIIAVERTVFYRERAAGMYSALPYALAQWYYWICPVAWTLNGLVASQYGDNRDKLENGQRVEEFVKSYFGFEHEFLGVVAIVVAGFSVLFALIFAFGIKVFNFQKR

SEQ ID NO: 172281 - protein, 224 aa, Glycine max
  Coding DNA Sequence Number=SeqID_55503
MAREWRPAFCMLICSLDGQWNHDPWFKEDHFVDSVRFSIVPVEGDSHILPFYLDLLLVLSQYPMFSYMCVSSTPPSPSLSSAATDIVMMVEEYVSPSPNSEIPLSTYLLYDPVAQTSFLMLVHPIGWIPVLDDYADDDNDEEEDPWVMSEGMIVGCVTAEHVVKSFQGERGRGAAIAAGEMGGDRRERVAVAGQGGEGSATGFCGIGAKKTRLSSWRDRGLFMA

SEQ ID NO: 172282 - protein, 183 aa, Glycine max
  Coding DNA Sequence Number=SeqID_55504
MTTRVSASTNSSFPSLSMTEEDQSNLSDNFAIDFLGILKLNFDLYFLKQSQEFVETITRSKGGGNRKSNNSSGNNNTKSQKRGSDVKSALFVEGSFLFGWHLPSHTQNLGRIFGSNNKSGSQHKAEEESASKSGFAKSSGRVEDMNEVLLEMEDSGFLSFVFDDHSNSAGFKGLKRLKRFWPN

SEQ ID NO: 172283 - protein, 215 aa, Glycine max
  Coding DNA Sequence Number=SeqID_55505
  Gene Ontology: Mol. function=nucleic acid binding; Cellular component= cytoplasm; Biological process=DNA integration
  Homolog annotation: Hit_ID=Q1S4N1; Match level="QueryCoverage=98%, HitCoverage=52%, E-value=2e-45, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MARCLLHDKDLPKKFWAEATSTSVFLLNRLPTKALSKLTPFEAWYGFKPKLMNLKVFGCLCFSYIPQVKRDTLDKKVEAGIFVGYSSTSKAYRIFLPQSNKVIVSRDVLFFEEEKWSKESEKLQVQEESEEDVDDQPVRGTRSLSNIYQRCNVAEMEHVDYNEAAISISKNPVQKQGDVQLLYCKTENQLADFLTKSLPQARFEYLRQKLGVCCR

SEQ ID NO: 172284 - protein, 658 aa, Glycine max
  Coding DNA Sequence Number=SeqID_55506
  Gene Ontology: Mol. function=protein binding; Cellular component =membrane; Biological process=defense response
  Homolog annotation: Hit_ID=Q6SQJ2; Match level="QueryCoverage=85%, HitCoverage=83%, E-value=8e-52, Identity=40%"; Hit description=NBS -LRR type disease resistance protein RPG1-B
  Pfam annotation: Domain name=LRR_1; Domain location=272-294; Score =5.2; E_value=30; Accession=PF00560.23; Description=Leucine Rich Repeat
  Pfam annotation: Domain name=LRR_1; Domain location=365-387; Score =4.6; E_value=40; Accession=PF00560.23; Description=Leucine Rich Repeat
  Pfam annotation: Domain name=LRR_1; Domain location=388-411; Score =8.5; E_value=7.4; Accession=PF00560.23; Description=Leucine Rich Repeat
  Pfam annotation: Domain name=LRR_1; Domain location=413-436; Score =10.5; E_value=3.1; Accession=PF00560.23; Description=Leucine Rich Repeat
  Pfam annotation: Domain name=NB-ARC; Domain location=436-654; Score= -83.0; E_value=5.3e-05; Accession=PF00931.13; Description=NB-ARC domain
  Pfam module annotation: Pfam domain module=LRR_1::LRR_1::LRR_1::LRR _1::NB-ARC; Domain location=272-294::365-387::388-411::413-436::436 -654
MGGVGKTTLAEHVYNDSRMEEANFDIKAWNERREEWEAVQTPLNYGAPGSRILVTTRSEKVASTLNADLKEIATTIVENCKGLPLALKTIGNYEFDKDGLIELWMTENFIQCPRQSKSPGEVGEQYFDVLLSRLEVDKGKCIPKTTRHFFIFNRRGTKVKKMPMHLGELKNLQDCKYCLLLPSVGLLPFLKHLAIRGFDGIVSIGAEFYGSISLPFASLETLIFSSMKEWEEWELECPKLKGLSEQLLHSKELSVHNCGRLERIGHIISDISLEELNIISCPYSNIPMSRCYDFLQEVVITDACDSNDFSVRFLPKTLYSSTVLEDCPQVKMFSDGGFPSNLNNVQLSSFKLITSPKGTLGANTSLKRLYIRKVDVESFPDEGFLLLSLTFLEIRDCPDLKKLDYKGLCQLSSLKELRLENCPSLQCLPEEGSSSQVSQKLPSTSLVVESVIYVRDDDKEMIINWLTYETGNYKQLSIISIVGMSGVGNTTLAQHVYNDTRMEEADFVIKAWVCVYDDFDVLTLTRTILEAITKSKDDSGYLEMGGRRRFCGKVEGKSSLIVQSIPSCIMGCFKLPQSLCDDIDKMMARFFLGGVAAAFNKELLARKWWHLINFEDSLVAPLLKAKYYPHKGPLEASRGHRLSYIWSNIMSSRDLMMD

SEQ ID NO: 172285 - protein, 218 aa, Glycine max
  Coding DNA Sequence Number=SeqID_55507
  Gene Ontology: Mol. function=hydrolase activity; Cellular component =cytosol; Biological process=pyrimidine nucleotide metabolic process
  Homolog annotation: Hit_ID=Q1PEH3; Match level="QueryCoverage=99%, HitCoverage=97%, E-value=2e-95, Identity=76%"; Hit description =Cytidine/deoxycytidylate deaminase family protein
  Pfam annotation: Domain name=dCMP_cyt_deam_1; Domain location=58-176; Score=121.9; E_value=1.7e-33; Accession=PF00383.13; Description =Cytidine and deoxycytidylate deaminas
  Subcellular localization annotation: CTP_CleavageSite=25; ConfidenceScore=5.09e-01
MNSREATLAATATVIGALASAIGFRFFYRSQTHAKSSLNGTVFSPRDPFDPSKRKGYLSWDDYFMAIAFLSAERSKDPNRQVGACLVSQDGVILGIGYNGFPRGCSDDKLPWAKKSRTGNPLETKYPYVCHAEVNAILNTNHASAAGQRLYVTMFPCNECAKIIIQSGVSEVIYFVEKRLENSDTAYIASHKLLSLAGVKVRKHQPLMNEIHLKFEEH

SEQ ID NO: 172286 - protein, 81 aa, Glycine max
  Coding DNA Sequence Number=SeqID_55508
MAQSYFRPRRPLIWSRLSLSKSWFRWVDWCRYKHTIVVFCDKNSCDLVLIGARATQVEVETKWCKHKKRSGGGATHEDEVW

SEQ ID NO: 172287 - protein, 106 aa, Glycine max
  Coding DNA Sequence Number=SeqID_55509
MNDDNVPSTGLRMLFMETIDMSICFEGLIFGQKGYRQKVKDIVQGALFPEAGIDNRVGHAGGNMLNAKSHMEKSDCEGMLNVSHALSTRLLSYSLRAAIALSVKVA

SEQ ID NO: 172288 - protein, 97 aa, Glycine max
  Coding DNA Sequence Number=SeqID_55510
MSCLLAYFTCVPNYHVHIFEALYATCVMLAAGVSLSEACALSENHVLSEALSPLSELGESRGESEKHLRAQHVISEAFVSSCSKHAQLAQRIFTNSR

SEQ ID NO: 172289 - protein, 256 aa, Glycine max
  Coding DNA Sequence Number=SeqID_55511
MAFKKRKATTSQPQEPYDTTRFTFEGAWERHSQNIHSRNILLERNVNLFVTEYDEFRREMIRRNWHKVLTQFMDGHIDVALFDAASLNAFLEMPSVIQPGEQRTLEAPEEGSDDTGPDLECALILQPCPHFSHASYEDGHGCGLPHLASDFLDGPIQLLETRLSSPHFRTLRGLRRTCKARARGSEGPSSAALPAPAPSTTPAPSSSSLVQTDTSTPPSSVPAYTWDPWLVTDQETPQPAQDAPSSPHGEPAPAQD

SEQ ID NO: 172290 - protein, 81 aa, Glycine max
  Coding DNA Sequence Number=SeqID_55512
MKLPKAVKPYFWQFRLPRLAQFKLTCLAGRLAQPNPKIWHSKEEIALSAKGLLSKTPSANEQGLLRLAQEVTRSARKGPFA

SEQ ID NO: 172291 - protein, 202 aa, Glycine max
  Coding DNA Sequence Number=SeqID_55513
  Gene Ontology: Mol. function=RNA-directed DNA polymerase activity; Biological process=RNA-dependent DNA replication
MEVQVGQLAKKLAERSTRSFVANIEKNPKEVARRFSLEAKGGRMLRKKKGLSEYWRMNLRIAPTRMTLQLANHSITRPYGVVEDVLVKEKDLKACLEDLDRLKDISLGEYAFEELKKDNLAEKPKMELKVVPNHLKYVFLEEDEDKPVVINNDLSSVEEARLVEVLKKHKKAIGWHISYLKGINLSYCIHKTMMEDDYRPVR

SEQ ID NO: 172292 - protein, 213 aa, Glycine max
  Coding DNA Sequence Number=SeqID_55514
  Gene Ontology: Mol. function=protein serine/threonine kinase activity; Cellular component=integral to membrane; Biological process=protein amino acid phosphorylation
  Homolog annotation: Hit_ID=Q9FGN6; Match level="QueryCoverage=65%, HitCoverage=16%, E-value=3e-38, Identity=57%"; Hit description =Receptor protein kinase-like
  Pfam annotation: Domain name=Pkinase; Domain location=11-200; Score= -114.6; E_value=0.098; Accession=PF00069.15; Description=Protein kinase domain
  Pfam annotation: Domain name=Pkinase_Tyr; Domain location=11-207; Score=-168.9; E_value=0.042; Accession=PF07714.7; Description =Protein tyrosine kinase
  Pfam module annotation: Pfam domain module=Pkinase::Pkinase_Tyr; Domain location=11-200::11-207
MTSLSATTKPTEVQSPSVTKAVLPTGIAVLVKKIEWEERSSKVASEFIIRLGNARHKNLVRLLGFCHNPHLFYLLYDYLPNGNLAEKMEMKWDWAAKFRTVVGIARGLCFLHHECYPTIPHGDKKASNIVFDENMEPHLVEFGFKQVLRWSKGSSPTTNKWETGASSTARNGCWRGTARFEGDLEGERGLRESSRLRERGVRPRQNNGGGNKG

SEQ ID NO: 172293 - protein, 136 aa, Glycine max
  Coding DNA Sequence Number=SeqID_55515
SEYQGSVWRKGQRPWQIKANGLSFIDILALLIFGVVLFPNMEGLVDLAAIDAFLAFHHGKESPVVAILAMYDTFDRGCPSIRYKVTARASKRERESRTSPIASQGQSSGGHLLRPRGDPQTSQLLSAYDRLNGPYD

SEQ ID NO: 172294 - protein, 342 aa, Glycine max
  Coding DNA Sequence Number=SeqID_55516
  Gene Ontology: Mol. function=pyridoxal phosphate binding; Biological process=metabolic process
  Homolog annotation: Hit_ID=Q2R457; Match level="QueryCoverage=91%, HitCoverage=90%, E-value=9e-85, Identity=51%"; Hit description =Expressed protein
MVEDEAKDIKNVPLGPIHKLIAENTKSNSLVIKKPHVVIPPHIIAEAISTIRDIDIRWSGPITQKEMEYVEQYVLAKYPEYAGLIEGDGNGIDMSSFIINEEPSEPLSDDRKKSPRGTFREPLFGSNLPEMDKTQLEPSRLLDILNKKSSFPGSFISIPEIQAQNKVLKHCGLPDDEYLVLFTPSYKDAMMLVGESYPFVKGNYYMTILGEEKDYIREFASFKESKVILAPKTWLDLRIRGSQLSQNFRRKCKVSLKGLFAYEADVNGTNHWVSEAHRNYWHVLLDASALVLGKDRLHLGLHRPDFLVCCLHSTHSNPSRITCLLVRTKSFGTSTASSQVNG

SEQ ID NO: 172295 - protein, 310 aa, Glycine max
  Coding DNA Sequence Number=SeqID_55517
  Gene Ontology: Mol. function=protein serine/threonine kinase activity; Biological process=protein amino acid phosphorylation
  Homolog annotation: Hit_ID=Q2QW75; Match level="QueryCoverage=64%, HitCoverage=69%, E-value=2e-30, Identity=36%"; Hit description =Uncharacterized plant-specific domain TIGR01627 family protein, expressed
  Pfam annotation: Domain name=DUF579; Domain location=52-282; Score =311.5; E_value=1.5e-90; Accession=PF04669.4; Description=Protein of unknown function (DUF579)
  Subcellular localization annotation: CTP_CleavageSite=62; ConfidenceScore=5.12e-01
MKGMNLTKKKLIPILVLILSVISILRLLSLNVKTLPFSARISVLSPAPQHNCSQPLSTCNKTASHAPESSDQPINTPNITTTLTEKEFKVLSDLIALKSPCNLLIFGFQPQYLILSSMNAAGSTIFLDEDPDKISKVRKISNNTQIYKLEYNMPAKAGYKLLKNARLNPATCVPNPRFLQKSKCKLALKNLPSQVYEKKWDVMVVDGPNGDSPESPGRMGSIYTASVLARSGNTSDVVVHDVDRMIEKWFSWEFLCDGNLLYSKGKLWHFRIKVHSNSTRFCPAEEVAHMIQSVRQNSFQMKRDHFLQGD

SEQ ID NO: 172296 - protein, 96 aa, Glycine max
  Coding DNA Sequence Number=SeqID_55518
  Gene Ontology: Mol. function=structural constituent of ribosome; Cellular component=ribonucleoprotein complex; Biological process =translation
  Homolog annotation: Hit_ID=O65731; Match level="QueryCoverage=89%, HitCoverage=50%, E-value=9e-31, Identity=67%"; Hit description=40S ribosomal protein S5
MADEVVVVPDPTQINVTDISLADYVEVAASKHATYVPHTTEKYLVKQFSKVRCPIVESLTNSLMMHGRNNGKKLMAIRIMKHAMEIIHLLTDHNPI

SEQ ID NO: 172297 - protein, 255 aa, Glycine max
  Coding DNA Sequence Number=SeqID_55519
  Gene Ontology: Mol. function=DNA binding; Biological process=DNA integration
MSFGLCNTPATFQKCMLAILAEMLEKCAKVFMENFSVFGPSFDYCLTNLELVLRHFIEENLCKEFELMCGASNYVVGVVLGQWKDKKEMLAIVYALEKFRSYFVWDDPYLFKIGVDNQLRRCVTKEETRSILWHCHYSPCGGHYSGDRTVAKRAGGISRRNEMPLQNIIEVETNGQTEVSNRELKRILEKTDASLRKDWVVNLSIELEHKAYWQKLPLLELKEMMLNAYESSKIYKQKMKVYHDRRLLKRTLQLG

SEQ ID NO: 172298 - protein, 150 aa, Glycine max
  Coding DNA Sequence Number=SeqID_55520
MGRNEAAQIHVHLYHQPINESIMLDVDIGSVRGRSKVEVAKEAPSLGEGGEVFSQNLPRSPSMFGVNCLPSVEVLGGGMAGEAYVSLPLLKFPIEFIIHHGGELHVPLQKNVSEVKVVLVAEPSCLKNKVRGVPSGLLYLRLIGGCSMLR

SEQ ID NO: 172299 - protein, 375 aa, Glycine max
  Coding DNA Sequence Number=SeqID_55521
  Subcellular localization annotation: CTP_CleavageSite=41; ConfidenceScore=5.42e-01
MFSLASTYQLSQLCRGCSSATSAKRLQLSLSGSVYVVMVILADHVSMASRKRKNNVLGRNILPERKVEIYQIELDEFKSELERRNFHKCLTNLVDGSIDLALVKEFYANLYSSEDRPPKQSKVRGHLVKIDAESLKIFLETPVVLAEGQTLPAYSRYCRLPTDYREIEAALCIPGRGFIFNSEDHPGKILRKDLTTLAQMWSVLSYSNLAPTSHTSDLTVDRAMLIFGLVSRMDMNIGALISGQMTSIAQSSTSRLEFPALITALCRDRGVVSDSLTFERLSPFINLAYIKKNYSNPEDLTVSIRGVRRARARPTELPSTSAAPTLASTSVAPSIPAQTDSQRFEAMLHSIHQGQIILLQSLQVVASPGSIPSVE

SEQ ID NO: 172300 - protein, 73 aa, Glycine max
  Coding DNA Sequence Number=SeqID_55522
WPETQPPLHREDEGLTAQVPQQREDESSETSMPKPLIRRKRVVETQEAAATSKKSLEDTAEPSEPVANTTSIQ

SEQ ID NO: 172301 - protein, 226 aa, Glycine max
  Coding DNA Sequence Number=SeqID_55523
  Gene Ontology: Mol. function=undecaprenyldiphospho-muramoylpentapeptid e beta-N-acetylglucosaminyltransferase activity; Cellular component=1- 2nm peptidoglycan-based cell wall; Biological process=UDP-N -acetylgalactosamine biosynthetic process
  Homolog annotation: Hit_ID=Q47AA4; Match level="QueryCoverage=98%, HitCoverage=63%, E-value=1e-57, Identity=50%"; Hit description=UDP-N- acetylglucosamine--N-acetylmuramyl-(pentapeptide) pyrophosphoryl -undecaprenol ...
  Homolog annotation: Hit description=N-acetylglucosamine transferase
  Pfam annotation: Domain name=Glyco_transf_28; Domain location=1-136; Score=126.5; E_value=7.6e-35; Accession=PF03033.10; Description =Glycosyltransferase family 28 N-terminal domain
MAGGTGGHVYPAIAVADALHAQGWKIVWLATEGGMENRLIADKPYDKAMMTMQGVRGKGLMGWLTLPVKLARAFAQAREAMKQHQPDVVLGMGGFAAFPGGVMARLAGVPLVIHEQNSIAGLTNKVLAKIASRVLTGFPNALGTKGEMVGNPVREVITTLPVPEQRFAEHHGVLRVLVVGGSLGAVALNTLLPQAFAQLPVNARPQIIHQAGEKQIEALKKNYAEA

SEQ ID NO: 172302 - protein, 338 aa, Glycine max
  Coding DNA Sequence Number=SeqID_55524
  Homolog annotation: Hit_ID=Q2NNE0; Match level="QueryCoverage=97%, HitCoverage=63%, E-value=4e-47, Identity=41%"; Hit description =Calmodulin binding protein IQD22
MGFFHLQALGSKARRALRALKGLVKLQALVRGHIERKRTAEWLKRVQVLLHAQPQVSAGLILHASPSGSKLSSHLHGPETPEKFESPIRSKSMKHEHSPILKRNGSKSCVQINGYQEMCGSRSESQVNEQSWNSGRSLNRTYSSNDERNDRVLEVDSGKPHFTIKRKNLSFSTGSDLYSKSLNSTKESTSLQSGQSSCCEVQSHSYTSQKVNEVEESPFCTADNSPQYLSATSKDGGFKRSPFTPTKSDGSRSYIRGYPDYPSYMACTESSKAKARSLSAPKQRPQSEKSGSSNRYSLNGFDMSRLATQRAMQASFTNKAYPGSGRLDKLGMPVGYRF

SEQ ID NO: 172303 - protein, 369 aa, Glycine max
  Coding DNA Sequence Number=SeqID_55525
  Gene Ontology: Mol. function=protein binding; Cellular component =integral to membrane; Biological process=protein amino acid phosphorylation
  Homolog annotation: Hit_ID=Q1SWI6; Match level="QueryCoverage=50%, HitCoverage=87%, E-value=7e-46, Identity=50%"; Hit description =Leucine-rich repeat, plant specific
  Pfam annotation: Domain name=LRRNT_2; Domain location=37-77; Score =49.5; E_value=1.1e-11; Accession=PF08263.3; Description=Leucine rich repeat N-terminal domain
  Pfam annotation: Domain name=LRR_1; Domain location=124-147; Score =8.0; E_value=9.3; Accession=PF00560.23; Description=Leucine Rich Repeat
  Pfam annotation: Domain name=LRR_1; Domain location=149-171; Score =14.3; E_value=0.45; Accession=PF00560.23; Description=Leucine Rich Repeat
  Pfam annotation: Domain name=LRR_1; Domain location=173-194; Score =0.6; E_value=2.2e+02; Accession=PF00560.23; Description=Leucine Rich Repeat
  Pfam annotation: Domain name=LRR_1; Domain location=196-221; Score =11.7; E_value=1.9; Accession=PF00560.23; Description=Leucine Rich Repeat
  Pfam annotation: Domain name=LRR_1; Domain location=223-245; Score =12.2; E_value=1.5; Accession=PF00560.23; Description=Leucine Rich Repeat
  Pfam annotation: Domain name=LRR_1; Domain location=275-296; Score =11.9; E_value=1.7; Accession=PF00560.23; Description=Leucine Rich Repeat
  Pfam annotation: Domain name=LRR_1; Domain location=301-323; Score =3.6; E_value=61; Accession=PF00560.23; Description=Leucine Rich Repeat
  Pfam annotation: Domain name=LRR_1; Domain location=325-350; Score =3.4; E_value=67; Accession=PF00560.23; Description=Leucine Rich Repeat
  Pfam annotation: Domain name=LRR_1; Domain location=352-366; Score =0.6; E_value=2.2e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=37 -77::124-147::149-171::173-194::196-221::223-245::275-296::301 -323::325-350::352-366
MKCSKVQDENIENLEMDLMVWAMLWLFSLPCRESVCIPSERETLLKFKNNLIDPSNKLWSWNHNNTNCCHWYGVLCHNLTSHVLQLHLHTYDSAFDHSYGFDVNAYERSQIGGEISPCLADLKHLNYLDLSANEFLGTAIPSFLGTMTSLTHLDLSDSGFYGKIPPQIGNLSNLVYLDLREVANGRVPSQIGNLSKLRYLDLSDNYFLGEGMAIPSFLGTMSSLTQLDLSYTGFMGKIPSQIGNLSNLLYLGLGGHSSLEPLFVENVEWVSSMWKLEYLDLSYANLSKAFHWLHTLQSLPSLTHLYFSECTLPHYNEPSLLNFSSLQTLHLYNTSYSPAISFVPKWIFKLKKLVSLQLQGNEIQGPIPG

SEQ ID NO: 172304 - protein, 1390 aa, Glycine max
  Coding DNA Sequence Number=SeqID_55526
  Gene Ontology: Mol. function=RNA-directed DNA polymerase activity; Cellular component=chromatin; Biological process=chromatin assembly or disassembly
  Pfam annotation: Domain name=Chromo; Domain location=1275-1321; Score= 28.6; E_value=2.2e-05; Accession=PF00385.14; Description='chromo' (CHRromatin Organisation MOdifier
  Pfam annotation: Domain name=RVP_2; Domain location=237-352; Score= -44.0; E_value=0.0027; Accession=PF08284.2; Description=Retroviral aspartyl protease
  Pfam annotation: Domain name=RnaseH; Domain location=743-862; Score= -25.9; E_value=0.015; Accession=PF00075.14; Description=RNase H
  Pfam annotation: Domain name=rve; Domain location=996-1152; Score =98.1; E_value=2.6e-26; Accession=PF00665.16; Description=Integrase core domain
  Pfam annotation: Domain name=zf-H2C2; Domain location=937-978; Score =23.6; E_value=0.00026; Accession=PF09337.1; Description=His(2) -Cys(2) zinc finger
  Pfam module annotation: Pfam domain module=Chromo::RVP_2::RVT _1::Retrotrans_gag::RnaseH::rve::zf-H2C2; Domain location=1275 -1321::237-352::483-652::1-85::743-862::996-1152::937-978
MDGRALSWFQWMNGNRQFTSWQGFLQALQTRFAPSQYEDPTGTLFKLTQRGTVAEYLAAFEELANRTIGLPPPFLLSCFVSGLTPEIRREVQAHQPLTLVQAAGLARLQEEKIMDARPQQRPKPPPPFPSPSLTQPLPLRTINPSPTPLLPSPPHPTPPAVKRLTPEEIATRRERGLCFNCDERYHRGHRCSSRVFLLISEDEDPPPLQIPQPNPQPEPETPIPDPIDPYPAQISFNSLAGNVAPETLRFMGTIGNRHVVLLVDGGSTHNFIQHQLVSQLSLIPRTTTPLRVMVGNGQQLECTSICESVPVTIQATEFIVDLHVLPIAGANVVLGIQWLKSLGPVLTDYNSLRMKFFHAGTFVELQGDTETTLNSLSSSQFHRLLQHQPESLYFHIAVLHDDTSTLNSDIDPVIQDLINRFQPLFQVPEKLPPARPTDHRIHLIPNATPVNVRPYRYPHFQKQEIENQVELMLQKGLIQPSNSPFSSPVLLVKKQDGTWRFCVDYRALNSLTVKDRFPLPTIDELLDELEGARCFSKLDLLQGYHQIRMHSGDISKMAFRTHHGHYEFRVMPFGLCNAPSSFQATMNSLFRPYLRRFIIVFFDDILIYSATFAEHLTHLEVAFQVLLSHHFVLKLSKCSFAQAQVEYLGHMVSFEGVQPVPSKISAIQQWPIPQTTRAVRSFLGLAGFYRRFIRGYASLAAPLVALTTSDKLHWSAEVQAAFDKLKCALSQAPVLALPDFSLPFQVETDASGVGMGAVLSQQGHPIAFYSKPFTAKLLRASTYVRELFAIKAAVKRWRQYLLGHRFIIVTDHKSLKELLTQAVQTPEQHTYLARLMGYDYQIVYRSGSHNQAADALSRLPEQRSSLMILSVPCLTFISELRQQLDSLPEYVAQRNAILQHPLSHPHFSITNNLILHKNRIWVPRGFPMIPTLITEYHCTPTGGHMGIAKTLARITENFYWQGLRDDVTRFVSQCLPCQQTKYETKRSAGLLCPLPVPHRPWEDLSLDFIAGLPPYHGNTVILVVVDRFSKGLHLGMLPTSQTAHAVATLFMEIVGKIHGLPRSLVSDRDPLFVSQFWQELFRYSGTQLRMSSAYHPQSDGQTEVMNRVIEQYLRAFVHSRPRTWGKLLLWVEWCHNTAWNAATSSTPYEITFGRKPFNFPDYLMGTSKIVAVEDMIKEREETLCIIRKKLLKAQGAMKKSADNKRREVVYQQGDWVLLRLRPRRQASAKGVFETKGKLAKRFYGPFEPFHGDPTSPGTNEVTKLPIQFYQNQPLAIPLAILDHRRHPQTGEWEVLVQWEGLSPDETSWEDWNSLQQDYHLEDKVTLQGPPNDRIANAEEEMNEATEDPSTQANTEESNIQVDTGEPNSKVRIASKSKRKVVRPAYLKDFV

SEQ ID NO: 172305 - protein, 691 aa, Glycine max
  Coding DNA Sequence Number=SeqID_55527
  Gene Ontology: Mol. function=protein binding; Cellular component =integral to membrane; Biological process=xylan catabolic process
  Homolog annotation: Hit_ID=Q949G8; Match level="QueryCoverage=89%, HitCoverage=86%, E-value=1e-111, Identity=29%"; Hit description =HcrVf2 protein
  Pfam annotation: Domain name=LRR_1; Domain location=116-138; Score =19.2; E_value=0.014; Accession=PF00560.23; Description=Leucine Rich Repeat
  Pfam annotation: Domain name=LRR_1; Domain location=140-162; Score =14.2; E_value=0.47; Accession=PF00560.23; Description=Leucine Rich Repeat
  Pfam annotation: Domain name=LRR_1; Domain location=164-187; Score =14.9; E_value=0.29; Accession=PF00560.23; Description=Leucine Rich Repeat
  Pfam annotation: Domain name=LRR_1; Domain location=189-212; Score =4.3; E_value=45; Accession=PF00560.23; Description=Leucine Rich Repeat
  Pfam annotation: Domain name=LRR_1; Domain location=262-284; Score =11.9; E_value=1.7; Accession=PF00560.23; Description=Leucine Rich Repeat
  Pfam annotation: Domain name=LRR_1; Domain location=304-323; Score =11.1; E_value=2.4; Accession=PF00560.23; Description=Leucine Rich Repeat
  Pfam annotation: Domain name=LRR_1; Domain location=332-353; Score =5.3; E_value=29; Accession=PF00560.23; Description=Leucine Rich Repeat
  Pfam annotation: Domain name=LRR_1; Domain location=356-378; Score =12.0; E_value=1.6; Accession=PF00560.23; Description=Leucine Rich Repeat
  Pfam annotation: Domain name=LRR_1; Domain location=380-402; Score =14.4; E_value=0.41; Accession=PF00560.23; Description=Leucine Rich Repeat
  Pfam annotation: Domain name=LRR_1; Domain location=404-426; Score =1.0; E_value=1.8e+02; Accession=PF00560.23; Description=Leucine Rich Repeat
  Pfam annotation: Domain name=LRR_1; Domain location=428-450; Score =5.0; E_value=33; Accession=PF00560.23; Description=Leucine Rich Repeat
  Pfam annotation: Domain name=LRR_1; Domain location=452-474; Score =15.6; E_value=0.18; Accession=PF00560.23; Description=Leucine Rich Repeat
  Pfam annotation: Domain name=LRR_1; Domain location=522-544; Score =10.7; E_value=2.9; Accession=PF00560.23; Description=Leucine Rich Repeat
  Pfam annotation: Domain name=LRR_1; Domain location=546-568; Score =14.4; E_value=0.43; Accession=PF00560.23; Description=Leucine Rich Repeat
  Pfam annotation: Domain name=LRR_1; Domain location=570-592; Score =14.3; E_value=0.45; Accession=PF00560.23; Description=Leucine Rich Repeat
  Pfam annotation: Domain name=LRR_1; Domain location=594-615; Score =11.6; E_value=1.9; Accession=PF00560.23; Description=Leucine Rich Repeat
  Pfam annotation: Domain name=LRR_1; Domain location=68-90; Score =18.3; E_value=0.027; Accession=PF00560.23; Description=Leucine Rich Repeat
  Pfam annotation: Domain name=LRR_1; Domain location=92-114; Score =16.9; E_value=0.071; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=116-138::140 -162::164-187::189-212:...
  Pfam module annotation: Domain location=:262-284::304-323::332 -353::356-378::380-402::404-426::428-450::452-474::522-544::546 -568::570-592::594-615::68-90::92-114
MGREFADGFFKGKGRVSHGGGINESTKMIGEELEDWFRGISAISFIVILIILRGSTKSNSYIPIRLQNIKNLDLQNNQLSGPLPDSLGQLKHLEVLNLSNNTFTCPSPSPFANLSSLRTLNLAHNRLNGTIPKSFEFLRNLQVLNLGTNSLTGDMPVTLGTLSNLVMLDLSSNLLEGSIKESNFVKLLKLKELRLSWTNLFLSVNSGWVPPFQLEYVLLSSFGIGPKFPEWLKRQSSVKVLTMSKAGMADLVPSWFWNWTLQIEFLDLSNNLLSGDLSNIFLNSSVINLSSNLFKGTLPSVSANVEVLNVANNSISGTISPFLCGKENATNKLSVLDFSNNVLYGDLGHCWVHWQALVHLNLGSNNLSGVIPNSMGYLSQLESLLLDDNRFSGYIPSTLQNCSIMKFIDMGNNQLSDAIPDWMWEMQYLMVLRLRSNNFNGSITQKICQLSSLIVLDLGNNSLSGSIPNCLKDMKTMAGEDDFFANPLSYSYGSDFSYNHYKETLVLVPKGDELEYRDNLILVRMIDLSSNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGKKVTWEIVSLHVNC

SEQ ID NO: 172306 - protein, 136 aa, Glycine max
  Coding DNA Sequence Number=SeqID_55528
  Gene Ontology: Mol. function=hydrolase activity; Biological process =metabolic process
  Homolog annotation: Hit_ID=Q1SUR0; Match level="QueryCoverage=54%, HitCoverage=26%, E-value=3e-24, Identity=77%"; Hit description=HAD -superfamily hydrolase subfamily IA, variant 3
MCMIQKLGMEAVKVTELNYPFYKTYGMTMAGLRAIGYDFDYDDFNSFVHGRLPYDVLLKPDHVLRGILQSPLVRKVLRLQARHVVKKCNRRVQIWKVKWQHKKGVKYSTNISYRNYVMFWDDKFGAHGLSAELFQA

SEQ ID NO: 172307 - protein, 192 aa, Glycine max
  Coding DNA Sequence Number=SeqID_55529
  Homolog annotation: Hit_ID=P21616; Match level="QueryCoverage=43%, HitCoverage=10%, E-value=2e-37, Identity=92%"; Hit description =Pyrophosphate-energized vacuolar membrane proton pump (EC 3.6.1.1) ...
  Homolog annotation: Hit description=(Pyrophosphate-energized inorganic pyrophosphatase) (H(+)-PPase) (Vacuolar H(+) -pyrophosphatase)
MGFLLAANGLLVLYIAINLFKIYYGDDWGGLFEAITSYGLGGSSMALFGRVGGGIYTKAANVRADLVGKVERNIPEDDLRNLALPLPHLKVGYLTAPPVGTSIAPHNDWKRSNFLLDHEKLQQRRLQFWGYSDRGKIAPSAYHMAPRSEAPSQVPPPVPEATVGAIGVSLVSVGLDGTTAKKKSDSILAREC

SEQ ID NO: 172308 - protein, 204 aa, Glycine max
  Coding DNA Sequence Number=SeqID_55530
  Homolog annotation: Hit_ID=Q1M2Z2; Match level="QueryCoverage=24%, HitCoverage=22%, E-value=6e-16, Identity=78%"; Hit description=Tubby protein
MDMLDCKRMKSSSNLEKLGRTCLQWITSTLSHHFKHLQSASTASLPRLLANDACLNMYSSENSNILKLETIFGQEMDREKTNEWSRNERAGGDVSMNLDWKTGIAAKDWDSVAKKEKIEKGQDADASSIGACRPRIFFINGFLCFLEDEWQRNKEKKRERRRHFKEKMSLEEAHHHRRPLIRAWRKKEMSEGRGREEHEILCSK

SEQ ID NO: 172309 - protein, 127 aa, Glycine max
  Coding DNA Sequence Number=SeqID_55531
MEATSGTRVLAYFGDPIKGPVVGNLGGGGGGRGREFCGPHSFTYFSLFTDQLVQCISRVTLSMNILTSSLVVVIKQLGLSYARTNTRKTRLLPTTCKAFTCTIERGVGQHRSTTFQSYLPFGPVTNK

SEQ ID NO: 172310 - protein, 238 aa, Glycine max
  Coding DNA Sequence Number=SeqID_55532
  Gene Ontology: Mol. function=protein binding; Cellular component =integral to membrane; Biological process=defense response to fungus
  Homolog annotation: Hit_ID=Q1T2W5; Match level="QueryCoverage=74%, HitCoverage=44%, E-value=3e-24, Identity=38%"; Hit description =Leucine-rich repeat
  Pfam annotation: Domain name=LRR_1; Domain location=119-141; Score =12.8; E_value=1.2; Accession=PF00560.23; Description=Leucine Rich Repeat
  Pfam annotation: Domain name=LRR_1; Domain location=148-170; Score =9.6; E_value=4.5; Accession=PF00560.23; Description=Leucine Rich Repeat
  Pfam annotation: Domain name=LRR_1; Domain location=15-40; Score=8.5; E_value=7.4; Accession=PF00560.23; Description=Leucine Rich Repeat
  Pfam annotation: Domain name=LRR_1; Domain location=172-195; Score =13.7; E_value=0.69; Accession=PF00560.23; Description=Leucine Rich Repeat
  Pfam annotation: Domain name=LRR_1; Domain location=197-225; Score =7.6; E_value=11; Accession=PF00560.23; Description=Leucine Rich Repeat
  Pfam annotation: Domain name=LRR_1; Domain location=44-67; Score=7.1; E_value=13; Accession=PF00560.23; Description=Leucine Rich Repeat
  Pfam annotation: Domain name=LRR_1; Domain location=70-92; Score =15.7; E_value=0.17; Accession=PF00560.23; Description=Leucine Rich Repeat
  Pfam annotation: Domain name=LRR_1; Domain location=95-117; Score =18.2; E_value=0.029; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=119-141::148-170::15 -40::172-195::197-225::44-67::70-92::95-117
  Subcellular localization annotation: CTP_CleavageSite=77; ConfidenceScore=5.69e-01
MSSSVFQGGFNFSSKLQNLDLHNCSLTDESFLMSSSFIMSSSSSLVSLDLSSNLLKSSTIFYWLFNSTTNLHKLSLYHNMLEGPIPDGFGKVMNSLEVLYLYGNKLQGEIPSFFGNMCALRSLDLSNNKLNGEFSSFFRNSSWCNRDIFKELDLSYNRLTGMLPKSIGFLSELEYLILAGNSLEGDVTESHLSNFSKLRYLYLSESSLSLKFVPSWVPPFQLESLGIRSCKLGPTFPS

SEQ ID NO: 172311 - protein, 111 aa, Glycine max
  Coding DNA Sequence Number=SeqID_55533
MRLKVKEVMEDIVADLKWAVVEYQSEVEEWVEYLLVVEVGRVEVALGIQNERFTKAIELSSDSLLHGAFELFILSPLLLNKAVHSQSNHLLYFSFSYYFWRSKIDLSVLTF

SEQ ID NO: 172312 - protein, 464 aa, Glycine max
  Coding DNA Sequence Number=SeqID_55534
  Gene Ontology: Mol. function=cytochrome-c oxidase activity; Cellular component=endoplasmic reticulum membrane; Biological process=GPI anchor biosynthetic process
  Homolog annotation: Hit_ID=Q6ZGZ4; Match level="QueryCoverage=97%, HitCoverage=91%, E-value=1e-105, Identity=46%"; Hit description =Putative cell division control protein CDC91
  Pfam annotation: Domain name=PIG-U; Domain location=325-464; Score =153.9; E_value=4.3e-43; Accession=PF06728.3; Description=GPI transamidase subunit PIG-U
  Subcellular localization annotation: CTP_CleavageSite=59; ConfidenceScore=5.15e-01
MKKKKVQWFWTCVLGSIVLRLILLYFPKNLNLSSRPEVSTPLTSLRHPMPNLRLLFVLPGSMYHGSPLLLTLLGPLTVKSLKFLWYNDFEYFVDATELKDNLIIFYADVVSAMLICAAGEKLKVACSSSLQSLGLHNLSENSERLPSGDFAALVYLWNPFTIVACVGLSTSAIENLMVVLSLYGACSLIAIEFTSLHPSVFLLLYLAASILDFGNARLAPLAAFGWVMATHLSLYPAILIIPVILLLGYGPDAPPRKLFCQRKNLEVGNSTPSDSCSEEEAKNQLKVANVFSWRPVVFFLFWTLLWSSYVLVLCGICVQQYGGLHELFKRTYGFILTTQDLSPNIGVLWYFFAEVFDFFRNFFLIVFHGNILLMIAPLALRLNHRPCFLAFVYIVISSMLKSYPSVGDSALYLGLLGLFAYELKDMQFSFFLFSGYVGVSLLSPVMHNLWIWRVWNFVVFYPFK

SEQ ID NO: 172313 - protein, 100 aa, Glycine max
  Coding DNA Sequence Number=SeqID_55535
METQTTLREKSAYLDNVGALKKKNEPMGQEAEEKTALQNGVGWKKKKVVKEEEEGRISSWVKLAGCTRETRRRRSQKKEEVLGAPAIMLGAPSSPPLLNL

SEQ ID NO: 172314 - protein, 290 aa, Glycine max
  Coding DNA Sequence Number=SeqID_55536
  Subcellular localization annotation: CTP_CleavageSite=27; ConfidenceScore=5.19e-01
MSSLEKNVPQRLKNSMKLMMKKTCSSCCSKKKGKFQSSNLSCPKESKNCPKESKNYLQQKKLSFLPLFHEESRPKPPKLIPRMDYAQIYVRYQATTYPPGLHISKATNIKIIANKMCPWLPIWDAFSSVYDGSDNANHHDFIQVLCPIRMYHETTTYDLTKMEERKFKDHMLKSKSRLLPKLWTKNIVHEVIIDITNTSVMDETLKLHQGEDAPDTIIIYSISSDPTPLNYAHPTAMTGNQVQEMIGQAMDSFAKQQRQVNEQFKIPMQNAITMQFSNLGVVLLQNLQQA

SEQ ID NO: 172315 - protein, 102 aa, Glycine max
  Coding DNA Sequence Number=SeqID_55537
  Gene Ontology: Mol. function=structural constituent of ribosome; Cellular component=ribonucleoprotein complex; Biological process =translation
  Homolog annotation: Hit_ID=P62299; Match level="QueryCoverage=60%, HitCoverage=42%, E-value=9e-20, Identity=76%"; Hit description=40S ribosomal protein S13
  Pfam annotation: Domain name=Ribosomal_S15; Domain location=16-92; Score=47.8; E_value=3.7e-11; Accession=PF00312.12; Description =Ribosomal protein S15
MTMRVRAFKAELKQGEVSSSTSAQHRVTSKPIPEIPEDLYHLIKKAVSIRKHLERNKKDKDSKFKLILINSRIYRLARYYKTKEAPASLEVVSSKFPPITLL

SEQ ID NO: 172316 - protein, 72 aa, Glycine max
  Coding DNA Sequence Number=SeqID_55538
MTYLHGSLALFECYLDQLMYKEHPLADLMLIGSTKEPNFQPNLGFQNEVKESCEDKHPIKSVTYKFDKTLSP

SEQ ID NO: 172317 - protein, 129 aa, Glycine max
  Coding DNA Sequence Number=SeqID_55539
  Gene Ontology: Mol. function=DNA binding; Biological process=DNA integration
  Homolog annotation: Hit_ID=Q1T035; Match level="QueryCoverage=66%, HitCoverage=10%, E-value=7e-14, Identity=46%"; Hit description =Integrase, catalytic region
MASSQSSEVGASTQHLDDPQEEASKPIRLFMRRNLLESQIIGDPIDCVQTRSSRGHTALISKVEPRHIDDVMQDDSWVKAIWEKLDQFQKNDVWKLVELLKGKKVVREKWVFHNKLDENGNVVMHLWLF

SEQ ID NO: 172318 - protein, 118 aa, Glycine max
  Coding DNA Sequence Number=SeqID_55540
  Homolog annotation: Hit_ID=Q01AD1; Match level="QueryCoverage=76%, HitCoverage=28%, E-value=2e-09, Identity=33%"; Hit description=[T] KOG1363 Predicted regulator of the ubiquitin pathway
  Pfam annotation: Domain name=UBX; Domain location=35-117; Score=86.8; E_value=6.8e-23; Accession=PF00789.11; Description=UBX domain
MSVEIIDTLPSFGKLKELETKLAAKEVSLPPEPSSDDDNAVNLMVKMPDGNRRGRRFLRSDRLQSLFDYIDIGRVVKPGNYRLVRPYPRRAFSDGESAATLDELGLTNKQEALFLELI

SEQ ID NO: 172319 - protein, 107 aa, Glycine max
  Coding DNA Sequence Number=SeqID_55541
  Subcellular localization annotation: CTP_CleavageSite=55; ConfidenceScore=5.08e-01
MDKVKVFEAHIDYISAATPFLLSLSRFRSHNHSRALILALTHRSIYSRSLTLVLSLTHERTLCWCENSATALSPQNKNIILGFQKWVYALCLLTNTSWHVLDQTHMS

SEQ ID NO: 172320 - protein, 92 aa, Glycine max
  Coding DNA Sequence Number=SeqID_55542
MARHRCHRLKLRRHVVTIIEKPHNHLDMHHHLDSKGQHQGKLIDYRYMHMPVQIQSYPPRALDRRLQEDWARDAREGPMVLLRLRVDFRPMS

SEQ ID NO: 172321 - protein, 171 aa, Glycine max
  Coding DNA Sequence Number=SeqID_55543
MMAHHFAFDVLMMPYDRDDLMSYENALLKFNSRQQSKNTRYNIKKISSILGREFQIEIAKGLTKKFKLKSLFQEIYSLVIDYQRITCKGILQDSGTLKRVAWGQDVGTRIFEVTFPTLWIFPILRRLQKLQLPKIEAWDILEKGNVGANQLKKVRFQTMRRQYELMQMEDT

SEQ ID NO: 172322 - protein, 73 aa, Glycine max
  Coding DNA Sequence Number=SeqID_55544
MSNKECVGLHFLGIMDYNNIIFRGDADWVARRRRFRVTSLVFGGAVVEVERLGLRRKEKEEVGQQAYVMGRCP

SEQ ID NO: 172323 - protein, 89 aa, Glycine max
  Coding DNA Sequence Number=SeqID_55545
  Gene Ontology: Mol. function=nucleic acid binding
MRVSGDEVLITKTKSQLAQELADRSITRSYGVAEDVLIKVRQFTFPVDFVITDKEEDSDIPLILGRPFMLTAKCVVDMRNKNLEMSVED

SEQ ID NO: 172324 - protein, 80 aa, Glycine max
  Coding DNA Sequence Number=SeqID_55546
MGFGDGVRSRRRCLSGLGGPNEKMEQRLGLTWQVVIRGGWLEQIVLVCKDWEKVNNAILSPKGIGYKTSKRLGQRCKRRP

SEQ ID NO: 172325 - protein, 161 aa, Glycine max
  Coding DNA Sequence Number=SeqID_55547
  Gene Ontology: Mol. function=RNA-directed DNA polymerase activity; Biological process=DNA integration
MMKEFEMTDIGKMSYYLAIEVKQKEDEIFISLQSYAKKMLNKFKMDRCKPIGTLMECKMKLSKFDEARKLDAIDFKSLVTMTLTGLEMKMIRKVLVDICFSWEIQPSLGCQKSSRYIVILLTCKPKYVAVASCICHAIWLKNLLKELGMSQEELTKIFVDN

SEQ ID NO: 172326 - protein, 155 aa, Glycine max
  Coding DNA Sequence Number=SeqID_55548
MDVKSTFVNGVLVEEVYIEQPLGLKVKLEEDKVLKLKKAFYGLKQALRAWYSRIDKYFQVSMNGRPSIKGISESSSLSVITKSTGKVNWRTLIRTSSATPYDLRRNHRHYRECRLCPPGGSDPNSNSNPHFRIAYYFGNTLALATFTAEPTWKYN

SEQ ID NO: 172327 - protein, 246 aa, Glycine max
  Coding DNA Sequence Number=SeqID_55549
MGSMSQFSELVQLNIFINGLRPHSKQLLDASTSGKIKLKTLDEAMELIENMTASDHVILRDRAYTPIKKSLLELTSQDALLAQNKLLAKQIEALTETLNKLPQQLHAVQPTHLLVMQIGGCNIYGGVHESGMCMAQNDASKEVNYKTNPNHQGQKGENLKGAEAAISLSLDHALSEYQPLSETSAHLASKRNLEKNLSRQHALSASSARPARSLFLLALSAKMALRYKIHLLTLSAKMALSVPSRT

SEQ ID NO: 172328 - protein, 71 aa, Glycine max
  Coding DNA Sequence Number=SeqID_55550
DCITVSTALGSPAGGQPPGADQFRAEVAWPRDWPEAQEGEAPAEASGDAEEARIDEEMMDLLNFLGGSRAT

SEQ ID NO: 172329 - protein, 301 aa, Glycine max
  Coding DNA Sequence Number=SeqID_55551
  Gene Ontology: Mol. function=protein binding; Biological process =ubiquitin cycle
  Homolog annotation: Hit_ID=Q1SB87; Match level="QueryCoverage=86%, HitCoverage=84%, E-value=1e-122, Identity=77%"; Hit description =Cyclin-like F-box; Galactose-binding like
  Pfam annotation: Domain name=F-box; Domain location=20-67; Score =27.6; E_value=4.5e-05; Accession=PF00646.23; Description=F-box domain
MGLRFSSSEAAASESASPSSSLGELPESCVAQIMTYMDPPQICKLATLNRAFRGASSADFVWESKLPPNYDILLRRIFADFPSHLGKRGIYARLCRLNSLDDGTKKVWLDRGMGKLCLCVSAKGLSITGIDDRRYWNHIPTDESSVISFNCRFSSVAYLQQIWWFQVDGEVEFPFPAGKYSVFFRIHLGRAGKRFGRRVCNTEHVHGWDKKPVRFQLWTSDGQYVASQCFLNGPGKWIFYHAGDFVVEDGNASTKVKFSMTQIDCTHTKGGLCLDSVLVYPSEFRKAASGGIENRVFNMVL

SEQ ID NO: 172330 - protein, 834 aa, Glycine max
  Coding DNA Sequence Number=SeqID_55552
  Gene Ontology: Mol. function=RNA-directed DNA polymerase activity; Cellular component=chromatin; Biological process=chromatin assembly or disassembly
  Pfam annotation: Domain name=rve; Domain location=410-556; Score =23.6; E_value=6.4e-05; Accession=PF00665.16; Description=Integrase core domain
  Pfam annotation: Domain name=zf-H2C2; Domain location=387-423; Score =13.0; E_value=0.0068; Accession=PF09337.1; Description=His(2)-Cys(2) zinc finger
  Pfam module annotation: Pfam domain module=RVT_1::rve::zf-H2C2; Domain location=63-279::410-556::387-423
  Subcellular localization annotation: CTP_CleavageSite=75; ConfidenceScore=5.52e-01
MASTITSLCSRLRPLPAQQTFLTPFKPYSPNMRLCSKLLGTYPHLATLTTTFTYCLMRAWLMSDRTCTLTIISTRLKARWMQCYNKALNTLMVRDRFPIPTIDVLLDELGGARCFSKLDLLQGYHQIRMHPDDIPKTAFRTHHGHYEFKVEYLGHLVSHKSVEPLVAKVATILQWPTPQTTKALRSFLGLASFYCRFIRGYATIAAPLVKATTIDPFQWTEEAQGAFDHLKRALSVASVLVLLDFQFPFTVETDASGVELFAITTTVKKLRQYLLGHQFTIVTDHCSLKDLLTQVIQTPEQHMYLARLMGYDYEIQYCSGTHNQAADALSRLPKHGPSVFMLLSVPCLTFMDELHRQLETDPGYVKRRHEVMNSPTTHPDLSISGNLILHCGPKTLALISENFYWVGLRDDVTQFVANCVDCQCTKYETKKLAGLLCPLPVPHRPWEDLSLDFIVVLSPFHGNIVILVVVDWDPLFVSKFWQELFKLSGTHLRMSSAYHPQSDGQTEVLNHVIEQYMCAFVHRRPGSWGKFLPWAEWSHNTSWNAATSTTPYELTFDWKPFNFLEYIAGSSSIDVMDEMLIAREDTFWAIRKKLFKAQASMMLHEDSKKRDVSYEPDEWVLLKLRPHRQTSAKGSQAISGKLAKRFYDPFKVIERIGRAAYRLQLPAETKIHPVFHCSLLKPFIGTPEDEKIATLPTQFTDDQPIITLAWHGLSLDETSWEDWDQLRRDYHLEDKVILQGPRGDKEAKHTTDTRVQTATKCKSSLLDACRAVGDKHNKSDPIILLCGSDLIHSFGIPGFWIPDQELVQEFDQETAAVVMARFASLKMENEAWHE

SEQ ID NO: 172331 - protein, 128 aa, Glycine max
  Coding DNA Sequence Number=SeqID_55553
MVVPSKSSTSVDKLEATLIRLTNQQLSLTSQQLSLSESMNHMTHHLDELLHRVTPFFSSSTPPISSTLSPTTTIPTVNHKMKLDVPRFDGTDPLGWIFKINQFFEYHGTPKHDQLTIASFYMEGRALA

SEQ ID NO: 172332 - protein, 97 aa, Glycine max
  Coding DNA Sequence Number=SeqID_55554
  Gene Ontology: Mol. function=sequence-specific DNA binding; Cellular component=nucleus; Biological process=regulation of transcription, DNA-dependent
  Homolog annotation: Hit_ID=Q1S0I1; Match level="QueryCoverage=78%, HitCoverage=10%, E-value=1e-23, Identity=75%"; Hit description=Lipid- binding START; Homeodomain-related
MRSMQGCFLLVLGPKPTGYVTEATRETGIVIINSLALVETLMDANRWAEMFPSMIVRAINLDVISNGMGRTRNGALQVACFITLILQFCKKLHLTSK

SEQ ID NO: 172333 - protein, 568 aa, Glycine max
  Coding DNA Sequence Number=SeqID_55555
  Gene Ontology: Mol. function=malate transporter activity; Biological process=response to aluminum ion
  Homolog annotation: Hit_ID=Q6YWQ1; Match level="QueryCoverage=87%, HitCoverage=83%, E-value=1e-116, Identity=47%"; Hit description =Putative aluminum-activated malate transporter
  Pfam annotation: Domain name=UPF0005; Domain location=71-553; Score =698.0; E_value=7.1e-207; Accession=PF01027.11; Description =Uncharacterised protein family UPF0005
MAAAATRSVSLRQIFAERSKERLLSRKDLSELRLNGNTTATATAAAATPHTLSDRVARFGEGVGRFFRELREMARSDPRKVVFAAKAGLSLALVSLFIYIKEEQLSKYSIWAILTVVVVFEFSVVYYSLHFKNQGATLNKGFNRSLGTISAGGLALGIAELAVLSGKFEELIIVLCIFIAGFCASYVKLLPAMKTYEYGFRVFLLTFCIVLVSGRTSREFFSTAFYRLILIAIGAGICLFVNIFIYPIWSGEDLHKLVVKNFNGVAASLEGCVNGYLQCVAYERVPSKILVYQASDDPLYRGYRAAVQSSSQEESLVDFALWEPPHGPYKTFNYPWRSYVKVSGALRHCAFMVMAMHGCILSEIQAPPEKRLVFSIELQKVGTEGAKVLRQLGSKVENMEKLSNVDILLKVHEAAEQLQMKIDQQSFLLVNSESWQAAKKPKEVENHDNLLIDLKDPHEHKHSLISSLSETGVDSRLNINIEPSVPELHISQSLLSNKISWPRLSFYGDNMLLEQDSKVYESASSLSLATFASLLIEFVARLQNLVDEFQDLSEKANFKDPFNPPVLK

SEQ ID NO: 172334 - protein, 606 aa, Glycine max
  Coding DNA Sequence Number=SeqID_55556
MVVVVLLAPRALFFKLDHYVYVCLRIFDNEGFEIGTSSCPKWGDVHLLNEESTRELDTYNVESELRVLVDMGCYGDVTTLVDNYRFVDNSQGCPLSNEIVPCRGRLFEVVGSSLDNLSSPRAWTSVIHDASVKLLWVDMLLVLQASSDITLPYKSLVEWARTRDVDTCHGVSKSESFSSERLRVSRRTGGDTSCLRRRAQPSHASPAGDLIPITMILPHFTFGGVEKSGGGDVRDDILKYKSSITFVVSVAALQCQAVLGNPPFFFMYKCLFEVLGLVLPLTAFQCALLEHLNVTPSQLHPNSWAMVRAFKILCLFFNIRPISLNNMSKKLFKFSNVFCRFKDYFFKVLATDVVGRQSYFEVVADLFGRAGIMGDFPWRPLVKQVGPLGGTVSLSAIAIAAGERSQLAIEVGLVAGVAEDGDAGMSSRKKLRALFSLHALRQAAFAFAVVVVVTPTPPPPLVVLVQEATPTTEVDAPAALASPIVSPSFTVATSLLSVGVVTMSAPMMPPPFSLTPLCWHRLPPLFTPYAGVNHATNSAKVFLLRSLTILEKNGQRNQEALSKVASLECPKVSSATVAFVEAVKLNHELSSKVGSVLAKLLRTRLD

SEQ ID NO: 172335 - protein, 102 aa, Glycine max
  Coding DNA Sequence Number=SeqID_55557
  Subcellular localization annotation: CTP_CleavageSite=77; ConfidenceScore=5.01e-01
MFISVWWSTASNNGSWWPPVVVGSGEESVRLAKFQGVTITIQPSAQQLGQNTANLGRQFVVQLHSFNKGDGSTRYLRALHFPNHESSNPTLGNLYLQGRHFA

SEQ ID NO: 172336 - protein, 132 aa, Glycine max
  Coding DNA Sequence Number=SeqID_55558
MFLCDDDNNNDGDNVSNSDKDKDISGGHDDSDNDNNNIRGGGKSGISGSGGVIEVVLTLVVVMVITKIVLVVVVVVVTLMKVVLLVAVMMTLMVVWWLCGGCDDIGGGCGSGDTNSDGGGSNADGDGNVGSD

SEQ ID NO: 172337 - protein, 90 aa, Glycine max
  Coding DNA Sequence Number=SeqID_55559
MGITSWLLSLDTRYQRSLGFIARSGNNFLVVITKYKGGKSFVENNVEDDIEGGIGAGCAPEAPWRQVPVAAVEVEAPFRFFDDSTIVGVF

SEQ ID NO: 172338 - protein, 672 aa, Glycine max
  Coding DNA Sequence Number=SeqID_55560
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=39%, HitCoverage=59%, E-value=1e-61, Identity=50%"; Hit description =Integrase, catalytic region
MKWNVASFVAMLTCWYRVTPSRWTSIPLCGADIVLGVQWLKALRPVLIDYNDLSMKFVFNGTLIELKGNSDNALLELTPPQLRRLNQTHSASEYFHIRLCSSASPSLPTHPAILTLNHQFSSLFQTPTALPPSCTTNHSIHLSPHSSPINVHPYRYPHFQKQEIESQVSCMLQHGIIRPSTSPFSSSVLLVKKRNDTWRFCVDYRALNVITIKDHFPISMVDELLDELGGARWLLKLDLLQGSGTCSCQGRSCPSMVATNISQSIVWFFGPFRILQSLHPRALCKAPVLRLPDFSLPFVVETDASGIDHRSLKELMAQAIQTPEQQTYLARLMGYDYTIQYCASKSNLAADAFSRRSEIPSGTLLILTVPNCMFLQELKAELSNNPKFQKYHQQIIAEPHNHPEYKVLSSTLFGITMPLAYSGTAMGRPLPRLYYGIVELLRSFHHPSSGRPVFERSSFGHVASIILRFRHGKAIHGHRRQNPRHASELGLRQGPPLCELFLAGIVQVQWNVLDLVASIILRGIGLQSLNQSHRIRRMEEEISLQEKNITMKIIVPPLDQRTDRGHEPCHRTIPQSLCPSTWGRFLIWAEWSYNTSVHSTTGMSPYEITFAKKPPSLIQYLEGTSNVEVIDEWLKQRDQILATFAKKLTKAQQRMKAYADKQRRELTFEVGD

SEQ ID NO: 172339 - protein, 55 aa, Glycine max
  Coding DNA Sequence Number=SeqID_55561
MGGGLASEGKRGRVGLGVGTRAGNGGGKLVGEGEVELGDETAQEKGGWESDDSIG

SEQ ID NO: 172340 - protein, 160 aa, Glycine max
  Coding DNA Sequence Number=SeqID_55562
  Gene Ontology: Mol. function=protein disulfide oxidoreductase activity; Biological process=cell redox homeostasis
  Homolog annotation: Hit_ID=Q941V7; Match level="QueryCoverage=80%, HitCoverage=58%, E-value=1e-33, Identity=48%"; Hit description =Glutaredoxin-like
MSRIHHETCRTPNQTVGIARRTAPESATLLSEHFVASIALVADHESQPSAQITHLPHLVGTADVHAGDEDARQRHAAADEDPLQFLAEALVDADVALVDRDGEAAEDRSDGAAVVEGAADDAEASVVDDDGGTVGVRRRLDGGGGGAGAAKGADEGGRDD

SEQ ID NO: 172341 - protein, 473 aa, Glycine max
  Coding DNA Sequence Number=SeqID_55563
  Gene Ontology: Mol. function=drug transporter activity; Cellular component=membrane; Biological process=multidrug transport
  Homolog annotation: Hit_ID=Q1SB90; Match level="QueryCoverage=94%, HitCoverage=82%, E-value=0.0, Identity=75%"; Hit description=Multi antimicrobial extrusion protein MatE
  Pfam annotation: Domain name=MatE; Domain location=234-397; Score =156.7; E_value=6.2e-44; Accession=PF01554.9; Description=MatE
  Pfam annotation: Domain name=MatE; Domain location=9-170; Score =139.1; E_value=1.2e-38; Accession=PF01554.9; Description=MatE
  Pfam module annotation: Pfam domain module=MatE::MatE; Domain location=234-397::9-170
KCIANISFSMVLTGLLLYSRSMISMLFLGHLGELALAGGSLAIGFANITGYSVLSGLAMGMEPICGQAFGARRFKLLGLTMQRTVLLLLVTSCLISLFFWLNMRKILLLCGQEEDIANEAELYILYSLPDLVLQSLLHPLRIYLRSQSITLPLTCCAAVSILLHVPINYLFVSILKLGIKGVALSAVVTNLNLVWLLIVYVVVSGTHKKTWPGISRECFQGWNSWKTLMNLAIPSCVSVCLEWWWYEIMILLCGLLVNPHASVASMGVLIQTTALIYIFPSSLSFGVSTRVGNELGAGNPRRAKLAAMVGLCFSFVFGLSALAFAVSVRNVWASMFTLDGQIIALTSAVLPIIGLCELGNCPQTTVCGVLRGTARPKLGANINLGCFYLVGMPVAVWLGFFAGFDFKGLWLGMLAAQGSCMMTMMFVLARTNWEGQALRAKELTDSDSGEEKNLMEEEEQEEEGFLGSCATKE

SEQ ID NO: 172342 - protein, 405 aa, Glycine max
  Coding DNA Sequence Number=SeqID_55564
  Gene Ontology: Mol. function=methyltransferase activity; Cellular component=cellulose and pectin-containing cell wall
  Homolog annotation: Hit_ID=Q9SIZ3; Match level="QueryCoverage=97%, HitCoverage=66%, E-value=1e-166, Identity=69%"; Hit description =Expressed protein
  Pfam annotation: Domain name=DUF248; Domain location=1-398; Score =592.9; E_value=2.9e-175; Accession=PF03141.7; Description=Putative methyltransferase
  Pfam annotation: Domain name=Methyltransf_11; Domain location=22-117; Score=24.3; E_value=0.00022; Accession=PF08241.2; Description =Methyltransferase domain
  Pfam annotation: Domain name=Methyltransf_11; Domain location=270 -365; Score=3.9; E_value=0.022; Accession=PF08241.2; Description =Methyltransferase domain
  Pfam module annotation: Pfam domain module=DUF248::Methyltransf _11::Methyltransf_11; Domain location=1-398::22-117::270-365
MTFVLCQTLPEIQWGKNIRVVLDAGCGVASFGGYLLDKNVITMSFAPKDEHEAQIQFALERGIPATLSVIGTQKLTFADNGFDLIHCARCRVHWDADGGKPLFELNRILRPGGFFAWSATPVYRDDERDQKVWNAMVTVTKAMCWTVVAKTLDSSGIGLVIYQKPTSTFCYQERKERTPPLCETSDRKSISSWYTKLSSCLIPLPVDAEGNLQSWPMPWPERLTSIPPSLSIESDASEMFLKDTKHWSELVSDVYRDGLSMNWSSVRNIMDMNAGYAGFAAALIDLPVWVMNVVPIDMPDTLTTIFDRGLIGMYHDWCESLNTYPRTYDLVHASFLFKHLMQRCDIVVVAVEIDRIMRPDGYLLVQDSMEIINKLGPVLRSLHWSVTLYQNQFLVGRKSFWRPRP

SEQ ID NO: 172343 - protein, 47 aa, Glycine max
  Coding DNA Sequence Number=SeqID_55565
MVMFGVGVTEDEDGVWASLAIASSRRSRFDLEHMDSALRVNESTKLL

SEQ ID NO: 172344 - protein, 94 aa, Glycine max
  Coding DNA Sequence Number=SeqID_55566
MRARVRQQCPRAAWTKTNKRQRLRVSWAYLLATWASSGGATKAQWRHDGCGRKTEARERGVPVSSSMRFFIVIHLFIRSPEHKVQDHSSQIQFT

SEQ ID NO: 172345 - protein, 149 aa, Glycine max
  Coding DNA Sequence Number=SeqID_55567
MTLAIPQFFLKPLQVMWDATVFGVFNEDFPLYIKHEDLSEIAHGGQCLNIFVIQLWILHLTETSMRTGNSDVYGFLEPQSIQRSGQSQFESKRYMKSWMQNSKRDVYLGAYLNGKPHDDESTMNQVVLMMTKKPKRMISRLSQQVQDQD

SEQ ID NO: 172346 - protein, 409 aa, Glycine max
  Coding DNA Sequence Number=SeqID_55568
  Gene Ontology: Mol. function=two-component response regulator activity; Cellular component=nucleus; Biological process=two -component signal transduction system (phosphorelay)
  Homolog annotation: Hit_ID=Q6H805; Match level="QueryCoverage=88%, HitCoverage=56%, E-value=3e-22, Identity=24%"; Hit description =Putative response regulator 9
  Pfam annotation: Domain name=Myb_DNA-binding; Domain location=207 -260; Score=23.7; E_value=0.00065; Accession=PF00249.21; Description =Myb-like DNA-binding domain
  Pfam annotation: Domain name=Response_reg; Domain location=19-131; Score=7.5; E_value=0.00093; Accession=PF00072.14; Description =Response regulator receiver domain
  Pfam module annotation: Pfam domain module=Myb_DNA-binding::Response _reg; Domain location=207-260::19-131
MDDQSISMVNCPPSFATELNILLLNNNTLSLVYLSSLLKQYAFKVTLTDEVSMAMSMVSNHENQFRLVMVKLNMPGLHDLAFVDLLHEKDIPVVFISSGGSEDTIWKTLAKGPCYFLEEPILFEDLQYLWLIAHQSKPKSAIEAQHANKACREKEERKIDNDGNESKQGEKREELRPAMMNFNRDNHIPKETEKRREHKIGFAKKRKILWTLELRQKFTEALEYLGGIESNIARPKAIQKLMKVSDLTLNQISSYMQRYKLQLKRNKVTIGYGSYQAGTSSNISGKTTFPSSLGSSSYRVEQQEHMHESINHPTTEFAAGIPTSFAPLNASPKQDLNSGETQESDIHKLQSVLSNSFVANELASQIDGAIVGNSIPNASSTLQNLPENEYEEFFRSLEDIETDNFGLMM

SEQ ID NO: 172347 - protein, 233 aa, Glycine max
  Coding DNA Sequence Number=SeqID_55569
  Gene Ontology: Mol. function=transferase activity; Cellular component= endoplasmic reticulum membrane; Biological process=DNA integration
  Homolog annotation: Hit_ID=Q1S0E3; Match level="QueryCoverage=78%, HitCoverage=20%, E-value=4e-39, Identity=45%"; Hit description =Peptidase S8 and S53, subtilisin, kexin, sedolisin; Zinc finger, CCHC- type; Peptidase ...
  Homolog annotation: Hit description=aspartic, catalytic; Polynucleotidyl transferase, Ribonuclease H fold
MDFYKRREFALVASLEAIRLVTSISSFKGLSLRQLDVKSAFLNRSLDEEGSLPNYGEWNSFQQIKEFSCTRKVCNKYLKRFNMLDCNPTSTPIEIGTRHKEGDEDLVNSTQYRPDLVYGVGLISKFTEKLSTSHQAARKRILRYIKGTLDFGLLFPNELQCEGVEIVRYIDSDCCEDKDNRKSIGGYVFIHENGSISWSSKKYDVVALSSCEVEYIVASFRACQAAWLETLLK

SEQ ID NO: 172348 - protein, 145 aa, Glycine max
  Coding DNA Sequence Number=SeqID_55570
MTQRKRGRPSHICTVYNHKKEEERSSLLQTPKLEVPPLVILQACWGRGKPDPVRGRNRRLIYNPVGFWGWGWGEMGSWGQGWVAAEMRIPAKMMVWMKEKRNEKKKNKIKNVVMPLKIISATTHSGEELALVLRSKGFHPLAIHC

SEQ ID NO: 172349 - protein, 63 aa, Glycine max
  Coding DNA Sequence Number=SeqID_55571
  Subcellular localization annotation: CTP_CleavageSite=43; ConfidenceScore=5.33e-01
MRILGPSSAALAQSSWSLLLMALVTSPFLGRIASKTPSMLGISISEIVVEFPQAIILLSNSVA

SEQ ID NO: 172350 - protein, 99 aa, Glycine max
  Coding DNA Sequence Number=SeqID_55572
MSNISGGAVADIGGGSGKVGGTVSVGEVVLALERCIDRDPQSSTIATISTRVYELELHHIVVALKLDQYISKGSKASIKKSLVVDDAHAWVDNQILIST

SEQ ID NO: 172351 - protein, 336 aa, Glycine max
  Coding DNA Sequence Number=SeqID_55573
  Subcellular localization annotation: CTP_CleavageSite=35; ConfidenceScore=5.49e-01
MTLPLLASLALLFPMPLSSTQCLLSSSLGSREDASSKMKVRRLEAIFRKQTTSDGGTCSPRWTRKRAKNLQNGNLSHSKEIEVAEETKDEEEEEKIVTIGKKGVVVLDQWLPDYMKTNYHVLQLGSLVMFADAKNWIRKSGLHHGGFAVENLFLLLVQGLALGDGLFRGEDAVELLAEGAEVLVDKAHHMTIVGSGDVIVACDGCHLVIYGGEREKERVGFELVIVGAQEEGVGRGLDAVHMLLILLGLGLRENEKEFAAGLSAQCSHPERLRKDGDAKCRRARRSENLREDAIMQPQDRTRPSEHSCREGQRCEVPLESEAEQRPKCCDDGGQRG

SEQ ID NO: 172352 - protein, 293 aa, Glycine max
  Coding DNA Sequence Number=SeqID_55574
  Gene Ontology: Mol. function=nucleic acid binding; Cellular component= nuclear pore; Biological process=DNA integration
  Homolog annotation: Hit_ID=Q94I37; Match level="QueryCoverage=77%, HitCoverage=23%, E-value=3e-42, Identity=37%"; Hit description =Putative retroelement
RGDDLSDNAMMVTEDDPVTYEEAVKSKTWRDAMKKEMEAIEKNKTWELTNLRTGMKPIGVKWIYKTKLKENGEIDKFKARLVAKGAFLHGELKEEVYVQQPIGFVKLGEEEKVYKLRKTLYGLKQAPRAWPDLTYEVSLISRSRFMANPTKTHWFAAKRILRYLKGTTELGIYCKKEESTNVVAYTDSDFAGDIDDRKSTSDFVFLLGNEAASWNVAESRKRLRNSGKSCRRLRKCVESWMMLRCTKRQISINEPCQSTCFGSHLGSQHPQSSLVTTTPTRLRLRACVAPFSL

SEQ ID NO: 172353 - protein, 95 aa, Glycine max
  Coding DNA Sequence Number=SeqID_55575
  Subcellular localization annotation: CTP_CleavageSite=57; ConfidenceScore=5.10e-01
MAQLQRVWPLKMEARTLFVVAQTSRVAVGLLLRRSNPCGVYPDLSSFTGSGVHPNLSSFTGSGIYPDLSSLFGSGVIQNSIACIKRSAPNQVHII

SEQ ID NO: 172354 - protein, 83 aa, Glycine max
  Coding DNA Sequence Number=SeqID_55576
MPQEGQEVLCQKIHEEDDAGDSEKLANCAEESMHSQKMQVQAMKALVDVLATSASSPAPIGLSKCNHKNIVYFTTLYGHIYLN

SEQ ID NO: 172355 - protein, 80 aa, Glycine max
  Coding DNA Sequence Number=SeqID_55577
MGDVLIHGVLLRCQLWFFKRDSPFMLGREIYQCASPVPDWLKLEVESLFLNDEVKGVTFWKDSTHGVYSATFTYRWLNKA

SEQ ID NO: 172356 - protein, 93 aa, Glycine max
  Coding DNA Sequence Number=SeqID_55578
  Gene Ontology: Mol. function=structural constituent of ribosome; Cellular component=ribonucleoprotein complex; Biological process =translation
  Homolog annotation: Hit_ID=Q9ZAE4; Match level="QueryCoverage=94%, HitCoverage=48%, E-value=2e-41, Identity=93%"; Hit description=50S ribosomal protein L6
  Pfam annotation: Domain name=Ribosomal_L6; Domain location=3-78; Score=113.2; E_value=7.5e-31; Accession=PF00347.13; Description =Ribosomal protein L6
MVVGIGYRAQLRGNTVVMNLGYAHPVVYEIPSDVKIEVPAPNRIVVSGIDKQRVGQVAAEIRAFRPLNVYTGKGIRYVGEVVRQKESKKAYRG

SEQ ID NO: 172357 - protein, 104 aa, Glycine max
  Coding DNA Sequence Number=SeqID_55579
  Gene Ontology: Mol. function=protein kinase activity; Biological process=protein amino acid phosphorylation
  Homolog annotation: Hit_ID=Q2QZ78; Match level="QueryCoverage=93%, HitCoverage=17%, E-value=7e-14, Identity=45%"; Hit description=AT hook motif-containing protein, putative
MAHKYCFEALDKTPKDITCMSHVDSVPFGGKVVFGGDFRKILPMIPRGSRSDIVHATINASYLRDYYTVLKRASAKRNTPGLSARKNPEEDELYRFAKRTTSSL

SEQ ID NO: 172358 - protein, 94 aa, Glycine max
  Coding DNA Sequence Number=SeqID_55580
MSYSFFLDETVFIIIVKSVYKHLYKRIHTEQIILRDVKGVCPYIEPCDSKTQKSNLGIALVGVGCEQNKVDVRVDNKLRKTSEIVLGLSGAYID

SEQ ID NO: 172359 - protein, 407 aa, Glycine max
  Coding DNA Sequence Number=SeqID_55581
  Pfam annotation: Domain name=Transposase_23; Domain location=61-129; Score=-0.3; E_value=0.0012; Accession=PF03017.5; Description =TNP1ENSPM transposase
MDMLQKELDAIKTELSQMQTQQSAPVQPANPNVLIARVSTKESCAEAVANVVAGDPSAIEENTMGLYVVCGDSKQLVALGKVYQVGGMIHNVPYADEVVRVSVVTVYDGDARVPIPTPEIEYVREAMNTFIGWPTNLVKPFSADSNQDVRNPNGHVDRSNVGFAKDPLGEIMKILYEVYMNPVELPWEASRFGIPNIDAKFYITHADMAEIISGHKCLNISILQLWMMYLDECATSRGDGSVYGFLEPQSIHIGKEDRQQCQLYIETWVKESQRCLYLGAYLHQSHWQLFVLCPRENMVVWFCSLRKKPDVNIKVVINSAMKTISSSLEGMSQQGPPRWIEPKSHVQSGGYECGYYVMHWMWCIVSGRLKDDWNRWFSNGSALEVEAMTIIQKNWATYFLAIRNKRC

SEQ ID NO: 172360 - protein, 290 aa, Glycine max
  Coding DNA Sequence Number=SeqID_55582
  Gene Ontology: Mol. function=nucleic acid binding; Cellular component= intracellular; Biological process=DNA integration
  Homolog annotation: Hit_ID=Q1RWN2; Match level="QueryCoverage=99%, HitCoverage=22%, E-value=5e-75, Identity=47%"; Hit description =Peptidase S8 and S53, subtilisin, kexin, sedolisin; Integrase, catalytic region; Zinc finger, CCHC-type
MWEKNANYAEVEDKVEQEDELLLMASVDLKEEKDKWFLDSGCSNLMSGIKDWFSHLDENFHHTVKLGNDTCIAVMGNGVFVWWCTIYVLELKNNLLSIGQLQEKGLTIKIQNNMCTVVHPEKGSIMEVSMSSSRMFVLIATRAPTSATCFKAELERESQLWHNHLGHLSYDGLKTLASKQIVNGLPTILVTQELCIHCLTGKHHRNSMSKKSQWRASEKLQIIHADLCGPVQPSSNSNKKYFLSFIDDFSRKNWVYFLHDKAETFSLFKSFKSLVEKEAGGSIICLRTDR

SEQ ID NO: 172361 - protein, 313 aa, Glycine max
  Coding DNA Sequence Number=SeqID_55583
  Gene Ontology: Biological process=regulation of GTPase activity
  Homolog annotation: Hit_ID=Q1T0M4; Match level="QueryCoverage=76%, HitCoverage=50%, E-value=4e-88, Identity=68%"; Hit description=Arf GTPase activating protein
MGNEKANCFWEAELPPNYDRVGIENFIRAKYDEKRWVPRDGNSKTPSGFREEKSPSHWQRPVERSGYAAVSENKFEERKKIQPSTAIPAARINVPAPPRASEQVTPITKPQHVEKVESVAPQPQAPQPLAETSKQATDTVKNTPPKVDYATYLFNMLSMDGPNENGSEAAGTTTDDNHWAAAAEVSTAEKTSPLKAADSTPASASGIEDLFKDLHPVTPSLTPEKPQRDVKNDIMSLFEKVFSDLERSVCRMVHRQVATIAWLEADSVCGSHSVAIPLVLVLPYLFRLNQCLRQYKDTGEKTTLLNGKNFVLF

SEQ ID NO: 172362 - protein, 47 aa, Glycine max
  Coding DNA Sequence Number=SeqID_55584
MEAVALDEEPVVELEFMPSRVFIFVSTNTGIVSPRFSRSMSLSTSSK

SEQ ID NO: 172363 - protein, 152 aa, Glycine max
  Coding DNA Sequence Number=SeqID_55585
  Homolog annotation: Hit_ID=Q1SKD7; Match level="QueryCoverage=77%, HitCoverage=30%, E-value=1e-07, Identity=28%"; Hit description =Ankyrin
MSLTKGKIGVNEMAPKKLSTKRSRRDATGEGWSFHRERRVQLREDEYTNFQEEIAHRHWTPLVTPMAKFDPEIVLEFYANAWPIEEGVQDMCSWVRGQWIPFDADALSQFLGDPLILEEGQQCEFSQRRSEVDDFDEEAITQLLCIPGQDFA

SEQ ID NO: 172364 - protein, 176 aa, Glycine max
  Coding DNA Sequence Number=SeqID_55586
  Homolog annotation: Hit_ID=Q6F2U6; Match level="QueryCoverage=61%, HitCoverage=32%, E-value=6e-42, Identity=72%"; Hit description =Expressed protein
  Pfam annotation: Domain name=Lysine_decarbox; Domain location=2-101; Score=42.3; E_value=1.7e-09; Accession=PF03641.4; Description=Lysine decarboxylase family
HGLVDAVVRNNSFDKTAVVALPGGIGTLDEVFEILALIQLERIGSKFPVPFLLMNYDSFYSKLLEFLNDCEGWGTVSKGEVASLWKVCNSNSEALAYLEEFYGISSSDKRSLPNSIGELQNLETLDIRQTDMSEIRKEISKLRKEALPQGEVKKVAKLDSTTRKSFKLVFDVLRVN

SEQ ID NO: 172365 - protein, 1148 aa, Glycine max
  Coding DNA Sequence Number=SeqID_55587
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=93%, HitCoverage=91%, E-value=0.0, Identity=44%"; Hit description=Kinesin related protein
  Pfam annotation: Domain name=Kinesin; Domain location=82-413; Score =320.3; E_value=3.5e-93; Accession=PF00225.13; Description=Kinesin motor domain
  Pfam annotation: Domain name=Kinesin-related; Domain location=488 -1107; Score=746.8; E_value=1.4e-221; Accession=PF06548.2; Description=Kinesin-related
  Pfam module annotation: Pfam domain module=Kinesin::Kinesin-related; Domain location=82-413::488-1107
  Subcellular localization annotation: CTP_CleavageSite=101; ConfidenceScore=5.76e-01
MRQKTNNAGSSGFLGSISSNFLRSISSSNRKPTSSSSSNPKPPNSDAENTPPTTHPNIPLNIHHQSKPNDPFSHSDSHVVVRIRPENSNGKEGDSQIKKVSSDALCAGDRKFTFDEVLDANSNQEDVFQSVGVPLVRNALAGYNTTILSYGQSGSGKTYTMWGPPSAMVGESSRSSQQGIVPRIFRMLFSELERERLVSDQKQFNYQCRCSFLEIYNERIGNLLNPIQENLEMKDDSSNAPYIENLIEEYITNYDDVAQILVKGLSRRKNGAMSLNSNSSRSHIIFTFVIESLCKGTAKSLSTSKTSRISLIDLAGLDRDEVDDGGSQCPRASGHVDKSLSQLEHLVDALTNKSQSGKNEDIPHSDSCLTRLLHGSLGGNAKLSVICSISPDNKSNDATLHTLRFGEQVRSIRNEPVINVLKEADVDLSNNIRHLKEELIRAKADVHSSAGSKDGYFQGHNVRESLNQMRVSLNRSLLLSNIDSDTNEHVNVNEDDIRQLRQQIDELDNSSEGNPKDISVDEDCVQFYSDEENCDADTITSGDEVKNAEVYCGETLSNPSRETESSLRDSISVNSCNHSPTLIGPQLSESPKFSKTQRKSVAISSSYLGSWNNVAESSTFSNNVLSKPYKQGEHVQSSLQSSKAKSLAASLQKGLQIIDYHQQNSALSKSSTSFSFEHLTLTPCLDIDKAESCDQTMRQKPSSDEVTAAFLCASCQMKISNQDSSEVQAGNPDEVTDKIPRHLENVIAKSIKKEKELENVCKEQAARIEQLNQLHVSNLQVEKLKGEKELDSIIMYNSMKDEEKLLRGISSSGHLPCIIEEKCEIKEIQEELAQRGVSFDSNEKESLLKEIQNLRSKLQLFSDAQVKKSTDKLRSSLVSRSIQLQKSGVFSYENGNEDLDNERQRWTEMESEWICLTDELRADLESYRQRTDRLEMELKLEKSSSVEMDDALKRAVMGHARMVEHYADLQEKYDDLVTKHDAIMEGIAEVKKAAAKASKKGHARFAKSLSAELSALRVERERESKLLKKENQSLKIQLRDTAEAVQAAGELLVRLREAEHAAAVAEENFANVQQDNENMKMQIEKLKRKHKTEINTMKQYITESKLPESALQPLYKEDSDGAHNATFSYTYDDQAWRAEFGAIYQEHF

SEQ ID NO: 172366 - protein, 159 aa, Glycine max
  Coding DNA Sequence Number=SeqID_55588
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q8PMZ6; Match level="QueryCoverage=96%, HitCoverage=40%, E-value=1e-51, Identity=67%"; Hit description=Two -component system regulatory protein
MDPACPMRTARLSHHRAGHVGQVAGTGLQAQAAAADPREVQQLLDHACHAQGAGLQVLQRLLRASVVFGKIQRQLVGTQQDGRQRRTQVVGQHRCHRLVELERTLQRLVARLQQLPLLVQLDEDIDLAQDYLRRHRLAQEIDPAALVALEHAQGIIRGG

SEQ ID NO: 172367 - protein, 253 aa, Glycine max
  Coding DNA Sequence Number=SeqID_55589
  Gene Ontology: Mol. function=hydrolase activity; Cellular component =outer membrane-bounded periplasmic space
  Homolog annotation: Hit_ID=Q4BAH3; Match level="QueryCoverage=90%, HitCoverage=63%, E-value=1e-101, Identity=79%"; Hit description =Choloylglycine hydrolase precursor
  Pfam annotation: Domain name=CBAH; Domain location=26-252; Score =38.3; E_value=2.4e-12; Accession=PF02275.8; Description=Linear amide C-N hydrolases, choloylglycine hydrolase family
MARMKWKEKALLAVALAAAAAPALACTRAVYLGDNGDVITARSMDWKVDVATNLYVLPRGIARSGQAGPKSLAWTARYGSVVATGYDVSTTDGMNEKGLVANLLWLVESEYPQQRGNKPGLAISLWAQYVLDNFATVEEAVTALKREPYAIVTDRVPGEDRQATLHLSLSDASGDSAIVEYIGGRQVIHHDRRYQVMTNSPIFEQQLALNSYWQQIGGTVMLPGTNRSADRFARASFYINAIPKAEDPVVALA

SEQ ID NO: 172368 - protein, 536 aa, Glycine max
  Coding DNA Sequence Number=SeqID_55590
  Gene Ontology: Mol. function=hydrolase activity; Cellular component =cellulose and pectin-containing cell wall; Biological process =aromatic compound metabolic process
  Homolog annotation: Hit_ID=Q1T2K5; Match level="QueryCoverage=97%, HitCoverage=98%, E-value=0.0, Identity=68%"; Hit description =Alpha/beta hydrolase fold
  Pfam annotation: Domain name=Abhydrolase_1; Domain location=210-501; Score=-0.9; E_value=0.0093; Accession=PF00561.10; Description =alphabeta hydrolase fold
MAEVRGRDTWTEELASLIEDSGVRYGGDSPPTSFEVHAPQSESGESLKEQALGFVMAWCEILMELGRGFRDILRQNLINEDSYVVRKFGGPCSKVSKRLRFLNDFLPEDRDPFHAWSVVFFVFILALAAISVDPNREAVAPVVKVRQHPPSASRVLLPDGRYMAYHEQDNLLGYNLYEEHNLRLDFTVHLIPSYEGLPGVKASLLEEYGIRLVTYDLPGFGESDPHPNRNLNSSAMDVLHLVNAVNVTDKFWILCHSSGCIHAWASLRYIPEKIAAYNRNLHSYAVVEQGPQLIEGAAMLAPMINPYDPHMTKEEMKRTWEKWLPRRKMMYSLARRFPKLLSFFYRKSFLPEQHDEIDKLLSVSPGKKDKLVTEEPEFEEFWQRDVEESVRQGNIRPFIEEAVLQVSNWGFDIKELHVQKKCQTRGILLWLKSMYSQAGCELAGFLGLKHIWQGLDDRVVPPSMMEYIERVLPEAVIHKLPNEGHFSYFYLCDQCHRQIFTTLFGTPQGPVERQEETATAFEEEDKEEAAPLLGGA

SEQ ID NO: 172369 - protein, 171 aa, Glycine max
  Coding DNA Sequence Number=SeqID_55591
  Homolog annotation: Hit_ID=Q1SAV4; Match level="QueryCoverage=19%, HitCoverage=8%, E-value=2e-07, Identity=61%"; Hit description =Integrase, catalytic region
  Pfam annotation: Domain name=Chromo; Domain location=80-122; Score =16.1; E_value=0.012; Accession=PF00385.14; Description='chromo' (CHRromatin Organisation MOdifier
MGIKHFEVTNEGRMLIKNGPRMKLGFDRSSSVEAAMKTQAEKQRKDVSYDVRDWIYVHLQFYRQLSVFGTTYTMLAKHYYGLYKIIERVGWVLVQWMGLSPKDATWERWDELSQSFHLEDKVIFPRDGNDSATNHTEATNNDNLIDEWEEEINYNRPKRNQYVSRIRNRVC

SEQ ID NO: 172370 - protein, 219 aa, Glycine max
  Coding DNA Sequence Number=SeqID_55592
  Homolog annotation: Hit_ID=Q1SLA3; Match level="QueryCoverage=63%, HitCoverage=12%, E-value=7e-08, Identity=25%"; Hit description=RNA -directed DNA polymerase
WKIGLNMNGSCDRFVVENMVRDIMENEDLMRSANDVAKKALHGIKENGSSYHNLENLIKDISLMKSAAGIMCQKVSFVIEDIDLCLKNLIHEGHWNINDLHTRVPQNFVEMLEAIDTNIHPDIHDYWIWSSSSNGDYSAASGYKWLSNSLPSSTIDHYAAFKWLWKLKNSLPTNAVGFRRNMDNNVACPTYSNLIEDFLHCLLDCYSLPIFILGLDHNS

SEQ ID NO: 172371 - protein, 534 aa, Glycine max
  Coding DNA Sequence Number=SeqID_55593
  Gene Ontology: Mol. function=nucleoside-triphosphatase activity; Cellular component=membrane; Biological process=defense response
  Homolog annotation: Hit_ID=Q1SVC8; Match level="QueryCoverage=63%, HitCoverage=37%, E-value=2e-49, Identity=34%"; Hit description=TIR; Disease resistance protein; AAA ATPase
  Pfam annotation: Domain name=LRR_1; Domain location=121-142; Score =6.4; E_value=18; Accession=PF00560.23; Description=Leucine Rich Repeat
  Pfam annotation: Domain name=LRR_1; Domain location=28-50; Score=6.8; E_value=15; Accession=PF00560.23; Description=Leucine Rich Repeat
  Pfam annotation: Domain name=LRR_1; Domain location=5-26; Score=9.9; E_value=4.1; Accession=PF00560.23; Description=Leucine Rich Repeat
  Pfam annotation: Domain name=LRR_1; Domain location=52-72; Score=5.7; E_value=25; Accession=PF00560.23; Description=Leucine Rich Repeat
  Pfam annotation: Domain name=LRR_1; Domain location=74-96; Score =11.2; E_value=2.2; Accession=PF00560.23; Description=Leucine Rich Repeat
  Pfam annotation: Domain name=LRR_1; Domain location=98-119; Score =10.6; E_value=3; Accession=PF00560.23; Description=Leucine Rich Repeat
  Pfam module annotation: Pfam domain module=LRR_1::LRR_1::LRR_1::LRR _1::LRR_1::LRR_1; Domain location=121-142::28-50::5-26::52-72::74 -96::98-119
MKFRNLKVLNFDDCEFLTEIGDVSDLPNLEKLSFDRCGNLMTVHRSIGFLNKLKILRARFCSKLTTFPPLNLTSLEILELSQCSSLENFPEILGEMKNLLYLELVNLGLKELPVSFQNLVGLKTLSLRDCGILLLPSNIVMMPKLDFLDASSCKGLQWVKSKEGEEKEIRGVPPFLTYFTARECISLSSSSSRMLSNQELHEAGQTKFWFPGATIPEWFNNQSRGPSSSFWFRNEFPVNVLCLLLARVERIDVDDIFMPAVFINGKLHKNPSRGTKVGKVKLDYTYLFDLKSALELNDIYEVALEKERNQVEITYAGLIETSLVKATGTHVLRQDDIRYDDPYYDGALITNAERRYRHISMDSSCRWRHACMLFVIVQRWLHFGEVLLHAEVYSETTVIDSCLGFRLIKPGECLSIDEAEIWGIYHGMKIARKYDIWGICHGMKIARSGMGSEEAIGFVLDGCPTSTSVQHCFPLCHELKALTSATNHLYFFLTPQDAAADSFAEFGLSMKQQAASIFSACPSFCQPFIKRKYR

SEQ ID NO: 172372 - protein, 270 aa, Glycine max
  Coding DNA Sequence Number=SeqID_55594
  Gene Ontology: Mol. function=ligase activity
  Homolog annotation: Hit_ID=Q1SND7; Match level="QueryCoverage=95%, HitCoverage=97%, E-value=1e-113, Identity=80%"; Hit description =Probable tumor-related protein T9L24.46 [imported]-Arabidopsis thaliana
MANNNEEEEEAVTPMVKLGSYGAEVRLVVGGEESAAEETMLLWGIQQPTLSKPNAFVSQASLQLSLDSCGHSLSILQSPSSLGTPGVTGAVMWDSGVVLGKFLEHAVDSGMLVLQGKKIVELGSGCGLVGCIAALLGSEVIVTDLRDRLRLLRKNIETNMKRVSLRGSVTATELIWGEDPDPELIDPTPDFGNSLPQLLQGAVVDLLETLMQLSGSDTTIFLAGELRNDAILEYFLEAAMDNFTIGRVEQTLWHPDYCSNRVVLYVLVKK

SEQ ID NO: 172373 - protein, 77 aa, Glycine max
  Coding DNA Sequence Number=SeqID_55595
MGKGWLRWRLPEDPIRVLPELPEEGVPEDFRKKGSSGSTERSSGRTGLLESFRNTSSRNSPDEVVLPETFRKKGSSG

SEQ ID NO: 172374 - protein, 94 aa, Glycine max
  Coding DNA Sequence Number=SeqID_55596
MHDAIKEYARVSFLCAPSSDNSLAWFYVTLLASRDIILLEIVLIGVANCHNLPLVGGRRGAHGCVFQGRKAHGVATNVYSRKTSEKPKRVVYEL

SEQ ID NO: 172375 - protein, 481 aa, Glycine max
  Coding DNA Sequence Number=SeqID_55597
  Homolog annotation: Hit_ID=Q1T2K4; Match level="QueryCoverage=99%, HitCoverage=99%, E-value=1e-147, Identity=58%"; Hit description=IQ calmodulin-binding region
  Pfam annotation: Domain name=IQ; Domain location=123-143; Score=33.7; E_value=6.2e-07; Accession=PF00612.17; Description=IQ calmodulin -binding motif
  Subcellular localization annotation: CTP_CleavageSite=55; ConfidenceScore=5.14e-01
MGRRGSSWFSTVKKALSPEPKEKNDQVKTKFIFNLSQNSSRSKKKWFGKQKLQTSESTSQTDNAPPLPPPEIILTHVESEISHERIEVATAVDAVEPVPAVQMAAAEVQATTTVQFNSKPTEEVAAIRIQKAFRGYLARRELRALRGLVRLRSLMEGPVVKRQAISTLRSMQTFAHLQTQIRSRRLRMLEENQELQKQLLQKHAKELESIRLGEEWDDSIQSKEQVEAKLLSKYEAAMRRERAMAYSFSHQQNWKNASRSVNPMFMDPTNPAWGWSWLERWMAARPWESHSLMEKEKNDNKSLRSSSRGITSAEISKSFAKFQLNSEKHSPTASQNPGSPNFESHSNPPKPSSPAVARKLKKASPKDILAIDDGTKSMVSVQSERPRRHSIAGSIVGDDESLASSPSIPSYMVPTKSAKAKSRMQSPFAAENGTPDKGSSGTAKKRLSFPASPARPRRHSGPPKVESSFNAEITVGNGVAG

SEQ ID NO: 172376 - protein, 475 aa, Glycine max
  Coding DNA Sequence Number=SeqID_55598
  Gene Ontology: Mol. function=binding; Cellular component=nuclear pore; Biological process=protein transport
  Homolog annotation: Hit_ID=Q9LYX8; Match level="QueryCoverage=99%, HitCoverage=100%, E-value=0.0, Identity=69%"; Hit description =Importin alpha-like protein
  Pfam annotation: Domain name=Arm; Domain location=118-159; Score =33.3; E_value=8.3e-07; Accession=PF00514.13; Description =Armadillobeta-catenin-like repeat
  Pfam annotation: Domain name=Arm; Domain location=161-200; Score =23.4; E_value=0.00081; Accession=PF00514.13; Description =Armadillobeta-catenin-like repeat
  Pfam annotation: Domain name=Arm; Domain location=202-242; Score =23.2; E_value=0.00094; Accession=PF00514.13; Description =Armadillobeta-catenin-like repeat
  Pfam annotation: Domain name=Arm; Domain location=246-286; Score =21.4; E_value=0.0033; Accession=PF00514.13; Description =Armadillobeta-catenin-like repeat
  Pfam annotation: Domain name=Arm; Domain location=288-330; Score =13.4; E_value=0.26; Accession=PF00514.13; Description=Armadillobeta -catenin-like repeat
  Pfam annotation: Domain name=Arm; Domain location=332-372; Score =32.1; E_value=2e-06; Accession=PF00514.13; Description=Armadillobeta- catenin-like repeat
  Pfam module annotation: Pfam domain module=Arm::Arm::Arm::Arm::Arm::Ar m; Domain location=118-159::161-200::202-242::246-286::288-330::332 -372
  Subcellular localization annotation: CTP_CleavageSite=22; ConfidenceScore=5.09e-01
MADSGFTSNRRDPIKSSVGNAAASRRRQHAVTVGKERRESLMRAKRFCRVGIDGGDGGDGEVSVDSDMLIEEEQSILESQTSAAVENLKSAIAFQGKGAVKKRVGALQELRRLLSRSEFPPVESAINAGAVPLLVQCLSFGSPDEQLLEAAWCLTNIAAGNPEETKALLPALPLLIAHLGEKSYPPVAEQCAWALGNVAGEGEELRNVLLVQGALLPLARMMLPNRGSTVRTAAWALSNLIKGPDPKAATELVRIDGVLDAIIRQLKKADDELATEVAWVVVYLSALSNIATSMLVKSNVLELLVHKLATSNSLQLMIPEASWVLSNIAAGSVEHKQLIYSSEAVPVLLRLFSAAPFDIRKEVAYVLGNLCVSPTKGDDKPSLILEHLVSLVEKGCLPGFIDLVRSADIEAARLGLQFIELVLRGMPNGKGPKLVEQEDGIEAMERFQFHENEDLRTMANTLVDKYFGEDYGLDE

SEQ ID NO: 172377 - protein, 294 aa, Glycine max
  Coding DNA Sequence Number=SeqID_55599
  Gene Ontology: Mol. function=dolichyldiphosphatase activity; Cellular component=integral to endoplasmic reticulum membrane; Biological process=protein amino acid N-linked glycosylation
  Homolog annotation: Hit_ID=Q10MZ3; Match level="QueryCoverage=74%, HitCoverage=95%, E-value=4e-78, Identity=65%"; Hit description=PAP2 superfamily protein, expressed
MELEHTNSIRLRIRCQFPSLSPGHIVLKLQHIRYMRSVLHVEPPPKRALFNNRKVRIQNGVHNPEPNRAEENPKRGPSENLSQRMVPQVDAGIHGEQREGPREEVEGGVVAHVPEREAASEGEEGEVGGEEEHVLAVAGGPAVGVAHLKEGAGGGAGLLDGGLDDFVDELGDDEAEGEEYALEFAAEDEVRDEAAQGDEDGDKGYPGQEVADAVAPLVAHVRQRHGLQRRRGCHCCGRAREDLRSGFGVKSETDLLSPVATLHLEALMIFQGLKKFNKLFLLDLQCQPNRKLEL

SEQ ID NO: 172378 - protein, 96 aa, Glycine max
  Coding DNA Sequence Number=SeqID_55600
  Homolog annotation: Hit_ID=Q1T344; Match level="QueryCoverage=89%, HitCoverage=31%, E-value=4e-13, Identity=39%"; Hit description=RNA polymerase, RBP11-like
MMRLHGKPVHGGGGWMVKLICGIHNHELAKSLVGHPYAGRLTKDEKKIIADMTKLMVKPKNILLTLKKHNANNCTTIKQIYNARSAYRSSIRGANT

SEQ ID NO: 172379 - protein, 392 aa, Glycine max
  Coding DNA Sequence Number=SeqID_55601
  Gene Ontology: Mol. function=oxidoreductase activity; Biological process=electron transport
  Homolog annotation: Hit_ID=Q7WFA5; Match level="QueryCoverage=59%, HitCoverage=19%, E-value=6e-74, Identity=62%"; Hit description =Putative pyruvate ferredoxin/flavodoxin oxidoreductase
GRGGGAFLGALLAVEHVGAGDVVLARAHQGQFDLVLDVFDMEGAATGAVAHQRVDGLGRQLFNQLAHAGRGRALAAVDGQEGLGHGDGDLAGFEPDHRAIAADDVVAGPLPAVGVGRGIGLRGRHGRGPGHRGDRGRNAWTDESAWRGRRVSAGYIARGRRRIALHQAGQLRPVLLDVRSLHVAEAADGFCKGGDCSRLRQVVAVQPCEQLVYGLAVLAHQRALHLAFGGVAERIEPGAAQALEAGQQLERGHGARAQRQLARHAGARVLAREDRRCHVEAQAVVAFELALELGLEGLARIEAGDFVFVLVGHQLEQSARHRHGQARRPGVGRQLALARGDAFDHLAVGLRVGGVLVGGQVFDAARHGALEGFRHMQLHHLGARAQRAFQRF

SEQ ID NO: 172380 - protein, 167 aa, Glycine max
  Coding DNA Sequence Number=SeqID_55602
MTGFLQFFRRFPQINVGGDSTHFPPLEDAPVSLASLARKRVGCDRYHQLLAPQWHIQGKARSWLDCGGVKERLSFELQKVAVGLSSVVGLRAYPPLSAASTRLAQRRIWQSISIKATREGQGTKFHSSHIAYLGKGALEVARGAAFAEIPRLDDFSIGKCTVALELD

SEQ ID NO: 172381 - protein, 244 aa, Glycine max
  Coding DNA Sequence Number=SeqID_55603
  Gene Ontology: Mol. function=structural constituent of ribosome; Cellular component=ribonucleoprotein complex; Biological process =translation
  Homolog annotation: Hit_ID=Q8PNR9; Match level="QueryCoverage=90%, HitCoverage=90%, E-value=1e-118, Identity=95%"; Hit description=30S ribosomal protein S3
  Pfam annotation: Domain name=KH_2; Domain location=63-117; Score =81.6; E_value=2.4e-21; Accession=PF07650.7; Description=KH domain
  Pfam annotation: Domain name=Ribosomal_S3_C; Domain location=119-202; Score=173.3; E_value=6.3e-49; Accession=PF00189.10; Description =Ribosomal protein S3, C-terminal domain
  Pfam annotation: Domain name=Ribosomal_S3_N; Domain location=1-62; Score=92.8; E_value=1.1e-24; Accession=PF00417.9; Description =Ribosomal protein S3, N-terminal domain
  Pfam module annotation: Pfam domain module=KH_2::Ribosomal_S3 _C::Ribosomal_S3_N; Domain location=63-117::119-202::1-62
MGHKVHPIGIRLGISKDWNSKWYANKAEFAGYLAADLKVRDMLRKKLAQAGISKILIERPAKTARVTIHTARPGVVIGKRGEDIEKLRKEVSEMMGVPAHINVTEVRKPELDAQLVAESIAQQLERRIMFRRAMKRSVGNAMRLGALGIKVNVGGRLNGAEIARSEWYREGRVPLHTLRADIDYGFAEAKTTYGIIGIKVWIYKGEVFDFSQVGQEKQDDTPSRNDRHDRGDRGDRQRPAREAR

SEQ ID NO: 172382 - protein, 273 aa, Glycine max
  Coding DNA Sequence Number=SeqID_55604
MERQQCDQAERRAGNVGSPRQARRVELSSDEHDNGDRACGQQPGVGHPTGVQIADRDPQAHTDGQQSQQCHRTLLCPSVDGQQLLSLISLGAAQAGVLPDALSASLVRFSKSVSKKSLICVLPSAIRTPAITAASRPYSSAVTPSSSFRNLRIDAFMTFVSLYLSATGHLLGGGPAPPGSSVDLRTSWRRRHGGMDPPCSSRVIDSRRDAVRATATARRGAVGRSVERYVHGHAVPLGVVIIKDRITVLSTLPEWRPAATGTYMQIRQNPFGP

SEQ ID NO: 172383 - protein, 106 aa, Glycine max
  Coding DNA Sequence Number=SeqID_55605
  Homolog annotation: Hit_ID=UPI000066CAB0; Match level="QueryCoverage =88%, HitCoverage=47%, E-value=6e-08, Identity=35%"; Hit description =PROBABLE PREPILIN PEPTIDASE TRANSMEMBRANE PROTEIN; CpaA2
MGAGDVKFFSVLGLMLGWQALLPIWIAASLAAGAHAALVLVSRRLGPVLPIGLQAHMHRASSQWHSHPALRGMQSARQGRQGIPYAAYLAVSAIAWILISTYGGVA

SEQ ID NO: 172384 - protein, 272 aa, Glycine max
  Coding DNA Sequence Number=SeqID_55606
  Gene Ontology: Mol. function=DNA binding; Cellular component =mitochondrion; Biological process=chromosome organization and biogenesis (sensu Eukaryota)
  Homolog annotation: Hit_ID=Q1S8P7; Match level="QueryCoverage=93%, HitCoverage=64%, E-value=1e-77, Identity=65%"; Hit description=HMG-I and HMG-Y, DNA-binding
  Pfam annotation: Domain name=DUF296; Domain location=27-170; Score =157.0; E_value=4.8e-44; Accession=PF03479.5; Description=Domain of unknown function (DUF296)
MAKQQVRDCDRLQKKCDVFAITAAGDFVAHVLNAYTGEDVAGKILSFAQKGPRGICILSANGAISNVTIRQPGSSGGILTYEAWSLRSKCFLIPVSDLTLEMGNKGRFEILSLSGSFTVVDNSGMKSRTGGLSVSLAGPDGRVIGGGVAGLLTAAGPIQIVVGSFMQNCCKTQKRKYQREQQIVAATPTSAGPEIVTAAIPISQANAADGENFLIPIPIYQIPDQNQRESISVSSDKQNLDATPDAAATWNGSEEYSDQRTSPDINISLPDE

SEQ ID NO: 172385 - protein, 183 aa, Glycine max
  Coding DNA Sequence Number=SeqID_55607
  Homolog annotation: Hit_ID=Q1T132; Match level="QueryCoverage=80%, HitCoverage=23%, E-value=2e-17, Identity=37%"; Hit description=IMP dehydrogenase/GMP reductase
  Pfam annotation: Domain name=DUF1723; Domain location=76-125; Score =27.6; E_value=4.5e-05; Accession=PF08330.1; Description=Protein of unknown function (DUF1723)
MSQMLRPPSRGGPRDLKLLQSYKDHVVGRVWISELRAELKLINHGSSVIPYPTQPTVKEYVVRSRLLDLYDAQYTGMSNGVINAFIERWHNETSSFYLLVGKKTITLGDVSCLLHLPIIGQLLGHTMTSYTKKKIRRLLRSQLGIMTNQEANVVMSVGNKAWVSKHMPTIQGRLKDLRGLKQI

SEQ ID NO: 172386 - protein, 36 aa, Glycine max
  Coding DNA Sequence Number=SeqID_55608
MALWSYAESRLNNYLPMTQTSFYVFDKMPELCESCL

SEQ ID NO: 172387 - protein, 542 aa, Glycine max
  Coding DNA Sequence Number=SeqID_55609
  Gene Ontology: Mol. function=kinase activity; Cellular component =integral to membrane; Biological process=carbohydrate metabolic process
  Homolog annotation: Hit_ID=Q0G1Q6; Match level="QueryCoverage=86%, HitCoverage=88%, E-value=1e-130, Identity=54%"; Hit description =Carbohydrate kinase, FGGY
  Pfam annotation: Domain name=FGGY_C; Domain location=280-517; Score =36.7; E_value=2.2e-09; Accession=PF02782.6; Description=FGGY family of carbohydrate kinases, C-terminal domain
  Pfam annotation: Domain name=FGGY_N; Domain location=43-275; Score =9.6; E_value=1.2e-10; Accession=PF00370.11; Description=FGGY family of carbohydrate kinases, N-
  Pfam module annotation: Pfam domain module=FGGY_C::FGGY_N; Domain location=280-517::43-275
IKDRCARRKSSATWEAWPCLGDGSCAEVSTRRFAKDVAMPADLLIGVDAGTSVIKAVAFDLGGRQVGASSVPNRYLRGDDGSATQSLEATWADCVTALRGLAEKVENLAARTAALAVTAQGDGTWLVGAGNVPTADAWLWLDARAAPTVQGLAASPLNRARFEGHGHGPQYLPAGVANGPYGPSRRVLARQGRSGAALQGLALSESDGCARHRPRYDDTVIDALGLNHRRHLLPEIIDGTQITHGLTADAARQTGLLAGTPVCLGYVDMAMTALGAGVHTGEANTACSIVGSTGVHLRSVTIDEVWLNPAQTGYVIPLPWPGYVTQVQTNMASTLNLDWLLNVASDLLSSFGCETDHARLVQQIDRWLNDAQPGTLLFHPYISLAGERGPFVNADARASFTGLNYQHNFGDLVRGVIEGIGMAARDCYQAMGATLPGEIRLTGGAVRSQPLRQILAACIGAPVRISQREEAGAAGAAMMAAVAIGAYPDMAQCVERWVRPLLDDAEAPSPALMQRYQQLFPQYQQIRRDLPAAWQALNSFKE

SEQ ID NO: 172388 - protein, 218 aa, Glycine max
  Coding DNA Sequence Number=SeqID_55610
  Homolog annotation: Hit_ID=Q4HIX7; Match level="QueryCoverage=26%, HitCoverage=62%, E-value=2e-08, Identity=48%"; Hit description=Cell wall-associated hydrolase, putative
RYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTSPVEQGRKLIFPRAHIDGKGWAVRPLKRYVSWVQNVVRQFGPYPVWALEH

SEQ ID NO: 172389 - protein, 74 aa, Glycine max
  Coding DNA Sequence Number=SeqID_55611
MTNTTFSTNQNTNQEMNFAAKKPVEFPPIPVSYADLLPYLLDNSMVAITPAKVHQPPFLQRNVCLSWRSPGAFH

SEQ ID NO: 172390 - protein, 119 aa, Glycine max
  Coding DNA Sequence Number=SeqID_55612
  Homolog annotation: Hit_ID=Q1T132; Match level="QueryCoverage=64%, HitCoverage=12%, E-value=1e-07, Identity=35%"; Hit description=IMP dehydrogenase/GMP reductase
CEEVLEYDHEQPLATRWRPLRDTNKVDSTKEVLERLQLTGVVWSPYASQRDLRPFKDQTYYSGNIRVGTNISLYLPERVLRKFRNNISDKSWFTPQGNDLFWRSVNLCIQLDWFFRTKL

SEQ ID NO: 172391 - protein, 173 aa, Glycine max
  Coding DNA Sequence Number=SeqID_55613
  Gene Ontology: Mol. function=delta14-sterol reductase activity; Cellular component=integral to membrane; Biological process=steroid biosynthetic process
  Homolog annotation: Hit_ID=Q9LDR4; Match level="QueryCoverage=93%, HitCoverage=42%, E-value=8e-51, Identity=73%"; Hit description =Delta(14)-sterol reductase
WDIIAERLGFMLVFGDLVWIPFTFSIQGWWLLMNSVESTPAAIVANCFVFLIGYMVFRGANKQNHVFKKNPKARIWGKPPKVIGGKLLASGYWFLGRGKGENRVSHSEIDLHYDVLQCHTKHKHFTNSILLSSLSSYSVNLEREGMKLVVQRNENGMVKAPRLIKSNSVMFPV

SEQ ID NO: 172392 - protein, 885 aa, Glycine max
  Coding DNA Sequence Number=SeqID_55614
MKGGKKNRKIPATLFKPVILKPVPIYTLGEKNQKGYHRACIDFSLGSEKPIVAVDSGKASDAVEAEARNSSVGQNDRLKKPFVPSFIIDNTGDPHETYIACCSKRNSQDIPFTLDNADKDKEESRQITSMQINKEEKNKELCDPIVEFAAVSSTFKENHKSDKGSSHGIDLNKPSQLKPRRRKHRLKVIEEDKPQRTEKPVTPKSVQSKENPTHKRKYERRKGVNKTSAPPREVPGELIKETMPESAQTSCPGYVNFDERARVRSYAVEDNPTVHLGSEIGVVRQEMKVGLACDLNASMKPKKNPTGKRKHLRWKGVNKTSAPPTEMIGTKKKMRESAQTSCKGSVKFDERARDQSYAVKENPAVCPVQEMNVGLACDLITSLKLEENPNVKTKYMGRKQVNKTSAPPTEVTGELTKEKMPESSQMSCTGSVNFDERTRDQSNVVKKNQSVLLGSEIGVVIQEMNVGFVCDLITSLKLEENPTAKMKCMRRKRVNKTSAPPTEIIGTKQKMPESAQTSCTGSVNFDERARDQSYPVKVNPTAVAWMKKALNNSMSLSEETQHPSTPIPPTEMTGKRNNARKKGLNPSPNMSWRRSLNFDMGTRNESYVGREILDFHIGKENMVLEETKVGLTYKDTWVKEALNVCMSLPEETQHPSTSNSKCTSLGAKLNANSMENKNRKGQTTAQDGNFNNSQISTIRLQMDGSKRKHSRTFNCADYSRMNRIGAHYNGLPSCQTNFCIQFPNIQKKRRTKKGETSNTSVTSVTTTKEVQQTYPQEDALAHSYASSSRCWIYGSGYNAATVPAVSELTENLIDNTHTFNEFVLALKRLAERSQSSTFDRDTKNEGTLSKNGNRKEEKEGILKQAQPNSDAKRASGAKRATNCRR

SEQ ID NO: 172393 - protein, 210 aa, Glycine max
  Coding DNA Sequence Number=SeqID_55615
  Gene Ontology: Mol. function=nucleic acid binding
MMIILCIHVDGSDATEDLDVTITFDDPEEETNDREGFNGSMQRKKGGRGVQQDSCKQSQSKAHGVDRKFQLLHHQKTTTPNVRQQDLKDHKWVIGTLFPTKDEFKEAVMTYGVQSGRNVKFDRNDKERVRVGCKEGCRWSIYLAKNKNEKTWQIRTLKDEHTCSRECRVTMMKSKWLSKRLVNGVREKPNTHPIPTTSTNTNPNPARSTL

SEQ ID NO: 172394 - protein, 181 aa, Glycine max
  Coding DNA Sequence Number=SeqID_55616
  Subcellular localization annotation: CTP_CleavageSite=32; ConfidenceScore=5.12e-01
MRWLETAFFIRRGNLIETTSFQSSGFSNKLKSAFLVSTLACLRSKNKNFEELKRRTLTGDVGMEEEYFKVKVHHSGKFVKGKKVTYEGKDYEKGYKDVETLWYKAAGRDLNDGLKQLVDDAGALEMIRIAKCEGCVHLYVLHPEIVHHIVGNERNDLPENHIAQDNIPQETPMAEDNVSIQ

SEQ ID NO: 172395 - protein, 49 aa, Glycine max
  Coding DNA Sequence Number=SeqID_55617
MASLRMLLCLLSLSFLPLSLMAFYNGFLHPQWLKTSITLAAATKLLITI

SEQ ID NO: 172396 - protein, 421 aa, Glycine max
  Coding DNA Sequence Number=SeqID_55618
  Gene Ontology: Mol. function=transferase activity; Cellular component= membrane; Biological process=electron transport
  Homolog annotation: Hit_ID=Q9FNI7; Match level="QueryCoverage=91%, HitCoverage=73%, E-value=1e-170, Identity=70%"; Hit description =Glucosyltransferase-like protein
  Pfam annotation: Domain name=Glycos_transf_2; Domain location=76-247; Score=22.0; E_value=1.8e-05; Accession=PF00535.16; Description =Glycosyl transferase
MGLIWSQVKEPVIVPMLRVSVFLCLAMSLMMLVERVYMGIVICLVKLFGRRPEKRYKWEPMKDDVELGNSSYPMVLVQVPMYNEREVYQLSIGAACGLSWPSDRIIIQVLDDSTNPTIKELVQMECSRWASKGVNIKYEVRDNRDGYKAGALKEGMKRNYVKQCDYVAIFDADFQPDPDFLWRTVPFLVNNPELALVQALNANECLMTRMQEMSLDYHFTVEQEVGSCTYAFFGFNGTAGVWRISALYESGGWNHRTTVEDMDLAVRASLRGWKFLYLPNLKVKNELPSTLNAYRFQQHRWSCGPANLFMKMFMEIMRNRKVSLYKKIYVIYSFFFVRKVVAHINTFMFYCIVLPATVVVPEVVVPKWGAVYIPSIITLLNAVGTPRNDNGEDSNPPPLLSSFFLHPSRTIGPTLYLSFAL

SEQ ID NO: 172397 - protein, 64 aa, Glycine max
  Coding DNA Sequence Number=SeqID_55619
MTSETKGNAPAFVDELRGFRGGGSAPVAHYCDASPCTCLGAQYFLMKAQLIGGLMTLLGVTGSP

SEQ ID NO: 172398 - protein, 203 aa, Glycine max
  Coding DNA Sequence Number=SeqID_55620
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=7e-25, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLNVLAFRGLHVLPFRGQHDLPFRGLHALALTGLHVLTFRGLHNLAFRGLDALAFRGVHILPLRGLHALAFVGLHTLTFKGVHVLNIRGLYIVAIRGLHVLAFRGLHVLHFRGLHAHTFKGYLHRTTRPWLRKASRPHLQRTTHARLQRTTRLCLRRATRPHLQRTTHPRFLSDTCPRLQRTTRLTFQGSTRPCLQWATRPCL

SEQ ID NO: 172399 - protein, 113 aa, Glycine max
  Coding DNA Sequence Number=SeqID_55621
  Gene Ontology: Mol. function=chitin binding; Cellular component =extracellular region; Biological process=chitin metabolic process
  Homolog annotation: Hit_ID=UPI0000612705; Match level="QueryCoverage =97%, HitCoverage=42%, E-value=1e-08, Identity=31%"; Hit description =UPI0000612705 related cluster
MSNTSKDYMSSTSEDYTFSPLEHYMSLPYEGYTASPFEDYTPSPSEDYTGLHNLAFRGLDALAFRGVHILPLRGLHALAFVGLHTLTFKGVHVLNIRGLYIVAIRGLHVLAFR

SEQ ID NO: 172400 - protein, 231 aa, Glycine max
  Coding DNA Sequence Number=SeqID_55622
  Gene Ontology: Mol. function=DNA binding
  Homolog annotation: Hit_ID=Q1SWX1; Match level="QueryCoverage=92%, HitCoverage=41%, E-value=5e-25, Identity=32%"; Hit description=IMP dehydrogenase/GMP reductase
MGSSQMPSLKKRFYQVKVKSLGITSLKELGQLMGQLQRQAFRKAYGKIWDLAMIEVSTEAIASLAQYYDQPLRCFTFGDFQLSPMVEEFEEILGCPLGGRKPYLFTGFYPSLARISKIVQISAQELDHRKQVENGVVGIPRKYLEVKARILADKGEWVPFIDNLALLIFGGVLFPNVDGLVDLAAIDAFLAYHNHKESPVVAMLADLYDTFDRRYEKSNTRIVCCTPALYV

SEQ ID NO: 172401 - protein, 62 aa, Glycine max
  Coding DNA Sequence Number=SeqID_55623
TTIEVHKDVGDFSDDEDLMLSEIAFYQEVIGEQILKGEMLSSDEECDSSGDESDPSKDMTSP

SEQ ID NO: 172402 - protein, 260 aa, Glycine max
  Coding DNA Sequence Number=SeqID_55624
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=21%, E-value=4e-83, Identity=68%"; Hit description=Chromo
MEPELAMILYTYRTVFDVPSGLPPSRTHNHSIPLVEGAGPVKVKPYSIFSNLDLRSGYHQILVNEEDRHKTAFRTHQGHYEWLVMPFGLTIAPATFQSLMNEVFQCYLRKFVLVLFDDILIYSPNWSAHLQHLETVLKVLEQHKLYAKLSKCSFGLQEIDYLGHTVSGKGVTMDQEKAQAVLNWPYPINLKQLRGFLGLTGYYRKFIKGYVSIATPLSNLLKKKNLHWNDHTSMAFDNLKAAITKAPVLALPDFSKAFTF

SEQ ID NO: 172403 - protein, 112 aa, Glycine max
  Coding DNA Sequence Number=SeqID_55625
MGEVEKLPATNAVAKVNPMPPSGLNQMNHPTSNMVGKDLGSTDDPMMCKFKTSTPSHHMACLPTIHHPMWHTLSMKISMTPLRYSLRTNNLNLIRHISLKPWGRHMKFPTTI

SEQ ID NO: 172404 - protein, 65 aa, Glycine max
  Coding DNA Sequence Number=SeqID_55626
MRGTVHEPQVNIGADQKFTPVDGGPWVLVTLTVERTTRPRLERTTRPPPWVLVTLTVERTTRPPP

SEQ ID NO: 172405 - protein, 77 aa, Glycine max
  Coding DNA Sequence Number=SeqID_55627
VRPKSNLASLPGSSGPKVWLHETFYQYTCHRQGQDSSPYTWPTTEQFEVAVAWPEDWPEDQTRLAGAPGGEDEVEDD

SEQ ID NO: 172406 - protein, 163 aa, Glycine max
  Coding DNA Sequence Number=SeqID_55628
MSYRMSRHHASEHADYMCPYEQIKQPLFTTFSPNHYPCNLYLRATLRYENLRSLPLTHTPVFTIKSKTHQRSTLNKRDQLYTLEINSTHIGPTLDARVPSRWLTKDSSPKNSQTNSSIPDLVQNSCSLHDYIAVYDSGLQLLDAGGDLSSSEKSAVKELKDNF

SEQ ID NO: 172407 - protein, 54 aa, Glycine max
  Coding DNA Sequence Number=SeqID_55629
MYMVNNIFTRSRRKENIKIMHHRPRAIPYNPLTQTNKHETKPKLLHRFGHIHTI

SEQ ID NO: 172408 - protein, 91 aa, Glycine max
  Coding DNA Sequence Number=SeqID_55630
MIIEESIHVAFDETNAILPRKDILDDISESLEEMHIHGEEHKGKGEGNDEDLHIDEIKINADLPREWRTSRYHPLDNIIGDISKGIWDGKC

SEQ ID NO: 172409 - protein, 45 aa, Glycine max
  Coding DNA Sequence Number=SeqID_55631
ENEGGVCHPAPPGELGCFLQMAPPSGGTSWKAQVGPIAICTPPVY

SEQ ID NO: 172410 - protein, 77 aa, Glycine max
  Coding DNA Sequence Number=SeqID_55632
  Subcellular localization annotation: CTP_CleavageSite=54; ConfidenceScore=5.20e-01
MTDRSSSLPGVGQAEDVAARQPKMASRKLASKRSRKDKAAEGTSSTPDASRPSRDSHFSGSDASSSGTMSIPISRKK

SEQ ID NO: 172411 - protein, 386 aa, Glycine max
  Coding DNA Sequence Number=SeqID_55633
  Gene Ontology: Mol. function=thiamin pyrophosphate binding; Cellular component=chloroplast; Biological process=branched chain family amino acid biosynthetic process
  Homolog annotation: Hit_ID=UPI0000687CDB; Match level="QueryCoverage =99%, HitCoverage=70%, E-value=2e-82, Identity=45%"; Hit description =acetolactate synthase, catabolic, putative
MARATPAKSVPAKSTPSVGQAVGALLDLDQRQGFVGKDEDDHRRPRVAGRRQFAQRHFQARVAGEHGHRPFGLGQLGADAQRQRAAHGAQRRGLHQGPRFMALPHLRQQDAMRAAVDRGHGVRGQQRPRHIDDRGRPPFLVGAVDGGDGALDVGNGAFGPLRLPRQPGAQRGQAVPDIADERDRRLVHVMGVAGRGHLDHPRVVGPDIAPSHAHLDRVVARQQDHVGLADERQHDLVCQWRQPHAADHHVAALVHDALALVGRDQRNPQLPHQRLDLRLRVMMQGLDPGDDHGPPGRRQPGAGLLEALRIGRRHRRRRHAPRAPGGHDFLQGHRNRHIHVHRPRRVVHGDGERLVDDGLRGAGGHAQRCLGDRPHQCRVVEHLMRI

SEQ ID NO: 172412 - protein, 452 aa, Glycine max
  Coding DNA Sequence Number=SeqID_55634
  Gene Ontology: Mol. function=metal ion binding; Cellular component =intracellular; Biological process=metabolic process
  Homolog annotation: Hit_ID=Q94E87; Match level="QueryCoverage=96%, HitCoverage=84%, E-value=1e-150, Identity=42%"; Hit description=PPR -repeat protein-like
  Pfam annotation: Domain name=PPR; Domain location=198-232; Score =47.3; E_value=5.3e-11; Accession=PF01535.11; Description=PPR repeat
  Pfam annotation: Domain name=PPR; Domain location=233-267; Score =10.6; E_value=0.41; Accession=PF01535.11; Description=PPR repeat
  Pfam annotation: Domain name=PPR; Domain location=269-303; Score=0.4; E_value=6.7; Accession=PF01535.11; Description=PPR repeat
  Pfam annotation: Domain name=PPR; Domain location=335-369; Score=9.5; E_value=0.56; Accession=PF01535.11; Description=PPR repeat
  Pfam annotation: Domain name=PPR; Domain location=97-131; Score=41.4; E_value=3.2e-09; Accession=PF01535.11; Description=PPR repeat
  Pfam module annotation: Pfam domain module=PPR::PPR::PPR::PPR::PPR; Domain location=198-232::233-267::269-303::335-369::97-131
MVTGFAQFGDSDKALKLFYDMHQSGELPSEFTLVGVINACSDACAIVEGRQMHGYSLKLGYELQLYVLSALVDMYAKCGSIVDARKGFECIQQPDVVLWTSIITGYVQNGDYEGALNLYGKMQLGGVIPNDLTMASVLKACSNLAALDQGKQMHAGIIKYNFSLEIPIGSALSAMYAKCGSLDDGYRIFWRMPARDVISWNAMISGLSQNGRGNEGLELFEKMCLEGTKPDNVTFVNLLSACSHMGLVDRGWVYFKMMFDEFNIAPTVEHYACMVDILSRAGKLHEAKEFIESATVDHGLCLWRILLAASKNHRDYDLGAYAGEKLMELGSLESSAYVLLSSIYTALGKWEDVERVRGMMKARGVTKEPGCSWIELKSLTHVFVVGDNMHPQIDEIRLGLKLLTKLMKDEGYQPLLDSLPPETISDDLKDQEDSHEIQLRLRALSPIKKQGN

SEQ ID NO: 172413 - protein, 1029 aa, Glycine max
  Coding DNA Sequence Number=SeqID_55635
  Gene Ontology: Mol. function=transmembrane receptor activity; Cellular component=membrane; Biological process=defense response
  Homolog annotation: Hit_ID=Q2HUD1; Match level="QueryCoverage=96%, HitCoverage=80%, E-value=0.0, Identity=49%"; Hit description=TIR; Disease resistance protein; AAA ATPase
  Pfam annotation: Domain name=ABC_tran; Domain location=13-167; Score=- 60.6; E_value=0.04; Accession=PF00005.17; Description=ABC transporter
  Pfam annotation: Domain name=LRR_1; Domain location=383-408; Score =3.8; E_value=55; Accession=PF00560.23; Description=Leucine Rich Repeat
  Pfam annotation: Domain name=LRR_1; Domain location=429-450; Score =1.1; E_value=1.8e+02; Accession=PF00560.23; Description=Leucine Rich Repeat
  Pfam annotation: Domain name=LRR_1; Domain location=452-474; Score =10.8; E_value=2.7; Accession=PF00560.23; Description=Leucine Rich Repeat
  Pfam annotation: Domain name=LRR_1; Domain location=476-495; Score =5.0; E_value=34; Accession=PF00560.23; Description=Leucine Rich Repeat
  Pfam annotation: Domain name=LRR_1; Domain location=499-520; Score =11.9; E_value=1.7; Accession=PF00560.23; Description=Leucine Rich Repeat
  Pfam annotation: Domain name=LRR_1; Domain location=523-544; Score =8.0; E_value=9; Accession=PF00560.23; Description=Leucine Rich Repeat
  Pfam annotation: Domain name=LRR_1; Domain location=546-568; Score =10.3; E_value=3.4; Accession=PF00560.23; Description=Leucine Rich Repeat
  Pfam annotation: Domain name=LRR_1; Domain location=570-592; Score =12.6; E_value=1.2; Accession=PF00560.23; Description=Leucine Rich Repeat
  Pfam annotation: Domain name=LRR_1; Domain location=651-674; Score =2.7; E_value=89; Accession=PF00560.23; Description=Leucine Rich Repeat
  Pfam annotation: Domain name=LRR_1; Domain location=783-804; Score =5.4; E_value=27; Accession=PF00560.23; Description=Leucine Rich Repeat
  Pfam annotation: Domain name=NACHT; Domain location=13-188; Score= -31.6; E_value=0.017; Accession=PF05729.3; Description=NACHT domain
  Pfam annotation: Domain name=NB-ARC; Domain location=3-291; Score =93.2; E_value=8.1e-25; Accession=PF00931.13; Description=NB-ARC domain
  Pfam module annotation: Pfam domain module=ABC_tran::LRR_1::LRR _1::LRR_1::LRR_1::LRR_1::LRR_1::LRR_1::LRR_1::LRR_1::LRR_1::NACHT::NB- ARC; Domain location=13-167::383-408::429-450::452-474::476-495::499 -520::523-544::...
  Pfam module annotation: Domain location=546-568::570-592::651 -674::783-804::13-188::3-291
MYSLMGIRLKDVRLIGIWGRGGIGKTTIARKVYEAIKGDFDVSCFLENIREVSKTNGLVHIQKELSNLGVSCFLEKCKTNGLVPIVEEVFRDQLRIVDFDNLHDGKMIIANSLSNKKVLLVLDDVSELSQLENLAGKQEWFGPGSRVIITTRDKHLLKTHGVHLTCKARALAQNEALQLICLKAFKRDQPKKGYLNLCKEMIECARGLPLALEVLGSHLHGRNVEVWHSALEQIRSFPHSKIQDKLKISYDSLQPPYQKMFLDIACFFKGMDIDEVKNILRNCGDYPEIGIDILIERCLVTLDRVKNKLGMHDLLQEMGRNIVFEESPNDPGKRSRLWSEKDIDYVLTKNKGTDKIQGMVLNLVQPYDSEVLWNTGAFSKMGQLRLLKLCDMQLPLGLNCLPSALQVLHWRGCPLKALPLWHGTKLLEKLKCIDLSFSKNLKQSPDFDAAPNLESLVLEGCTSLTEVHPSLVRHKKLAMMNLEDCKRLKTLPSNMEMSSLKYLNLSGCSEFKYLPEFGESMEQLSLLILKETPITKLPSSLGCLVGLAHLNLKNCKNLVCLPDTFHKLKSLKFLDVRGCSKLCSLPDGLEEMKCLEQICLSADDSVELPSSAFNLENLQITFESQSQTSFVTYLTGSNSVILPSCISKITKLELLILNFCKKLQRNSVFPKQDLTWSEIPSWSVPPKYVVPPEMHQHEVECCLFRPNGKVLISSRILPTMEPLFIGNSEVWVSFGICDICELFSSITKSAQVEHKLVGQNVLKTDPTRNNFVTLPSCISKLTKLELLILNLCKKLQRLPELPSSMQQLDASNCTSLETSKFNPSKPRSLFASPAKLHFPRELKGHLPRELIGLFENMQELCLPKTRFGMFITGSEIPSWFVPRKSVSFAKIAVPHNCPVNEWVGFALCFLLVSYAVPPEACRHEVDCYLFGPNGKKIISSRNLLPMEPCCPHLYSLYLSIDKYRDMIYEGGDGSEVEFVQKSYCCQSLGIVRCGCRLKLLILHTCGLNSTFACFVEMIHANENQDIKGN

SEQ ID NO: 172414 - protein, 157 aa, Glycine max
  Coding DNA Sequence Number=SeqID_55636
  Gene Ontology: Mol. function=transmembrane receptor activity; Cellular component=membrane; Biological process=defense response
  Homolog annotation: Hit_ID=Q70WI0; Match level="QueryCoverage=97%, HitCoverage=19%, E-value=5e-56, Identity=70%"; Hit description =Putative resistance gene analogue protein
  Pfam annotation: Domain name=TIR; Domain location=17-146; Score =160.6; E_value=4.2e-45; Accession=PF01582.10; Description=TIR domain
MGSSSTLTSGRLWSNHVFLSFRGDDTRKGFTHNLFASLERRGIKAYRDDHDLERGKVISVELIEAIEESMFALIILSSNYASSTWCLDELQKILECKKEVFPIFLGVDPSDVRHQRGSFAKAFRDHEEKFREEKKKVETWRHALREVASYSGWDSKD

SEQ ID NO: 172415 - protein, 101 aa, Glycine max
  Coding DNA Sequence Number=SeqID_55637
MIGSDTALGSLPHWCLGLAKQSQNFAFESNRQMLDIHAFLFNGIMIVLPAMKHQHRHGHRTRYGYGHVNICNVQNIERSTGVVSVSNTDTDACRTPDTTKN

SEQ ID NO: 172416 - protein, 139 aa, Glycine max
  Coding DNA Sequence Number=SeqID_55638
MGEAEEVQEKIKADMEAMKKQMATMMEAMMSMKKIMEANAVIVAATSAVAKVNPMLPSGLKQMNHPTSNMVGKDLGSMDDPMMCKFKTSTPSHHMACLPTVHHPMWHTLSMKISITPLRYSLRTNNLNLIRHISLKPWG

SEQ ID NO: 172417 - protein, 59 aa, Glycine max
  Coding DNA Sequence Number=SeqID_55639
MAEQARQVFYVQDPCDERWCMRDRSPKQMASLGLHTTHVCRQFHHPPPLPSLASHVYCC

SEQ ID NO: 172418 - protein, 56 aa, Glycine max
  Coding DNA Sequence Number=SeqID_55640
MTLSLEYLPCDLMRKSVQFQVKRGQNLEVLKGAVVLSGPCRLRAHALLSAASVWLA

SEQ ID NO: 172419 - protein, 108 aa, Glycine max
  Coding DNA Sequence Number=SeqID_55641
IWATWEYVSSVGGGQTRDGGEVPRDMSRGSGDLGDVRRAPGSQQIKGTKTTKQGGLWWLASCEFCVIYGLWSLVIDYQGWEAKGASGNRLPVCVIDYTEEWVTGNRLP

SEQ ID NO: 172420 - protein, 128 aa, Glycine max
  Coding DNA Sequence Number=SeqID_55642
MDINFDSFDKFVELVLDLFSVCTLVMLEKPSPLRFILRRIKIFPKGMLEVVSIPWRFIVGNWLCDSDLVSPTGIERVLTEKDLLADLYSDLEASILDEKEFLLLKVISTFPELSCLICSMVGAGRGID

SEQ ID NO: 172421 - protein, 308 aa, Glycine max
  Coding DNA Sequence Number=SeqID_55643
  Gene Ontology: Mol. function=RNA-directed DNA polymerase activity; Biological process=RNA-dependent DNA replication
  Homolog annotation: Hit_ID=Q8H6Q8; Match level="QueryCoverage=95%, HitCoverage=10%, E-value=3e-26, Identity=27%"; Hit description=CTV.20
  Subcellular localization annotation: CTP_CleavageSite=44; ConfidenceScore=5.27e-01
MDKATPSIPRPAPTIEHIKQDNSGKVEITFNRRNSFSSRIEASRSEYKSARRSFSVRTRSIPVGLTRSESHNQFPTINLQGIDTTSSIPRTTYNQEQEDDQNIDKETLRKDFYSPENEPQRRWFFQHYKGTNRKQIQDKFYEFVERVKINVHFFDWFHAYAIRNDIDYPWKQDIIGDPTTNVITNWQVKDGELIQSELPPATQYQLPNIKDSNNKPVMAIPFKTKDVSEEVTSKDIKSLMEQANYTNKYLQALGETIKTKVVPKQKSIEETSPSIPIEKPLFKPFKVSEKAKRKIRELRKTKSLIEGV

SEQ ID NO: 172422 - protein, 162 aa, Glycine max
  Coding DNA Sequence Number=SeqID_55644
  Gene Ontology: Mol. function=RNA-directed DNA polymerase activity; Cellular component=intracellular; Biological process=RNA-dependent DNA replication
SILRLMRTLGLSPTSLAQSSWSLLTMALVMGPLLERIASQMLPVVARYPEWVANIVPIPKMDGKVRMSMDYRDLNQASPKDNFPLLHIDILVDNTTRFALFSFMDRFSRYNQIKMAPEDIEKMTFITRAMVALFHDMMHKEIEDYVDDMIAKSKMEEEHLVN

SEQ ID NO: 172423 - protein, 81 aa, Glycine max
  Coding DNA Sequence Number=SeqID_55645
LSLPHQWAKCASTAKRSFIALRATEESGRASASRSRAKREISALSAAGYNAQGTKFHRHHSAYFRKIALEAARGAAFAEIP

SEQ ID NO: 172424 - protein, 121 aa, Glycine max
  Coding DNA Sequence Number=SeqID_55646
MCPVVGFGPWLGLGKPLVEILPPGQLRGFCPLLAWLGSAVLGYGPVLSFGLVGPPPPPQKKFVPGFCQLWLAPRWLSLCLGGGSSCHNMARHKVTRTHTHTHSRRLKGEEGLGRPSARAHT

SEQ ID NO: 172425 - protein, 229 aa, Glycine max
  Coding DNA Sequence Number=SeqID_55647
MVFVGEIIEVGLKTGKFDYVSSTCTNARRIGATGAKRKEGDTHAITSAPAWIKPPRISHGTHQYAQHHPSFSARAGDFSNSAPVQTRAPVPIQREAPQALAPIPTHLAGNAHFGAGSNAIRNFPSRPTFTLIPMAYEDLLPSLVANQMAMISPGRIYQPPFPKWYNPEEEIPTEGRGHNRALHVSVKCIDHVVAKVTFQVMDINLAYNYLLGRPWIHSVGVVPSTLHQK

SEQ ID NO: 172426 - protein, 197 aa, Glycine max
  Coding DNA Sequence Number=SeqID_55648
  Gene Ontology: Mol. function=protein binding; Cellular component =nucleus; Biological process=multicellular organismal development
  Homolog annotation: Hit_ID=Q570C0; Match level="QueryCoverage=100%, HitCoverage=33%, E-value=1e-89, Identity=76%"; Hit description =TRANSPORT INHIBITOR RESPONSE 1 protein
  Pfam annotation: Domain name=F-box; Domain location=4-52; Score=19.1; E_value=0.016; Accession=PF00646.23; Description=F-box domain
MRPRVAYSFPEEVLEHVFSFIECDKDRGSISLVCKSWYEIERWCRRRVFVGNCYAVSPATVVNRFPKVRSIAIKGKPHFADFNLVPEGWGAYVGPWIKAMAAAYPWLQEIRLKRMVIADECLELIAKSFKNFQVLVLTSCEGFTTDGLAAIAANCRNLRELELRESEVDDICGHWLSHFPDSYTSLVSLNISCLGNE

SEQ ID NO: 172427 - protein, 127 aa, Glycine max
  Coding DNA Sequence Number=SeqID_55649
MGTRGCINYNPVLAIRQLGYPMRGTPLEEGLTPFIAWLKAYAQGLDWLPNLRTTKVVEGEAPKEDEQVQALKTKLERAQTGKEKFKSVTVRIRKGNAELRDINIAITKALEQETKRARKEEHGRNKF

SEQ ID NO: 172428 - protein, 138 aa, Glycine max
  Coding DNA Sequence Number=SeqID_55650
  Pfam annotation: Domain name=zf-CCHC; Domain location=78-95; Score =13.5; E_value=0.0059; Accession=PF00098.13; Description=Zinc knuckle
MELQRLNQNEETDKRKRRITLKASSSKQEEEEEEEESNDEEDFSLFVKKIHKSVKNTRMERSYNFNNGKRSQEVSPTLKCYKCNQPDHIKNEKKIYKERRSKKAYIAWDDNDSSDGSKKEINLLSKDYESDENIFQED

SEQ ID NO: 172429 - protein, 323 aa, Glycine max
  Coding DNA Sequence Number=SeqID_55651
  Gene Ontology: Mol. function=phosphoribulokinase activity; Biological process=carbohydrate metabolic process
  Homolog annotation: Hit_ID=Q5PLV2; Match level="QueryCoverage=66%, HitCoverage=74%, E-value=1e-104, Identity=88%"; Hit description =Phosphoribulokinase
  Pfam annotation: Domain name=PRK; Domain location=115-320; Score =349.1; E_value=7.3e-102; Accession=PF00485.8; Description =Phosphoribulokinase  Uridine kinase family
  Pfam annotation: Domain name=UPF0270; Domain location=63-124; Score =18.3; E_value=0.00021; Accession=PF06794.3; Description =Uncharacterised protein family (UPF0270)
  Pfam module annotation: Pfam domain module=PRK::UPF0270; Domain location=115-320::63-124
PCRLLSKITQPTLIIHAKDDPFMDHHSIPAQEFLPDNVHYQLTEHGGHVGFIGGTLRRPKMWLETRIPDWLTPYLDGTDYGEHERSLEQKVNDVKRQLKSGDVVLGVVMSARHPIIAVTGSSGAGTTTTSLAFRKIFAQLNLRAAEVEGDSFHRYTRPEMDMAIRKARDLGKHISYFGPEANDFGLLEQTFIEYGQSGKGQSRKYLHTYDEAVPWNQVPGTFTPWQPLPEPTDVLFYEGLHGGVVTPQHDVARHVDLLVGVVPIVNLEWIQKLTRDMSERGHSREAVMDSVVRSMEDYINYLTPQFPALISTSSACRRWTPPT

SEQ ID NO: 172430 - protein, 149 aa, Glycine max
  Coding DNA Sequence Number=SeqID_55652
  Homolog annotation: Hit_ID=Q1SP02; Match level="QueryCoverage=60%, HitCoverage=19%, E-value=5e-09, Identity=35%"; Hit description=IMP dehydrogenase/GMP reductase
MKGITGASYQACCDALTVTDVCWLPYSEHRGVRGFELISSFQGQLRWDPMVVTVRPKRVLRQFGYIQSIPSPPVSALLSYDDIDDMWMHFADHVLAVGELLCSAWVGDQPRHVPAPDHEDYMQPTIPQVPVAFDPPRHAVVRLFTRFNV

SEQ ID NO: 172431 - protein, 235 aa, Glycine max
  Coding DNA Sequence Number=SeqID_55653
  Gene Ontology: Mol. function=RNA-directed DNA polymerase activity; Cellular component=nucleus; Biological process=RNA-dependent DNA replication
MECILKEIGLPMQFVSWIMTGVSTVSYRFNVNGTYSDIMQAKRGIRQGDPMSPMLFVIIMEYMHRTLVKMQQNPDFNYHSKCGKIGLTNLTFADDVLLFCRGDRLKVNPAKCQMFFGGMDGCSKENLRRITDFAEGKLPVRYLGVPLSCKRLTIQQYMPLIDKIVDKVKHWTSKLLSYAGRIQLVKSITSAIAMYWMQCFPLPQFVLRKINAICRSFVWTEILRIFGCCGFIHII

SEQ ID NO: 172432 - protein, 263 aa, Glycine max
  Coding DNA Sequence Number=SeqID_55654
  Gene Ontology: Mol. function=DNA binding; Cellular component=nucleus; Biological process=regulation of transcription
  Homolog annotation: Hit_ID=Q2LME6; Match level="QueryCoverage=90%, HitCoverage=70%, E-value=3e-78, Identity=59%"; Hit description=MYB18
  Pfam annotation: Domain name=Myb_DNA-binding; Domain location=14-61; Score=48.5; E_value=2.2e-11; Accession=PF00249.21; Description=Myb -like DNA-binding domain
  Pfam annotation: Domain name=Myb_DNA-binding; Domain location=67-112; Score=48.4; E_value=2.5e-11; Accession=PF00249.21; Description=Myb -like DNA-binding domain
  Pfam module annotation: Pfam domain module=Myb_DNA-binding::Myb_DNA -binding; Domain location=14-61::67-112
MGRAPCCDENGLKKGPWTPEEDLKLTNYIQIHGPGNWRSLPKNAGLRRCGKSCRLRWTNYLRPDIKRGRFSLEEEDVIIQLHSILGNKWSAIAARLPGRTDNEIKNYWNTHIRKRLLRMGIDPVTHTPRLDLLDMSSILRSMLGNPSLLNMQGLLGAQVLMNQGLLKLASTASLLSTINNDENPNLASQNFVHSQVATTPPSLDSTQFQFQMPTNQTNNVEVEGFLGTVTNLSCSSSPSGDDKINLVLQQKNQVDLLGNHDVL

SEQ ID NO: 172433 - protein, 101 aa, Glycine max
  Coding DNA Sequence Number=SeqID_55655
  Subcellular localization annotation: CTP_CleavageSite=87; ConfidenceScore=5.59e-01
MNNSLLLQAALVTKRVKTKMLLQANMWKFDSKVQHRSSSVVSSRTTLNNLFFKVGREWSSNVLPLPSIMNQVILNSQMSITNMSIIKCFTYRNLFQPSIIK

SEQ ID NO: 172434 - protein, 98 aa, Glycine max
  Coding DNA Sequence Number=SeqID_55656
MEAYLLVLVGEFGELGIQRPLTTRSSLSGNLGDYDFGSILCDSWGRWLVGYSASNSGYMHVICESNSKNALNLINNQDSALHPHASLINRIHSFLDKP

SEQ ID NO: 172435 - protein, 98 aa, Glycine max
  Coding DNA Sequence Number=SeqID_55657
MSKSQQFSTSICWNPPRNSQYKLYCDGSVKLNSSQAVADDGTHFELCSIHYGMRFSMVIDLSFVTITVVPSLMIPACWFLFLCWMRYLSCLPIYLVKN

SEQ ID NO: 172436 - protein, 71 aa, Glycine max
  Coding DNA Sequence Number=SeqID_55658
MAAPQMNLPLLEKNLTRLLQMISICFKNNSRLLQQTKPCLKTKCFQDMQGSGNRLPGSVIDYQKTGLRNSY

SEQ ID NO: 172437 - protein, 78 aa, Glycine max
  Coding DNA Sequence Number=SeqID_55659
  Gene Ontology: Cellular component=chloroplast
MDGSLSRWHSKGFLIWDPVVLEGAGPCEQLDALSPFNPLSEMWQKEKESMDRPHRLHPVGTTRSPQGRLRHPGVADRP

SEQ ID NO: 172438 - protein, 178 aa, Glycine max
  Coding DNA Sequence Number=SeqID_55660
MDFAVTLKAGCDMNQHGTYNSHFEKYRPDTPTAVLLQAFPESNPYYTFKTFDCTTGMTQGPLRATNLHTAAQRHMTRKRHDARHVELLPCNHLYILSYMGGNVQAQRPVSTRLGRSQGQTDRLRHARGPAGRLGNTPFAAPASARRQYACQGPPADGAAATAVARSHECKQPTTAPPI

SEQ ID NO: 172439 - protein, 105 aa, Glycine max
  Coding DNA Sequence Number=SeqID_55661
MEFYANAWPTEEGVRDMRSWSVPGAPTDEEAIAQLLCIPVQDFARTAAGRWFLLLSGDNQVQWHADTNIVIYFPCRKTQCLSTKATRVSPAILRQASPVAYGDHH

SEQ ID NO: 172440 - protein, 512 aa, Glycine max
  Coding DNA Sequence Number=SeqID_55662
  Homolog annotation: Hit_ID=UPI00005FA3FD; Match level="QueryCoverage =60%, HitCoverage=96%, E-value=1e-125, Identity=68%"; Hit description= COG3272: Uncharacterized conserved protein
  Pfam annotation: Domain name=DNA_photolyase; Domain location=299-469; Score=159.2; E_value=1.1e-44; Accession=PF00875.8; Description=DNA photolyase
  Pfam annotation: Domain name=DUF1722; Domain location=182-299; Score =220.2; E_value=4.8e-63; Accession=PF08349.2; Description=Protein of unknown function (DUF1722)
  Pfam annotation: Domain name=DUF523; Domain location=1-133; Score =143.5; E_value=5.7e-40; Accession=PF04463.3; Description=Protein of unknown function (DUF523)
  Pfam module annotation: Pfam domain module=DNA_photolyase::DUF1722::DU F523; Domain location=299-469::182-299::1-133
ACLLGDSVRFDGGHKRFAFATDELAPFVRFEPVCPEMAIGLPTPRPALRLVKQSDDQIHLCFSKDGGEELTDDMARWSAERVKSLHHLCGYILCAKSPSCGLERVRVYEPDTNNNRKAGTGVFTSFLQKELPWLPLEEDGRLHDDAIRENFMGRVYALHEFNDMWRSGLTRHKLIAFHSRYKLLLLSHAQDEYREMGRFVAAMEQWESLDAYAFEYRNRLMHLMSHQASRRNHTNVLMHVQGYFRPKLSSPQRQELAQLIDRYRRGVQPLLAPITMLKHYMAEFPHPWLAQQRYFDPYPEALRLRYGHALAAACRDSQAEVLALFIATPGQWQQHSMAPKQAAFIHQNLCLLQQSLAERGIKLHFHQCDDFAASVDYLATFCQQHKVDALFYNYQYEINERQRDAAVEKQLDQQGVVCQGFDDSLLLPPGSVQTGSNSMFKVFTPFSKAFIRRLQQGLPECHHAPKARAGAPVAAGKKIAAFDYPVEKFDETWFPAGEEAALKQLRQFAQQR

SEQ ID NO: 172441 - protein, 118 aa, Glycine max
  Coding DNA Sequence Number=SeqID_55663
MHHSHTSMIFIGCIAHGILSLKTNLIIVIKRKEHASRSPYRTRARARVMGEVEEVQEQIKADMEAVKEKMAIMMEAMISMKKIMEVNAVAIAATSAIAKVNITPQSGLNQMNHPTSNM

SEQ ID NO: 172442 - protein, 292 aa, Glycine max
  Coding DNA Sequence Number=SeqID_55664
  Pfam annotation: Domain name=Transposase_23; Domain location=207-277; Score=-6.0; E_value=0.0052; Accession=PF03017.5; Description =TNP1ENSPM transposase
FCQTRRDLSWEDVRKKAHAIQKQNIAPHVLSRGGYDYLEQKLLIEKTKKKLEEAAQSGSVDGVIDPPSPVRRHVKWKMARTKKTEEMTTEAAKEIAEKIDSFEEQATQGSFVLHGRQDVLAAAIGRPEHPGRVRAAGAAADPADQGLARGVHHRESDEASQASFNQLQSQMQSQGLAVPPEPLVGPSGPQVSTKGSCVYPSGNDPETGDSDRCGLYIEADPAHLVAMGRVYEGSTVVYNTPLLLGQVKVSVEEVTDADAPVLVPTDEVSLVGQALHTFLAWPTHLVKSLSQQ

SEQ ID NO: 172443 - protein, 246 aa, Glycine max
  Coding DNA Sequence Number=SeqID_55665
  Gene Ontology: Mol. function=helicase activity; Biological process =viral genome replication
  Homolog annotation: Hit_ID=Q9LTU4; Match level="QueryCoverage=95%, HitCoverage=16%, E-value=2e-83, Identity=59%"; Hit description =Helicase-like protein
MAICAHVGFPNLFLTLTCNPAWPEIQRQVAKSNLTAHDCPDVVSRVFKMKLNQLMHDLKSGHVFGPILAFVYTIEWQKRGLPHAHILIFLHPLNKNPNPEDIDNIISAEIPNKDTDPELYQIVSNHMMHGPCGLANKRAPCMANGKCFRFFPKKFQPATIVDQDGFPVYRRRDTRQTVQKQGVHLDNRFVVPYNPHLLLKYRTHLNVEWCNQSSSIKYLFKYINKGSDRITAVIVNDQNQDGPQNQ

SEQ ID NO: 172444 - protein, 73 aa, Glycine max
  Coding DNA Sequence Number=SeqID_55666
  Subcellular localization annotation: CTP_CleavageSite=40; ConfidenceScore=5.32e-01
MRGYRMVTSTFRQPGANEPVDVQRLASSSAPFVVLTRKVRFYSRRSETFKPGDARGSSLLGRDDRVQWRREVS

SEQ ID NO: 172445 - protein, 70 aa, Glycine max
  Coding DNA Sequence Number=SeqID_55667
MEGSRDITAMTEGELTNTGVQKEIILKRKESSENLPAHAIFHNPPADAAYLRGSSHNRISYVIFLGLYQF

SEQ ID NO: 172446 - protein, 101 aa, Glycine max
  Coding DNA Sequence Number=SeqID_55668
MLVEKLIDRKTETVESLLVRIGTSKSMEIEAAHGKRTEKRGWGGGAMVVHSWLWCASRLADSIIHGEVEEFVVLVGREVEVGDLEVVGTVEEEGEVLELEV

SEQ ID NO: 172447 - protein, 183 aa, Glycine max
  Coding DNA Sequence Number=SeqID_55669
  Subcellular localization annotation: CTP_CleavageSite=42; ConfidenceScore=5.19e-01
MQKQTASSIGEFPVSVLDSPAPLAISPCMGSSQSNWRVPSRRAQARVLGGCSLHAGTRHSHWHLVGELAIPTGELHFEKKNSPYKTCTTTLSCSLTPSRVPPSSLLIPLCSAFLSSIPTTCFVFLVKFFTLFALHCLVALPTTCFWLDFISLSMTSSSSCSSNIQIKSGPIDGDVVWMHAKHV

SEQ ID NO: 172448 - protein, 119 aa, Glycine max
  Coding DNA Sequence Number=SeqID_55670
MEMQKVPETKQQQKKLKSKEFFNNLHAYLGLQVDVVEPPLVKVTSQPQPIVEDELAMVSTSITPREITPLTTFAPTSPLPPPPTSIPALVTTVNLVPVPPPPSSPPKSPPTIPQPLSTK

SEQ ID NO: 172449 - protein, 85 aa, Glycine max
  Coding DNA Sequence Number=SeqID_55671
MVVILKGLESYDNDDGEECGIVSSSKDECNPLTRYLRNPIFIKHMIHHKQVTSTKSLTLVSYTDASCWTHKPGRKRIDKPLHSSL

SEQ ID NO: 172450 - protein, 301 aa, Glycine max
  Coding DNA Sequence Number=SeqID_55672
MQKQIASSIGEFVVSVLDSPALLAILPCMGSSQSDWRVPAQEGSSLCHWRVRLNWSSHWHWRVRKMGIASSKKAIQIKREISFNALKKKIGDKVKLENNEIICAIGCRFLVSGKYVALQICDDKVVEIMLESFQQQDQMSVLELYIEKDVAGGSMFHSANSLTSFGNNLSNNEAQPPRNVSDLHGDEDDDDDDYLVSNSYVEESLDEDDSIDGISDTDDEVTDMIQPVRIVHPAKGVQGIQNPFWNDALHYNNINRSHPDEEDICGLEMPSSFNVGQELYVGMDFNSKDAVNNAVKQYVMK

SEQ ID NO: 172451 - protein, 213 aa, Glycine max
  Coding DNA Sequence Number=SeqID_55673
  Homolog annotation: Hit_ID=Q1T493; Match level="QueryCoverage=66%, HitCoverage=32%, E-value=7e-07, Identity=28%"; Hit description =Nucleic acid-binding, OB-fold, subgroup
MGCTITCILWGPFAMQLKAWTSVKTTLNLWLSYYTWPKSKNLKESMQTTLLPFKTQCSGVQKSLESNENIVVSFSQKIVTLSQSSQFSSEVKLAHNVKVKSLSELDDIKKQCNRLTVATTKKLLVYNGWSFKGCPRCNRKLKRQWSHTHVQAVRIGMREKCLGDQLNQIANEGKFDPKSMPKALDNVLKKQLAFKIKIVPNSSCYSVLETSQD

SEQ ID NO: 172452 - protein, 854 aa, Glycine max
  Coding DNA Sequence Number=SeqID_55674
  Gene Ontology: Mol. function=sequence-specific DNA binding; Cellular component=nucleus; Biological process=regulation of transcription, DNA-dependent
  Homolog annotation: Hit_ID=Q8LJS7; Match level="QueryCoverage=91%, HitCoverage=96%, E-value=0.0, Identity=63%"; Hit description =Homeodomain protein GhHOX2
  Pfam annotation: Domain name=Homeobox; Domain location=86-142; Score =83.5; E_value=6.5e-22; Accession=PF00046.19; Description=Homeobox domain
  Pfam annotation: Domain name=START; Domain location=285-510; Score =177.9; E_value=2.6e-50; Accession=PF01852.10; Description=START domain
  Pfam module annotation: Pfam domain module=Homeobox::START; Domain location=86-142::285-510
  Subcellular localization annotation: CTP_CleavageSite=54; ConfidenceScore=5.32e-01
MYGDCQVMSSMGGNVVVNPDTLFSSSIQNSSFNFIPTMPFQPFPSMKEEDGILRGKEEVESGSGSEQLVEDKSGNEQESHEQPTKKKRYHRHTARQIQEMEALFKECPHPDDKQRLKLSHELGLKPRQVKFWFQNRRTQMKAQQDRADNVILRAENESLKSENYRLQAALRNVICPNCGGPCIMGADMGLDEHQVRIENARLREELERVCCLTTRYTGRPIQTMATGPTLMAPSLDLDMSIYPRHFADTIAPCTEMIPVPMLPPEASPFSEGGILMEEEKSLTLELAASSMAELVKMCQTNEPLWIRSTESEREVLNFEEHARMFAWPQNLKHRSELRTEASRDTSVVIMNSVTLVDAFLDAQKWMELFPTIVSRAKTVQIISSGASGLASGTLQLMYAEFQVLSPLVSTRETHFLRYCQQNAEEGTWAIVDFPVDSFHQNFHPSYPRYCRRSSGCVIQDMPNGYSRVTWVEHAKVEEKPVHQIFCNYVYSGMAFGAQRWLGVLQRQCERVASLMARNISDLGAIPSPEARKNLMKLAQRMIKTFSLNMSTSGGQSWTAISDSPEDTVRITTRKITEPGQPNGVILSAVSTTWLPYSHTKVFDLLRDERRRSQMDALSNGNSLNEVAHIANGSHPGNCISLLRINVASNSSQNVELMLQENCTDQSGSIVVYTTIDVDSIQLAMSGEDPSCIALLPQGFKIVPMSSPPNNVDTPIIDAATNSSSEPPPSLNNNNSGGCLLTMGLQVLASTIPSAKLNLSSVTAINNHLCNTLHQIEAALSSSSSHENGNGSFLCTEPTKHVSFLCGSIKEYQEDEEELLLCFVLEEKNEGTEGVKSEPDSTLGFLVIRDDLTSE

SEQ ID NO: 172453 - protein, 185 aa, Glycine max
  Coding DNA Sequence Number=SeqID_55675
  Gene Ontology: Mol. function=RNA-directed DNA polymerase activity; Cellular component=chromatin; Biological process=chromatin assembly or disassembly
MGAMLMQHRRLIAFFSKQFTPKLERASTYVRELHSVTMAPKGIDDPNNSDVGAAVLLGQTSGYEYTIKYKSGSLNIVADALSRIEHLADSSMFIISVLQFEFMDQLQQHLQASSMFQDKWSVISSNPAAYPDYKLQDQLILHKGSIWLNDDNPFRTALLTEFHSTPLGDHLGVAKTTHCLQANFT

SEQ ID NO: 172454 - protein, 94 aa, Glycine max
  Coding DNA Sequence Number=SeqID_55676
MSRGIEASENALNSRSRLRNLASTVSKLQRFEFVLHYLSFGGNPFHCTRTIGGVMRPIEVLDRGNGGAWNSEILDGFVMWLAGEDGKQRVQHTR

SEQ ID NO: 172455 - protein, 883 aa, Glycine max
  Coding DNA Sequence Number=SeqID_55677
  Gene Ontology: Mol. function=DNA binding; Cellular component=nucleus; Biological process=regulation of transcription
  Homolog annotation: Hit_ID=Q9FJS0; Match level="QueryCoverage=77%, HitCoverage=90%, E-value=0.0, Identity=59%"; Hit description =Arabidopsis thaliana genomic DNA, chromosome 5, P1 clone:MQD22
  Pfam annotation: Domain name=JmjC; Domain location=291-414; Score =190.1; E_value=5.2e-54; Accession=PF02373.13; Description=JmjC domain
  Pfam annotation: Domain name=JmjN; Domain location=115-159; Score =41.6; E_value=2.6e-09; Accession=PF02375.7; Description=jmjN domain
  Pfam annotation: Domain name=zf-C5HC2; Domain location=511-564; Score= 9.3; E_value=0.0041; Accession=PF02928.6; Description=C5HC2 zinc finger
  Pfam module annotation: Pfam domain module=JmjC::JmjN::zf-C5HC2; Domain location=291-414::115-159::511-564
MSLLVKCSRLWFPQNERPIHLLIDSSMVERRVTLSKEVRNGLEFLKRKRLQRAKSVTATQTSVASMMNRSGGDALRASASCGTRFHGNADVFSKRKVDKFDTNDLDWTDKIPECPVYSPTKEEFEDPLIYLQKIAPEASKYGICKIISPLSASVPAGVVLMKEKAGFKFTTRVQPLRLAEWDTEDKVTFFMSGRNYTFRDFEKMANKVFARRYCSAGCLPATYLEKEFWHEIGCGKMETVEYACDVDGSAFSSSPTDQLGNSKWNLKKLSRLPKSILRLLETSIPGVTEPMLYIGMLFSIFAWHVEDHYLYSINYHHCGASKTWYGIPGHAALEFERVVREHVYTNDILSSDGEDGAFDVLLGKTTLFPPNILLEHEVPVYKAVQKPGEFIITFPRAYHAGFSHGFNCGEAVNFAIGDWFPLGAVASRRYALLNRVPLLPHEELLCKEAMLLRTCLELEDSDFPSSDLFSHNSIKISFVNLMRFQHCARWFLTKSRASIRVSFHSHATILCSLCKRDCYIAYVDCNCHMHPVCLRHDVDFLNFNCGSKHTLYLREDIMDMEAAAKMFEHEDGILDEIRKQTKSDQNMYAYPLSNMFQRAEANGYTPYCELKLDSVVEFYATPEHSTNNQEYSSQNQSVIVRCSENKKPVVSEVSFSSATSTLCSLSESLESFSAPKNAEEHINNNASIIDFEEFAERISNSACESSLSPAVYHESSVKPLGDLQKRFDTKSIVDESDDSDSEIFRVKRPSSLKAERRNMNDAVPSKHTEQQGLKRLKKILPEGKSGQPMDSSRSNESSYKYSHAVNHKGHADISSRDRFARSNGIPISIRYKKLGNEEISMQGDHHQRDRLQQTFREPPSMELEPKRLKVRGPSFLGLESRSN

SEQ ID NO: 172456 - protein, 61 aa, Glycine max
  Coding DNA Sequence Number=SeqID_55678
MTGQGGTDTWRFLVSRRHTRHADKGVVSWIFCVTGGGGQNGYSRRLQQGSQGSPTIERSRR

SEQ ID NO: 172457 - protein, 73 aa, Glycine max
  Coding DNA Sequence Number=SeqID_55679
MSNIMNLMCFNFSFSENHALSEALSPRSELGESGGESEKHMRAQCVISLLSEAFVSSHAKHAQLAQWIFTNLR

SEQ ID NO: 172458 - protein, 87 aa, Glycine max
  Coding DNA Sequence Number=SeqID_55680
  Gene Ontology: Mol. function=potassium ion transporter activity; Cellular component=membrane; Biological process=potassium ion transport
  Homolog annotation: Hit_ID=Q06XL8; Match level="QueryCoverage=81%, HitCoverage=9%, E-value=1e-23, Identity=73%"; Hit description=KUP2
MQEELEDLYAAQEAGIAFILGHSHVRAKQGSSVLKKLALNYGYNFLRRICKGLDVALKVPLVSLSEVGMRYLAFHHKAAPFSYKMRV

SEQ ID NO: 172459 - protein, 76 aa, Glycine max
  Coding DNA Sequence Number=SeqID_55681
MDLSVLALEISFSSLSGSLVSWAETTWAPVSDWEYQATLPHTTSIIDLAAKMISEGRGLELMLMEADPTAPITAYR

SEQ ID NO: 172460 - protein, 228 aa, Glycine max
  Coding DNA Sequence Number=SeqID_55682
MHIGIIHIGSRKYKTFICLFVCGNHNQQFSPTVNSSCPTTSHKPCHHEYIVIKCVECFSPFIFMIVILSGIILTILIISFQCYVYLQNLIEVPSLYHRQWAPDYPPYVLFDYNGDKHCIKLRKYYNRYYFADRLKDFKRTMGIHEGFMITFSAPEKNWIFHLHFMPLLHRQTCGRPPITTRTNVFTIDVSQHMISCAYPLVLPPDALNFVDASTKYITILHTHGRRHL

SEQ ID NO: 172461 - protein, 45 aa, Glycine max
  Coding DNA Sequence Number=SeqID_55683
MDGPTKVSLAIQSNWKLVDLSWKSSYTSIKIIIYNAMVGLATWGG

SEQ ID NO: 172462 - protein, 109 aa, Glycine max
  Coding DNA Sequence Number=SeqID_55684
MPRQAQGDAHQDAGAPPPPQLADSAGPLGVERIYSIWFASRRPTTVDSCRYTSVSTGSASFGAEVAWPGDWPDAQAGEEPAGSPGEADESRMDEDMTDLVGFLGGSEAT

SEQ ID NO: 172463 - protein, 58 aa, Glycine max
  Coding DNA Sequence Number=SeqID_55685
MKDLFVTKFESNEALKVVGPLLLDSNSPIDGTNPRFQFPTWQLTNKETKRQAITKDQK

SEQ ID NO: 172464 - protein, 59 aa, Glycine max
  Coding DNA Sequence Number=SeqID_55686
  Subcellular localization annotation: CTP_CleavageSite=27; ConfidenceScore=5.09e-01
MDKVNTTTYNANHIGRIWLIIRKFKPRRFNNVSMGDFAKIFNRSSTFFIHSSSFFGLQP

SEQ ID NO: 172465 - protein, 72 aa, Glycine max
  Coding DNA Sequence Number=SeqID_55687
MGKPRKEHYQAIKRIFSWKATLQLVVSFSTSKAACMALAEATKEAKDQVYHERIKHIDIKNQFIQTEKRITV

SEQ ID NO: 172466 - protein, 319 aa, Glycine max
  Coding DNA Sequence Number=SeqID_55688
  Gene Ontology: Mol. function=nucleic acid binding; Cellular component= intracellular; Biological process=DNA integration
  Pfam annotation: Domain name=rve; Domain location=111-286; Score =75.3; E_value=1.9e-19; Accession=PF00665.16; Description=Integrase core domain
MVMKPLRPNYWWLIRLEGRRRRRRKKKIRVHNGIVRTLIEVLHVLELKKNLVFVGSMDSKGFSYWVEGEVMQIRGKGKFVVMQGTKEGNMYILQGPAMIGSISTVSQVGNHASNNNSLWHLRLGHMSEKKTGNSEQRPSRVSSLGGARYLLSIIDDYSRMTWRLMMKHKFEAFKCFKHWTILMKNQIGKTMKCLSTNNDLEFYSTKFNEFCKDEDIARQHIVHYTMQQNRVVERMNITLLENSKCMLSNSGLNRSFWVKAINTTCYLVNCSPFIVLGFRTSIEVFGCPTYYHASEGKLDPKAKKNVFMEYEDGIKGFRI

SEQ ID NO: 172467 - protein, 596 aa, Glycine max
  Coding DNA Sequence Number=SeqID_55689
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=77%, HitCoverage=54%, E-value=1e-156, Identity=55%"; Hit description =Lustrin A-like
  Pfam annotation: Domain name=DUF231; Domain location=420-584; Score =249.4; E_value=7.4e-72; Accession=PF03005.6; Description=Arabidopsis proteins of unknown function
  Subcellular localization annotation: CTP_CleavageSite=31; ConfidenceScore=5.43e-01
MADSTKYIPIGGTGTTLNSHLNTLFPILKARKTLTVAYCFTFAFVALTVFLAFCPSPNTSSPFFTSIFSSTATTASSASSYKSQLSSIFSFFFPNTTISSSATLHTDTTRSSNSTSQSPQTSKKTFKTTPFENQTQTTPPTRSKIPSDHHTAKPPDHVVNKEPSSGNNHTQVSDEDKAVKKTNQSSNGVGHSPNKNLSSLVNGGGTEKGVGHSNYTVSWSKKQKNGSNETDSRVKDEFMESLIKCEFFDGEWIKEDSYPLYEPGSCNIIDEQFNCIQNGRPDKAFQKYKWKPKGCSLPRLDGHRMLDMLRGKRLIFVGDSINRNMWESLICILRNAVKDKSKVYEANGRVHFRGEASYSFIFKDYNFSVELFVSPFLVQEWEVQVKNGTKKETLRLDLVGKSSVQYKNADIIIFNTGHWWTHDKTSKGKDYYQEGSHVYDELNVLEAFRRAITTWSRWIDANINQSKSMVFFRGYSASHFSGGQWNSGGQCDSETVPIKNEKYLREYPPKMRVLEKVLKNMKAHVTYLNVTKMTDFRKDGHPSIYRKQNLSPEERKSPLRYQDCSHWCLPGVPDAWNEILYAELLLKQYQNQQKRP

SEQ ID NO: 172468 - protein, 84 aa, Glycine max
  Coding DNA Sequence Number=SeqID_55690
MGQNTKTSRAPKFINQFSSKHQLRYLQWFPEIPQAFPLTALTGFPNVREKEKGLKPSFHCLSAMSISPSTYVLFQIPTVKMCGN

SEQ ID NO: 172469 - protein, 128 aa, Glycine max
  Coding DNA Sequence Number=SeqID_55691
  Gene Ontology: Mol. function=zinc ion binding; Biological process =cell redox homeostasis
  Homolog annotation: Hit_ID=Q1SEK9; Match level="QueryCoverage=56%, HitCoverage=15%, E-value=8e-16, Identity=51%"; Hit description =Thioredoxin domain 2; Erv1/Alr
MRVEYFPLKEDVILQNEAPTDLYIFVIGAAVKEILIPVVSLDSLRCPACRNYKPHYEKVARLFNEPDAVHPGIILIARVDCGLKFSIHKFDVMMHFAAVAYVGESTLDPLNQGDIHVLYCILDHFGSW

SEQ ID NO: 172470 - protein, 46 aa, Glycine max
  Coding DNA Sequence Number=SeqID_55692
MKPPQKGRSEEQENCQRLRIGRGEEEVAMVVWQRNEMTKHGGCRVH

SEQ ID NO: 172471 - protein, 267 aa, Glycine max
  Coding DNA Sequence Number=SeqID_55693
  Gene Ontology: Mol. function=ribonuclease H activity; Biological process=RNA-dependent DNA replication
  Homolog annotation: Hit_ID=Q1RYI2; Match level="QueryCoverage=63%, HitCoverage=28%, E-value=7e-20, Identity=37%"; Hit description =Ribonuclease H
DPLSPHSSMLGIKRLFHLIKWVVDQKIWCPIQISRDGLHIAHLAFAYDLLLFAKANVDQAKVIKYVLKSFCDNSGQKIAQELGFQRMADLGLLVMRLIEDAEISCGGTRPKEGALVKLEGCLFPRDIANNEDCKSCFANERGRRLWSSPDDLWVRVMKSKYKSGMAGRLIIDKDRNGSNFWKGLVSCWSHIEKNIIWRLGNAPTARFWDDAWVPQVGKLSDICSQKDLPACFFVNWEGQWNTDIRDGFLQANVIDQIENIKPPMGSN

SEQ ID NO: 172472 - protein, 234 aa, Glycine max
  Coding DNA Sequence Number=SeqID_55694
  Subcellular localization annotation: CTP_CleavageSite=35; ConfidenceScore=5.20e-01
MDMNVGALISGQITLMAQSNSSRLGFPALITTLCMAQGVTSDSLTFKSLSPAINLAYIKKNCWNLDNPTVSFPGTRKARTRGSEGPSSVAPQTSTAPAPIPSTSVPDTSDPSAQSTYLMMAMLQSIHQGQYLVMQSLHSLAQHQPIMSIEEFSLQVAWPGVQPSSHGGGEASAAQEPQPDLETTPAAQEDDLEATPPESFVPETNPEKDVVIVEASPQASPVSTPVLELSTLQG

SEQ ID NO: 172473 - protein, 151 aa, Glycine max
  Coding DNA Sequence Number=SeqID_55695
EREESKEFSDCVVFNSLTREKGDTKEFKRLVLRSFGKGRRETQKESRRLVLRSFGKGRRETQKESRRLVLGEFFLAKGEENEKMNSTSFQGLENQNTLESFWHKEEEEVQRDSRLVKDCIRLIENCVLKSKSKPCFYRPFMSGLEDHLEEL

SEQ ID NO: 172474 - protein, 36 aa, Glycine max
  Coding DNA Sequence Number=SeqID_55696
MFARAHPCSPRQTGFCSLGLGTTIPKAEAFGWRQNS

SEQ ID NO: 172475 - protein, 459 aa, Glycine max
  Coding DNA Sequence Number=SeqID_55697
  Gene Ontology: Mol. function=exonuclease activity; Cellular component= intracellular; Biological process=regulation of transcription, DNA -dependent
  Homolog annotation: Hit_ID=Q5N739; Match level="QueryCoverage=98%, HitCoverage=41%, E-value=1e-173, Identity=68%"; Hit description =Putative 5'-3' exoribonuclease
  Pfam annotation: Domain name=XRN_N; Domain location=1-165; Score =295.2; E_value=1.2e-85; Accession=PF03159.8; Description=XRN 5'-3' exonuclease N-terminus
  Pfam annotation: Domain name=zf-CCHC; Domain location=171-188; Score =25.6; E_value=6e-05; Accession=PF00098.13; Description=Zinc knuckle
  Pfam module annotation: Pfam domain module=XRN_N::zf-CCHC; Domain location=1-165::171-188
MVRPRELLYMAIDGVAPRAKMNQQRSRRFRAAKDAADAAAEEARLREEFEKEGRKLPSKGESQTFDSNVITPGTEFMAVLSIALQYYVHLRLNNDPGWQNIKVILSDANVPGEGEHKIMSYIRLQRNLKGYDPNTRHCLYGLDADLIMLALATHEIHFSILREIVFTPGQDKCFLCGQMGHMAANCEGKAKRKAGEFDEKGEAIVTKKPFQFLNIWTLREYLEYEMRISNPPSEIDFDCIVDDFIFMCFFVGNDFLPHMPTLEIREGAINLLIAVYKKEFREFGGYLTNGSTINLSRVEHFIQAVGSYEDKIFQKRARLHQRQTERIKREKAQARRGDDAEPQFQPESLVAVSRFHGSRLASAPTPPPFQPSGHYNSQASASVRKDNKEAFERPLKVSRVSSGATVAAAIVEAENNLEIDAQDNKDELKTKLKEILREKSDVFNSKNAEEDKYSLRPYL

SEQ ID NO: 172476 - protein, 1102 aa, Glycine max
  Coding DNA Sequence Number=SeqID_55698
  Gene Ontology: Mol. function=microtubule motor activity; Cellular component=microtubule associated complex; Biological process =microtubule-based movement
  Homolog annotation: Hit_ID=Q9C698; Match level="QueryCoverage=96%, HitCoverage=99%, E-value=0.0, Identity=47%"; Hit description=Mysoin -like protein; 11013-7318
  Pfam annotation: Domain name=DUF593; Domain location=196-274; Score= -25.3; E_value=0.02; Accession=PF04576.6; Description=Protein of unknown function, DUF593
  Pfam annotation: Domain name=DUF869; Domain location=117-1000; Score =1219.3; E_value=0; Accession=PF05911.2; Description=Plant protein of unknown function (DUF869)
  Pfam annotation: Domain name=Pox_A_type_inc; Domain location=250-272; Score=2.0; E_value=42; Accession=PF04508.3; Description=Viral A-type inclusion protein repeat
  Pfam annotation: Domain name=Pox_A_type_inc; Domain location=909-931; Score=11.6; E_value=1.7; Accession=PF04508.3; Description=Viral A -type inclusion protein repeat
  Pfam annotation: Domain name=Pox_A_type_inc; Domain location=91-113; Score=3.1; E_value=29; Accession=PF04508.3; Description=Viral A-type inclusion protein repeat
  Pfam annotation: Domain name=Strep_SA_rep; Domain location=204-228; Score=9.7; E_value=2.7; Accession=PF06696.2; Description =Streptococcal surface antigen repeat
  Pfam annotation: Domain name=Strep_SA_rep; Domain location=863-887; Score=1.2; E_value=66; Accession=PF06696.2; Description =Streptococcal surface antigen repeat
  Pfam annotation: Domain name=Strep_SA_rep; Domain location=87-111; Score=4.9; E_value=16; Accession=PF06696.2; Description =Streptococcal surface antigen repeat
  Pfam annotation: Domain name=Strep_SA_rep; Domain location=954-977; Score=2.3; E_value=44; Accession=PF06696.2; Description =Streptococcal surface antigen repeat
  Pfam module annotation: Pfam domain module=DUF593::DUF869::Pox_A_type_ inc::Pox_A_type_inc::Pox_A_type_inc::Strep_SA_rep::Strep_SA _rep::Strep_SA_rep::Strep_SA_rep; Domain location=196-274::117 -1000::250-272::909-931::...
  Pfam module annotation: Domain location=91-113::204-228::863-887::87 -111::954-977
MGAKTMSNQQFGLALLHCLLLGVVSWCPYFSMDRRWPWKKKSSDKTVLEKAAGELDSAAGAGTQKPSYVQISVESYSHLTGLEDQVKTYEEKVQTLEEEIKELNEKLSAANSEINTKESLVKQHAKVAEEAVSGWEKAEAEALALKNHLETVTLAKLTAEDQASQLDGALKECMRQIRKLKEEHEQKIQEVALIKTKQLDKIKGEFEAKIENFEQELLRSAADNAALSRSLQERSNMIINLSEEKAHAEAEIELLKGNIESCEREINSLKYELHVISKELEIRNEEKNMSMRSAEAANKQHMEGVKKIAKLEAECQRLRGLVRKKLPGPAALAQMKLEVESLGREYGETRLRKSPVKPSSSHMSTLPGFSLDNAQKFHKDNEFLTERLLAMEEETKMLKEALAKRNSELQASRSSFAKTLSKLQILEAQVQTSNQQKGSPQSIIHINHESIYSQNASNAPSFISLSEDGNDDVGSCAESWSTAIISELSQFPKEKNTEELSKSDATKKLELMDDFLEVEKLARLSNDFSGVSVTSNNMANETVTNDVSEVSTEKDVPSNTQDNSEPNPLPSEVSSAEELSAPDPQSDVPAGLSLAELQSRISSVFESTAKGADIEKILKDIKHVLEEACCTSIQNSVSAIPHDVKPSDTTCDEQGNTEDAAGSNAEKEIISSQQPIEYVQMTSDLEVATSQIHDFVLSLAKEAMTAHDISSDGDGISEKMKEFSVTFNKVTCNEASLLQFVLDLSNVLAKASEFRFNILGYKGTEAETNSPDCIDKIALPENKLVQDNSSGERYQNGHSHILNPCSDPEVPDDGNLAPGYESNATSQKFSMEDFEELKLEKEKAVADLSKCAENLEMTKSRLLETEQYLAEVKSQLASAQRSNSLAETQLKCMTESYRTIEARTKDFETELNHLRMKTETLENELEDEKKAHEEALAKYKEIEEQLQRNESLAADKDIKTKQERNLAAAAEKLAECQETIFLLGKQLKSLHPQTEPMGSPYSKAEGFTECEPNSPTFQDQAEMDSASSAFVQRLGGESPLHFSNSLYSPSDNESNFPAISSVQNPNHRPTKSTSSSASSTPTPEKHTRGFSRFFSSKGKNGH

SEQ ID NO: 172477 - protein, 122 aa, Glycine max
  Coding DNA Sequence Number=SeqID_55699
  Gene Ontology: Mol. function=RNA-directed DNA polymerase activity; Cellular component=nucleus; Biological process=RNA-dependent DNA replication
MRVLEWVIDQSQSAFLRERQLLNSVLIANKAVDEAKRRKRKYFVFKVDFEKAYDSLSSGFLRLMLGRMVFHERWILWIKGCLQSLCSLVLVNESLAQEFKCYKGLHQGDPLTPFLFLIVVER

SEQ ID NO: 172478 - protein, 71 aa, Glycine max
  Coding DNA Sequence Number=SeqID_55700
MELINVPLVGKTFTCFLTNGKAKSRIDKEAWLKKNVVGWGAYLLKEKLNRVKEVLKKWYKEEFGVYKGDDN

SEQ ID NO: 172479 - protein, 125 aa, Glycine max
  Coding DNA Sequence Number=SeqID_55701
MSVHVAQVIADAIYLFAGMPPTRHPLDPDKSNRALGFPALITGLCQSFEVADASPPPDQADPAGSLGMERYLQHLVRQQAANHRGQVQIHECLYRFSLSQQGQGFAPFACPTPEKFGANVTWPGD

SEQ ID NO: 172480 - protein, 66 aa, Glycine max
  Coding DNA Sequence Number=SeqID_55702
MSAVQRVQDADDERKCFSRARLAQFQPREGFGLSGLTRWAKFTIRSNSEGIALSAQWALSEMQLCA

SEQ ID NO: 172481 - protein, 314 aa, Glycine max
  Coding DNA Sequence Number=SeqID_55703
  Gene Ontology: Mol. function=transferase activity, transferring glycosyl groups; Cellular component=integral to membrane; Biological process=metabolic process
  Homolog annotation: Hit_ID=Q9AR73; Match level="QueryCoverage=67%, HitCoverage=44%, E-value=3e-57, Identity=53%"; Hit description =Hydroquinone glucosyltransferase
MDQVRNRKIDEYKWYLYHVSRMTMSTGILLNTWQDLEPVTLKALSEHSFYRSINTPPLYPIGPLIKETESLTENEPECLAWLDNQPAGSVLFVTFGSGGVLSSEQQNELAWGLELSGVRFVWVVRVPNDASAFAAFFNAGGDDDATSYLPEGFVSRTRERGLVVRSWAPQVAILRHASTGAFVSHCGWNSTLESVANGVPVIAWPLYAEQRMNGTTVEEDVGVGVRVRAKSTEKGVVGREEIERVVRMVMEGEEGKEMKRRARELKETAVKSLSVGGPSYEMRAAMANVCLFATKKQCTKKPVQRVDHETEVKG

SEQ ID NO: 172482 - protein, 98 aa, Glycine max
  Coding DNA Sequence Number=SeqID_55704
MPKYTCDSGVHLMLVAHADSLGFYRNQTTGEGSKRPLVWAKGASSIERKCVESPPMFIRGKRQKNQKDDGLRILKMRVRELFSRTGKGVSLAPTYPQL

SEQ ID NO: 172483 - protein, 397 aa, Glycine max
  Coding DNA Sequence Number=SeqID_55705
MALKKLPAKRSRKGITEEDTDSEGGDEDQGDEDMVDLFDFLGGKTASPITCRDQYGHLLPLSKTLVSFDRDYISLTFAIPRQSSLIACRDTSWLSTPSSSGDGKSDDTQRHLMVIRTVVIRRRQVRLQAETNVVICSLCRRPQCLSIETTLVSPSSFGDGKSDDMRRHLMVIRTLAPPKTASPMTRKDQCGHLLPLLETSMSFDRDYFSLTLVIRRWANTLWLSAQSSSRDGKPDDTQRPMWSSATFVNQRQASPLIETTLVSPSSSKDDKQVSPLVETTLVSPSSSRDGKFNDMRRPIMVIRWLHQPEASEPIDRDYFSLTFIIQRQQADDTRRPIMVICHLCQPEANELRQVSPLIETTLVSPSSSRDNKSDDTWRPIMVIRHCRQPEASEPVDT

SEQ ID NO: 172484 - protein, 71 aa, Glycine max
  Coding DNA Sequence Number=SeqID_55706
MSENFADYLTMDVKYLEAVKQRLHPTEQMVQQSKRERKGMRNLLGSLLERRCVKMQKKAKMHEVGCERERK

SEQ ID NO: 172485 - protein, 259 aa, Glycine max
  Coding DNA Sequence Number=SeqID_55707
MVIYPFVEDSMSFDRDYYSLFSFVIQTQLSLMARRGKYGHLPFFRRLNVFRSRLLQSPLPSIDNQVRWHAETNMVIYPFARDLMSFNRDYYSLLFRLKTIKSDGTQRQICSSALLLETQCLLTETITVYFVVQRQSSPMARRDKYGHLPLWSETQCLSTKTITVSFAIQRQSSSMARRDKYGHLPFYQRLNVFQPRLLQSPFTIQRQLSPMACRDHHGPSLLLFPETILVSFTIQRQSSPMVSLIELVVGWLARSLERN

SEQ ID NO: 172486 - protein, 75 aa, Glycine max
  Coding DNA Sequence Number=SeqID_55708
MESTLSSRRKLPGGHPLVLEEGHHCKFSERRSRASGFDEETIGQLLCVPRQNFTRSVTGRRVRIVRTSMTTLTQI

SEQ ID NO: 172487 - protein, 173 aa, Glycine max
  Coding DNA Sequence Number=SeqID_55709
  Subcellular localization annotation: CTP_CleavageSite=50; ConfidenceScore=5.07e-01
MGPMLVTPPSLMSAAPYFVFLADLFPKHRETLRITQRRVLSILNQLAKVCALTNNCPRKKLGIVIKRKERTLWCPYRTRARARVMSEIKEVQEHMKADMEAMKEKMITMMEAMMSMRKMMEVNMATIVAASTATKVDPTHPSGLNHVNPPVLDMVEQGGEALGCTGDPHFVQI

SEQ ID NO: 172488 - protein, 97 aa, Glycine max
  Coding DNA Sequence Number=SeqID_55710
  Subcellular localization annotation: CTP_CleavageSite=39; ConfidenceScore=5.46e-01
MRGTMHKPQGNLGADQKFSPGSSLTPGHVTSLSQRALLRASEARLTGALSKGGKMRGVATNEGISTSHVDKSEALAPTYPPSKRKSDLRSSSLRVKP

SEQ ID NO: 172489 - protein, 150 aa, Glycine max
  Coding DNA Sequence Number=SeqID_55711
MCKKEHESFKEYVQRLRDLAAQVVPPMVEREMITMIVETLPVFYYEKMVGYTPSTFADIVFASERIKVGLRRGKFDYPTLMNRKPGANGENKKDPSHYPSPYQQRMPNHPQRPPLNQPQNLPVAHLMLNTTLNMNQNTNQGRNFPEKKHV

SEQ ID NO: 172490 - protein, 91 aa, Glycine max
  Coding DNA Sequence Number=SeqID_55712
MELPPTCQQARLPQADKRYLRMSSDLPSLDDKGADDDVSLYVSTGSLASSCQKVRINIRYLHMSSNSPSLDDKGADDDVSLYVSTGSLASS

SEQ ID NO: 172491 - protein, 142 aa, Glycine max
  Coding DNA Sequence Number=SeqID_55713
MVCTNQADTTGRLLAGSLAFECRIMHYLIVCILLPRSSNLAQAHLVRYHIHKALRSNALLPYPHLITLFLQHFNIPLDSEPFVKVKRSFSIGANVVSSFRYHKERDGSWVKKDAPVQAVEDRSPSPPPQRNDSSSLMHNILD

SEQ ID NO: 172492 - protein, 65 aa, Glycine max
  Coding DNA Sequence Number=SeqID_55714
MTVKKRLSHEVQKRSFSVLSAIEESGRALASRSCTKHEISALSATGVFSQAQRTTGAKPESTYSR

SEQ ID NO: 172493 - protein, 131 aa, Glycine max
  Coding DNA Sequence Number=SeqID_55715
MSGPKYNKTEESKNFPSLQTHAFVKWWTQFDVSKVEPEQVKLWFKAHLEHLKAVDPETSSFLNQKSQLATFLASSRSRESLAKNLKEVLQLLQQEEDEGFSSKKEETNSSKEDDPFYQNEDDCFGISLNDD

SEQ ID NO: 172494 - protein, 112 aa, Glycine max
  Coding DNA Sequence Number=SeqID_55716
MALGDMAARPGELELHPEVTLVTQASYSSPRQAGYFTLKSFGGPGELEASLGEPSDRKLASWTQSPLLSFFPLKVCFLVYRGYREEEIGPHLSTPLASLKHGVTKREKLNLT

SEQ ID NO: 172495 - protein, 99 aa, Glycine max
  Coding DNA Sequence Number=SeqID_55717
MMQVRGCTLCGRARESGMCIAQEDASKERRTPRRNARWFSQGARGRKALKKKRELREKWRISLRSPFPLEKPCDRCRWTLNFLRTSSRRKGSTSTMRTL

SEQ ID NO: 172496 - protein, 78 aa, Glycine max
  Coding DNA Sequence Number=SeqID_55718
MPRGLQENWVTDAGEGPRVLRSLRAWVSHKVDIVDLMLEDEGENLEEDTSYEEDSSLDKEDPTTERKIVEGNSSKDSS

SEQ ID NO: 172497 - protein, 415 aa, Glycine max
  Coding DNA Sequence Number=SeqID_55719
  Gene Ontology: Mol. function=RNA-directed DNA polymerase activity; Cellular component=intracellular; Biological process=RNA-dependent DNA replication
MPLSVCRRIGNLKIAPTRMTLQLLDRSITRSYGVVKDVLVKVRQFTFPMDFVIMDIEEDLNIPLILGRPFMLTTKCFVDMGNGNLEMRVKDQKEVDLVVQRFTIHSPLEKALINVVECLTNEEEKDLRGCLAYLARLKETPSREYAFEELKKDFAAEKPKVELKVLPPHLKYDFLEANDAKPVVISNDLSSNEDAWLVEVLKKYKVAIGWHISDLKGISPSYCMHKIMMKADYRLEEVQKQILKLLEAGLIYSISGSAWVSPIHVVPKKGGVVVACNEKNDLIHTQTIIGWRMCIDYRKLNDATRKDHFPLRFMDQTLDNEFSTPNLYKTNLVNKMMTKVMNKKLKRSKNNSSESKNISSESRTSQEFKNQEEFKTQKESLQSRIKIQDSRSQESRSRFKTQDSRIKKGLNQDKN

SEQ ID NO: 172498 - protein, 99 aa, Glycine max
  Coding DNA Sequence Number=SeqID_55720
MLHEMKYWNLSMLHKRYPTNDRSNTKSKNEKVHPKNKCCESSLSTPQKTHPPSSTIIPLLTRATRVGSLSRISLQEKVKTLDETSHFQNDRKEKFTTVG

SEQ ID NO: 172499 - protein, 76 aa, Glycine max
  Coding DNA Sequence Number=SeqID_55721
MMQPMQGFTTKIMHNIDGVLNHVTLSMMLVARDGGATVQAKYHSQGKLELQLRVWEKRIVLGLKLKVLGSNMWSII

SEQ ID NO: 172500 - protein, 464 aa, Glycine max
  Coding DNA Sequence Number=SeqID_55722
  Gene Ontology: Mol. function=translation initiation factor activity; Cellular component=eukaryotic translation initiation factor 4F complex; Biological process=translation
  Homolog annotation: Hit_ID=Q1SL91; Match level="QueryCoverage=99%, HitCoverage=51%, E-value=1e-169, Identity=67%"; Hit description =Initiation factor eIF-4 gamma, middle; Initiation factor eIF-4 gamma, MA3
  Pfam annotation: Domain name=MIF4G; Domain location=206-432; Score =219.6; E_value=7e-63; Accession=PF02854.9; Description=MIF4G domain
MTGDSRFEGHERVRYTRDQLLQLKEAVEVPDDILKIKQDIEAELFGEDPSWGRAESNLPHQLQNRYSEPDNRDWRGRSGQPPASTDERSWENLRDNREFGNRQQDASQVNRHDQLNSQFARTQISSMQGYIYSVIIYRQASHEKAGQGRAKGPVTVEQGLVAAEQCLVAAKKRRCGRKGGPTPTLVKAEVPWSARRGSLSEKDRVLKTVKGILNKLTPEKFDVLKGQLIDSGITSADILKDVISLIFDKAVLEPTFCPMYAHLCSDLNEKLPPFPSEEPGGKEITFKRVLLNNCQEAFEGAENLREELKRMTVPEREMERTDKGRLLKLRTLGNIRLIGELLKQKMVPEKIVHHIVQELLGSPDSKSCPVEENVEAICQFFNTIGKQLDESPKSRRINDIYFSRLKELSSNLQLVPRLRFMIRDVIELRASNWVPRREEVKAKTITEIHSEAEKNLGLRPGATA

SEQ ID NO: 172501 - protein, 47 aa, Glycine max
  Coding DNA Sequence Number=SeqID_55723
MESGRVYIPEIAKEIGLLDKNLRPTSPSWVPENGKLEDKAVVLRRKS

SEQ ID NO: 172502 - protein, 87 aa, Glycine max
  Coding DNA Sequence Number=SeqID_55724
  Gene Ontology: Mol. function=Rab GDP-dissociation inhibitor activity; Cellular component=barrier septum; Biological process=regulation of GTPase activity
  Homolog annotation: Hit_ID=Q9LXC0; Match level="QueryCoverage=88%, HitCoverage=17%, E-value=1e-36, Identity=93%"; Hit description=GDP dissociation inhibitor
  Pfam annotation: Domain name=GDI; Domain location=1-87; Score=-283.3; E_value=0.061; Accession=PF00996.9; Description=GDP dissociation inhibitor
MDEEYDVIVLGTGLKECILSGLLSVDGLKVLHMDRNDYYGGASTSLNLTQLWKRFRGDDTPSENLGSSREYNVDMIPKDNRPVLIKC

SEQ ID NO: 172503 - protein, 35 aa, Glycine max
  Coding DNA Sequence Number=SeqID_55725
MVPSPSSTNRAATMKRTNVKGYKGRVFRAHLILEW

SEQ ID NO: 172504 - protein, 224 aa, Glycine max
  Coding DNA Sequence Number=SeqID_55726
  Homolog annotation: Hit_ID=Q9LG92; Match level="QueryCoverage=65%, HitCoverage=45%, E-value=5e-46, Identity=58%"; Hit description =Putative seed specific protein Bn15D17A
  Pfam annotation: Domain name=DUF260; Domain location=4-109; Score =93.6; E_value=5.9e-25; Accession=PF03195.5; Description=Protein of unknown function DUF260
MKSSCNGCRILRKGCNDNCIIRPCLEWMNSPESQANATLFLAKFYGRTGLLNLITAAPQHLGPVVFRSLLYEACGRLVNPTYGSLGLFWTGEWAQCEAAVDAVLTGSKINGVAPSDGHTSGTLASDHILSTCDIRHMKNGTNVDDMRGRIQFKNVKQVIKPKPRMGSIDSTMLWKPNCQSQSMETIEASLVSQDELNRVRKIKLDLELTLGFRCQSTNGKKTHY

SEQ ID NO: 172505 - protein, 141 aa, Glycine max
  Coding DNA Sequence Number=SeqID_55727
  Gene Ontology: Mol. function=DNA binding; Biological process=DNA integration
  Homolog annotation: Hit_ID=Q1SKC8; Match level="QueryCoverage=70%, HitCoverage=23%, E-value=2e-26, Identity=57%"; Hit description =Integrase, catalytic region
MRINTYESSKIYKHKIKTYHDKKLQRQNFQPGQQVLLFNSKLRLFPGKLKSKCSGSFMIKEVRPHGAVELVDHMASTPEKRWIVNGQQLKIYNGGQLEILTRCRKQKGGWADNVIALIAHLHAQCLAGERRAKRDILAKCV

SEQ ID NO: 172506 - protein, 161 aa, Glycine max
  Coding DNA Sequence Number=SeqID_55728
MATISQWRFYLYSAAVMTRAFPDYIGDRRDLFLLQSIASYLLLGCGVVYVVSGILCIGFLKRARQKQEITREQATKDLESYCNSAPLPFHVHHHWWRLGTKIYSMGLFSILTERIKTLISLSNFLSPADLVYNTCFLIKKTCFIYLLLWTHPGVGTPQRGA

SEQ ID NO: 172507 - protein, 315 aa, Glycine max
  Coding DNA Sequence Number=SeqID_55729
  Gene Ontology: Mol. function=Rab GDP-dissociation inhibitor activity; Cellular component=cytoplasm; Biological process=regulation of GTPase activity
  Homolog annotation: Hit_ID=Q1SG94; Match level="QueryCoverage=94%, HitCoverage=66%, E-value=1e-164, Identity=94%"; Hit description=Rab GDI protein
  Pfam annotation: Domain name=GDI; Domain location=1-308; Score=499.0; E_value=5.4e-147; Accession=PF00996.9; Description=GDP dissociation inhibitor
MGLFEKRRARKFFIYVQDYETNDPKSHEGLDLNQVTARQLISKYGLEDDTVDFIGHALALHRDDSYLDEPAKDFVDRVKIYAESLARFQGGSPYIYPLYGLGELPQAFARLSAVYGGTYMLNKPECKVEFDDNGKAIGVTSEGETAKCKKVVCDPSYLSDKVQKVGKVARAICIMSHPIPDTNDSHSAQVILPQKQLGRKSDMYLFCCSYAHNVAAKGKYIAFVTTEAETDQPEVELKPGIDLLGPVDEIFYDIYDRFEPCNDHEADGCFISTSYDATTHFETTVKDVVELYSKITGKVLDLSVDLSAASAATEE

SEQ ID NO: 172508 - protein, 207 aa, Glycine max
  Coding DNA Sequence Number=SeqID_55730
  Gene Ontology: Mol. function=hydrolase activity; Cellular component =cytosol; Biological process=metabolic process
  Homolog annotation: Hit_ID=Q2HVA6; Match level="QueryCoverage=83%, HitCoverage=87%, E-value=3e-59, Identity=61%"; Hit description=HAD -superfamily phosphatase subfamily IIIC; TonB box, N-terminal
MEDVERVKAEALQIMGVFSLLPRLVVFDLDYTLWPFYCECRSKHDTPSLFPHSRGILHALKQERIDVAIASKSPTPDIATTYLDKLSIRSMFAAEEIFYTWKDKTEHFQRIHSKTGVPYNSMLFFDDDNNNIPGASELGVTSILVRNGVNLGAFRDGLTKFSQNKDASKKNRPKRPKTTSIDDFKSVASITPNSQEENLSVPGAFLI

SEQ ID NO: 172509 - protein, 195 aa, Glycine max
  Coding DNA Sequence Number=SeqID_55731
  Subcellular localization annotation: CTP_CleavageSite=64; ConfidenceScore=5.33e-01
MTAGAMRQMLFSIWKPPVEHVGPSAGGGYSFAFVRIARASAACFSNPVDAGRGQSMTSAQASVGAAATPPTTGTILMTAEVTRQGAAARPQPVQDRQSREISNHFMGFVGEGWAPRAWPWRNAWILRRGPVMNSGELSGECNDVCARALRIVQPFQLASAIGDAAHSGAWPRWRYTRARLAKNDSAAMQQARAKT

SEQ ID NO: 172510 - protein, 58 aa, Glycine max
  Coding DNA Sequence Number=SeqID_55732
MHCIHNGMQPIQDYYFVFDKNGYFAGHCQGQDLDSADDSPIHISQLKVDVILPLKGIE

SEQ ID NO: 172511 - protein, 158 aa, Glycine max
  Coding DNA Sequence Number=SeqID_55733
  Gene Ontology: Mol. function=nucleic acid binding
  Homolog annotation: Hit_ID=Q1SMQ6; Match level="QueryCoverage=92%, HitCoverage=16%, E-value=3e-46, Identity=62%"; Hit description =Tudor; Staphylococcus nuclease subtype
MKKIQGLQVLHGATSKIPGVAEASIRNLPPSTIGDASIFNAKALLDANKGNPMEGIVEQTRDGSTLRVYFLPEFQFVQAPQMGRRVVPESVAEPEVIANATNGDVTGEPQALLTSAQRLVAPASVETATDPLAPEAKFFTKIRVLNQDLGVDKYNNLI

SEQ ID NO: 172512 - protein, 80 aa, Glycine max
  Coding DNA Sequence Number=SeqID_55734
MVLESILDPLLYHLHCHALGPFRPVVMGLSGQLATSAAGIPLFEFFLTMDKKGEFKSQICCSKNYEQLGIPGNQFGLLVA

SEQ ID NO: 172513 - protein, 244 aa, Glycine max
  Coding DNA Sequence Number=SeqID_55735
  Gene Ontology: Mol. function=phosphoric ester hydrolase activity; Cellular component=chloroplast; Biological process=carbohydrate metabolic process
  Homolog annotation: Hit_ID=Q9FMF1; Match level="QueryCoverage=99%, HitCoverage=59%, E-value=1e-105, Identity=75%"; Hit description =Fructose-bisphosphatase-like protein
  Pfam annotation: Domain name=FBPase; Domain location=1-242; Score =124.2; E_value=3.7e-34; Accession=PF00316.10; Description=Fructose-1- 6-bisphosphatase
MASEENDAPTWISDDGPYVVVTDPLDGSRNIDASIPTGTIFGIYKRLEELDNLPTEEKAMLNSLQSGSKLIAAAYVLYSSATILCITFGSGTQAFTLDHSTGDFILTNPSIKIPPRALVYALDSSLVWSGQIYSVNDARYFDWPEGLRQYIDTVRQGKGRYPKKYSARTLLYGGVTMNPRDHLRLVYEANPLSFIVEQAGGRGSDGKNRILSLQPVKLHQRLPLFLGSLEDMEELESYGDIQQK

SEQ ID NO: 172514 - protein, 62 aa, Glycine max
  Coding DNA Sequence Number=SeqID_55736
KLEDASEDQGSSFGVVAASKSCKNFLILSALRLLQVALISKSMGIKPPAVDLLCIQEKQNSN

SEQ ID NO: 172515 - protein, 44 aa, Glycine max
  Coding DNA Sequence Number=SeqID_55737
MGWAGAEGGVRPFGVSLLVVGFDDNGPQLYQTICNKSRLQNLVH

SEQ ID NO: 172516 - protein, 83 aa, Glycine max
  Coding DNA Sequence Number=SeqID_55738
  Homolog annotation: Hit_ID=Q5ZC01; Match level="QueryCoverage=76%, HitCoverage=7%, E-value=7e-09, Identity=50%"; Hit description=IFA -binding protein-like
  Pfam annotation: Domain name=DUF593; Domain location=1-43; Score= -24.2; E_value=0.016; Accession=PF04576.6; Description=Protein of unknown function, DUF593
MEALQYFRMTEKQQEYDNDELEKVNGLLTEKEKKIQELEAELECYRSNMADDEPMATKNPMYLNYIKVNGQTLGAADSNNTFG

SEQ ID NO: 172517 - protein, 81 aa, Glycine max
  Coding DNA Sequence Number=SeqID_55739
  Homolog annotation: Hit_ID=UPI000034F2F4; Match level="QueryCoverage =64%, HitCoverage=7%, E-value=4e-14, Identity=64%"; Hit description =protein binding
MWGDGGWCLLDIDPCGKLVLCLDSTFFEFEELWDAHSIELEESLQKLGVEKLNKDDVQKLQWEILEAKIGNWIHFMRIAVR

SEQ ID NO: 172518 - protein, 49 aa, Glycine max
  Coding DNA Sequence Number=SeqID_55740
MALTSALCSAFDELLDTMACFLDFHEIIERKIPAPGDPLIYLRIQIVAC

SEQ ID NO: 172519 - protein, 182 aa, Glycine max
  Coding DNA Sequence Number=SeqID_55741
  Gene Ontology: Mol. function=DNA binding; Cellular component=oxygen evolving complex; Biological process=DNA integration
  Homolog annotation: Hit_ID=Q1ST43; Match level="QueryCoverage=58%, HitCoverage=7%, E-value=1e-31, Identity=61%"; Hit description =Integrase, catalytic region; Peptidase aspartic, catalytic
MNQQKIGTIEMVEGLYRLNMIPIKSKYKSDFAGSSISNFSAFSYDYSRFVWVFLMQSKAETQSHLKNFVANVERKFSPSYHNIVLSITQSLEPRSYNEASKDPVWVEAMNAEIKALELNDTWILTDMPQHNNVIGCKWVYKIKHKSDGSMERHKARLVAKGYTQVEGQDYLGTFSPVSKLTT

SEQ ID NO: 172520 - protein, 242 aa, Glycine max
  Coding DNA Sequence Number=SeqID_55742
  Homolog annotation: Hit_ID=Q8GXL7; Match level="QueryCoverage=39%, HitCoverage=29%, E-value=1e-18, Identity=52%"; Hit description=GATA transcription factor 27
  Pfam annotation: Domain name=GATA; Domain location=80-117; Score =56.8; E_value=7e-14; Accession=PF00320.17; Description=GATA zinc finger
MGSHLCFGSNIPPPCPCPPLSLFHMMHRKNGQFASMKEDYKSPAENWDSSNGTPCPESTVLMLICYCRAATLPLLSERRCQHCGISEKSTPAMRRGPAGPRSLCNACGLMWANKGTLRDLSKAARIAFEQNELDTSADIKPSTTEAEHSFAKQDKEGSPEETKPVQMDSSRSPEKTNDQFIIGTAESVTDNLSIQVENHALSLHEQDTLEDLADASGTEFEIPAGFDDQVDIDDSNMRTYWL

SEQ ID NO: 172521 - protein, 288 aa, Glycine max
  Coding DNA Sequence Number=SeqID_55743
  Gene Ontology: Mol. function=GTPase activity; Cellular component =mitochondrion; Biological process=cell division
  Homolog annotation: Hit_ID=Q2HV98; Match level="QueryCoverage=78%, HitCoverage=38%, E-value=2e-74, Identity=54%"; Hit description =Dynamin central region; Dynamin; Dynamin GTPase effector
  Pfam annotation: Domain name=GED; Domain location=109-172; Score= -6.1; E_value=0.0089; Accession=PF02212.8; Description=Dynamin GTPase effector domain
  Subcellular localization annotation: CTP_CleavageSite=47; ConfidenceScore=5.02e-01
MDYINTSHPNFIGGSKAIEAAVQQTRSSRIALPVSRVKDALESDKGSASERSGKSRSILARHANGVVADQEMTASKPHTEPVHTVQSFSTIHLREPPPVLRPLESNSETEAVEITVTKLLLKSYYDIVRKNVEDLVPKAIMHFLDLNELPLEAETVERGYSLPETTTGLPKIRGLPTSSMYSTGSLGDYYEASPKNTKSRKSSHSGELQSPFHDSNGNGGPYTSGRSARPAPRAAPRPAPVHHAPPPAPAQSGGGSMLGGIGSTIAQGMAFGTGSAVAHRAVDAVMGP

SEQ ID NO: 172522 - protein, 35 aa, Glycine max
  Coding DNA Sequence Number=SeqID_55744
MWECLNSYGSDLSKCQFYMDMLAECRKNSGASLSV

SEQ ID NO: 172523 - protein, 150 aa, Glycine max
  Coding DNA Sequence Number=SeqID_55745
MKKGIACLPGLGSNNVASSAQLLCLVCESNLENCWHNFINYDRAQQCWQKTHLWQAMEAISIQVENFAEFFSSCFQSLSVKEMEACVREYVEGKKHRLMGKQIVAVDQVVFQATKVLTQWSGAQAMEKSLDVQRDRELVVALGLHRKMTS

SEQ ID NO: 172524 - protein, 125 aa, Glycine max
  Coding DNA Sequence Number=SeqID_55746
MASSKYQSLCFYNLPLFDDDNLIPEIKIQDRIYARYNVMFTHSILPLCFGINDLLISKLSKLLNYPVSLPLWQNQKAKVRGSWWKVEAPMKITHILFKLRDTGIHSFKATIQRIKAFANIGAEAP

SEQ ID NO: 172525 - protein, 45 aa, Glycine max
  Coding DNA Sequence Number=SeqID_55747
MKTETARLTHNTGLTINSTQAQHEQGLRTSKLKGTLSMKVHAKHE

SEQ ID NO: 172526 - protein, 111 aa, Glycine max
  Coding DNA Sequence Number=SeqID_55748
  Gene Ontology: Mol. function=DNA binding
  Homolog annotation: Hit_ID=Q1S0F5; Match level="QueryCoverage=88%, HitCoverage=24%, E-value=1e-13, Identity=37%"; Hit description=IMP dehydrogenase/GMP reductase
KESPIVAVLADAYDTFDQRCEKSSARIVCCTPALYVWLVSHIFRHERASVNWFPRWKEEGVGVLCSCEGFPNVPLMETRGCINYNPMLAIRQLGYPVRGAPSEEIIAPFIA

SEQ ID NO: 172527 - protein, 53 aa, Glycine max
  Coding DNA Sequence Number=SeqID_55749
QGCAEGTRLGDPYSALVVLKVAPQPMVDDGRLAQGPMGVPRWRHLDRLYHLAS

SEQ ID NO: 172528 - protein, 168 aa, Glycine max
  Coding DNA Sequence Number=SeqID_55750
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=99%, HitCoverage=11%, E-value=1e-49, Identity=58%"; Hit description =Putative retroelement
MAEEDIPKIAFRTHHDHYEYWVMPFGLCNAPSTFQAAMNALLSPFLRKFASVFFDDILIYSATFNDHLHHLECVFNSLLQAHYYLKQSKCLIGQRQLDYLGHIISGSGVRPNPTKIQAIVEWATPRSPKDLRAFLGLTGFYRKFVQGYAAIAAPLTKLHWKNAFQWTS

SEQ ID NO: 172529 - protein, 85 aa, Glycine max
  Coding DNA Sequence Number=SeqID_55751
MISLHTIDANRRCLITVAVRMHNGMDEGARPKGCAVLQRRGDQEQRMWQLGCCCSNIGVAGSYLDWVEWGEKKLKGLTFVGIKNK

SEQ ID NO: 172530 - protein, 137 aa, Glycine max
  Coding DNA Sequence Number=SeqID_55752
  Gene Ontology: Mol. function=chromatin binding; Cellular component =chromatin; Biological process=chromatin assembly or disassembly
  Homolog annotation: Hit_ID=Q1SAV4; Match level="QueryCoverage=99%, HitCoverage=34%, E-value=3e-33, Identity=48%"; Hit description =Integrase, catalytic region
MKHFIDQMRRDVIYEVDQLVYVKLRPHRQSSLCSQPSTKLTKRYFGPFQVLECIGSVAYRLQLHEGSKIHPMFHCSLLRPHYGPLDLQQAPLPPDVLDNHPIMEPMAILDSRVDSSTQPPTQMVLVQWTGLAPEDST

SEQ ID NO: 172531 - protein, 149 aa, Glycine max
  Coding DNA Sequence Number=SeqID_55753
IMVRTKGLGRALDRIIGRALGRKDHHHSDDVPQRRRPTASTRRQREVAPIAKDAPNVTEDVHAHVEETIDYAEGFPGGPRDPSALTNYGDHVAVIVWNGEERPELKLSSHGMKVQKFERLAPKIEGLVVAIGLSLLIACHAILPPKGIG

SEQ ID NO: 172532 - protein, 102 aa, Glycine max
  Coding DNA Sequence Number=SeqID_55754
  Gene Ontology: Mol. function=nucleic acid binding; Biological process= DNA integration
  Homolog annotation: Hit_ID=Q1SDG1; Match level="QueryCoverage=97%, HitCoverage=8%, E-value=1e-16, Identity=40%"; Hit description =Integrase, catalytic region; Zinc finger, CCHC-type
MEEGFSTKKLPIFRGVKYDYWKEQMITHFESIHIDLWDMVEHRNHIPYDDKLNEVPRSQWREEQKLTFLFNSKARNVMLCALSKEEYTNVHSFRSVKQMWTV

SEQ ID NO: 172533 - protein, 51 aa, Glycine max
  Coding DNA Sequence Number=SeqID_55755
MDSGRFQVSVPVPHLLRMPPSSDNISLDVSYPNFVWGPLLGDMRPFFGPWE

SEQ ID NO: 172534 - protein, 97 aa, Glycine max
  Coding DNA Sequence Number=SeqID_55756
  Subcellular localization annotation: CTP_CleavageSite=53; ConfidenceScore=5.12e-01
MRIPLRLKCSSQCGGLAANNGSSWWPPVVVGGGGGVSRVVGQSFERERREIISLDERVSLRWSPLLALSTTFHAYRNFSQVRIALRALLTLCNYLKL

SEQ ID NO: 172535 - protein, 288 aa, Glycine max
  Coding DNA Sequence Number=SeqID_55757
  Gene Ontology: Mol. function=catalytic activity; Cellular component =cytoplasm; Biological process=glutamine metabolic process
  Homolog annotation: Hit_ID=Q9AUL0; Match level="QueryCoverage=97%, HitCoverage=81%, E-value=6e-65, Identity=45%"; Hit description =Putative glutamine synthetase
  Pfam annotation: Domain name=GATase; Domain location=108-251; Score= -59.0; E_value=0.042; Accession=PF00117.18; Description=Glutamine amidotransferase class-I
MEIKKRFGVLMCAEDSEYVKKVYGGYSGVFVRMLAEEGETWDVYKVARGEFPDEDDLGLYDGFVITGSCSDAHGNDTWVSDLLNLLRKLDSINTKILGICFGHQVRNAAASFDSIQHYFYSQKVYTVHFLSCISHPDYAISHIDLCKILGRALGGKVTRSTTGWDLGVRTITLSPSLRFALSSLDLPSRLSIIECHRDEIRELPAKAEVIAWSDKTGIEMFRYGDHIMGIQGHPEYSKDILLHLIDRLIQRNYIIDAFGKQARERAALWEPDREAWKKLCVTFLKGRL

SEQ ID NO: 172536 - protein, 278 aa, Glycine max
  Coding DNA Sequence Number=SeqID_55758
MAEIFTRDGAQMLHLIRDLRSIDIEIPVELESEINLYKSVQDIDRAARVDLQNAQSRLSACTPDEWDDTVLALSAALTTSWNLDNGLTSNLLQTTTDRLVRTTYRYTSHWSAQIVSRLNALVESTEWNRHVRNIPAFDQKVRALSITRSQATAVAACLEAADAFNPLWNVLVRLGNLDGHEIGVGRADDFSRNAHLFYILSDGDWGQAQGAAMRMAGSAFKSTAAEEYTELIPFVFPGLVGAELDFATPNRASERRRNRQTFGTVGPIAQYSGVSYHS

SEQ ID NO: 172537 - protein, 112 aa, Glycine max
  Coding DNA Sequence Number=SeqID_55759
  Subcellular localization annotation: CTP_CleavageSite=70; ConfidenceScore=5.86e-01
MKDRRNTSSGDVSFTSRTSQSLTNSSQALRTTSTSCSILCSGWTQAVRLTGLALARQTRTGHPSSKFFLALSQRSVALSRWLAKPEDWLSERMKISTSQTCLINLKLRGNGY

SEQ ID NO: 172538 - protein, 107 aa, Glycine max
  Coding DNA Sequence Number=SeqID_55760
MVEIVAYPPPKLIRGQDVPIWAPTPNDTFSISSAYELIENCADPLNDPLWKSIGCGKGCNGSKLSCGVWPFMTNMQPLLIVKELMSRNWSVRVTRFSFYSYFCWYNN

SEQ ID NO: 172539 - protein, 370 aa, Glycine max
  Coding DNA Sequence Number=SeqID_55761
  Homolog annotation: Hit_ID=Q10NT0; Match level="QueryCoverage=26%, HitCoverage=11%, E-value=8e-10, Identity=32%"; Hit description =Expressed protein
  Pfam annotation: Domain name=DUF593; Domain location=193-286; Score =78.8; E_value=1.7e-20; Accession=PF04576.6; Description=Protein of unknown function, DUF593
  Subcellular localization annotation: CTP_CleavageSite=77; ConfidenceScore=5.20e-01
ATPPPLCAPNAAITRSLSFFILLFPFAPTLIGVPSLLLPPPPASDADSPSLLLHQRLPMDFPPALNLLTEFGCGFVLLRSLSRIFNLLGLFLMLTFCFKVMCFGWNSKNALRFLCDSGGVPRIRFCLDKVVLEKVSKAKTKPLKKPRHPTSSSSFRRRPGGSGERGNAVSDDGSEGKGENEREGGNEDEVFDVMTLRRMVRMERQKANAACADLEKERTAASSSAEEAMAMILRLQSEKSAAEIQATQFRRMAEQKLDYDNEVIESLQWTITQHEFQKCEVEDRIEMCREELRQFMRDEEIDRIEDEVSRSFMYDNENDNDDPDGSTFRFDSVRLSKFNGAHNVAGIDASPACKNLILMLAVDNNVIRGI

SEQ ID NO: 172540 - protein, 365 aa, Glycine max
  Coding DNA Sequence Number=SeqID_55762
  Gene Ontology: Mol. function=formate-tetrahydrofolate ligase activity; Cellular component=mitochondrion; Biological process=folic acid and derivative biosynthetic process
  Homolog annotation: Hit_ID=Q1SCS3; Match level="QueryCoverage=83%, HitCoverage=45%, E-value=1e-134, Identity=80%"; Hit description =Formate-tetrahydrofolate ligase, FTHFS
  Pfam annotation: Domain name=FTHFS; Domain location=43-365; Score =228.3; E_value=1.7e-65; Accession=PF01268.9; Description=Formate- -tetrahydrofolate ligase
MEVVIVAIAATLGNLLMGWDSSTIADKMMSSTTVRKLQVVSPVPVDIDIANSVEPVHISQIAKDLNLSPNHYDLYGKYKAKLESDLDAHAQVLLSVLDELQGSEDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHESTQSDKALFNRLCPPNKEGKRSFSDVMFRRLTKLGISKTNPDDLTPEEVNKFARLDIDPNSITWRRVMDINDRFLRKIAIGQGLDEKGMVRETGFDISVASEIVAVLALTTSLADMRKRLGKMVIGNTRESHFTFCFMLDLITEMAQETTRALRTGYILAY

SEQ ID NO: 172541 - protein, 489 aa, Glycine max
  Coding DNA Sequence Number=SeqID_55763
  Gene Ontology: Mol. function=protein serine/threonine kinase activity; Cellular component=cell surface; Biological process =protein amino acid phosphorylation
  Homolog annotation: Hit_ID=Q1SFV7; Match level="QueryCoverage=98%, HitCoverage=72%, E-value=0.0, Identity=69%"; Hit description=Protein kinase; Concanavalin A-like lectin/glucanase
  Pfam annotation: Domain name=APH; Domain location=165-344; Score= -15.8; E_value=0.077; Accession=PF01636.13; Description =Phosphotransferase enzyme family
  Pfam annotation: Domain name=Pkinase; Domain location=160-429; Score =171.6; E_value=2e-48; Accession=PF00069.15; Description=Protein kinase domain
  Pfam annotation: Domain name=Pkinase_Tyr; Domain location=160-429; Score=115.3; E_value=1.7e-31; Accession=PF07714.7; Description =Protein tyrosine kinase
  Pfam module annotation: Pfam domain module=APH::Pkinase::Pkinase_Tyr; Domain location=165-344::160-429::160-429
MVHSMDERGYDADVSYDSGSNRLSVTFTGYKDDKKIKQHLFSVVNLSDVLPEWVEIGFSSATGDFYEEHTLSSWSFNSSLGPKPQKGGSKTGLVIGLSVGLGAGVLFVILGVTFLVRWILRNRGVEEVSLFDHTMDNDFERMSLPKKFSYEELARATNNFASENKIGQGGFGAVYRGFMRELNAHVAIKKVSRGSRQGVKEYASEVKIITQLRHKNLVRLFGWCHENNDLLLVYEFMENGSLDSYLFKGKGLLTWKVRYDIARGLASALLYLHEEWEECVLHRDIKSSNVMLDSNFNAKLGDFGLARLMDHAIGSKTTGLAGTIGYLPPEAATRGKASRESDVYSFGVVTLEIACGRKVIEPNLNEEQIYLVDWVWEHYGMGALLKASDASLYGHFDEKEMERLMIVGLWCTHSDFLLRPTIRQAVQVLNFEAPLPILTSFSSMSSRTPASANNQHVSSNSSSSLLTESLQSSTTIDLISPAAAYLHTY

SEQ ID NO: 172542 - protein, 439 aa, Glycine max
  Coding DNA Sequence Number=SeqID_55764
  Gene Ontology: Mol. function=glutamate synthase (NADPH) activity; Cellular component=membrane; Biological process=nitrogen compound metabolic process
  Homolog annotation: Hit_ID=Q1GXP0; Match level="QueryCoverage=99%, HitCoverage=23%, E-value=1e-179, Identity=71%"; Hit description =Glutamate synthase
  Pfam annotation: Domain name=GATase_2; Domain location=21-376; Score =228.4; E_value=1.6e-65; Accession=PF00310.11; Description=Glutamine amidotransferases class-II
MSTQQPNPWGLYDPSAGSDSCGVGFITRKDGEQTHEILQMAHSALCTVPHRGGMSAEGVGDGAGVNVDLSLNFFRKLTGQALEAGRFGVGNFFVPKDAALRANAERLVEETLAAYNFPVLLKRDMPLDNSVTRPAAQQFQLPIVQWVFAAPQDVTEQSDFERHIYRALLDIEARAFTESEFGGLYPLSLSSRTQVFKARLNSNEVIPYFKDLTDPDHQVRGLFFHTRFSTNTDPHTTMAQPFRLMAHNGELNTDRKNRIAEAALMLARGKKIVRPKGQSDSSRLDQSIHSRLMEDNLDLINAVVSMMPPAWENDTSLSAEVRAMLEYFSLYEEKNDGPAALIFGNGEVIGARLDRLGLRPLRSVETAEYIGAMSEAGQIAFPPESVLRRGRIEAGGMLYYDHKEKRSYTTVQALEKLAAEKDYLSLVQAARVELQQLPE

SEQ ID NO: 172543 - protein, 119 aa, Glycine max
  Coding DNA Sequence Number=SeqID_55765
MINPALHHPLRGEEGSSLNQKPSYCQKKHYQHKDEVLNIENISNMNMTQKLQTISILVDILNNLHRPNFASSKLFIFMGRKRIFSQDSPDKIANRKVHRSTLPLSIEHEYVHAPGKVWR

SEQ ID NO: 172544 - protein, 49 aa, Glycine max
  Coding DNA Sequence Number=SeqID_55766
HVPPGGMAVCTSHSYPCPANANSGTPLSRHCHWRFKLPASVNGGTHVQK

SEQ ID NO: 172545 - protein, 616 aa, Glycine max
  Coding DNA Sequence Number=SeqID_55767
  Gene Ontology: Mol. function=protein serine/threonine kinase activity; Cellular component=cell surface; Biological process =protein amino acid phosphorylation
  Homolog annotation: Hit_ID=Q1SFV6; Match level="QueryCoverage=99%, HitCoverage=75%, E-value=0.0, Identity=68%"; Hit description=Protein kinase; Heat shock protein Hsp20; Concanavalin A-like lectin/glucanase
  Pfam annotation: Domain name=Lectin_legB; Domain location=31-267; Score=204.0; E_value=3.5e-58; Accession=PF00139.10; Description =Legume lectin domain
  Pfam annotation: Domain name=Pkinase; Domain location=367-612; Score =148.2; E_value=2.2e-41; Accession=PF00069.15; Description=Protein kinase domain
  Pfam annotation: Domain name=Pkinase_Tyr; Domain location=367-612; Score=101.5; E_value=2.5e-27; Accession=PF07714.7; Description =Protein tyrosine kinase
  Pfam module annotation: Pfam domain module=Lectin_legB::Pkinase::Pkina se_Tyr; Domain location=31-267::367-612::367-612
MHVQLSNLNFPHHLLVMLLSIFFLLIIPYASSLSFNFTSFDPNDKSIVFEGSANPVAPTIQLTRNQMDKGMIGSIGRATYYQPMQLWDKATGNLTDFTTHFSFVIDSQNRSKYGDGIAFFLAPAGSKIPNATKGASMGLTLDNQQLNSTDNSFVAVEFDIYQNGWDPPHEHVGIDINSMRSASNVTWLADIKEGKLNEAWISYNSSSLNLSVVFTGFNNDTDHTIQQQHLSAIVDLRLHLPELVSFGFSAATGNATAIHSLYSWDFTSTLAAQENITKGADPVARSPTSNIAPSQKKKNKTGLAVGLSIGGFVCGLGLISIVLWKKWKKGTEEEEHDFEEFMGEDFGRGVETRKYSYAELAQAANGFKDEQKLGQGGFGGVYRGYLKDIKSHVAIKRVSEDSDQGIKEFASEIRTINRLRHRNLVHLIGWCHERKKLLLVYEYMPNGSLDTHLFKKQSLLKWAVRYNIARGLASALLYLHEEWEQCVVHRDIKSSNIMLDSEFNAKLGDFGLARFVDHAKGAQTTALAGTMGYMAPECATLGRASKESDVYSCGVVALEIACGRKPINLKAQENEINIVQWVWELFGGGRILDAADPRLEGDFEEEQIKCLMIVGL

SEQ ID NO: 172546 - protein, 393 aa, Glycine max
  Coding DNA Sequence Number=SeqID_55768
  Homolog annotation: Hit_ID=Q53PU8; Match level="QueryCoverage=59%, HitCoverage=51%, E-value=1e-41, Identity=42%"; Hit description =Expressed protein
MDHSPKVGRGSRSLRSDAALEAIAKASEDRVSNIILYNYPSFSGAFSALFAHLFHTRHNLPSLILPFSAVPFLALRVEDLCFEGLETCYLLDFIPPKEFLSDLSRKSKCKIIGFDHRKLVLRHIPPANDCPDNIMINVNLEKSSSSAVYEYFASKLSHTTMTEIERCLNFIKGAAPCLVESKYKGQVQLMLKYIENGDLRRWSLPGIRNIPILGASYCQFLYSYHVFAEFALFFEKSSWQLLELSAEGLIAKGNSCVSARQNAANKLLEKVFRVRLGRGFYGECLGVRADGNSNLSDEIGKLLSVKSAATGLRPIGAVIFMQRNNLKMCLRSTDSSTDTSEVAKCYHKRSINSPDIDTAHDETRINKVEPDPEQDGSIDLGVNTPLLGSTSRT

SEQ ID NO: 172547 - protein, 1029 aa, Glycine max
  Coding DNA Sequence Number=SeqID_55769
  Gene Ontology: Mol. function=RNA-directed DNA polymerase activity; Cellular component=chromatin; Biological process=chromatin assembly or disassembly
  Pfam annotation: Domain name=Chromo; Domain location=967-1018; Score =20.5; E_value=0.0037; Accession=PF00385.14; Description='chromo' (CHRromatin Organisation MOdifier
  Pfam annotation: Domain name=rve; Domain location=698-854; Score =113.7; E_value=5.3e-31; Accession=PF00665.16; Description=Integrase core domain
  Pfam annotation: Domain name=zf-H2C2; Domain location=639-680; Score =6.9; E_value=0.044; Accession=PF09337.1; Description=His(2)-Cys(2) zinc finger
  Pfam module annotation: Pfam domain module=Chromo::RVT_1::rve::zf -H2C2; Domain location=967-1018::214-376::698-854::639-680
MARFLALPSSPTASLRVMVGNDNTLECDTVSHQVPLHIQGNSFTLHLLHLPLCGADIVLSVQWLKLLGPITTDYVALTMTFQYMGHPVTLHADAPLHPASITAHQLKRVAQTHNISALFHITPVIAQPESPSPSTPPPPPLPPQITTVLARYPEIFSKPTHLPPHRTIQHHIHLLPNTEPVNVKPYRYPHFQKTKIEKQITSMLDSGLIQPSHSPFSSPILLVKKKDGTWRCCVDYRALNALTVKDRFPMPTIDELLDDLGHASCFSKLDLRKGFNQIRMAESDVHKTAFRTHQGHYEFRFVAVFFDDILVFSSDLATHVTHLDTVLATLSAHNFLLRHSKCEFARSRLNYLGHVISAHGVAPDPEKIQAMLAWPVPTSPTALRGFLGLTGFYRKFIRGYATVASPLTTLLRKDNFKWSPTADLAFQTLKTMMTHAPVLSTPDFSIPFTLETDALASAIGAVLLQQGHPIAYYSKTLCPQLQYSSTYVRELYAITSVVRKWRHYLLGSSFIILIDHKSLKDLMSQVIQTPEQQNYLVKLLGYDYEIKYKPGSTNIVADALSRLPDGVCLSFSIPHFDFLDKLRHTLTQDPQYVELLQVIHSRSAEHPSFSVHKELIFRQDRIWIPFPTPFTSILLDEFHSSPLGGHAGVAKTLHRIRQNFDWPTLRADVRQFVSQCPICQQTKYATKKPSGLLQPLPPPAAVWEDLSLDFITGLPSSQGFTVILVVVDKFSKGAHFGALPTHYSAFKVASLFLDMVYKHHGFPRSLVSDRNSIFLSTFWRELFRLSGTKLHMSTAYHPQSDGQTEVLNRTLEQYLRSFVHHKPSLWFRFLPLAEWSYNTTIHSSTGFSPFEVIYDRPPPSISRYIQGTSSIDAVDTLLVDRTELHAALLRRLGKAQEAMKASADTHRRDVQFSVIQSIGAIAYKLQLPAYSRIHPVFHASLLKPHHGPLPTEYTHLPTDAIDNSPVISPLSIVDWKWDESVTPTIKKVLVQWDGLAPEDTSWESWEDLRTSYNLEDKVVFGVEGVDSNT

SEQ ID NO: 172548 - protein, 474 aa, Glycine max
  Coding DNA Sequence Number=SeqID_55770
  Gene Ontology: Mol. function=oligopeptide transporter activity; Cellular component=integral to membrane; Biological process =oligopeptide transport
  Homolog annotation: Hit_ID=Q1T3R4; Match level="QueryCoverage=99%, HitCoverage=72%, E-value=0.0, Identity=71%"; Hit description =Peptidase aspartic, active site; Oligopeptide transporter OPT superfamily
  Pfam annotation: Domain name=OPT; Domain location=1-438; Score=336.6; E_value=4.3e-98; Accession=PF03169.6; Description=OPT oligopeptide transporter protein
MCRALHEKDERRFSRAKFFFIALVCSFSWYVIPGYFFSTLTNISWVCWIFSKSVTAQQLGSGMNGLGFGALTLDWTAVASFLFSPLISPFFAIVNIFVGYTLVVYVVIPIAYWGLNVYSAHMFPIFSSNLFTSQGQEYNISAIVNEKFELDIAKYHQQGRIHLSVFFSLTYGFGFATVASTLTHVVCFYGREVMERYRASAKGKEDIHTKLMKKYKDIPTWWFYVMMGVTLVVSLVLCIFLNNQVQMPWWGLIFASALAFIFTLPISIITATTNQTPGLNIITEYLFGIIYPGRPIANVCFKTYGYISMAQAVSFLGDFKLGHYMKIPPRSMFLVQFIGTMLAGTINICVAWWLLNSINNICHKDLLPEGSPWTCPSDRVFFDASVIWGLVGPLRIFGSHGDYQALNWKKWWQRYNYVLSAALDAGVAFMAVLLYFTLGLENTSLNWWGTAGEHCPLATCPTAKGIVVDGCPVY

SEQ ID NO: 172549 - protein, 720 aa, Glycine max
  Coding DNA Sequence Number=SeqID_55771
MPAAGMRRTTRVFGMKGAETARVLRSGRRLWPDSGEVKTKRSHDGDQWPMAPPSKAAKIDAAATPRKGKRCEEAAAAVVDRRFGKGLVYQRRRKGLLKKEGSRRNGEVLRCVISVVVSRCAGKSGRFLRLLASVVRKLSGFCMSEAIHGAFASQGMQFVKGPTVVNTGICQFFGVTGTVPAFSVDFSAVSPCFEYLQYAMFLKSMFRSFFLVHNPINVPSDEDIESDDDLLEYQNEQQISSDTFKREPSEIVTVTSDVIEINDKQSLHSSVKVTTRAAGRNGQYKNMLNSRGIQKRRSSLRKRKARSPSMVSLRRNGAVASDLTGGRKSNCQLSVVTSSRKLRSMANGSPTGSLKEASSAIVDSKERLGSSSCYANLLVSEIDQCCRLEGAIVTLEWSSPKEWLFTVKKDGLTRCTFRAEKVMRPFSTNRFTHAVVYSLDNGWKLEFTNRQDWNVFKDLYKKCSDRNIPATAAKVIPVPGVREVSSYAESNCFPYHRPDTYISASGDELTRVMTRATANYDMDSEDEEWLKKFNEFQEHVSEDNFELIIDALEKVYYYNPDDSFDEKSAANGCQDLGSKEVVEAVYNYWMRKRKLKRSFLLRVFQGHQSKRAPLIPKPLLRKRRSFKRQPSQFSRGNQPSVLKAFAAEQDAMEENAMLKIEEAKANANMSMELAINKRKRAQCLAQNADLATYKATMLIRIAEAAMAAESLDDAAAYFLD

SEQ ID NO: 172550 - protein, 119 aa, Glycine max
  Coding DNA Sequence Number=SeqID_55772
  Subcellular localization annotation: CTP_CleavageSite=30; ConfidenceScore=5.55e-01
MTTFAFTSLLPLTVSSPSSSSKFSAFHAIRASLDSEYVASRHTLRREFLKGVALMPLPLVVMREPPPSHAREVEVGSFLPPSPSDPSFVLFKATPKDTPALRAGQVVIMIMIMIFQEPE

SEQ ID NO: 172551 - protein, 109 aa, Glycine max
  Coding DNA Sequence Number=SeqID_55773
  Subcellular localization annotation: CTP_CleavageSite=42; ConfidenceScore=5.40e-01
MGPKSTLMLMRTSAPSLASLAQSSWSLLSNALGGSLSKNLCYGETGRSKGGEPTNEQFEDFCVYGIQLENVEAMSSKVILMMPKNQELSKVSSKDSRIKFQDSRFKIQE

SEQ ID NO: 172552 - protein, 617 aa, Glycine max
  Coding DNA Sequence Number=SeqID_55774
  Gene Ontology: Mol. function=transcription regulator activity; Cellular component=nucleus; Biological process=regulation of transcription
  Homolog annotation: Hit_ID=Q41101; Match level="QueryCoverage=99%, HitCoverage=95%, E-value=0.0, Identity=71%"; Hit description =Phaseolin G-box binding protein PG1
  Pfam annotation: Domain name=HLH; Domain location=428-477; Score =50.5; E_value=5.8e-12; Accession=PF00010.16; Description=Helix-loop -helix DNA-binding domain
  Subcellular localization annotation: CTP_CleavageSite=14; ConfidenceScore=5.29e-01
MSSSDLSSLWLPTPQSAASTTTPGLETTRAPPPQSHSLLNQETLQQRLQTLIEGARESWTYAIFWQSSYDYSSGTSLLGWGDGYYKGEEDKVKAKGKTPKTTSSAEQDHRKKVLRELNSLISGPSASVDDVDEEVTDTEWFFLVSMTQSFVNGSGLPGQAFFNSSPVWVAGPDRLSESVCERAHQGQMFGLQTLVCIPSANGVVELASTEVIFQNPDLMNKVRDLFNFNNNPETGSWALNCVATTDQGENDPSSLWLNPEIRDSSTVAPPNSTVNKTLQFETPGSSTLTDTPSAAAVHVPKSNGQGFFSRELNFSNSLKPESGEILSFGESKKSSYNGSFFPGVVAIEENNKKRSPVSRSSIDDGMLSFTSLPAANIKSGSGGAGAGGGDSDHSDLEASMVKQADSRVMEPEKRPRKRGRKPANGREEPLNHVEAERQRREKLNQRFYALRAVVPNVSKMDKASLLGDAISYINELKLKLNGLDSEKGELEKQLDSAKKELELATKNPPPPPPPPPGLPPSNNEEAKKTTTKLADLEIEVKIIGWDAMIRIQCSKKNHPAARLMAALKDLDLEVHHASVSVVNDLMIQQATVNMGNKFYTQEQLLSALSSKVGDEQR

SEQ ID NO: 172553 - protein, 64 aa, Glycine max
  Coding DNA Sequence Number=SeqID_55775
MPGKVVKNFRRLESLSCGEGWMERWGTKSFCMVERFFFGGDGVEEVCSSGGVDGGSESDDEGGG

SEQ ID NO: 172554 - protein, 261 aa, Glycine max
  Coding DNA Sequence Number=SeqID_55776
GTSTWVVVIENKRGYISCGSILVEGTSTRLFKENKGGYIPCGSLLVKVFTRLKEISRTAGRLGTGWKLKEWNKDVFGNIQWQNFEIKKATNEIDKKDEMGVMNEEDVKSIRDLFVDFKKVILAKVLSRRIRRVLSGAIDGRQGTFIGGKNLLDEVVVANEVSCLESVSFSILLNGSPTLEFKPQRGLREGERFSSFLFLVIVEALSGLMRRVMEKICLKAIGWELLSADFHPLAKPIFWLSEPSAVGNTSRLSARKNLEEG

SEQ ID NO: 172555 - protein, 111 aa, Glycine max
  Coding DNA Sequence Number=SeqID_55777
MTEELSSVHRFIRYSVIQCTNNENLELDESESEVWVWFVLAAKEGVEKRECVYLSEERDKERYTPIKSLNGRGCKKMPSILNLSQGNREVVAHWDTWQFLIGFSGKLSSLA

SEQ ID NO: 172556 - protein, 60 aa, Glycine max
  Coding DNA Sequence Number=SeqID_55778
WVASARLGELGGNLLPIFPINRLKGAVLRIPDAPGEVFVSKSVKVFLRYSPFFICSSFFN

SEQ ID NO: 172557 - protein, 86 aa, Glycine max
  Coding DNA Sequence Number=SeqID_55779
MSQAQALRIPTRVELKPSKAWLGSFPPLLVPIIFSTCGLVDTVQEGYTGFHMGAFNVEISDYLNVTILLVIVSAGYHLSLARCFGT

SEQ ID NO: 172558 - protein, 63 aa, Glycine max
  Coding DNA Sequence Number=SeqID_55780
MKHCQSETESNKWNHRESESDTKNEDGSTVRVRGRPRMRTEALREMTQAVHARLARTIPQHWF

SEQ ID NO: 172559 - protein, 60 aa, Glycine max
  Coding DNA Sequence Number=SeqID_55781
MLHLVVLILFVVLLASLSLLVHSHCRSHSDGHCRCFVGLALSCNSPWQRRECSVPCVRII

SEQ ID NO: 172560 - protein, 87 aa, Glycine max
  Coding DNA Sequence Number=SeqID_55782
MAMDCHTFACTGFIPESQLKNKISHSLIHMGFIGLVTWSGQNRALGGLAACPSELMLHFEVTLLAQVSYNSPKQADYFSPKPFGGPG

SEQ ID NO: 172561 - protein, 67 aa, Glycine max
  Coding DNA Sequence Number=SeqID_55783
MTTEEHQTKNDVEVDYSRDSIAPRPHFSLLLLLLSNFSPNSLNTECPTLYSASLTPIYSKKGHLVDL

SEQ ID NO: 172562 - protein, 669 aa, Glycine max
  Coding DNA Sequence Number=SeqID_55784
  Gene Ontology: Mol. function=unfolded protein binding; Cellular component=mitochondrion; Biological process=protein folding
  Homolog annotation: Hit_ID=P37900; Match level="QueryCoverage=99%, HitCoverage=96%, E-value=0.0, Identity=88%"; Hit description=Heat shock 70 kDa protein, mitochondrial precursor
  Pfam annotation: Domain name=HSP70; Domain location=42-642; Score =1379.5; E_value=0; Accession=PF00012.10; Description=Hsp70 protein
  Pfam annotation: Domain name=MreB_Mbl; Domain location=39-423; Score=- 237.6; E_value=0.0056; Accession=PF06723.3; Description=MreBMbl protein
  Pfam module annotation: Pfam domain module=HSP70::MreB_Mbl; Domain location=42-642::39-423
MVVQLTSGTKTSYRKIWVLPISDLFIVKFDPRCSSKPAGNDVIGIDLGTTNSCVSVMEGKNPKVIENSEGARTTPSVVAFNQKAELLVGTPAKRQAVTNPTNTLFGTKRLIGRRFDDSQTQKEMKMVPYKIVKASNGDAWVEANGQQYSPSQVGAFVLTKMKETAESYLGKSVSKAVITVPAYFNDAQRQATKDAGRIAGLDVQRIINEPTAAALSYGMNNKEGLIAVFDLGGGTFDVSILEISNGVFEVKATNGDTFLGGEDFDNALLDFLVNEFKRTESIDLSKDKLALQRLREAAEKAKIELSSTSQTEINLPFITADASGAKHLNITLTRSKFEALVNHLIERTKAPCKSCLKDANISIKEVDEVLLVGGMTRVPKVQEVVSAIFGKSPSKGVNPDEAVAMGAAIQGGILRGDVKELLLLDVTPLSLGIETLGGIFTRLINRNTTIPTKKSQVMGPVFVFSTAADNQTQVGIKVLQGEREMAVDNKSLGEFELVGIPPAPRGMPQIEVTFDIDANGIVTVSAKDKSTGKEQQITIRSSGGLSEDEIDKMVKEAELHAQKDQERKALIDIRNSADTSIYSIEKSLGEYRDKIPSEVAKEIEDAVSDLRTAMAGDNADEIKAKLDAANKAVSKIGEHISGGSSGGSSAGGSQGGEQAPEAEYEEVKK

SEQ ID NO: 172563 - protein, 170 aa, Glycine max
  Coding DNA Sequence Number=SeqID_55785
  Gene Ontology: Mol. function=oligopeptide transporter activity; Cellular component=integral to membrane; Biological process =oligopeptide transport
  Homolog annotation: Hit_ID=Q1SFU4; Match level="QueryCoverage=82%, HitCoverage=23%, E-value=4e-61, Identity=69%"; Hit description =Oligopeptide transporter OPT superfamily
MAEVKSEEPEKANTNVKEEEEEEEEEEEESPIEEVRLTVKNTDDPTQPPLVITQITVQVATLPLGHLMAVVLPTAMFRIPGFGTKRFSFNPGPFNMKEHVLITIFANAGSAFGSGSPYALGIVNIVKALYRRKISFISSWLLVLGYGWAGLLRKYVVEPAHMWWPSTLVQ

SEQ ID NO: 172564 - protein, 87 aa, Glycine max
  Coding DNA Sequence Number=SeqID_55786
MRGWWEGGVVKGGRGVVTVGVPSREMLSRVERREKRGVRARGFTSPFKYPSLPFNSFRCSSAAGCTSANNGSSFEIHDGALGLLILT

SEQ ID NO: 172565 - protein, 259 aa, Glycine max
  Coding DNA Sequence Number=SeqID_55787
  Gene Ontology: Mol. function=protein dimerization activity; Cellular component=nucleus; Biological process=transposition, DNA-mediated
  Homolog annotation: Hit_ID=Q1SYN6; Match level="QueryCoverage=78%, HitCoverage=30%, E-value=8e-52, Identity=48%"; Hit description=Zinc finger, BED-type predicted
MDVVDGQESLDVEVELEQESQSICNKRKKDINIRLLEIFFEDGTGNIRQWLKYLNPDVIPISRNTTKVDVLKIHMREKEKLKELMVRIPSRISLTYDLWTTCTTKGYICLTAHFIDTNWRLNSKILNFCHMPPPHIGHELSKKILDLLIDWGTKKKICSWVVQEHLKSQLVLQNNGLLCDEDFFHVNCSTHVLNLIVKERQKVCSKALEKIRDSVIYVRGSESRMKKFKECIERVGGVDTSASLCLDVPTRFELNLFDA

SEQ ID NO: 172566 - protein, 73 aa, Glycine max
  Coding DNA Sequence Number=SeqID_55788
  Gene Ontology: Mol. function=protein dimerization activity; Cellular component=nucleus; Biological process=regulation of transcription, DNA-dependent
  Homolog annotation: Hit_ID=Q0GPH7; Match level="QueryCoverage=72%, HitCoverage=35%, E-value=2e-16, Identity=77%"; Hit description=BZIP transcription factor bZIP59
MKPAPTAGRISMTIRNLPKYIEIEVANDILRAQTMELVNRLRFMNSILEITNAVGGGGESFKILQIPYPFFMP

SEQ ID NO: 172567 - protein, 879 aa, Glycine max
  Coding DNA Sequence Number=SeqID_55789
  Gene Ontology: Mol. function=GTP binding; Cellular component=exocyst; Biological process=vesicle docking during exocytosis
  Homolog annotation: Hit_ID=Q9LXX6; Match level="QueryCoverage=89%, HitCoverage=100%, E-value=0.0, Identity=66%"; Hit description =Probable exocyst complex component 6
  Pfam annotation: Domain name=Sec15; Domain location=531-876; Score =49.8; E_value=4.8e-12; Accession=PF04091.3; Description=Exocyst complex subunit Sec15-like
MGKAPLVGNAVSISVTLLTNSAFSKIKSIPNGDFDGVVGEAVSKEIEGGALVVAKGGGGEDEEESKEGDEEGEVELEGDGVVVGFGIHVIMDVKTMRRGVVENGDGGEDMVLANLIANGDDVGPLVRLAFERGRPEGLLHRLIYVVKQKESEIEEMCKTHYEEFILAVDELRGVLVDAEELKSELQSDNFKLQQVGSALLAKLEELLESYSVRKNMTEAIEMLKNCIQVLELCVKCNDHISEGQFYSALKTLDLVEESCTQNIPAKAIKMVIESRIPVIKLHVEKKVCSEVNEWMVEIRSSAKNIGQTAIGRAVTVRQRDKEMLEQQRKAEEQSISGLGDLAYTLEAEELEEDSVLQFDLTPLYRACHIHDCLGIQEKFRKYYYTNRLLQLNSDLEITSAQPFVESYQTLFAQIAGFFIVEDRVLRTTAGLLVADQVETMWETAVAKMTSLLEEQFSSMESAPHLLLVKDYVTLFGSTLRQYGHEIGTLLDILDSSCDKYHLLLLEECRQQTLDVFGNDQYDQMEIKKESDYENIILSFNLQTSDIMPAFPYTAPFSSMVPDACRIVRSFIKGSVDYLSYGIHVNFFGVVRKYLDMFLIDVLNVTLLEKINSDHVTVPQLMQIAANIAVLERACDFFLQHTAQLCGIPVRSVGRPQATLTAKVILKASREAVFIALQSLVNTKVDEFMTLTESVNWTPEETNENGNDYIHEVIIYLDSILSPVQQILPLDAVYRVGSGAFEHISNSIVTAFSSDSVKRFNANAVINIDYDLQFIENFAEERFYSAGLGEIDNEVSFKICMVEARQLVNLLLSSQPENFLNPDIWEKNYYALEIKKVAAILDKFKDSPDGIFGSLANKNAKQSARKKSMDVLKKRLKDFS

SEQ ID NO: 172568 - protein, 81 aa, Glycine max
  Coding DNA Sequence Number=SeqID_55790
MESKRLVFYKSAFENGERATIGQLLRVTDVDLAGVNLKPNVVNNEFVTRVRQATSPLPKLFHQQTEVFCDCATTLGSSDFQ

SEQ ID NO: 172569 - protein, 136 aa, Glycine max
  Coding DNA Sequence Number=SeqID_55791
  Homolog annotation: Hit_ID=Q9FGF0; Match level="QueryCoverage=95%, HitCoverage=69%, E-value=4e-41, Identity=51%"; Hit description =Putative ZW10 protein
MAFDLTLQTAVGVFGGEGYTDKTDVLPLMVANAGNSYRAAISSLNSPPVVAVELCREHLLDSDEDTWWKANIRETKEELAARGLKFLNCFANCELRSMVIVDRSMIGSELSTTNYPGKIPSGLDLPSDVADEKSEK

SEQ ID NO: 172570 - protein, 285 aa, Glycine max
  Coding DNA Sequence Number=SeqID_55792
  Gene Ontology: Mol. function=carboxypeptidase activity
  Homolog annotation: Hit_ID=Q6ZGL3; Match level="QueryCoverage=88%, HitCoverage=57%, E-value=8e-94, Identity=62%"; Hit description=Leaf senescence related protein-like
  Pfam annotation: Domain name=DUF231; Domain location=104-285; Score =73.2; E_value=8.1e-19; Accession=PF03005.6; Description=Arabidopsis proteins of unknown function
MGPTELPLAPDRPGSVSGVADKGAKKWKKKGAWRGAYFPKFNVTVAYHRAVLLSRYQWQPKQSEAGVKDGSEGFYRVDVDVPADDWAKIAGFYDVLVFNTGHWWNRDKFPKEKPLVFYKAGQPIVPPLGMLDGLKVVLTNMVAYIQKEFPGNTLKFWRLQSPRHFYGGDWNQNGSCLFNKPLEEDECFMPHVLLSIGLRNDILIPGQLDLWFEPRNNGVNKEARVLNFVIEEALQAANIQLLDLTHLSELRADAHPAIWLGRKDAVAIWGQDCMHWCLPGVPDTW

SEQ ID NO: 172571 - protein, 127 aa, Glycine max
  Coding DNA Sequence Number=SeqID_55793
  Homolog annotation: Hit_ID=Q1T3G5; Match level="QueryCoverage=64%, HitCoverage=41%, E-value=9e-39, Identity=87%"; Hit description =Putative ZW10 protein-related
  Pfam annotation: Domain name=PGAM; Domain location=17-124; Score= -14.5; E_value=0.06; Accession=PF00300.12; Description=Phosphoglycerat e mutase family
MDCVAGSSLFPLHRCKTIHLVRHAQGIHNVEGDKNYNAYINPDYFDAHLTPLGWQQVDNLRKHVRDSGLINTIDLVIASPMMRWMFGFQFKMQCTNSEVNLMVHKLSFARKALDAFANFILLQTSVC

SEQ ID NO: 172572 - protein, 235 aa, Glycine max
  Coding DNA Sequence Number=SeqID_55794
  Gene Ontology: Mol. function=nucleic acid binding; Biological process= DNA integration
  Homolog annotation: Hit_ID=Q1SH19; Match level="QueryCoverage=47%, HitCoverage=6%, E-value=3e-15, Identity=37%"; Hit description =Integrase, catalytic region; Zinc finger, CCHC-type
MRDAPRINYESSEDVKLRKVATLTKHYENFTMKEGKIIDEMFGRFQTFLNGLQGLGHEFTKAQNNMKILENFHKKWEPKTTTIQEAQNIATLMLDEMLGALRVHNVMKWALCISRRSSSDEEQVNICLMVDTNDKAEVYFLSHKHESFKVFENIKEVHKAPKALHSIFSKPLQALPSVEAKLSKFILMMPKTQVKNQSQANIKNQRVIQSKQVSRIKESFNQESRFKQRIKRRLN

SEQ ID NO: 172573 - protein, 158 aa, Glycine max
  Coding DNA Sequence Number=SeqID_55795
GTLVDDCKHLYSNHDARKMVYTENAYMASKEDLIGPFKPVIKLIGLILSVDEPFVKVKHSFAIRATVVASFAYQKDMDGQWVQKQDLPPTVPDERTPSPPPQRDSLSSLLHDGLTKLWDLRAFVVIILMLWIHGKESLGGSEVVKEFYKDSVNLKWVA

SEQ ID NO: 172574 - protein, 434 aa, Glycine max
  Coding DNA Sequence Number=SeqID_55796
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LEC9; Match level="QueryCoverage=92%, HitCoverage=43%, E-value=0.0, Identity=77%"; Hit description=Alpha -glucosidase
  Pfam annotation: Domain name=Glyco_hydro_31; Domain location=279-434; Score=-98.6; E_value=3.4e-08; Accession=PF01055.16; Description =Glycosyl hydrolases family 31
  Subcellular localization annotation: CTP_CleavageSite=21; ConfidenceScore=5.12e-01
MVSSNRFAALPLCSLLLALLLCAVGASSSSSSSTNATKIGQGYRLVSIEETPDGGLIGILQVKQKTKTYGPDIPLLRFYVKHETDNRLRVHITDAQKQRWEVPYNLLPREQPPPLSQSIGKSRKNPITVSQYSGSEFLFSYTSDPFSFAVKRKSNGETLFDSSSGDSDPFSSLVFKDQYLEISTKLPKDASLYGLGENTQPHGIKLYPSDPYTLYTTDISAINLNADLYGSHPVYMDLRNAGGKASAHAVLLLNSNGMDVFYTGTSLTYKIIGGVFDFYFFSGPSPLNVVDQYTTLIGRPAPMPYWAFGFHQCRWGYHNLSVVEDVVENYKKAQIPLDVIWNDDDHMDGKKDFTLNPVNYPRPKLLNFLDKIHNIGMKYIVIIDPGIAVNTSYGVYQRGVANDVFIKYDGEPFLAQVWPGAVNFPDFLNPKTVS

SEQ ID NO: 172575 - protein, 93 aa, Glycine max
  Coding DNA Sequence Number=SeqID_55797
FVNGGMRNEGLTVGGGSFEQLERGGFGSDDVLGKGIVVIGEEGTRGVDGKARAWEEELRRRWAEGVAESGGGEEGGGGGGGGGGSTDGRHGSW

SEQ ID NO: 172576 - protein, 333 aa, Glycine max
  Coding DNA Sequence Number=SeqID_55798
TGIRVDSVGGDLESQEGSPVQDICGIALVDKDRRHHEVCNDDGDNHGVILVDGDNMQMMFSGLARLPSIGKAACDGVDYTSDVLDKFLFFWRLSLTSLLLLSLSASYLVASDPNLGGFVWGSRMGTSRLKASSKIVVQLVVRIDFGASFALFAFMSALEHGMQCYLGIKILDLDGCAPKYVHEFSKGLVVCLSQTCQGGQGHAVRPAGGILRTKLFDEGVEAVYEPGWESTVKKASRCSFGFVVPLYRSRLTGFHLKGMSASIVRLAKGCRRKVHPAGWCMWERLKSFAVLPMCWGCDSPWREPLAAHGQPLALSTPPHGVTPSSRCGFGVVV

SEQ ID NO: 172577 - protein, 112 aa, Glycine max
  Coding DNA Sequence Number=SeqID_55799
MAKIHHLAWPTKTYHPMKHTPPHLFQKTIPKLQNSLRVGKGNIGSKGLSKELIQGRLIWLEAYKNKMPKSSPNMHVKQEVSTRVKPRLLCKQSMGQNTPNKIDDDGSNSHQG

SEQ ID NO: 172578 - protein, 62 aa, Glycine max
  Coding DNA Sequence Number=SeqID_55800
MLVSRVPKGANKIAMRGLAAAPELNVWQIFVWSQLEHGCKSGKRISHLVFLSGNLVEGDIIE

SEQ ID NO: 172579 - protein, 64 aa, Glycine max
  Coding DNA Sequence Number=SeqID_55801
MDKSLKVGEDEWREKERRSTKFYASNELVSSARLSARLALSPNPLTRAKHEGGAKRNVTISEPI

SEQ ID NO: 172580 - protein, 109 aa, Glycine max
  Coding DNA Sequence Number=SeqID_55802
MPPSKIKNPDKVPNEVMYQMKDMQAHMDQQYALVSTKLPLFLSNFSLPPCNPRPINLGWVQTAKVLLQPFNGTNPDVAPRGACRPWILFINGVFCFMKINGSGMEKEER

SEQ ID NO: 172581 - protein, 333 aa, Glycine max
  Coding DNA Sequence Number=SeqID_55803
  Gene Ontology: Mol. function=transporter activity; Cellular component= integral to membrane; Biological process=transport
  Homolog annotation: Hit_ID=Q1SYG1; Match level="QueryCoverage=91%, HitCoverage=49%, E-value=2e-94, Identity=61%"; Hit description=Major facilitator superfamily MFS_1
  Pfam annotation: Domain name=MFS_1; Domain location=41-299; Score= -22.5; E_value=0.0034; Accession=PF07690.6; Description=Major Facilitator Superfamily
MAQQQEHEGKPESSLEPDMGTNSTMIPSTSWFTPKRLLAIFCVINLLNYLDRGAIASNGVNGSQRTCEGGTCKSGTGIQGDFNLNNFEDGVLSSAFMVGLLVASPIFASLAKRCTISHLDATRCKRREWGHKEINLQQLVYSSPPVWHDVCEGPLALCVNPFRLIGVGLSVWTLATLCCGFSFNFWSIAVCRMLVGVGEASFISLAAPFIDDNAPVSQKTAWLAIFYMCIPAGYAIGYIYGGLVGNHFGWRYGFWVEAILMSPFAILGFVMKPLQLKGFAPTDSEKALTLGTVASEVSDVGASNGKDEALSLKAEFRDKSSHEPSRQEQYPYS

SEQ ID NO: 172582 - protein, 152 aa, Glycine max
  Coding DNA Sequence Number=SeqID_55804
  Gene Ontology: Mol. function=zinc ion binding; Cellular component =integral to membrane
  Homolog annotation: Hit_ID=Q1T3F6; Match level="QueryCoverage=73%, HitCoverage=21%, E-value=2e-45, Identity=79%"; Hit description=Zinc finger, DHHC-type
  Pfam annotation: Domain name=Ank; Domain location=56-88; Score=41.5; E_value=2.9e-09; Accession=PF00023.20; Description=Ankyrin repeat
  Pfam annotation: Domain name=Ank; Domain location=89-121; Score=27.2; E_value=5.6e-05; Accession=PF00023.20; Description=Ankyrin repeat
  Pfam module annotation: Pfam domain module=Ank::Ank; Domain location =56-88::89-121
MASSEIEVVSSSSVSKPNNDQPPILDIFTASAHGDFNKLRTFVEQDGASVSLPDSNGYYALQWASLNNFHDIAHYLIQHGADVNAKDNMQQTALHWAAVRGSTLAADVLVENGARVEAADVNGYRVVHSTHVSQQLCKWISCIISGGFAYFL

SEQ ID NO: 172583 - protein, 241 aa, Glycine max
  Coding DNA Sequence Number=SeqID_55805
  Homolog annotation: Hit_ID=Q1SPQ2; Match level="QueryCoverage=25%, HitCoverage=8%, E-value=2e-15, Identity=73%"; Hit description=IMP dehydrogenase/GMP reductase
MTSSVMINTQTVNFIISWYMIQKQQNTQAIRKKKYEVCILVLGAPREDRSAIVKDGLEGDFRVFICKKGRVTSLLHAHGSSSLSSHLGANRRPPHGLGGGPVRRGRAAGLPRQQQRPLREADNRRRQGGPTSEASERRESRRRAGTRSTCHRGSRAWPQITVTFVNGVEEVFDATATAAQSIRNLILENSRRLRALTNGTPYQMKTENGDENVFGWISENIFSENENGEQPENENNKFSSS

SEQ ID NO: 172584 - protein, 107 aa, Glycine max
  Coding DNA Sequence Number=SeqID_55806
GGSVSNSMPPDALASPGMPPVGEAIPQSRQEQERDAPRSSSPARSRSEMLHGSEAHALGDYMFTYSLMFNGVCNDTQRRKLCMLSLFMMRLNIRSEIRFKASCRCSQ

SEQ ID NO: 172585 - protein, 49 aa, Glycine max
  Coding DNA Sequence Number=SeqID_55807
MGWRSLTRTLSLRILGFLPAALPAFPELGMGRRSIDHRPSLYSRSSLST

SEQ ID NO: 172586 - protein, 99 aa, Glycine max
  Coding DNA Sequence Number=SeqID_55808
MDHVAAIFFTSINPIQLTELIGSLKEKWKREAIEENKHREERLLENMVCSFKVGLEEVQDANADILLPTSKVQLVRQVVGFFIARLRHLMNPVLHEVFT

SEQ ID NO: 172587 - protein, 57 aa, Glycine max
  Coding DNA Sequence Number=SeqID_55809
MVEPIHRSNPIDDLLVDLVKVLYDLYLKPVQVEWYGIAFGVHNDDFLFFIEFNDVYE

SEQ ID NO: 172588 - protein, 482 aa, Glycine max
  Coding DNA Sequence Number=SeqID_55810
  Gene Ontology: Mol. function=transferase activity, transferring glycosyl groups; Cellular component=cytoplasm; Biological process =metabolic process
  Homolog annotation: Hit_ID=Q8S999; Match level="QueryCoverage=99%, HitCoverage=98%, E-value=0.0, Identity=69%"; Hit description =Glucosyltransferase-10
  Pfam annotation: Domain name=UDPGT; Domain location=12-478; Score= -28.7; E_value=3.5e-09; Accession=PF00201.9; Description=UDP -glucoronosyl and UDP-glucosyl transferase
MGSLGTINKPHAVCIPYPAQGHINPMLKLAKLLHFKGFHITFVNTEYNHKRLLKARGPDSLNGLSSFRFETIPDGLPETDLDATQDIPSLCEATRRTCSPHFKNLLAKINDSDAPPVSCIVSDGVMTFTLDAAEELGVPEVLFWTTSACGFMCYVQYQQLIEKDLTPLKDSSYITNGYLETTIDWIPGIKEIRLKDIPSFVRTTNPDEFMLDFIQWECGRARRASAIILNTFDALEHDVLEAFSSILPPVYSIGPLNLHVKHVDDKELNAIGSNLWKEESKCVEWLDTKQPSSVVYVNFGSIAVMTSEQLIEFAWGLANSNKNFLWVIRADLVAGENAVLPPEFVKQTENRGLLSSWCSQEQVLAHPSVGGFLTHSGWNSTLESMCGGVPMICWPFFAEQQTNCRFCCKDWGIGLEIEDVEREKIESLVRELMDGEKGKEMKKKALQWKELAESAAFRSVGSSFANLDNMVRDVLLGKSLKY

SEQ ID NO: 172589 - protein, 78 aa, Glycine max
  Coding DNA Sequence Number=SeqID_55811
MNKLKTSSFGDTKPVTPKWIEVKSHVQTECYECGYYVMHWMWNIISGEMKSDWSQWFGDDTPLGIDTITTIQKKWTSF

SEQ ID NO: 172590 - protein, 144 aa, Glycine max
  Coding DNA Sequence Number=SeqID_55812
MGLENSGPVTKGEKLNSVFKVYVRRMVQLNLGPNLRENRAEVEPRKLDFKDNYIDHMPGGDLHGSATGTLTLKQDWPPYTPILPSSFNKEYIGDEDDVHRELARDLGVSFAENNISMVNMMNEVDNRNIIFAPAAVMGMDQNDS

SEQ ID NO: 172591 - protein, 341 aa, Glycine max
  Coding DNA Sequence Number=SeqID_55813
  Homolog annotation: Hit_ID=Q1RVN3; Match level="QueryCoverage=37%, HitCoverage=18%, E-value=3e-07, Identity=28%"; Hit description =Nucleotide-binding, alpha-beta plait
  Pfam annotation: Domain name=RRM_1; Domain location=46-116; Score =34.6; E_value=3.3e-07; Accession=PF00076.12; Description=RNA recognition motif. (a.k.a. RRM, R
TRGRGRHREEVRKRVDPRQSYVKTRLGQHHGYDHANWRERDDITTFYFTRFPEDTTEKDLWAQFKKWGDVREIFISKHRNKGGRRYGFVRFKGVSDKRRLERQLDNIIVGGLKLYVNVPKYGRGKERYEESRVKPRTQLEIPAGEKKWYTNVWVGCVKKSGISERVEDEPPWEVGTNVVPKYLGDDMILLLGLSDTKAEKLIIEETRHGSSPFHSLEKWNPTMRSGHRLLWAQCWGIPSEAWDIGQIHKIVAAIGDLVEVDDNVEELRMLDRARVLIRIPWRPIFQHMVEVHISGEVHKVHIIEENWSEAGRKRIYHCRSAIGRRKRSILTTTITAPRSRR

SEQ ID NO: 172592 - protein, 173 aa, Glycine max
  Coding DNA Sequence Number=SeqID_55814
  Gene Ontology: Mol. function=aminoacyl-tRNA ligase activity; Cellular component=mitochondrion; Biological process=glycyl-tRNA aminoacylation
  Homolog annotation: Hit_ID=Q8L785; Match level="QueryCoverage=81%, HitCoverage=13%, E-value=2e-49, Identity=64%"; Hit description =Glycyl-tRNA synthetase 2, chloroplast/mitochondrial precursor
  Pfam annotation: Domain name=tRNA_synt_2f; Domain location=1-173; Score=-340.7; E_value=0.0015; Accession=PF02092.7; Description =Glycyl-tRNA synthetase beta subunit
MVENNNYHVCILCSGNLSFGLRNTSSAVIQVESAESYSVSIKNVGINVSVEDRKKIIFEQSNALAESVNGQILIPKGLLDEVVNLVEAPFPVLGKFKETFLDLPKDLLTMVMQKHQKYFAVCDANGQLLPYFVAVANGAIDETTVRKGNEAVLSCWLYLMASGKDKLSLMFKL

SEQ ID NO: 172593 - protein, 214 aa, Glycine max
  Coding DNA Sequence Number=SeqID_55815
  Homolog annotation: Hit_ID=Q1S4Z4; Match level="QueryCoverage=64%, HitCoverage=17%, E-value=8e-07, Identity=28%"; Hit description=RNA -directed DNA polymerase
MSQLPWEGVCATRCDSHCDKLREGKEQKTGGMHQTSSRISQHHYLIQQLGVASVGIWEWQLEWKRLFREAEIDIVAKFMEDIEGMIVQPNQHDRWGWRVDPSGVYIMGTAYKVLTRQLLGENNDEVLKELWKLKIPSVTFCLETDSGEATNKGFNGQKMMDDAIFFCWIWLKNMEKGFDIPFHSWSSNIKVTFCVGMFTLIQTDGGLILAISLY

SEQ ID NO: 172594 - protein, 79 aa, Glycine max
  Coding DNA Sequence Number=SeqID_55816
  Gene Ontology: Mol. function=aminoacyl-tRNA ligase activity; Biological process=glycyl-tRNA aminoacylation
  Homolog annotation: Hit_ID=Q8L785; Match level="QueryCoverage=75%, HitCoverage=5%, E-value=6e-24, Identity=91%"; Hit description=Glycyl- tRNA synthetase 2, chloroplast/mitochondrial precursor
  Pfam annotation: Domain name=tRNA-synt_2e; Domain location=1-75; Score=-155.3; E_value=0.00038; Accession=PF02091.6; Description =Glycyl-tRNA synthetase alpha subunit
MEITQFTYFQQAGSLQLSPVSVEITYGLERILMLLQGVDHFKKIKYSDGITYGELFLENEYLITLTTGFELHFILFFWL

SEQ ID NO: 172595 - protein, 179 aa, Glycine max
  Coding DNA Sequence Number=SeqID_55817
  Gene Ontology: Mol. function=aminoacyl-tRNA ligase activity; Biological process=glycyl-tRNA aminoacylation
  Homolog annotation: Hit_ID=Q5VRH2; Match level="QueryCoverage=56%, HitCoverage=9%, E-value=2e-51, Identity=92%"; Hit description =Putative aminoacyl-t-RNA synthetase
  Pfam annotation: Domain name=tRNA-synt_2e; Domain location=80-179; Score=-4.3; E_value=5.2e-13; Accession=PF02091.6; Description=Glycyl- tRNA synthetase alpha subunit
  Subcellular localization annotation: CTP_CleavageSite=39; ConfidenceScore=5.49e-01
MGILALPLVISVLKPHTATRLLPSHSLLHRHRHFATTLSAATTPSSPHSPSPSLSRHSSSYSSSSSHSNTRSINSSTLTFQQAIQRLQEYWASVGCSIMQCSNTEVGAGTMNPLTYLRVLGPEPWNVAYVEPSIRPDDSRYGENPNRLQRHTQFQVILKPDPGNSQDLFIRSLSALGTN

SEQ ID NO: 172596 - protein, 103 aa, Glycine max
  Coding DNA Sequence Number=SeqID_55818
  Subcellular localization annotation: CTP_CleavageSite=30; ConfidenceScore=5.09e-01
MSPNNFTGHIPTTFFGPSDKGPLSSYLQLVATTLVGHEKGSIRPNKEGGLVLPLSLDPIAMINMKGMDNQSIEGIGFMELTKISLMGEEIDSTKEGSIGVLRR

SEQ ID NO: 172597 - protein, 84 aa, Glycine max
  Coding DNA Sequence Number=SeqID_55819
MKERGDNYKIWKERVILRLDWMNINNVIKKEESQLTETRGVCDHIMRIKDIVAQLKGLKGMKNLRRPVGSEQCIYSGSMMSSHV

SEQ ID NO: 172598 - protein, 126 aa, Glycine max
  Coding DNA Sequence Number=SeqID_55820
  Gene Ontology: Mol. function=transcription regulator activity; Cellular component=nucleus; Biological process=regulation of transcription
  Homolog annotation: Hit_ID=Q8S3F4; Match level="QueryCoverage=75%, HitCoverage=24%, E-value=1e-29, Identity=67%"; Hit description =Putative bHLH transcription factor
  Pfam annotation: Domain name=HLH; Domain location=26-75; Score=50.7; E_value=5e-12; Accession=PF00010.16; Description=Helix-loop-helix DNA-binding domain
EIRDNQDDRDSKAEVGQSNSKRRSRTAAIHNQSERKRRDMINQKMKALQGLVPNANKTDKASMLDEVINYLKQLQAQIQMMNRTSLPQMMVPLAMQQQFQMSMLARMGAAGLGMGMGMVNMNMGRC

SEQ ID NO: 172599 - protein, 809 aa, Glycine max
  Coding DNA Sequence Number=SeqID_55821
  Gene Ontology: Mol. function=nucleotide binding; Cellular component =membrane; Biological process=defense response
  Homolog annotation: Hit_ID=Q1SJ16; Match level="QueryCoverage=42%, HitCoverage=69%, E-value=1e-126, Identity=65%"; Hit description=3-5 exonuclease
  Pfam annotation: Domain name=DUF82; Domain location=644-806; Score =36.2; E_value=4.8e-10; Accession=PF01927.7; Description=Protein of unknown function DUF82
  Pfam annotation: Domain name=NACHT; Domain location=45-194; Score= -22.5; E_value=0.0033; Accession=PF05729.3; Description=NACHT domain
  Pfam annotation: Domain name=NB-ARC; Domain location=1-306; Score =96.9; E_value=6.2e-26; Accession=PF00931.13; Description=NB-ARC domain
  Pfam module annotation: Pfam domain module=DUF82::NACHT::NB-ARC; Domain location=644-806::45-194::1-306
MAVPKLPAYNLELTDRVLGRQKEKDQVVKFLLDLSDNTNTNGNMSILGIVGPGGIGKTTLAHVVYEDHKVRTSFQLRIWITFPSYQLEARTLAKIMLRILQVSSGQDDELLDPMPHLQESLNGKNLLLVLDGCWSIHEWEKLQTCFESAARGSAIILTTRTTKTALQMLADLHLSFLSMEYCWSLFSNHCFGNQRHSCSPELEVMGKRILRKSGGMPLAVKMLGGLLYEKDYEVFEKMHNLPCYMDGQRSNSAGNMDFTREKLGSEYFDFLVARSFLIRSNSGGNMDFTMHDMVRDLALFVSAKSHPIFDRNDESIDTSFLISNLQNVEESSSELYGPQMEEYIPLKDKIDIANITHGLDQESPEIEVNYLSSTANDAVQTTFEYWTHFDTLRILDASQLVELPSELYSLRIEGCHSFKSLQDVLIDRSTNLFELFIIDCSFLEYLTDASCPTSSKCPELDSLQGLPSCLKLLSIAFGGKLIPKKDWNLQALHCLLHFVEIERDLILETTVLSNPDASLGLKELFQNHDMSDKVLRAHFSEALAIVQATTCSDTAQMIPLAGGMIQKSSCWVTVPMDEVLLKVVKKYSDKILLKESDRKPKSSKKKGKKHSLFNGISLEKHFEKSDEWRGTPPWDPLVGGNAYPKFLCDVMVEGLAKHLRCVGIDAAIPYSKKPEPRMLIEQAQKEKRVILTRDAKLLRHDYLTKNQIYRVKTLLKNEQLLEVIEAFQIKINEDQLMSRCTKCNGTFIQKPLTTEEAIEAAKGFQRIPNCLFNKNLEFWQCMDCHQLYWEGTQYHNAVQKFVDICKLSD

SEQ ID NO: 172600 - protein, 216 aa, Glycine max
  Coding DNA Sequence Number=SeqID_55822
  Gene Ontology: Mol. function=3'-5' exonuclease activity; Cellular component=intracellular; Biological process=tRNA processing
  Homolog annotation: Hit_ID=Q1SJ16; Match level="QueryCoverage=88%, HitCoverage=39%, E-value=7e-64, Identity=65%"; Hit description=3-5 exonuclease
  Pfam annotation: Domain name=3_5_exonuc; Domain location=14-197; Score=90.3; E_value=5.8e-24; Accession=PF01612.11; Description=3'-5' exonuclease
MDGGDPTKLLKVHLVTCTDSAEFALLSSALTRTSVVGLDAEWKPVRRLFPRVAVLQIACGDSAVFLLDLLSLPLSSLWAPLRELLLSPDILKLGFGFKQDLVYLSSTFASHGGFDKVEPYLDIKSVYNHLQHNKKHVPKQSKSLSTICAEVLGFSLSKELQCSDWSHRPLTEEQITYAAMDAHCLLDIFEVFQAKVVKEAIQTVFQTCSKWFKFEK

SEQ ID NO: 172601 - protein, 71 aa, Glycine max
  Coding DNA Sequence Number=SeqID_55823
MEFHWSLSRVNNDRPKILEPLAVVQYVHSSHGKGPRGTQVMEIFRRDVWNVCEFLASSALLGEVEGIDPEP

SEQ ID NO: 172602 - protein, 134 aa, Glycine max
  Coding DNA Sequence Number=SeqID_55824
  Gene Ontology: Mol. function=nucleic acid binding
MELENQEIRDDGGGRRRRRRDNDGGDAREEKIEGVKLNVPPFQGKKTFTTSFKVSKGNRSVDECYKDMEVPLIRSSLNEHREAIMARFLHGLNSDIRDVVELHNYKELEDLMHHVVKLEQQLKRKSVMRRQGHK

SEQ ID NO: 172603 - protein, 136 aa, Glycine max
  Coding DNA Sequence Number=SeqID_55825
MHGLAGLQPTNPTQEKPILNSAHDTLESIVQHATCPRYQPSKFTREKGHAPTSNRKNNSIGAPDGGEVQGVPSSARKRTWSNANNMLEECDILSGCASAGATFCRDNDTAMITWASLESGRNLKTIEEDSACHCGS

SEQ ID NO: 172604 - protein, 147 aa, Glycine max
  Coding DNA Sequence Number=SeqID_55826
  Gene Ontology: Mol. function=RNA-directed DNA polymerase activity; Biological process=RNA-dependent DNA replication
MNRRLASLSRFLPKLTKKAKPFYKLLKKIESFLLNKGREKAFLAFKKTIATPPVLSRPREGGASTHYSGLTSQAVLSESPTSCQNEQPHQIGKQGNILEGPDNVILKQALKLNFKPLNNQAEYEALIVGLKLAREVGAKKLRCYTYS

SEQ ID NO: 172605 - protein, 616 aa, Glycine max
  Coding DNA Sequence Number=SeqID_55827
MGYLRTGRKHGKWPNQYKSSHLSNKSLTAKGITFVLLCQGRHGELTYVMECHGEEFVEPPSMNECYPVSRGVTSTSVVRAASAKLARVDMLLVLQVRRVKHRCSTLAYVSLMEWTRTGDADRGYPLLIMSFFLFESTIGMDGIDSGGSIQQPLVDLEERLRVLRRAGGGSSRLHGRQGRVVVETLGYPLVCSIAIVMGRHRPPAVAGYEWMMLTSKINWVSLNNVSKKLFNFDSNVFRRSKDHFFKVLAIDIVSDPTKFKSFNVDLLTLVERVEKAILEQLPVLLDAWAILSLPLTDDPFPTLDDKTRSAGGTVPLSTIIPLTRERGQLVVEVGPTTGVAQVSLGVPSSILAKRKQDDNTWGPPLAPSAIQASVVVLAPPLPLAAPIQEFTPTASTSPIVAPSSIIIAPYRVPHHLPPYFTPAFLWITSTLPMMLIRCGALSKVASLEDEVAKWRANACIAWRMECPKVVNATIAFAEAIKSNHQLSSKVGSVLAKLCTRNELIENVESIMTEKDELAKLVANLEVQLKESKSRLEEFELHVSKEKEASKKLEKELLMYKREVVEQHEKGFHNTIRQVGFIAKDRDLSHFYLFKDVKDSVMLDEEDIVVEGEVGEE

SEQ ID NO: 172606 - protein, 65 aa, Glycine max
  Coding DNA Sequence Number=SeqID_55828
MATSDHHKPSLLAAGPPHIEECFNWRRIFIIHLKDFVENEAPNRLCPGFFEDTMTKLDVPGGEIE

SEQ ID NO: 172607 - protein, 50 aa, Glycine max
  Coding DNA Sequence Number=SeqID_55829
MDVKNAFLNGDLSEEVYMVPPLGVSHNLDKGPEMEEVSWKQVWSTKALKG

SEQ ID NO: 172608 - protein, 230 aa, Glycine max
  Coding DNA Sequence Number=SeqID_55830
  Gene Ontology: Mol. function=transition metal ion binding; Cellular component=nucleus; Biological process=cytoskeleton organization and biogenesis
MSTKEKISFCQGLWSLKVPQGYSSNIKSLVSVNDLKLVGLKSHDCHVLMQQLLPIAIHGILPDKVRVAKSLTLDNWMIWSMRLPLSFVNWRFERYLKVLKGYSKDQYQLEASIVEKYVVEESIQFCSQYIDTVKFVWIPETRYDWTWGAIGPNLNVSTWRGCDINNYSFYTKSQDDKSSVQNSGMSVDADSNHFSSVSENNLIRASMPYFGVIEEIWELDYSEFRVSVFK

SEQ ID NO: 172609 - protein, 172 aa, Glycine max
  Coding DNA Sequence Number=SeqID_55831
  Gene Ontology: Mol. function=nucleic acid binding; Biological process= DNA integration
MQIQVNMHKSAKGEERESAKRDEEVQLYSMNIIETLPIKKRKHSAECDFVNKLGICVGEKTKGVGAKRETPIESSNHLNQTISIIVGDMALYSTLVEDLDITVCFFLFQEIRDSPKKMQNLVGGLLGLSVRKMSLIKDVGNVFGLIEKIASKRICNFNAQKVQRVPKSLISN

SEQ ID NO: 172610 - protein, 185 aa, Glycine max
  Coding DNA Sequence Number=SeqID_55832
  Gene Ontology: Mol. function=protein kinase activity; Cellular component=cell surface; Biological process=protein amino acid phosphorylation
  Homolog annotation: Hit_ID=Q1S8T9; Match level="QueryCoverage=97%, HitCoverage=27%, E-value=3e-67, Identity=66%"; Hit description =Protein kinase
  Pfam annotation: Domain name=Pkinase; Domain location=2-153; Score= -69.7; E_value=0.00021; Accession=PF00069.15; Description=Protein kinase domain
  Pfam annotation: Domain name=Pkinase_Tyr; Domain location=1-153; Score=-138.9; E_value=0.0006; Accession=PF07714.7; Description =Protein tyrosine kinase
  Pfam module annotation: Pfam domain module=Pkinase::Pkinase_Tyr; Domain location=2-153::1-153
MEILHFDIKPHNILLDENFIPKISDFGLAKLYPIDNSIVTMTGVRGTIGYMAPELFYKNIGGISYKADVYSFGMLLMEMASKRKNLNPYAERSSQLYYPFWIYNHLVEEKDIETKDVTEEENKIAKKMIIVALWCIQLKPNDRPSMNKVVEMLEGDIENLEIPPKPTLYPHETTIRDQRTPNNIE

SEQ ID NO: 172611 - protein, 135 aa, Glycine max
  Coding DNA Sequence Number=SeqID_55833
MNEISGVLIQGESVEASFMMMNQIQRTNRLRILCLNTLEGTSFVVQVEGTSTWVVEIENKRGYISCGSVQVEGTSTWLFKENKGGYIPCGSLLVKVFTRLKEISRTGGCLGTGCRHGKKLIESSNIKKDKFYLVK

SEQ ID NO: 172612 - protein, 222 aa, Glycine max
  Coding DNA Sequence Number=SeqID_55834
  Homolog annotation: Hit_ID=Q1SHY8; Match level="QueryCoverage=21%, HitCoverage=7%, E-value=2e-09, Identity=62%"; Hit description=WD40 -like
  Pfam annotation: Domain name=WD40; Domain location=112-150; Score =35.5; E_value=1.8e-07; Accession=PF00400.22; Description=WD domain, G-beta repeat
MNAQQRESRTRTNLGEVEEVDECYLRCEGVFSLKEAPSSEVIAAGGREGCEKEKEEKKGKRKKEANTCLAFSAQTYASEEHRPREAAVSQEKFQDYDMSKRKRKYWWKRYVNIRKTEVRAHKGLVWTMKFSPCGQYLASGGEDGVVRICDFHDQDRSKVTYLHESFGERAKANLQLQLQKTQNSNSELLLATLKPLPQNLTLPGYNTISHGTLFGFSKLAGI

SEQ ID NO: 172613 - protein, 100 aa, Glycine max
  Coding DNA Sequence Number=SeqID_55835
  Homolog annotation: Hit_ID=Q96329; Match level="QueryCoverage=31%, HitCoverage=7%, E-value=8e-10, Identity=87%"; Hit description=Acyl -coenzyme A oxidase 4, peroxisomal
MCRGDCRIIPLAPSTSKARTTVLPLNCVVALVGSSYHRSTSQPPPVNKAFCDIEPIYTFEGTYDINTLVTGREITGILCALSRLLKKVDCESVKMCSFMD

SEQ ID NO: 172614 - protein, 298 aa, Glycine max
  Coding DNA Sequence Number=SeqID_55836
MDRLCYSFRSKVVYDSGSSVLQNCCNSGSLVNFQALRSYARDARKGYNLFGRGRPGDEEFKKTWANEMDEDNTLWTGSEDDNDEDMGPKTDLDKEIRKARLEAKKHADLIDADDSDELRSVWSGSDEEKTLWTGDEMDSDDDIPTEAYPSESSDKYIDKLFEFDEMPKYRTISEMLKAEQEPEELTPGKQARKIAVENALKKLKKGPDGRYSNVWEVMSDLDILIGAFENVVSGPEYAELRQGGPKHLNIQFFKDIQARMRDPNYKFSPELKLKPKSKLVSRKKWQKAESRRRKARKR

SEQ ID NO: 172615 - protein, 253 aa, Glycine max
  Coding DNA Sequence Number=SeqID_55837
MADDELSSKCLDHLEAAISILAITQASMAAKLDLLHLKMDTLLTNHHFSSSSSVRSPPPSPLSIPTLSSCSAPMQPSPAPLPAPLFMSHVPPCPVPMQQSPAPMPAPHLAANSKHQVPHTLFSVFNQLCHVCAVVSLDNLLSVVVHDGRATAPHDKILEHRDMALFEMGVESYGSAIVARKCQPAAFALWTAAKPREFRRDRPWDPGITFGSHGCSPNTLRTRNQALNVPLRTVTNNLNAGATHTSTWWIRAN

SEQ ID NO: 172616 - protein, 220 aa, Glycine max
  Coding DNA Sequence Number=SeqID_55838
  Gene Ontology: Mol. function=hydrolase activity, acting on ester bonds; Cellular component=cellular_component; Biological process =lipid metabolic process
  Homolog annotation: Hit_ID=Q40317; Match level="QueryCoverage=90%, HitCoverage=51%, E-value=3e-55, Identity=57%"; Hit description =Nodulin
  Pfam annotation: Domain name=Lipase_GDSL; Domain location=46-220; Score=72.4; E_value=1.4e-18; Accession=PF00657.12; Description=GDSL -like LipaseAcylhydrolase
MEFPSITKFYNIPFVSSSLVILCIATTILNNPVMAKKQYYCDFPAIFNFGASNADTGGLAASFFVAAPKSPNGETYFGRPAGRFSDGRLIIDFLAEKFGLPYLSPYLDSLGTNFSSGASFATAGSTIIPQQNLRFSPFSLGIQYSQFQRFKPTTKFIRDQGGVFAALMPKEEYFQEALYTFDIGQNDLTAGFSGNMTLLQVNASIPDIIKSFTSNIKVVA

SEQ ID NO: 172617 - protein, 390 aa, Glycine max
  Coding DNA Sequence Number=SeqID_55839
  Gene Ontology: Mol. function=hydrolase activity, acting on ester bonds; Cellular component=cellular_component; Biological process =lipid metabolic process
  Homolog annotation: Hit_ID=Q40317; Match level="QueryCoverage=96%, HitCoverage=97%, E-value=1e-137, Identity=64%"; Hit description =Nodulin
  Pfam annotation: Domain name=Lipase_GDSL; Domain location=42-369; Score=302.6; E_value=7.1e-88; Accession=PF00657.12; Description=GDSL- like LipaseAcylhydrolase
MEFPSIITLFHIKLVSSLVFLSIFTTTLNPIIAAKDCVFPAIFSLGASNADTGGMAAAAFSLPNSPNGETYFHRPSGRFSDGRIILDFIAESFGIPYLSPYLDSLGSNFSRGANFATFGSTIKPQQNIFLKNLLSPFNLGVQYTQFNGFKPKTQLIRNQGGTFASLMPKEEYFTEALYTFDIGQNDLMAGIFSKTVPLITASIPDLVMTFKLNIKNLYNLGARSFWIHNTGPIGCLPLILTNFPLAIKDASGCVKEYNEVAQDFNRHLKDALAKLREDLPLAAITYVDVYTPKYNLFSDPKKYGFELPHVTCCGYGGKYNFNDVARCGATMKVMNKDILVGSCKTPSTRVVWDGIHYTEAANKVIFDQISSGNFTDPPIPLKMACNRNLA

SEQ ID NO: 172618 - protein, 244 aa, Glycine max
  Coding DNA Sequence Number=SeqID_55840
MAISRYMLIPMKVIAPSITCWAVKAQVNKIWKTIDNVNGSAIGRHTIECVFCDEYIKVIIDLVRDDNVDAPYLAIQHSRLQVCGALTHVWAKIVGFMDNTPWWEIENGHRLVGYNYTRNYETEVSVPIQLIGKHLLFLIDRESVEGRCVGDVVNYPNKYMVHQIYHDKQVLMMFHAKEFLTMAQELGAKTVTQKSSIENAKMIIAQPVPPTMLIEWIKKQKGRLKISRFWGRQESCTSGYIKLL

SEQ ID NO: 172619 - protein, 653 aa, Glycine max
  Coding DNA Sequence Number=SeqID_55841
  Gene Ontology: Mol. function=sequence-specific DNA binding; Cellular component=nucleus; Biological process=regulation of transcription, DNA-dependent
  Homolog annotation: Hit_ID=Q8LLD8; Match level="QueryCoverage=92%, HitCoverage=98%, E-value=1e-120, Identity=43%"; Hit description=BEL1- related homeotic protein 30
  Pfam annotation: Domain name=Homeobox; Domain location=335-404; Score= -0.5; E_value=0.0056; Accession=PF00046.19; Description=Homeobox domain
  Pfam annotation: Domain name=POX; Domain location=196-343; Score =216.4; E_value=6.6e-62; Accession=PF07526.2; Description=Associated with HOX
  Pfam module annotation: Pfam domain module=Homeobox::POX; Domain location=335-404::196-343
MATYYTSSSNERNAVPMLCLREPLPNSYPETPVLPSNMTFYMNSGSYSEALSGNSQQQNNCFVIPSPSVGASHSTPEQQEIFANISGFQTGFHDFSAWREGRSEMLVRQPMDGQNLQGHGLSLSLGTHIPSGIHSSSFDSFLGTNPSISGNEAYQNDSSRDEGMRHSENLPPGLPEANQDLAKADFSFHGMSGVGKTVPSSKYLKTVQLLLDEVVDIRKAIKRPAMKSHSTHEKSKKDSKEDDEQLENDRPSANGVPNSQASTGKTSCELSHAEKQDLHHKLTKLLSMLDEVDNRYKQYYQQMQTVVSSFDVIAGCGAAKPYTALALQTISCHFRCLRDAITGQISATQKNLGEQDASGSNNGVGMARLNYPKDSDKIMLARQTGLTRSQVSNWFINARVRLWKPMIEEMYKQDNCIAGMDSNSSSENVSKVTKSYVKTSNDVGDDSQHCQSPIVADTNHSGGQAKDLRHDQALDTEMMASIGLASLINGGYGAETEHRRNLDDCGLFSNDTVVQSDGATNKRFVSVGPTCQMPESERFKSGSGVSLTLGLQHCEGGNFLPGKTHLSLVSMREDDISKATAASTVGVETTELECIGAGNQQQRKRVVSADVGTILQTVNHRRNSVVPQRMIGLTKQLYDIMKFIGKIYLMVNV

SEQ ID NO: 172620 - protein, 79 aa, Glycine max
  Coding DNA Sequence Number=SeqID_55842
MEWDVGHSMWHSVIMYRVILLSVLYTSRNGSVDRSVTHGDEKRGLRHIIVRDWSVLSYAKGKRKASFFSTYVQSVHLPL

SEQ ID NO: 172621 - protein, 61 aa, Glycine max
  Coding DNA Sequence Number=SeqID_55843
  Gene Ontology: Mol. function=zinc ion binding
  Homolog annotation: Hit_ID=Q7XI22; Match level="QueryCoverage=75%, HitCoverage=21%, E-value=6e-10, Identity=53%"; Hit description =Putative ES43 protein
MILTRVMFHPACIDMTVEEAKRLDHFFCESCSAEGQKKLQNSHSASRHSDTKNLIPFELTR

SEQ ID NO: 172622 - protein, 57 aa, Glycine max
  Coding DNA Sequence Number=SeqID_55844
  Homolog annotation: Hit_ID=UPI0000E490DB; Match level="QueryCoverage =68%, HitCoverage=7%, E-value=2e-07, Identity=65%"; Hit description =PREDICTED: similar to Psmc6 protein
GINGADLRNVFTEAGLFAIRAQRDYVIDGDFVKELIQDSEYMVFNLNARKWYGNTCP

SEQ ID NO: 172623 - protein, 435 aa, Glycine max
  Coding DNA Sequence Number=SeqID_55845
  Gene Ontology: Mol. function=zinc ion binding
  Homolog annotation: Hit_ID=Q1SKJ1; Match level="QueryCoverage=99%, HitCoverage=99%, E-value=1e-148, Identity=61%"; Hit description=Zinc finger, RING-type
  Pfam annotation: Domain name=zf-C3HC4; Domain location=270-328; Score= 7.1; E_value=0.029; Accession=PF00097.15; Description=Zinc finger, C3HC4 type (RING finger)
MGAACCVAARDKTIQSGSTSDNLHRNARCSPTWSFRWDHRGRVAGEDTSINWFSDGISRNDGSENKNESAYVSEDGSPLQNYQQKRCQKPPISEVTAAHRRNSTSDQSFSRTVSTDVNIEQVNGLAESSIVSCPSPTKPSLPSTSLSASPLSSQCHIPPSSSTPLRWPCHSPGHQLSQQAYDSRIPAVKSPSSFSLSDERPVFSSWSNEVGMHSHGGSSDGWSIPGFSELMGTPQRERWSFDSESYGFNRERLARPSSWFSASQVDLQSCGICSKLLAEKSSWSMQKIIASNDLSVVAVLVCGHVCHAECLEIMTPDINKYDPACPVCTFGEKQTIKLSEKALKAEMDLKARNNKSKNRVVDSDIDDDSVVFDHFKGRGLKGKGPRIDSSSSGRSSFGKPFLRRHFSFGSKGSRSVLDNHPTRKKGFFWAKSSKE

SEQ ID NO: 172624 - protein, 121 aa, Glycine max
  Coding DNA Sequence Number=SeqID_55846
  Gene Ontology: Mol. function=inositol or phosphatidylinositol phosphatase activity; Biological process=carbohydrate metabolic process
  Homolog annotation: Hit_ID=Q1SKI8; Match level="QueryCoverage=61%, HitCoverage=23%, E-value=3e-34, Identity=86%"; Hit description =Inositol monophosphatase; Histidinol-phosphate phosphatase, putative, inositol monophosphatase
MARAEKVRNSEKGTNGKVENSSFVFCPVTIADQSAEEAMVSIILDNFPSHAIYGEENGWRCEEKNADYVWVLDPIDGTKSFITGKPVFGTLVALLQNGTPVSMSHLLNAYMELDPVTLDFP

SEQ ID NO: 172625 - protein, 542 aa, Glycine max
  Coding DNA Sequence Number=SeqID_55847
  Gene Ontology: Mol. function=metal ion binding; Cellular component =intracellular; Biological process=protein kinase C activation
  Homolog annotation: Hit_ID=Q1SKJ6; Match level="QueryCoverage=98%, HitCoverage=100%, E-value=0.0, Identity=61%"; Hit description =Pentatricopeptide repeat
  Pfam annotation: Domain name=PPR; Domain location=134-168; Score =44.2; E_value=4.5e-10; Accession=PF01535.11; Description=PPR repeat
  Pfam annotation: Domain name=PPR; Domain location=235-269; Score =46.6; E_value=8.1e-11; Accession=PF01535.11; Description=PPR repeat
  Pfam annotation: Domain name=PPR; Domain location=270-304; Score=6.5; E_value=1.3; Accession=PF01535.11; Description=PPR repeat
  Pfam annotation: Domain name=PPR; Domain location=338-372; Score =12.4; E_value=0.25; Accession=PF01535.11; Description=PPR repeat
  Pfam module annotation: Pfam domain module=PPR::PPR::PPR::PPR; Domain location=134-168::235-269::270-304::338-372
  Subcellular localization annotation: CTP_CleavageSite=75; ConfidenceScore=5.13e-01
MEVRSMWEALQLHGQKDASRNLSKVFSFAALSPFGDLNYARLLLSTNPSTTTLSFAPSPKPPTPPYNFTFPFLLKCCAPSKLPPLGKQLHALLTKLGFAPDLYIQNVLVHMYSEFGDLVLARSLFDRMPHRDVVSWTSMISGLVNHDLPVEAISLFERMLQCGVEVNEATVISVLRARADSGALSMGRKVHANLEEWGIEIHSKSNVSTALVDMYAKSGCIVRKVFDDVVDRDVFVWTAMISGLASHGLCKDAIDMFVDMESSGVKPDERTVTTVLTACRNAGLIREGFMLFSDVQRRYGMKPSIQHFGCLVDLLARAGRLKEAEDFVNAMPIEPDAVLWRTLIWACKVHGDDDRAERLMKHLEIQDMRADDSGSYILTSNVYASTGKWCNKAEVRELMNKKGLVKPLGSSRIEIDGGVHEFVMGDYNHPEAEEIFVELAEVMDKIRKEGYDPRVSEVLLEMDDEEKAVQLLHHSEKLALAYGLIRIGHGSTIWIVKNLRSCEDCHEFMKLISKICKRDIVVRDRIRFHHFKNGECSCKDYW

SEQ ID NO: 172626 - protein, 42 aa, Glycine max
  Coding DNA Sequence Number=SeqID_55848
MALVGTSSLSFGSDGIRCRCRNPESRRCKFWACTGDLKKSIN

SEQ ID NO: 172627 - protein, 67 aa, Glycine max
  Coding DNA Sequence Number=SeqID_55849
  Gene Ontology: Mol. function=catalytic activity; Biological process =metabolic process
  Homolog annotation: Hit_ID=Q2PEY2; Match level="QueryCoverage=75%, HitCoverage=7%, E-value=5e-17, Identity=82%"; Hit description =Putative long chain acyl-CoA synthetase 9
EGQKARLEKFEIPAKIKLLSDPWTPESGLVTAALKLKREAIKKTFDEELSEFLSCTVRLVTCRRPTC

SEQ ID NO: 172628 - protein, 572 aa, Glycine max
  Coding DNA Sequence Number=SeqID_55850
  Gene Ontology: Mol. function=transporter activity; Cellular component= intracellular; Biological process=transport
  Homolog annotation: Hit_ID=Q1SKK1; Match level="QueryCoverage=98%, HitCoverage=99%, E-value=0.0, Identity=75%"; Hit description =Cellular retinaldehyde-binding/triple function, N-terminal
  Pfam annotation: Domain name=CRAL_TRIO; Domain location=148-334; Score=162.3; E_value=1.3e-45; Accession=PF00650.10; Description =CRALTRIO domain
  Pfam annotation: Domain name=CRAL_TRIO_N; Domain location=62-131; Score=48.4; E_value=2.4e-11; Accession=PF03765.5; Description =CRALTRIO, N-terminus
  Pfam module annotation: Pfam domain module=CRAL_TRIO::CRAL_TRIO_N; Domain location=148-334::62-131
MTDIMSAPVDLPMKLGHEIEYSEDERKKKLGSFKKVAISASSKFKHSFAKRGRRHSRVMSVSIEDDLDAEELQAVDAFRQALILEELLPAKHDDHHMMLRFLRARKFDIEKTKQMWADMLKWRQEFGADTIMEDFEFNELEEVLKYYPQGHHGIDKDGRPVYIEKLGQVDSIKLMQVTTMERYLKYHVREFERTFAVKLPACSISAKKHIDQSTTLLDVQGVGLKSLNKAARDLLQRLQKIDGDNYPESLNRMFIINAGSGFRLLWNSIKSFLDPKTTSKIHVLGNKYQRKLLEIIDASELPEFLGGTCTCADKGGCMLSDKGPWNDPDILKMVHNGEGKCKRKTLSGIEEKTIIEDGTAHQNVGNKESFPETYDVDEQCLSPKKQCAVYKYDAFVPVLGKPVDSSWNKLTQKDKDALSKDCFPSKTCDGYSNHFVGGIMAIVMGIVTVIRLTRNMPRKITEAIVYGSSSGYYDGTMMKAPTISCNDYMAVMKRMAELEEKVTVLSMRPVIPHEKEEVLNNALCRVTTLEQDLVATKKALDDALARQVELQAQIDKKKNSNKKLFRFRCFAT

SEQ ID NO: 172629 - protein, 179 aa, Glycine max
  Coding DNA Sequence Number=SeqID_55851
  Gene Ontology: Mol. function=binding; Cellular component=membrane; Biological process=photosynthesis
  Homolog annotation: Hit_ID=Q7YW78; Match level="QueryCoverage=59%, HitCoverage=28%, E-value=3e-18, Identity=42%"; Hit description=Small glutamine-rich tetratricopeptide
  Pfam annotation: Domain name=TPR_1; Domain location=114-148; Score =7.6; E_value=0.66; Accession=PF00515.18; Description=Tetratricopeptid e repeat
  Pfam annotation: Domain name=TPR_1; Domain location=38-71; Score =24.5; E_value=0.00039; Accession=PF00515.18; Description =Tetratricopeptide repeat
  Pfam annotation: Domain name=TPR_1; Domain location=80-113; Score =28.2; E_value=2.9e-05; Accession=PF00515.18; Description =Tetratricopeptide repeat
  Pfam annotation: Domain name=TPR_2; Domain location=114-148; Score =9.0; E_value=3; Accession=PF07719.7; Description=Tetratricopeptide repeat
  Pfam annotation: Domain name=TPR_2; Domain location=38-71; Score =16.4; E_value=0.1; Accession=PF07719.7; Description=Tetratricopeptide repeat
  Pfam annotation: Domain name=TPR_2; Domain location=80-113; Score =21.5; E_value=0.0031; Accession=PF07719.7; Description =Tetratricopeptide repeat
  Pfam module annotation: Pfam domain module=TPR_1::TPR_1::TPR_1::TPR _2::TPR_2::TPR_2; Domain location=114-148::38-71::80-113::114-148::38- 71::80-113
MFTLWHCKDLKFDLEMQGRMKGELERSGCHQFSLKNLAESLKTLGNKAMQSKKYSDAIELYNCAIAVHEKSAVYYCNRVRLILIIRAAAYTQINKYTEAIQDCLRSIEIDPNYSKAYSRLGLVYYAQGNYRDAIHKGFRKGCGNHLENVDFIAVMYCYFIKVAERKLLEEQHRAYQNQF

SEQ ID NO: 172630 - protein, 48 aa, Glycine max
  Coding DNA Sequence Number=SeqID_55852
MGLTRSKGTGNLSGACISHLIEKVTIFRIGSMETEWSRFHQSNFKCVQ

SEQ ID NO: 172631 - protein, 123 aa, Glycine max
  Coding DNA Sequence Number=SeqID_55853
  Gene Ontology: Mol. function=methyltransferase activity; Cellular component=nematocyst; Biological process=pathogenesis
  Homolog annotation: Hit_ID=Q2HRW2; Match level="QueryCoverage=97%, HitCoverage=32%, E-value=3e-29, Identity=55%"; Hit description=SAM dependent carboxyl methyltransferase
  Pfam annotation: Domain name=Methyltransf_7; Domain location=1-123; Score=-190.8; E_value=0.0014; Accession=PF03492.6; Description=SAM dependent carboxyl methyltransferase
MQSLVEEAKLEYVNMPRYGPTAKEVKQLIDAEGSFTLEKLETFKSRWDEGLKENGNGDFVLDTNVRANFIAKYVRATTEPFLTARFGEGIIDELFIRFRKKVAELLEEVILEHAYLVMFMTKK

SEQ ID NO: 172632 - protein, 120 aa, Glycine max
  Coding DNA Sequence Number=SeqID_55854
MIEGLREEEVWVQRNCGSKNLRKGVGETVVIMVVDKVKMKRLVSCNSKIQVNIPRAFAKRNTHGLSVRKTLEENELYRFAKRTASVHLLSEKGALSRKSLMCTKRSISALSARAQTRPPI

SEQ ID NO: 172633 - protein, 226 aa, Glycine max
  Coding DNA Sequence Number=SeqID_55855
  Gene Ontology: Cellular component=mitochondrion
  Homolog annotation: Hit_ID=Q5VMT5; Match level="QueryCoverage=98%, HitCoverage=14%, E-value=5e-22, Identity=30%"; Hit description =Putative Spo76 protein
MELHNLFQEICPEETQKKIEIMFTKIAAFFPDSHKAEECLHKLNQIKDNSVFKLLEKLLEEQAFTTIGQTMKDKHLVMIGDSNPNYEFLRLLFSKCSSNIFSSEHVKCILDYLSNNENGNKDLEDSSANLLLAIVRNFPSMLKGLEKQFQKLLEQKSPVNDKLIEVIAKAGSHMSFNHSDIYPLLKRICLDGTRRQAKFAGSAIAALSFEQSVFRKLYEMMRQGET

SEQ ID NO: 172634 - protein, 115 aa, Glycine max
  Coding DNA Sequence Number=SeqID_55856
  Gene Ontology: Mol. function=RNA-directed DNA polymerase activity; Biological process=RNA-dependent DNA replication
MENWKWIKGEVLGRQVEGRWGSIAGEVPKNVLRFSTATTIYPAARGGNKWRLGMAVPVEEIIFGGCDRHSCKIYGGYRGSDSTSSATRHLDLGGGSKWELHSGECLDFAQSKYDR

SEQ ID NO: 172635 - protein, 411 aa, Glycine max
  Coding DNA Sequence Number=SeqID_55857
  Gene Ontology: Mol. function=serine-type endopeptidase inhibitor activity; Cellular component=mitochondrion; Biological process =attachment of spindle microtubules to kinetochore during meiosis I
  Homolog annotation: Hit_ID=Q5VMT5; Match level="QueryCoverage=85%, HitCoverage=23%, E-value=1e-43, Identity=30%"; Hit description =Putative Spo76 protein
  Pfam annotation: Domain name=HEAT; Domain location=264-299; Score =9.2; E_value=3.3; Accession=PF02985.12; Description=HEAT repeat
  Pfam annotation: Domain name=HEAT; Domain location=304-339; Score =14.2; E_value=0.48; Accession=PF02985.12; Description=HEAT repeat
  Pfam annotation: Domain name=HEAT; Domain location=344-379; Score =6.1; E_value=7.8; Accession=PF02985.12; Description=HEAT repeat
  Pfam annotation: Domain name=HEAT; Domain location=72-110; Score=9.6; E_value=2.9; Accession=PF02985.12; Description=HEAT repeat
  Pfam module annotation: Pfam domain module=HEAT::HEAT::HEAT::HEAT; Domain location=264-299::304-339::344-379::72-110
MDESSLQLVSEIGRHLAHRTRPNKDFLVKSLGFELPRHVGRRDKKAANALALIKQSPQPRTAKEVQAAKKQEDALKPLANAVVCGGLLQHADKEVRLLVAMCVTDLFRIMAPVPPFEDKHLRMYFCSQDVFKLIISLFEDLADTASPFFSKRVKVLETMAQLKCCVIMLEIDCIDLVLEMFNIFFSVVRLSLFQNLTPTEQQDAIFTADKLAASVIKACAQEDELNSLVCGFLTTCIHDRDAMGSELKEYYNEIFSKVFQCAPEMLLDVIPSLIKELSADEVDVRIKAVNLVGMLFALQHHVVQKYHELFVEFLKRFSDKSVDVRISALQCAKAFYLANPYDGTESREIMTSVGDRLLDSDDQVRKQAVLVACDIFSSNLKLVSSKLLSQATERLRDIKACAIEFCMLGKG

SEQ ID NO: 172636 - protein, 65 aa, Glycine max
  Coding DNA Sequence Number=SeqID_55858
MKNNLGAHPALQPTLQVSKLPGYHHVSYLQTSGDTGNCDVCPRVVKGLVHSHPEWVLGLQSMVRC

SEQ ID NO: 172637 - protein, 79 aa, Glycine max
  Coding DNA Sequence Number=SeqID_55859
MVSEPIPDPFKGSPTIVVHAPSSRSVRREGVYWEKHPRFKLTPLKRLKKILYLQAECFDIDGNLQGVKRLLSTRKCKGC

SEQ ID NO: 172638 - protein, 104 aa, Glycine max
  Coding DNA Sequence Number=SeqID_55860
MAALSKALRGTTKLEKILDIWEAGKLFYCLSTWGLALAGDKSLDLEGRPKVWRLYVRRKRGQNSKGEVAKAVTELPNVLYQSRAILRVAAKGVHSGSKLALKAL

SEQ ID NO: 172639 - protein, 263 aa, Glycine max
  Coding DNA Sequence Number=SeqID_55861
  Gene Ontology: Mol. function=GPI anchor binding; Cellular component =membrane; Biological process=cell wall catabolic process
  Homolog annotation: Hit_ID=Q93ZH0; Match level="QueryCoverage=87%, HitCoverage=55%, E-value=9e-96, Identity=75%"; Hit description=LysM domain GPI-anchored protein 1 precursor
  Pfam annotation: Domain name=LysM; Domain location=113-160; Score =27.0; E_value=6.7e-05; Accession=PF01476.10; Description=LysM domain
  Pfam annotation: Domain name=LysM; Domain location=180-222; Score =41.4; E_value=3.1e-09; Accession=PF01476.10; Description=LysM domain
  Pfam module annotation: Pfam domain module=LysM::LysM; Domain location=113-160::180-222
MPNQNPILHCTFLLLLLHLLLNASPMRCKSTIEPCSNYDSCNALLGYTLYTDLKASEVASLFQIDPIALLTANAIDISYPDVEHHILPSKLFLKVPITRSCVDGIRKSMSTHYRTRPSDTLSSIANSIYGGLVSPDQLREANSIGDDPSVLDVGLNLVVPLPCTCFNESDNSLPSIYLSYVVQPIDTLAAIAARYFTTFTDLMNVNDMGTTAISDGDILVVPIPACASNFPKYASDYGLLVPNGSYTILLLVTVCSVAVDHKI

SEQ ID NO: 172640 - protein, 176 aa, Glycine max
  Coding DNA Sequence Number=SeqID_55862
  Gene Ontology: Mol. function=GPI anchor binding; Cellular component =membrane; Biological process=cell wall catabolic process
  Homolog annotation: Hit_ID=Q93ZH0; Match level="QueryCoverage=79%, HitCoverage=32%, E-value=2e-32, Identity=48%"; Hit description=LysM domain GPI-anchored protein 1 precursor
  Subcellular localization annotation: CTP_CleavageSite=59; ConfidenceScore=5.64e-01
MFIWVCRSTCSLYCMPSSLAVSCSSMRCKNSNLMLGNVTVQRSSSGCNVTSCNYDGFVSGTTITSLSPSLQPRCPGLQRFHPLIAPPTSVIRESEFAFTPSLSPSQSSQSQETGLTAPKSSVMPATRSFPGFSPANGPVSRIASGASATPSLANPMLVLRFAFMLLLVKLLIPLAL

SEQ ID NO: 172641 - protein, 227 aa, Glycine max
  Coding DNA Sequence Number=SeqID_55863
  Homolog annotation: Hit_ID=Q10ED5; Match level="QueryCoverage=87%, HitCoverage=73%, E-value=4e-21, Identity=33%"; Hit description =Expressed protein
MKSVEVAKTVLEVADVAWTAVEHTHHYRHRCSHPVAPAAADVCPSDQDLESLRSENRRLRNLLDLNLNLLQNLSKSPCLDNCPPDLNERLVATMRSDEYLTRLKFLQQETASGGNQFPFKEATELDHRSADILVNIDSQEPSWWVWVTDEVDPINVEELSGIDDESYVVISEEHVVDGVANFMARCILSNPKALNFSPEELQKVRFSPIHLYFMLGVGTVRHVAQPQ

SEQ ID NO: 172642 - protein, 109 aa, Glycine max
  Coding DNA Sequence Number=SeqID_55864
MESKLKDASGLVHAKEIVKRNGIDAIIYIANGGSILKEHLCFRKRFKAYDIWGDEVEDLISEAIRDGEGAVEEGAEREEVQCGAVLRGFKAFRSCWWCCKRTCEEEGVE

SEQ ID NO: 172643 - protein, 122 aa, Glycine max
  Coding DNA Sequence Number=SeqID_55865
MLIHCEVQLKIEAKELDRICVSFRQEPYQHPMVANAIIAFAEAVRANRQLFSKVGGALAKFLCTQLDGDDIFRRCKSLQGEKMDLGGKVESMAGKKDELAKRIATLEARLKESESKLEESKL

SEQ ID NO: 172644 - protein, 148 aa, Glycine max
  Coding DNA Sequence Number=SeqID_55866
MVKEECKEVSVSSKRLAKKENYFAIKTNIKETSLLKQPPHLLLCRRTLVNTATPLRLEVIPLINELLDEGFVCKSLNPCALLVPKIDIIRHQIPKIVIKGFPQILREIWPTPPSVKGRSPEFQEPMDLRSNPFQGGGDDAILPPKGIG

SEQ ID NO: 172645 - protein, 93 aa, Glycine max
  Coding DNA Sequence Number=SeqID_55867
MLRSSLFDFEDCNGEDNLEYKKVVDWFSCNLQHDRTEPEQRVLRILGFIRAEKRQKMSQSHRTALSDSLGERKRPKQLSIGDSIKRYASAPTN

SEQ ID NO: 172646 - protein, 91 aa, Glycine max
  Coding DNA Sequence Number=SeqID_55868
  Homolog annotation: Hit_ID=Q2VCK8; Match level="QueryCoverage=63%, HitCoverage=25%, E-value=6e-11, Identity=51%"; Hit description=ChaC -like family protein-like
  Pfam annotation: Domain name=ChaC; Domain location=7-90; Score=-62.5; E_value=0.0011; Accession=PF04752.3; Description=ChaC-like protein
MRTSPWSLILETRNTVKSRLLAFEGMLQYLEVREKQYDKKEYLDFYTDLTATSPAVSGVMVYIATPDKKSNVNYLGPASIEDIARYYFIYV

SEQ ID NO: 172647 - protein, 99 aa, Glycine max
  Coding DNA Sequence Number=SeqID_55869
MGANVSSFMNRVWREHPELAMMYPELEWATDPRCSVLLPYLQHNLHPQWHPQADVEPGREYSTSPGISHGGGSTASALRSLCSERRCWRVLEQELVVLV

SEQ ID NO: 172648 - protein, 35 aa, Glycine max
  Coding DNA Sequence Number=SeqID_55870
MANMHLYEGGEWSYGGGRESDGATKEENERLWSRE

SEQ ID NO: 172649 - protein, 83 aa, Glycine max
  Coding DNA Sequence Number=SeqID_55871
MKEKVDAKHEEEGVNGTFPLIPDKTFQTFTREVTRMEIKKIMFSMGNYKGYRYRQVASWFYKTQWHVVGNLLCNFNMDIFHDL

SEQ ID NO: 172650 - protein, 468 aa, Glycine max
  Coding DNA Sequence Number=SeqID_55872
  Gene Ontology: Mol. function=RNA-directed DNA polymerase activity; Biological process=RNA-dependent DNA replication
  Subcellular localization annotation: CTP_CleavageSite=51; ConfidenceScore=5.11e-01
MGSWRFPSSYTRAELKTSSATERYRSMGTLSLGRLRTGGVAMVFLKAKKACLNMDRDASLLFSLWNSWALVGWCISSMVMHLLRLASIPQYVSEYFQVWHMLGYAIGFEVNVVDVDLRILPDMLFEDSVHQSLGMHSWDCPIKISVVSAHLPFFFRLFEHENVGEPDGELVAYNAGVDNRYLRWLPREQYINYTFVFMTGDVLAELRTFPGFGSEIQFDVFFNRIWASFSSVVAQIDIKYVIQACLVDYHGLYWRPSIDAHNLSIASSYGVWLGRLPKLALTEGGHEVYIALVKDVSGAALIDGNLGHHEVRDYDVDNHGVVLTNRVDTLEVSISEIDVDVLDGVEMTLAGLAGLPCIGEFACNEVDDCVFTVGAFVSLDLLLYPFLCQRHDSYIDALGILQVLLLLDNCSASLQIGLDTQPFYGYLLVEGFLEDSCVVSRQKCVTFIPGPFWESLVLVWLVPFVRLV

SEQ ID NO: 172651 - protein, 137 aa, Glycine max
  Coding DNA Sequence Number=SeqID_55873
MMHAPDSTLRCNVVRTNNNQISGNSLSVFTRHSHLGNCADLPPIGDQPGSPKVFPTSYDHDQKQVPKTMDQLKRLSIPSEMLRFSNHASYPRLGHPTRITFTKSLSLRFFKGSIRHAMAVPKSEKMQRQDETNKKQA

SEQ ID NO: 172652 - protein, 41 aa, Glycine max
  Coding DNA Sequence Number=SeqID_55874
MANQVSLGISNQLTWASYSSPRRVTLLGIEHNVLITNSSRL

SEQ ID NO: 172653 - protein, 143 aa, Glycine max
  Coding DNA Sequence Number=SeqID_55875
  Gene Ontology: Mol. function=DNA binding; Biological process=DNA integration
MVIVKTNYPIKHVLRKPKLARWMVALSIEFYEFDLQYETSGPVKTQFMTNFLAKFSKNDQTTLDWWRLYVDNAFNVKGSGTCIILGGLGNVTLEQALKLNFKALNNRLRRVTPKQTYSSRRGGTRLNNSLQEFPNSGDVNPKS

SEQ ID NO: 172654 - protein, 118 aa, Glycine max
  Coding DNA Sequence Number=SeqID_55876
MNTHPPIEIPVAKRGSTLVPFTSSTLNHRRSTEAVEYICLCHTRTKSGTEPMSSLHCCLPRPPSGENPSRVYVMFWVKTHSFRFYRRFVFIVNGHHDKKYALIFVELIFLPTSGTPDI

SEQ ID NO: 172655 - protein, 71 aa, Glycine max
  Coding DNA Sequence Number=SeqID_55877
PKEEKVQVDDISLSKTNPLSEWHPLSEAYRSLSGLKDRRRGLVKDVLVQRAPAQLAQRVGCLFSRLAGPTH

SEQ ID NO: 172656 - protein, 147 aa, Glycine max
  Coding DNA Sequence Number=SeqID_55878
MASRKRKSTTFQLQEPYDTTRFISEVAWERYEQNYDEFRRELERRRWHKALTRQPDGRIDVALVKEFYANLFDPEDKSPRQVQVRGKLIKFDGETLNAFLETPVVLELGEHYSAFSRFCHMHPDPQELASKLCIPGRGFVLNTEGAP

SEQ ID NO: 172657 - protein, 163 aa, Glycine max
  Coding DNA Sequence Number=SeqID_55879
MADGDVWEGGVKKDARWFTARKSGDQKYDIVSNGEPRAQGMLSSPLSYKPDPTLENHHSHFRTKKTFSPFIMKTRRSCRILGAVLALVVLHFLLFSLYSLSHEQSFSGETSLSVSRELLSSSFASFSTSINKISGSKKQKKKKVMEPSLRKAPPSIPNPTQNK

SEQ ID NO: 172658 - protein, 70 aa, Glycine max
  Coding DNA Sequence Number=SeqID_55880
  Subcellular localization annotation: CTP_CleavageSite=48; ConfidenceScore=5.45e-01
MANGEIHSHNSIVQCHFLSHFSLLASSFFSTSMVPLNFSQEVLTNSPRKAELPSRVAYLVLKILTRLGEL

SEQ ID NO: 172659 - protein, 218 aa, Glycine max
  Coding DNA Sequence Number=SeqID_55881
MDDDVIDNQIKQLEREAYSGVLRAFTCQSDDKNLRLCCFYFGTILINMIENAIRESRQRQTGSASHQHATKNTSQPVHGDLHSPTDSTETDSPPSKKRISIAAMFPRDEDTQEKGKDQVIPYRNQHNSGQGGDDVIAGRAPRIRIKYGDTSKIPTPPSVKGKRVMEVTTLMNRDMYVNKVKIFALQVHWRRASVFAWEINKRDGSTLTTFWWMRMSFS

SEQ ID NO: 172660 - protein, 253 aa, Glycine max
  Coding DNA Sequence Number=SeqID_55882
  Gene Ontology: Mol. function=RNA-directed DNA polymerase activity; Cellular component=mitochondrion; Biological process=RNA-dependent DNA replication
MEFITEDAIFCYRVMPYGLKNIGATYQRLMDRIFKQHIRQNSEVYINDIDVKSYSIAQHVPDMEEDEAYKQAFLAFKKTIATPSVLSQPRLRVPILLYLSVADEVISSALVKEEGNLQLPIYFTSCILHDTEKRYQMIEKLALALITSARRLIPYFQSHMVIVKTNYPIKHVLRKPKLARWMVALSIEFSEFDLQYETSGPVKTQFMTNFLAKFSKNDQTTLEWWRLYVDNAFNVKGSGTCIILGGLGNVTLE

SEQ ID NO: 172661 - protein, 335 aa, Glycine max
  Coding DNA Sequence Number=SeqID_55883
  Gene Ontology: Mol. function=protein binding; Cellular component=Smc5- Smc6 complex; Biological process=double-strand break repair via homologous recombination
  Homolog annotation: Hit_ID=Q9LT44; Match level="QueryCoverage=81%, HitCoverage=68%, E-value=9e-69, Identity=49%"; Hit description =Arabidopsis thaliana genomic DNA, chromosome 3, P1 clone: MOE17
  Pfam annotation: Domain name=Nse4; Domain location=16-290; Score= -35.8; E_value=1.3e-10; Accession=PF08743.1; Description=Nse4
MTIKITTPLTTTTLMITKRRKAGEVFVHDEREEIARADSHKFNLIFNEMETLHQLVTKPREQVADAKALLDITQSLVMSVKNIAIGGLTPSDFVTHILKKFGGQAGPSNSTEDFSRNSVAWKDIGVAVSRVFRAGCGCYTMIGAMDAKIKQRKVYNRRKRVRPTELARPKELGGGSGEERTETDKHMITMFNILRINKFVKLENLILNRNSFAQTVENLFALSFLVRDGRAEIKVNEAGWLLVSPRNAPAANSVVSRDVAFSHFVFRFDFNDWKLMVCSVGVGEELMPHRDSQLQSQTEEYTSSLYLIQVKFASIQFPVLKTVKYQIMAPAHNDI

SEQ ID NO: 172662 - protein, 215 aa, Glycine max
  Coding DNA Sequence Number=SeqID_55884
IFRKEIDLLQHQTVAAQKRRLLYNHGGCTSSVPSPGLKSCKQGLLDLELTLLRVDFLPGLVAPRFLNALSNNQKKARIVKYRDSPHLTCLISPAKPKGMSTLDNLIEAARTTLVLVGGLAKPHRPATLALVEVTTLDTKQLFYMLGDSMNSRPSYLSRLLPSTLDNLFRPQTDSELGGLCTIQGPPNTYGKLCGTLIHTLAFHLCPSTEAHTSSP

SEQ ID NO: 172663 - protein, 402 aa, Glycine max
  Coding DNA Sequence Number=SeqID_55885
  Gene Ontology: Mol. function=nucleic acid binding; Biological process= DNA integration
  Homolog annotation: Hit_ID=Q1SZQ0; Match level="QueryCoverage=83%, HitCoverage=44%, E-value=3e-19, Identity=30%"; Hit description =Integrase, catalytic region; Zinc finger, CCHC-type; Peptidase aspartic, catalytic
  Pfam annotation: Domain name=RVP; Domain location=219-326; Score= -3.6; E_value=0.0089; Accession=PF00077.10; Description=Retroviral aspartyl protease
MAGNLSKIIPDMSKIEPLDDSNYRRWFQKLLILFEALEVDYVLFEDPPADVNASESSTLETPATPVVTPLPAETKKANEEAKKKYEKDNKTARGHLLTHMADNLFDLFINQKSAKTIWDTLLKRYGDDDAGRKKYVVGNWLRFQMMDDKPIMEQIHEYENLVGDILNEGMKMCEILQANVLLEKFPPSWSHKAYECKLRKGQQSNNSKPAAPHAPQAHLAENEEVIAAVVVEANMVDNKVDWILDTGASKHLCANKELFHQIEDADDGKCVFMGNSATTRVLGKGKILLKLTSGKTLSLSDVLYVPSLRRNLISGSCLNRAGLKLVFEADKVVITEMMNAMLLSSVWGCLAKVALPDFKRTNVGTKTFDCVFIGYAQNGAAYRFLHALDGFNFVRVKVGRLL

SEQ ID NO: 172664 - protein, 339 aa, Glycine max
  Coding DNA Sequence Number=SeqID_55886
MASRKCKSIGSRPTTQYDTRRFHSLDPWNRYTDNVLGRNILPEKKVKLYHTEFDVFKTELERHNLHKRLTNLVDGSIDVALVKEFYANLYSSEGPSPKQARFRGHLVKIDADSLNTFLETPVVWHKDPEEGLDDFSPVSHMDMNIRALIYGQMTSIAQNNSSRFGFPALITALCRARGVVSDSLTFERLSPVVAPPGSIPSIEQFLEMVTWPGAQPSLHREYEGPTAQVPQHVEDASSKVTVPEPFIVEEEAGETQVRQEAAATPERSREVTSNPPTLVVDLSSPQHAADPSTPILEIPEDPTTPVLTLNTSPLATPVLHLIDEEDVQTRDTQDQSQEF

SEQ ID NO: 172665 - protein, 215 aa, Glycine max
  Coding DNA Sequence Number=SeqID_55887
MARDTLGYSGQRGSPDLGELASPDYLALSALIWHGKLTGLTLLLPTGSETMIFELGVGEMYIVFDSPLQPPISGGGHRAFRRVFTWISRFCYNYMVEEEAHAAYPFPFVYTPQRDINHIISYYTYFGFERLDNPLRLLLQFFGHDVNEWATRSNFCWDTSIENFKDTGDFIDNKDLTPSEIAFYWGVYGEEMILFDKECNSLEDENDPSKDMISP

SEQ ID NO: 172666 - protein, 176 aa, Glycine max
  Coding DNA Sequence Number=SeqID_55888
KANCYKGKELQIEDDDEVLPTKYVKARPDRLFIHELEDLKQKEFYLVFDCTFSLLVHLPHSKFNFTPQVQPIIEEVDYDVEVVLDPDAMAVSIYDPPSSRAYVKMIEAELQRRQEAFAQALKDHAHKITRWKLARPLMPSDTPAFSIDLSSDFDYFGDKYLRKLDEDIAKLNGEKK

SEQ ID NO: 172667 - protein, 73 aa, Glycine max
  Coding DNA Sequence Number=SeqID_55889
MVIEFLEQATIAFSVPKSTTVKSLAAIDEGNLNKLSEKLLMSKSGKVISAPNIKPKEIMLEAVCLMRFDERLK

SEQ ID NO: 172668 - protein, 115 aa, Glycine max
  Coding DNA Sequence Number=SeqID_55890
MYGNNRFILLRKGGTSGKEKSTETNTGGEGVERGSLRGASLLDENSEGRKLQWKAHMVKEGQKGRKLHRKSGNTIIINEKKLWEIGKLCGVTFEGEDVIMKEKLKKMEVRDQQGL

SEQ ID NO: 172669 - protein, 122 aa, Glycine max
  Coding DNA Sequence Number=SeqID_55891
  Gene Ontology: Mol. function=nucleic acid binding
MDYLTPNLGEANTNQLIDLLKGIMFDFKHELLQMLENNPFSGGAHQHPMQHLTKFIKLTNTNKITTWNQCTSALRRYFSPMKTDQHIRDIGNFVQREQKGLLEAWERLQEIIRSCPHHGITQ

SEQ ID NO: 172670 - protein, 359 aa, Glycine max
  Coding DNA Sequence Number=SeqID_55892
  Gene Ontology: Mol. function=RNA-directed DNA polymerase activity; Biological process=RNA-dependent DNA replication
MDEINFYGEDIVLIIITPTILIKDMALGRIKECIDLNLCKIKCLDKMRDNPLFKKPCFNIWLRMIKERSSAKEGRGSKEGDTEISLGSYFDKCLCDLGATINLIPYSIFKKLGITDLEPTNITLHLADHSVVYPRRAIEDVLVKEEKFIFSVDFVILDIEVGDERVVFSLSNTLKQPSSLVDALMEGVFPMEEILTFLHSQHGHEPPNCKRLKCGIVPKIKPPVKEPPEVELKPSPSNFKYVFINPPSSLPTMIAICLHETKEEKLLWIFRDKKGNFGWNIHDMKGLNPTLCTHKINAKEGSPPKQSSQRKLIPNMMEFVKKKDIMSTIKMKAYHERFQQMQTIMHPSDLLANHHMSNS

SEQ ID NO: 172671 - protein, 156 aa, Glycine max
  Coding DNA Sequence Number=SeqID_55893
  Gene Ontology: Mol. function=carboxypeptidase activity; Cellular component=membrane; Biological process=auxin mediated signaling pathway
  Homolog annotation: Hit_ID=O24091; Match level="QueryCoverage=93%, HitCoverage=30%, E-value=8e-24, Identity=39%"; Hit description=MtN21 protein
MERITSRWPVLDQNLYNMGMKNTSTTFASATVNVMPAITFIMALICSKDYQHQLQVISFTTHHITLIARHDNARLETVNLRKIPSVAKVVGTAVTVSGAMVMTLYKGPALQFIKGQAATHHESGNSTQPSEQNWVLGTVELIASCGGWASFFILQV

SEQ ID NO: 172672 - protein, 62 aa, Glycine max
  Coding DNA Sequence Number=SeqID_55894
MAKKRELESGGGGGCRRGSGWMMREVNITCKMCKAQNHHSLIMAGHYQGDVRVKHIYQSEGI

SEQ ID NO: 172673 - protein, 64 aa, Glycine max
  Coding DNA Sequence Number=SeqID_55895
MERVGFFKKKERRWCHKGLSHDSGRQWRHYESRRWVLSQVDDEIVWRENRRCKGEAGLLENLFK

SEQ ID NO: 172674 - protein, 71 aa, Glycine max
  Coding DNA Sequence Number=SeqID_55896
MVEQNKFMADEKPTTKNTYTPTTHSLLSISSAMNPWLDDLTDDLQSLNFASTATVDMKWAPASAPKPPLSY

SEQ ID NO: 172675 - protein, 153 aa, Glycine max
  Coding DNA Sequence Number=SeqID_55897
  Gene Ontology: Mol. function=RNA-directed DNA polymerase activity
  Homolog annotation: Hit_ID=Q1S0V9; Match level="QueryCoverage=55%, HitCoverage=23%, E-value=1e-09, Identity=37%"; Hit description =Probable Ta11-like non-LTR retroelement protein [imported] -Arabidopsis thaliana
MMSLWNQDHNIRVKKWPLKPSGLGAPLIIEKLHVELLLEKVQNPSFQTLHVSSTDAKLISKKSCPKEVTFHGLIGFHSLESLSLILVTSRGEVPFDKISLLWRALRVGLQGNCRNLRELLQRIDRSRMPPRLVLDLTGKRTKMEGQGMPRGKR

SEQ ID NO: 172676 - protein, 91 aa, Glycine max
  Coding DNA Sequence Number=SeqID_55898
MVYTWTRELYVVSNLTFLFVVFLTFSRFFFTHHVDPFIEDVFDVEASSNSMVIRVYDLPTSHAYVCLLEDELARTKEVLAQTIQDRAYAEN

SEQ ID NO: 172677 - protein, 114 aa, Glycine max
  Coding DNA Sequence Number=SeqID_55899
  Gene Ontology: Mol. function=carboxypeptidase activity; Cellular component=membrane; Biological process=carbohydrate metabolic process
  Homolog annotation: Hit_ID=Q9ZUS2; Match level="QueryCoverage=91%, HitCoverage=35%, E-value=5e-29, Identity=51%"; Hit description =Nodulin-like protein
AITLRKYPAEMSLATWVCFVGALQSSAVSFFMERNSPHVWSLAWDSRLVAYAYSGIVTSAIQFYVQGMVIKTTGPVFVTAFNPLRMIIVTALACIVLSEKLHLGRYYQVKQHFN

SEQ ID NO: 172678 - protein, 44 aa, Glycine max
  Coding DNA Sequence Number=SeqID_55900
MKDIHWYLAYRKMIASTKVMEGTEFITADANDADVYFIPRNVKH

SEQ ID NO: 172679 - protein, 87 aa, Glycine max
  Coding DNA Sequence Number=SeqID_55901
MDEGFYPMGSKSLYALKNQFTKLEYTSVENVLLEFNHINTNIFKLYIDLRVFEDQVIVPLLLYYNPSAKALAFSDWTLKQYRPMADA

SEQ ID NO: 172680 - protein, 321 aa, Glycine max
  Coding DNA Sequence Number=SeqID_55902
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=86%, HitCoverage=37%, E-value=1e-83, Identity=60%"; Hit description =Subtilisin-like protease C1
MNNPTATIFKSYEGKDPLAPYIDSFSGRGPNKITPNILKPDLAAPGVNILAAWSPIAPISGVKGDKRISKYNILYGTSMACPHVTAAAVYIKSFHPNWSPAVIKSALMTTATPMRDILNHGNAEFGYGAGQINPMKAVKPGLVYDATEIDYVKFLCGDGYSGFMDKITGDNKTTCTPANTGSVLDLNLPSFALSTTRSKYISATFSRTVTNVGSAKSIYKATVTTPPSSSSLNIKVVPDVLVFSSLEEKMSFTLKIEGSINNANIVSSSLVWDDGTFQVRSPVVVYVPPCTYCYYLLHAAKQMNPVNNRDAEFAYACCRPN

SEQ ID NO: 172681 - protein, 84 aa, Glycine max
  Coding DNA Sequence Number=SeqID_55903
MTNWMQCAKKILRKKTWWMQTPLKLRIEPKRRWAHPLPRLPMYHNVQYEEDDDKGDDKKIKGQSKNEFKMFKIESRTLQDSRGK

SEQ ID NO: 172682 - protein, 358 aa, Glycine max
  Coding DNA Sequence Number=SeqID_55904
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=97%, HitCoverage=45%, E-value=8e-86, Identity=51%"; Hit description =Subtilisin-like protease C1
  Pfam annotation: Domain name=Peptidase_S8; Domain location=132-352; Score=-83.4; E_value=0.026; Accession=PF00082.12; Description =Subtilase family
  Pfam annotation: Domain name=Subtilisin_N; Domain location=29-95; Score=21.5; E_value=0.0011; Accession=PF05922.7; Description =Subtilisin N-terminal Region
  Pfam module annotation: Pfam domain module=Peptidase_S8::Subtilisin _N; Domain location=132-352::29-95
MISVGLWHLLQIFTCFLLLTQSFSKDDRKTYIVYMGDYPKGVGFAESLHTSMVESVLGRNFPPDALLHSYKSLNGFVARLTKEEANRMRGNFNTHVSQYISHEWIVWSLLYQTESISHKQQGLGTFLASPENVQRNIIAESNTIVGVIDSGIWPESDSFNDAGFGPPPKKWKGICQNFTCNNKIIGAQYFRTKGFFEKDDIKSPIDTTGHGSHCASTAAGNPVRSASLLGFGSGTARGGVPSARIAVYKVCWATGCDTTDILKAYDAAIADGVDILSVSVGATQLTHNKYFKDVHAIGAFHAMKKGILTSTSADNLGQLGPYSTSKFAPWLLSVAASTIDKKFFTKIQLGNGKIYEVY

SEQ ID NO: 172683 - protein, 573 aa, Glycine max
  Coding DNA Sequence Number=SeqID_55905
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=99%, HitCoverage=72%, E-value=0.0, Identity=66%"; Hit description =Subtilisin-like protease C1
  Pfam annotation: Domain name=PA; Domain location=167-263; Score=31.7; E_value=2.6e-06; Accession=PF02225.12; Description=PA domain
  Pfam annotation: Domain name=Peptidase_S8; Domain location=3-389; Score=-0.0; E_value=8.9e-07; Accession=PF00082.12; Description =Subtilase family
  Pfam module annotation: Pfam domain module=PA::Peptidase_S8; Domain location=167-263::3-389
  Subcellular localization annotation: CTP_CleavageSite=51; ConfidenceScore=5.04e-01
DGFKIKDLKSPRDTDGHGTHTASTAAGNPVSMASMLGLGQGTSRGGATSARIAVYKACWNDHCDDVDILAAFDDAIADGVDILSVSLGGSNDQNYFGDASSIGAFHAMKNGIVTVFAAGNSGPSPASVDNLYPWSISVAASTLDRKFVTKVQLGDNRTYEGISINTFDLKGELHPLIFGGDAPNTKAGKDESESRLCHLYSLDPNLVKGKIVLCEDGSGLGPLKAGAVGFLIQGQSSRDYAFSFVLSGSYLELKDGVSVYGYIKSTGNPTATIFKSNEIKDTLAPQVASFSSRGPNIVTPEILKPDLMAPGVNILASWSPISPPSDTHADKRELQFNIISGTSMSCPHVSGAAGYVKSFHPTWSPAAIRSALMTTARANPGAAVKLCLGDLLVMGSNPETVSLHMQGHIVYDTVKQMSPVNNRDTEFAYGAGQIDPYKAVKPGLVYDADESDYVRFLCGQGYSSKMLKLITGDNSTCPETPYGTARDLNYPSFALQATQSTPIVSGSFYRTVTNVGSPNSTYKATVTAPIGLKIQVTPSVLSFTSLGQKRSFVLSIDGAIYSAIVSGSLVWHD

SEQ ID NO: 172684 - protein, 216 aa, Glycine max
  Coding DNA Sequence Number=SeqID_55906
  Gene Ontology: Mol. function=nucleotide binding; Cellular component =membrane; Biological process=small GTPase mediated signal transduction
  Homolog annotation: Hit_ID=Q40193; Match level="QueryCoverage=99%, HitCoverage=99%, E-value=1e-100, Identity=85%"; Hit description=Ras -related protein Rab11C
  Pfam annotation: Domain name=Arf; Domain location=1-173; Score=-77.2; E_value=0.00083; Accession=PF00025.11; Description=ADP-ribosylation factor family
  Pfam annotation: Domain name=MMR_HSR1; Domain location=13-128; Score =12.1; E_value=7.7e-05; Accession=PF01926.13; Description=GTPase of unknown function
  Pfam annotation: Domain name=Miro; Domain location=14-128; Score =83.0; E_value=9e-22; Accession=PF08477.3; Description=Miro-like protein
  Pfam annotation: Domain name=Ras; Domain location=14-175; Score =328.8; E_value=9.3e-96; Accession=PF00071.12; Description=Ras family
  Pfam module annotation: Pfam domain module=Arf::MMR_HSR1::Miro::Ras; Domain location=1-173::13-128::14-128::14-175
MAYKVDHEYDYLFKVVLIGDSGVGKSNILSRFTRNEFCLESKSTIGVEFATRTLQVEGKTVKAQIWDTAGQERYRAITSAYYRGAVGALLVYDITKRQTFDNVQRWLRELRDHADSNIVIMMAGNKSDLNHLRAVSTEDAQSLAEREGLSFLETSALEAYNVEKAFQTILFDIYHIISKKALAAQEANSSTGLPQGTTINVSNMSSNAGNRSCCSN

SEQ ID NO: 172685 - protein, 75 aa, Glycine max
  Coding DNA Sequence Number=SeqID_55907
MEIRCVVSEPEPIEQWSYGPKEWNVYKRKPKPKYTTHMHHTASYNFKTSSLLNTIPQPQIIERLECFLDLLEILP

SEQ ID NO: 172686 - protein, 86 aa, Glycine max
  Coding DNA Sequence Number=SeqID_55908
MPILDQFHLFIHDFIKNIVDVKADGMGEDSWLLVHNHLLKELAKWSDEYVNLFGDIGNKFKELKRSLLVEGLSMVTMDKWIWISPT

SEQ ID NO: 172687 - protein, 147 aa, Glycine max
  Coding DNA Sequence Number=SeqID_55909
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=84%, HitCoverage=15%, E-value=1e-35, Identity=64%"; Hit description =Subtilisin-like protease C1
  Pfam annotation: Domain name=Subtilisin_N; Domain location=32-121; Score=42.8; E_value=1.1e-09; Accession=PF05922.7; Description =Subtilisin N-terminal Region
MASRSSVLLLLLLFSFTSLVLKCHSTSPDDLKTYIVYTGNSMKDETSSLSLYQSMLQEVADSNAAPKSVLHHYKRSFSGFVVKLTEEEANRIADLLNKKFGNNAGLDGVVSVFPNGKKQLYTTKSWDFIGFPQHVQRSNTESDIIIG

SEQ ID NO: 172688 - protein, 64 aa, Glycine max
  Coding DNA Sequence Number=SeqID_55910
MESGDMRGYRIVTRTFCQPGANEPVDAQRLTSSSAPFGHPGTTSQVFSLVVRTHSSPMTHEILL

SEQ ID NO: 172689 - protein, 108 aa, Glycine max
  Coding DNA Sequence Number=SeqID_55911
  Subcellular localization annotation: CTP_CleavageSite=55; ConfidenceScore=5.35e-01
MVNKSSLLHLDPKSPEAQAFNQIGQKSNGGSISPSPTTSVEGSSQNGRKQGTDETATAKKNRTLTNDSIINFFTDPSAPQTIDSTHSSVALALMEGLYLKSLAYEFRR

SEQ ID NO: 172690 - protein, 1108 aa, Glycine max
  Coding DNA Sequence Number=SeqID_55912
  Gene Ontology: Mol. function=zinc ion binding; Biological process =proteolysis
  Homolog annotation: Hit_ID=UPI0000196E5D; Match level="QueryCoverage =95%, HitCoverage=66%, E-value=0.0, Identity=47%"; Hit description =DNA binding / protein binding / zinc ion binding
  Pfam annotation: Domain name=DDT; Domain location=201-260; Score =47.4; E_value=4.8e-11; Accession=PF02791.7; Description=DDT domain
  Pfam annotation: Domain name=PHD; Domain location=425-470; Score =42.3; E_value=1.7e-09; Accession=PF00628.19; Description=PHD-finger
  Pfam module annotation: Pfam domain module=DDT::PHD; Domain location =201-260::425-470
MEPPAARPRGRPRKRRRKEEEENEAEAKRQAMGTRAIALVGRYVLKDFPGNGIFLGKVVYYECGLYRVSYEDGDFEDLDSGEVRTILVKDDEEFDKDFARRRAALEKLVAKKNSVKAKDVSESRGEGREEQSAVGEAELKGGLVLEKNEGEGNENDMEDDSSSDSSFGEIESGTTDAELLPPMPLPPELPSSSGTIGVPEESVSHLFAVYGFLRSFSTQLFLMPFTLDEFVGAVNCRVPNTVFDAVHLSLMKVLRRHLEALSSEGSEIASKCLRCYDWSLLDSLTWPVFAIQYLVVSGHTTAHEWRGFYKEVSTDEYYLLPVSRKLMILQILCDNALESEEIVMEMNIRRESEVGMDYDGEDILPSEVGLRRVQPRYANTPASEDKEATKFVSASNAVNQPGSSISYSRDTEGTEDGDVDRNGDECRLCGMDGILLCCDGCPSAYHSRCIGVLKNHIPEGPWYCPECKINMMGPTIAKGTSLRGAEIFGKDLYGQLFMGTCEHLLVLNIGNDEFCHRYYNLNDIPKVLKVLYGSTEHRAIYHDICMAVLQYCNIPESTLLFPPLGETPLSPATQCNGNGSSNECPSSKCSLVNGQIGNYDHANDTVNLSSQTKESTQAGFEKCERNVTNDPAYMGFSYKPLLYINHYAHGDFAASAAAKFALLSSEESRSEGHVSDNQRKTASGNTYLQAKAFSLTASRFFWPSSEKKPVEVPRERCGWCFSCKAPASSKRGCMLNHAALSATKSAVKMLAGFSPIRSGEAILPSIATYIIYMEECLRGLVVGPFLSASYRRQWRKQVEQAPTFSAIKPLLLKLEENIRTIVFCGDWVKLMDDWLVEFSMVQSASSTLGTAQKRAPSGRRYKKRLANDEATADGCPENFVWWRGGKFTKFIFQKAVLPKSMVRKAARQGGSRKISGIFYADGSEIPKRSRQLVWRVAVQMSRNASQLALQVRYLDFYLRWSDLIRPEQNIQDGKGQETEASAFRNANICDNKLVEGKSCYGIAFGSQKHLPSRVMKNVVQVEQDPEGKEKYWFFETRIPLYLIKEYEEGNGNMPCNEEHLNTASELLHRRRLKAICKDIFFYLTCKRDNLDVVSCSGCSQVQCMPRYS

SEQ ID NO: 172691 - protein, 128 aa, Glycine max
  Coding DNA Sequence Number=SeqID_55913
MKLSIARLRSCPRKRRREEDENENEVKRPTIGVSYEGDDFKDLDSAEVPTILIKDDGFYKDLAQKRVGLEKLKARSSVKNDGGKENDGDMEDESSSDSGSRDHKSRIDLEALLPIELLSSFGTIGIPK

SEQ ID NO: 172692 - protein, 113 aa, Glycine max
  Coding DNA Sequence Number=SeqID_55914
MARKIKRTFREVKKCERETLTFSVLKRVRMLPYPPPRGSGAPPSPSSPAAEGSGNAIGVDEIQIQLRFITENVQSERERERGRERERMERVKNENQKLKNPLGGAVRCWSDPC

SEQ ID NO: 172693 - protein, 273 aa, Glycine max
  Coding DNA Sequence Number=SeqID_55915
  Gene Ontology: Mol. function=structural molecule activity; Cellular component=clathrin coat of trans-Golgi network vesicle; Biological process=intracellular protein transport
  Homolog annotation: Hit_ID=Q6JJ39; Match level="QueryCoverage=86%, HitCoverage=20%, E-value=5e-84, Identity=67%"; Hit description =Putative adapitin protein
  Pfam annotation: Domain name=Alpha_adaptinC2; Domain location=30-139; Score=4.1; E_value=0.0015; Accession=PF02883.10; Description=Adaptin C-terminal domain
MYSYQPWKVPLLECYCRIPFPIGNTGERFCSLCLKDSGVLYEDPYIQIGVEAEWRAHHGHLVLFLGNKNTSPLISVQSLVLPPAHLKMELSLVPETIPPRSQVQCPLKIINLHPSRDVAVLDFSYKFDNNMVNAKLHLLAVLNKFLEPIPVSAEEFSPQWKITFLTTFKASRSGMYLLQVCVFTNSVLSELIQFVRGVRPLPLLELANLFNSYHLTSCPGLDPNPNNLVASITFHSESTSAMLCLTTELRMTVASGYAYTYARTSNDSTSQHS

SEQ ID NO: 172694 - protein, 532 aa, Glycine max
  Coding DNA Sequence Number=SeqID_55916
  Gene Ontology: Mol. function=zinc ion binding; Biological process =proteolysis
  Homolog annotation: Hit_ID=UPI0000196E5D; Match level="QueryCoverage =79%, HitCoverage=25%, E-value=6e-66, Identity=38%"; Hit description =DNA binding / protein binding / zinc ion binding
  Pfam annotation: Domain name=PHD; Domain location=180-230; Score =17.1; E_value=0.0011; Accession=PF00628.19; Description=PHD-finger
MKTPYITGYCHEGCSTRSTVSANEVEYLTTCKQCYHARLLAQKENTNESPTSPLLLQGRENNSGTFLNGSRPKSHDQVLKSSRTKANNPNVKQVTPVTALKGTKAKYYEQEPTSTRTKDNNHFGTPQVASEATLTGKKPRKNCSWGIIWQKKNNEDTDNDFWLRNILLKGGSNMPQLKPVCHLCRKPYMSDLTYICCETCRNWYHAEAVELEESKISSVLGFKCCKCRRIKSPVCPYSDLKPKRQEGKKSRTRTKKKEHSGADSDSGAIYYDMRDCEVATPVFHVEDDPSHVFPVEGDPTHVFPVEDDPLLFSLSSVELLTEPKMEGDVEWNSVPGPGLRKLPVRRNVKHEGDGDVSFGGMPADVSPPLEYASAVDFDNKLLNDSDNVNYDDYMDFEPNTYFSLTELLQPDDGSQFEGVDVSADLSGYLENSSTLIPEERGDDKTEPAFSLQDTGGDLSGYLENSITFIPEECGDVMTEPTFSLQDTGFSSNVRLGLKYHLGLEVGGVGIAGIGNRLILLVLLVAALSPLEK

SEQ ID NO: 172695 - protein, 114 aa, Glycine max
  Coding DNA Sequence Number=SeqID_55917
  Homolog annotation: Hit_ID=Q9LHL2; Match level="QueryCoverage=40%, HitCoverage=13%, E-value=7e-14, Identity=76%"; Hit description =Similarity to RNA binding protein
MVEGTHIINGKQVEIKRTIPRGVAGWNSKDFRTKKIFVGGIPSTVTEGLDMAVSLLNGCWFFTGVYWEDAYFITNMEPMKFWEFMSLVVEGLGYERKYQFEFQKMSIYNPRMDQ

SEQ ID NO: 172696 - protein, 65 aa, Glycine max
  Coding DNA Sequence Number=SeqID_55918
MNLDEDDAVMGDATARSDATTVYYVYLIVFALYGTLKAIAGEAGVPFFYRAGSEFEEIKSSFCIL

SEQ ID NO: 172697 - protein, 102 aa, Glycine max
  Coding DNA Sequence Number=SeqID_55919
MAFQRCSFISVSYRVTQGKNIKYKLNEILIPYLVLAYTSVACLLTLPIPFIRLGTRLIFPGEQEFTHFLDTHAPLFLRVIYKRLPVNEESSSRRWRENTIIQ

SEQ ID NO: 172698 - protein, 302 aa, Glycine max
  Coding DNA Sequence Number=SeqID_55920
  Gene Ontology: Mol. function=RNA-directed DNA polymerase activity; Cellular component=chromatin; Biological process=chromatin assembly or disassembly
MVDWPIPTTIQSLQGFLGLTGFYRKFIKQYASIAAPLTTLLQKDNFHWNDDASAAFIRLKEAMIQAPVLALPDFTTPFTVETDASGLAMGAVLAQHGHPLAFFSKVFCPRLQRSSTYVRELHAITTVVRKWRQYLLGHSFIILTDHRSLKDLMSQVIQTPEQQIYLSKLLGYDYTIEYKSGKSNLVAEALSRIPLGTTASFFVLSTPNFTFLDDLRHSLADNHHFRKQCELVTASPDSHPDFKLHKGLLFFCGKIWLDPQNSFRTALIDEYHATPLGGHMGFAKTLHRVQKKFYWSSMRNDV

SEQ ID NO: 172699 - protein, 122 aa, Glycine max
  Coding DNA Sequence Number=SeqID_55921
MDDGVWESLGKQDLTARKGMLGQARACQHPLTPRKQCLTSCLCMDVTSLVLQLENEVRCEAQVGRASARGQTFVFEGFPNPHQHPLSDSNMFLVKFKPENILNKNHNNYMFKYQFINHLITL

SEQ ID NO: 172700 - protein, 295 aa, Glycine max
  Coding DNA Sequence Number=SeqID_55922
  Gene Ontology: Mol. function=galactosyltransferase activity; Cellular component=membrane; Biological process=protein amino acid glycosylation
  Homolog annotation: Hit_ID=Q7FN01; Match level="QueryCoverage=95%, HitCoverage=75%, E-value=2e-80, Identity=56%"; Hit description=Beta 1,3-glycosyltransferase-like protein II
  Pfam annotation: Domain name=Galactosyl_T; Domain location=173-295; Score=-58.5; E_value=0.011; Accession=PF01762.12; Description =Galactosyltransferase
  Subcellular localization annotation: CTP_CleavageSite=53; ConfidenceScore=5.20e-01
METLPTTTTKRGGARSKPVQTSKSSLVMAFFSCVAWLYVAGRLWQDAENRNLLASLLKKNSAQRPKVLTVEDKLMVLGCRDLERRIVEAEMELTLAKSQGYLKGQGQRSGSSDRRLLAVIGVYTGFGSKLKRNVFRGSWMPRESVRIGLVREWVGRIRIKFICDADFEYFLGDALKKLEERGVVIRFVIGRSANRGDSLDRNIDEENRTTKDFLILEGHEEAQEELPKKVKTFFSTAVQNWDADFYVKVDDGIDIDLEGLIELLDRRRGQDGAYVGCMKSGEVISEEYFLYLSLL

SEQ ID NO: 172701 - protein, 66 aa, Glycine max
  Coding DNA Sequence Number=SeqID_55923
MLFFIQAFIIHRLGLYFDLQYFEDMVLEGSWDEELVNLMLVNDCHKALDILLKDLKVFAQRNEGMS

SEQ ID NO: 172702 - protein, 231 aa, Glycine max
  Coding DNA Sequence Number=SeqID_55924
  Gene Ontology: Cellular component=membrane
  Homolog annotation: Hit_ID=Q653X2; Match level="QueryCoverage=70%, HitCoverage=36%, E-value=2e-07, Identity=23%"; Hit description =Solute carrier family 35, member F5-like
  Pfam annotation: Domain name=DUF6; Domain location=17-217; Score=5.4; E_value=0.033; Accession=PF00892.11; Description=Integral membrane protein DUF6
MGWRYKAGLFLILTVVVIWVTSAEVTQDIFIDYKQPFAVTYLGASLMVVYLPVAFIKDWLYKLFKHCSSKSGRSAKVGDDFSVTCTSPLKGNGVQKTTEVELGSMTRKDSDANLSVQEQVKPLVAKYNDATAIKAEKELTTREIATYGFYIAPIWFITEYLSNAALARTSVASTTVLSSTSGLFTLFIGVFLGQDNLNVSKVVAVLVSMSGVVMTTLGKTWAADDALSSAS

SEQ ID NO: 172703 - protein, 322 aa, Glycine max
  Coding DNA Sequence Number=SeqID_55925
  Gene Ontology: Mol. function=transaminase activity; Biological process=metabolic process
  Homolog annotation: Hit_ID=Q1STG7; Match level="QueryCoverage=80%, HitCoverage=47%, E-value=1e-114, Identity=77%"; Hit description =Aminotransferase, class IV
  Pfam annotation: Domain name=Aminotran_4; Domain location=129-322; Score=-83.4; E_value=6e-05; Accession=PF01063.9; Description =Aminotransferase class IV
LVCIYNELCEIGKPPPVVDAAELQQDPEATLRALFNDLEIPFQPAMLNWEAGPKPIDGLWAPWWYKTVHKSTGFKEENKYPQIKSHKKIRYLEVGSKILAEEAIPSRHSLTYSSDLPVPANEKLLAWVGNEIVPRESAKVSVFDSVVQGGDSVWEGLRVYNGKIFKLEEHLDRMFDSAKALAFENVPTRDKIKEAIFKTLIRNGMFDNSHIRLSLTRGKKVTSGMSPALNLYGCTLIVLAEWKPPVYDNEHGIVLVTATTRRNSPNASSSVAATSPTTSALAACRMRSPSSATFASLPATARCSLTAVSSSMTMSPSSGSRR

SEQ ID NO: 172704 - protein, 120 aa, Glycine max
  Coding DNA Sequence Number=SeqID_55926
  Gene Ontology: Mol. function=branched-chain-amino-acid transaminase activity; Biological process=branched chain family amino acid metabolic process
  Homolog annotation: Hit_ID=Q84L60; Match level="QueryCoverage=69%, HitCoverage=15%, E-value=2e-37, Identity=91%"; Hit description =Branched-chain amino acid aminotransferase-like protein
MLYSKLAFKNLDSKIHHNNLLNNILAKLITKKSLFLLQIEGNNAKADDAIMLDKDGYVSETNATNMFIVKRGRVLTPHADYCLPGITRATVMDLVVKEQFILEERRISLSEVHTADEVYL

SEQ ID NO: 172705 - protein, 319 aa, Glycine max
  Coding DNA Sequence Number=SeqID_55927
  Gene Ontology: Mol. function=transcription regulator activity; Cellular component=nucleus; Biological process=regulation of transcription
  Homolog annotation: Hit_ID=Q1RUX8; Match level="QueryCoverage=99%, HitCoverage=96%, E-value=1e-103, Identity=62%"; Hit description =Helix-loop-helix DNA-binding domain, putative
  Pfam annotation: Domain name=HLH; Domain location=119-170; Score =57.8; E_value=3.7e-14; Accession=PF00010.16; Description=Helix-loop -helix DNA-binding domain
MALEAVVFPQSQDPFGSGYGSVNTKDFYNYTLLAATYEQQHINKEEEQGGASISTFQPETSNYPYGDWTTSSSSSMLPHLNNELQETTTTTSNTLDSLNTRPKRRRAKSRKNKEEIENQRMTHIVVERNRRKQMNEYLSVLRSLMPDSYIQRGDQASIIGGAVNFVKELEQRLHFLGAQKEGEGKSDDGGATNMPFSEFFTFPQYSTGGGGGSDNSAAIGEDVSEVKCGIADIEVTMVESHANLKIRSKKCPKQLLKLVSGLHTVRLTILHLNVTTTGEVVLYSLSVKVEDDCKLGSVDDIAAAVYQMLDRIQQEAMLN

SEQ ID NO: 172706 - protein, 80 aa, Glycine max
  Coding DNA Sequence Number=SeqID_55928
  Gene Ontology: Mol. function=catalytic activity; Biological process =metabolic process
  Homolog annotation: Hit_ID=Q9ASR4; Match level="QueryCoverage=100%, HitCoverage=14%, E-value=3e-32, Identity=83%"; Hit description =Branched-chain-amino-acid aminotransferase-like protein 2
MEVIHLWSAPRSLSTTVMYSFAQRDDIEVLDEPLYANFLRVTAVHRPYKEELLSKMESDGNKVVKDIIYRPGNSKYRFCK

SEQ ID NO: 172707 - protein, 44 aa, Glycine max
  Coding DNA Sequence Number=SeqID_55929
MMVERSYVCGAFKVEVARAREGWSHNSGSGWGLGEKKMGGLGSG

SEQ ID NO: 172708 - protein, 125 aa, Glycine max
  Coding DNA Sequence Number=SeqID_55930
EYVEKQRKVVQVQRHFMLRRPIQRYDLLYMVMHSLWLRRLNLRVLASEANWEGVEVGVSLSEANALSEYHPLSEASARLASQRNLEGNLPRKHAPSAPSARLAIRLFLLALSVPSSLSQSSLTHA

SEQ ID NO: 172709 - protein, 367 aa, Glycine max
  Coding DNA Sequence Number=SeqID_55931
  Gene Ontology: Mol. function=hydrolase activity, acting on ester bonds; Cellular component=cellular_component; Biological process =lipid metabolic process
  Homolog annotation: Hit_ID=Q2HTP0; Match level="QueryCoverage=97%, HitCoverage=96%, E-value=1e-155, Identity=71%"; Hit description =Lipolytic enzyme, G-D-S-L
  Pfam annotation: Domain name=Lipase_GDSL; Domain location=31-349; Score=317.8; E_value=2e-92; Accession=PF00657.12; Description=GDSL -like LipaseAcylhydrolase
MDSKNVVAFQVVTFCICLAVANSVEFSYPAVFNFGDSNSDTGELAAGMGFLVVPPYGKNYFKTPSGRFCDGRLIVDFLMDAMKLPFLNAYMDSVGLPNFQHGCNFAAAGSTILPATATSISPFGFGVQENYHNKVSGKKFDQYVPTEDYFEKGLYMFDIGQNDLAGAFYSKTLDQILASIPTILLEFETGIKKLYDSGARNFWIHNTGPLGCLPQIVAKFGTNPSKLDELGCVSSLNQAATAFNIQLQSFCSKFKGQYPDANVTHVDIFTIKSNLIANYSKYGFEQPIMACCGYGGPPLNFDSRVSCGLTKILNGTTITAKGCNDSSVYVNWDGTHYTEAANQYVASQVLTGNYSNTLLGDKIPFLL

SEQ ID NO: 172710 - protein, 344 aa, Glycine max
  Coding DNA Sequence Number=SeqID_55932
  Gene Ontology: Mol. function=transferase activity; Cellular component= membrane; Biological process=metabolic process
  Homolog annotation: Hit_ID=Q1S2I4; Match level="QueryCoverage=98%, HitCoverage=87%, E-value=1e-178, Identity=87%"; Hit description =Exostosin-like
  Pfam annotation: Domain name=Exostosin; Domain location=16-308; Score= 249.9; E_value=5.4e-72; Accession=PF03016.6; Description=Exostosin family
MANIMSYLEMEKIFKVYVYPDGDLPIAHDGPCKDIYSIEGRFLHEMEHGAGRFRTNDPNAAHVYFLPFSVTWMVKYLYTPLSFNVTPLKQFVSDYVRVISTRHPFWNITHGADHFMLACHDWGPHASQGNPFLYNTSIRVLCNANTSEGFNPRKDVSLPEIHLYGGEVSPKLLSPPPDTAPRRYLAFFSGGLHGPIRPALLRHWKNDNDDDIRVYEYLPKDLDYYSFMLNSKFCLCPSGHEVASPRIVEAIYAECVPVILSEYYVLPFSDVLQWEAFSVQVDVSDIPRLKEILSAISEDKYRKLKEGVKAVRGHFTLNRPAKRFDVFHMILHSIWLRRLNIKLR

SEQ ID NO: 172711 - protein, 383 aa, Glycine max
  Coding DNA Sequence Number=SeqID_55933
  Gene Ontology: Mol. function=pyridoxal phosphate binding; Biological process=biosynthetic process
  Homolog annotation: Hit_ID=Q75IY1; Match level="QueryCoverage=83%, HitCoverage=67%, E-value=9e-78, Identity=47%"; Hit description =Putative ACT domain containing protein, ACR4, with alternative splicing forms
  Pfam annotation: Domain name=ACT; Domain location=195-266; Score =19.5; E_value=0.012; Accession=PF01842.15; Description=ACT domain
  Pfam annotation: Domain name=ACT; Domain location=273-340; Score =25.9; E_value=0.00015; Accession=PF01842.15; Description=ACT domain
  Pfam annotation: Domain name=ACT; Domain location=51-123; Score=39.7; E_value=1e-08; Accession=PF01842.15; Description=ACT domain
  Pfam module annotation: Pfam domain module=ACT::ACT::ACT; Domain location=195-266::273-340::51-123
  Subcellular localization annotation: CTP_CleavageSite=68; ConfidenceScore=5.45e-01
MQAIGRSRASSPSQQHSNNNNNNSVFTTMTNYKTYSKRLLPLLPNPNDQHTAIEMTGADRPGLFSEISAALADLHCNIVEAHAWSHNARLACVAYISDQSTDTAIDDPSRLASIEDHLTTVLRATTNPNGGGGANHPDVKTSELLGGEGQMTTVERRLHQLMLSVRDFETPSSPKEKKGRKRMVSVESCEQKGYSIVSIECKDRPRLMFDTVCTLTDMQYVIFHASITSHAGYACQEYFIRHVDGCALDTASEKERVMKCLEAAIERRVCEGIRLELCADNRVGLLSDITRVLRENGLVVVRADVETHGEKSVNAFYVRDISGNEVDIEYFSNSVKKEMGPIATLHVKNDTNRRKPNSPKQAPLSFGGMLRSRIERFSHGFIL

SEQ ID NO: 172712 - protein, 220 aa, Glycine max
  Coding DNA Sequence Number=SeqID_55934
  Gene Ontology: Mol. function=protein translocase activity; Cellular component=mitochondrial inner membrane presequence translocase complex; Biological process=intracellular protein transport
MYRFPLSFRIFLQHSKHISISIGRPHENCPSFNNLYMLDGQQISISSPGFIYESYEPREKIPFGKRWFTRSGWRRTKNDIILELKSAYAIAKLRKKGYSKNQFYNEAANMYKESSMCFIISVSQDSATFAKLAGMPTSLLLGLMFVGVALFPTDKINTLIAKGDKRTLRKAVTENMFSIGVDRKDLNKTFIQLTLEILAKQKFEAYDSKGSVVAGDKSKE

SEQ ID NO: 172713 - protein, 144 aa, Glycine max
  Coding DNA Sequence Number=SeqID_55935
MEIPRKYHFSPILSLILLSLIIVVLVLRSRQLLEFAPIATGSKPPYSVPLDRLRTKLSGENPLHAVGNSGELRRNKFRNRTATRKVGKLEQRLAAARAAMRKVASESEDERGNLSVANTARDGDGDHRYVPAGAIYRNARLFYR

SEQ ID NO: 172714 - protein, 245 aa, Glycine max
  Coding DNA Sequence Number=SeqID_55936
MTNHNYKLHPNSPPTIMHMHVPDSPPPPNQIGFIEDVGEGIEGLVTCTKSLASFQSIDVSGEIDDNDNNDDEEDEDNCWRKTRVAEGRGNFPPPLSSLNGNGQPSFILVPVRKNGRLQLTKVRIKRPKILYATRQDGRLRLLLVPDQCVEDNAQEEEHEQELVDDTEEEDMRLVESMGEEEEDDEVVEEIISYDSEEKDVRIGELKFPNERSRKCHEVLNHIQSHHHHGHGSHHHHLHMYGFSIA

SEQ ID NO: 172715 - protein, 449 aa, Glycine max
  Coding DNA Sequence Number=SeqID_55937
  Gene Ontology: Mol. function=protein serine/threonine kinase activity; Cellular component=cytoplasm; Biological process=protein amino acid phosphorylation
  Homolog annotation: Hit_ID=Q8RXC8; Match level="QueryCoverage=58%, HitCoverage=57%, E-value=1e-105, Identity=68%"; Hit description =Putative serine/threonine protein kinase
  Pfam annotation: Domain name=Pkinase; Domain location=166-442; Score =102.6; E_value=1.2e-27; Accession=PF00069.15; Description=Protein kinase domain
  Pfam annotation: Domain name=Pkinase_Tyr; Domain location=166-435; Score=94.7; E_value=2.8e-25; Accession=PF07714.7; Description =Protein tyrosine kinase
  Pfam module annotation: Pfam domain module=Pkinase::Pkinase_Tyr; Domain location=166-442::166-435
MANHKLDYHLWDKKKNQANKSKKKLTIAEALNFESHMQHANPNPNPNTNTNTNANSRSKRATKRQASLFSCYSSAHDLRHLELEKEKEDSSSPREVLEAFMKDFVDSHHEQSHESETTSSTTKTHYHWTKFFKLWKKKSFKRLGSIPPLSVPKLPKWKSKSSRENQALKNIIGRGGFAEVYKGCLQNGQLIAVKKLTKGTTDEKTAGFLCELGVIAHVDHPNTAKLVGCCVEGEMLLVFQLSTLGSLGSLLHGSDKNKLDWSKRYKICLGIADGLLYLHECCHRRIIHRDIKAENILLTENFEPQICDFGLAKWLPEQWTHHNVSKFEGTFGYFAPEYFMHGIVDEKTDVFSFGVLLLEIITGRPAVDHMQQSVVIWAKPLLDKNHIKDLVDPSLGDDYERGQLSCVVLTASMCIEHSPIFRPRMSQASTPRPRLMHIISSFKLKLPSY

SEQ ID NO: 172716 - protein, 791 aa, Glycine max
  Coding DNA Sequence Number=SeqID_55938
  Homolog annotation: Hit_ID=Q9H6U6-2; Match level="QueryCoverage=45%, HitCoverage=34%, E-value=5e-27, Identity=27%"; Hit description =Isoform 1 of Q9H6U6
MQPVPEISEGCEGFRASHPLLLVVACDKSKIPGKMLNVRDGHNETQAENIVSSATAVRFYSLRSHTYVHALRFRSTVYMVRCSPRIVAVGLATQIYCFDALTLENKFSVLTYPVPQLGGQGMIGVNIGYGPMAVGPRWLAYASNSSLLSNTGRLSPQSLTPPAVSPSTSPSSGNPVARYAMESSKNLAAGLINLSDMGYKTLSKYYQDLIPDGSCSPVSSNSSWKVSRFASNSTETDPAGMVVVKDFVSRAVVAQFRAHTSPISALCFDPSGTLLVTASIHGNNINIFRIMPSCSRNGSGSQSSDWSYSHVHLYKLHRGMTSAVIQDICFSHYSQWVAIISSKGTCHIFVLAPFGGETVLKMHDQDTDGPALLPIFPLPWWFTPHFTVNQQQYCLTPPPPVVLSVVSRIKNSNAGWLNTVSNAASSAAGKVSIPSGAVSAVFHSSIPYNSHNAYSKIHAMEHLLVYTPSGHLIQYKLLPPLVAEPSETASRTAPVPSAQIQEEDLRVKVEPVQWWDVCRRYDWPEKEVGILGNTVVRLEAVEMILDSSDYEDNNSVGNNNSIKLNNEQCHFSNVEVHISSGRIPIWQESEVSFFVMSHSEAGELNLCELNTSGEIEIENIPVNEIEIKQKDLLPIFDHFHRIQSTWGDRGIVMGRCSSSSSDSHGTEEKLSEDAAIFHSKLMVPGLAEKTFVDGASAKLKSSKHEKAGDSFNSSLSGCDLNMNVTREESISDSPDFEQCFQEGYCKASVDCRESTEVITDVDCSSPCGREKSDEDGDNDDMLGDVFDFSEE

SEQ ID NO: 172717 - protein, 128 aa, Glycine max
  Coding DNA Sequence Number=SeqID_55939
  Gene Ontology: Mol. function=chromatin binding; Cellular component =chromatin; Biological process=chromatin assembly or disassembly
  Homolog annotation: Hit_ID=Q1T2D5; Match level="QueryCoverage=79%, HitCoverage=6%, E-value=5e-21, Identity=51%"; Hit description=Chromo
MMTSFATSLRPCNRTKTPNLVTLIGVVCFSTKEVFSGGSWGLLQPLNIPNQIWEEFSMDFITRLPKSKGYTAILVVVDCLLKYSNFIPLKHHYIAKTLAEIFTMEVICLHGVMASILSDKDPIFASGF

SEQ ID NO: 172718 - protein, 90 aa, Glycine max
  Coding DNA Sequence Number=SeqID_55940
  Gene Ontology: Mol. function=ATP-dependent helicase activity; Cellular component=nucleus; Biological process=rRNA processing
  Homolog annotation: Hit_ID=Q7FGZ2; Match level="QueryCoverage=79%, HitCoverage=14%, E-value=7e-23, Identity=73%"; Hit description=DEAD -box ATP-dependent RNA helicase 1
MGISKLFPVQVALWQETVGPGDFERDLCTNSPTGSGKTLAYALPIVQNLSTDTDGRLRALVVISTRDLALQLWHVVYVGGDIRLKKKKLY

SEQ ID NO: 172719 - protein, 189 aa, Glycine max
  Coding DNA Sequence Number=SeqID_55941
  Gene Ontology: Mol. function=ATP-dependent helicase activity; Cellular component=nucleus; Biological process=rRNA processing
  Homolog annotation: Hit_ID=Q7FGZ2; Match level="QueryCoverage=89%, HitCoverage=38%, E-value=5e-38, Identity=47%"; Hit description=DEAD -box ATP-dependent RNA helicase 1
  Pfam annotation: Domain name=DEAD; Domain location=54-189; Score =14.2; E_value=3.5e-07; Accession=PF00270.19; Description=DEADDEAH box helicase
MEEEKQQPSVAVVPWMRHPVDITRCQELPVCSVPLMKRRLQSVLEENMGISKLFPVQVTLWQETIGPGDFEQDLCIKSPIGSGKTLAYALPIVKLVFDAFASLLGLHICLATGQSLLRHELSSLIYLPGEDDGPNPGFLSPLWFQSKVDILVATPERLVDHVNKLSLKHLCYVVVDEADRFKPASTNIL

SEQ ID NO: 172720 - protein, 216 aa, Glycine max
  Coding DNA Sequence Number=SeqID_55942
  Gene Ontology: Mol. function=ATP-dependent helicase activity; Cellular component=cytosol; Biological process=rRNA processing
  Homolog annotation: Hit_ID=Q7FGZ2; Match level="QueryCoverage=73%, HitCoverage=39%, E-value=2e-39, Identity=48%"; Hit description=DEAD -box ATP-dependent RNA helicase 1
  Pfam annotation: Domain name=DEAD; Domain location=23-182; Score =25.5; E_value=3.9e-08; Accession=PF00270.19; Description=DEADDEAH box helicase
MEEEKQQPSVVVLPWMRHPVDITRYQELPICSVPLMKRRLQSVLEKNMGISKLFPVQVKRVFDALASLLGLRICLATDQSSLRHKLSSLIYLPGEDDGQDPGFLSSLWFQSKVDILVVTPGRLVDHVNKLSLKHLRYLMVDEADRLLREDYQSWLPTVLKLTQSRLTKIVLSATLTRDPGRLAQLNLHHPLFLSTGKMRYRLPEYLECYKLVYDTA

SEQ ID NO: 172721 - protein, 298 aa, Glycine max
  Coding DNA Sequence Number=SeqID_55943
  Gene Ontology: Mol. function=ATP-dependent helicase activity; Cellular component=nucleus; Biological process=rRNA processing
  Homolog annotation: Hit_ID=Q7FGZ2; Match level="QueryCoverage=70%, HitCoverage=49%, E-value=5e-53, Identity=50%"; Hit description=DEAD -box ATP-dependent RNA helicase 1
  Pfam annotation: Domain name=DEAD; Domain location=51-208; Score= -8.3; E_value=2.8e-05; Accession=PF00270.19; Description=DEADDEAH box helicase
  Pfam annotation: Domain name=zf-CCCH; Domain location=57-82; Score =27.9; E_value=3.6e-05; Accession=PF00642.15; Description=Zinc finger C-x8-C-x5-C-x3-H type (and similar)
  Pfam module annotation: Pfam domain module=DEAD::zf-CCCH; Domain location=51-208::57-82
MPEKLHLASTTKPPGTLSCITPRRFCSVLGRIIRVDHVDKYKKKEEEDEETERQKREAHGVCRAFQIGECTRGASCKFSHDEQVKRVFDALASLLGLRIGLAAGQSSLRHEFSSLIFLPREDDGPNPGFLSSLWFQSKVNILVATLGRLVDHVNKLSLKHLRYLVVDEADRFLHEDYQSWLPTVIKLTQFGLAKIVLFAMLTRGPGRLAQLILHYLLFLSAGKMCYRLPEYLECYKLICERKVKPLYLVALLKSLGEEKCIVFTRFVESTHHLCKLLNFFGDLKIGIKEFSGLKHQQT

SEQ ID NO: 172722 - protein, 344 aa, Glycine max
  Coding DNA Sequence Number=SeqID_55944
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=91%, HitCoverage=69%, E-value=6e-78, Identity=51%"; Hit description =Putative CBL-interacting protein kinase 23
  Pfam annotation: Domain name=NAF; Domain location=230-292; Score =12.4; E_value=0.00028; Accession=PF03822.5; Description=NAF domain
  Pfam annotation: Domain name=Pkinase; Domain location=3-198; Score =84.6; E_value=3.1e-22; Accession=PF00069.15; Description=Protein kinase domain
  Pfam annotation: Domain name=Pkinase_Tyr; Domain location=1-199; Score=-117.4; E_value=2.9e-05; Accession=PF07714.7; Description =Protein tyrosine kinase
  Pfam module annotation: Pfam domain module=NAF::Pkinase::Pkinase_Tyr; Domain location=230-292::3-198::1-199
MATTARVYIVMELVIGGGPLLDKINFSRLPGRTSGMSETKARHYFHQLICAVDCCHRRGVIHRDLKQSNLLLDADGVLRVSDFGMSALPQQARQDGLLHSACGALDYIAPEVIRNRGYEGKKADIWSCGAILFHLVAGYVPFRNEYDDRNTKIRQILQADFICPSFFSSSLITLIRRILDPNPTTRITMNEIFENEWFMQNYQPPRFFRQNFSFGHRVDKGDEAGSSAPPVPVMNAFEILNTFLGYNLIIGKLLNQLVQLKRETRFISQNPVDEIIDGIERVAGIMGFDVKKINNFRMSIEGGANARRKGHLSIFTKFCRHIYAALSDFIWKGRAEPMDTETDG

SEQ ID NO: 172723 - protein, 561 aa, Glycine max
  Coding DNA Sequence Number=SeqID_55945
  Homolog annotation: Hit_ID=O04136; Match level="QueryCoverage=27%, HitCoverage=35%, E-value=5e-22, Identity=41%"; Hit description =Homeobox protein knotted-1-like 3
MQRSPFYRHYSGEDLITNEGCFYFLSNAEPLDTITNADIHFSHSLSVSLLSLVIGARVYRGFRFVPSSLLQQWRNLGEVVALPPVPFPAPLPPPTPVPPLARAPFLGPVLPRAPYRLPPPPPLPPEAPAAAALPRRGAEGTANLEIDETFHCYFKDCALLKYFSPAEYRDCAEDIAILEIAPKLPQLQPSPAEISFYGIGSFLLLLSQFYEGNQEVEELLKLYASEKYILMVNQQLEDLRFYVSFKVGATSVSVLRSVWHTFWLRVSPGEGTGATMSDDEDEQVGSDANLFDGALDGPDSMGFGPLIPTENERSLTERVRPEVKHELKQETCCALVTCWSWVRIRKQPLCICKGKAAYNIPPPYLRIAKSLWAMGYEVFICVIRRAREGSCIVATKTESNKVAGNAILYECVQTIMSIEDNGGLHVLAINILGRFLSNHDNNISTLSVHIAKFHYKSQKKHKKLSTVRGLRCLLQLGNNVLLQSNDLIQESIVFRAFLLAAGIPNKDVLLRKKRARILKPAFTVIRDKESKCLLVFIRGTQSLKDTLTEAIGAPVSFNHFI

SEQ ID NO: 172724 - protein, 218 aa, Glycine max
  Coding DNA Sequence Number=SeqID_55946
  Gene Ontology: Biological process=lipid metabolic process
  Homolog annotation: Hit_ID=O80959; Match level="QueryCoverage=83%, HitCoverage=41%, E-value=1e-28, Identity=41%"; Hit description =Similar to latex allergen from Hevea brasiliensis
MMSLSKILMATPRPVVTSLASLTMAEVAKPSMRYKCKFLFDYDDPKLWFPEQIPPKSESQTPTATAALDCVSAGKNQHDKICILAIDDGGMREILIGKALTYSEATLKKKSNDQNATITDYFDVAIEKGNKFYHAEGGASNRKFLKRLLSGGGFGLVLSVTAGLEKAVKEAFTAESGGGSSTLKDTLKPILILCYDLSSIAPFLFSRADTLKMDSFDF

SEQ ID NO: 172725 - protein, 167 aa, Glycine max
  Coding DNA Sequence Number=SeqID_55947
MAFLGETSSQTVVNSTLDDADVNTMLMCNHEFSFVGPIELLCSIARTPDGILNLLQATITPTHDALLYYNGRWNMSRQNEFVGYSFTGKNLKKFDIPSGFTMDELKDLIKQVAPTGIPPYGIDETQMVLIESSYWKKIEPIEILVVFSKPVPKMEETSCPCRKINMS

SEQ ID NO: 172726 - protein, 119 aa, Glycine max
  Coding DNA Sequence Number=SeqID_55948
MENFVYANSIRYEIRSSAASILSGTSFLDVYFIFKNLYLCDGYLNGSEMYSFFRNCATTRKLAFIDPHYIIEPPSQANTPHTLVLFTNFTGSSTIDLNLELVESDSTAKTHEVVTAKTL

SEQ ID NO: 172727 - protein, 93 aa, Glycine max
  Coding DNA Sequence Number=SeqID_55949
MDQILTFMSKGLLLCQKVFYCIEGSSLMVPCQILWPRRVVQNMWIYGLEGTWLDASGVLLMQSYPARALDRRLQEDWARDAREGPRVDFGSMG

SEQ ID NO: 172728 - protein, 286 aa, Glycine max
  Coding DNA Sequence Number=SeqID_55950
  Gene Ontology: Mol. function=RNA-directed DNA polymerase activity; Biological process=RNA-dependent DNA replication
MEQSTKHHNKDIRVEDQTDVPSVCENDHLREAYWSWQPEANPPKGGKVELTAVGLPRATNLSATFPSNWKNLTIEKYGGTIDPNEHLDVLITQVSLYTTDDEILCQFATSRPHHLTFVALVNIQQEKREPLWTFMEHFRKAEYKNQVHDSNKACNDGLGRKLSSHAKESQHPTKSRLLKMWPISPQSWSLDEGIHYLKSQNGRAYQAWPPKEAEELKFLEGERGKTPKPIEADHKHHRWRFHGGKAIDPVQDDPMVISVEITNYIVKKTLVDQGSSTNILFWNTFK

SEQ ID NO: 172729 - protein, 382 aa, Glycine max
  Coding DNA Sequence Number=SeqID_55951
  Gene Ontology: Mol. function=protein kinase activity; Cellular component=cytoplasm; Biological process=protein amino acid phosphorylation
  Homolog annotation: Hit_ID=Q10R62; Match level="QueryCoverage=81%, HitCoverage=73%, E-value=1e-116, Identity=64%"; Hit description =Serine/threonine-protein kinase NAK, putative, expressed
  Pfam annotation: Domain name=Pkinase; Domain location=72-353; Score =161.2; E_value=2.7e-45; Accession=PF00069.15; Description=Protein kinase domain
  Pfam annotation: Domain name=Pkinase_Tyr; Domain location=72-353; Score=147.6; E_value=3.4e-41; Accession=PF07714.7; Description =Protein tyrosine kinase
  Pfam module annotation: Pfam domain module=Pkinase::Pkinase_Tyr; Domain location=72-353::72-353
  Subcellular localization annotation: CTP_CleavageSite=40; ConfidenceScore=5.69e-01
MGNACAKGKPVAHVSSSNFSGGKKHASRPKQYSNSSEQLSAPITSELNVPKSFSSNLKSFSLNDLKEATKNFRQENLIGEGGFGRVFKGWIDENTYGPTKPGTGIVVAIKNLKPESFQGHKEWLQEVNYLGQLQHENLVKLIGYCLEGKNRLLVYEFMQKGSLENHLFRKGVQPMAWVTRVNIAIGVARGLTLLHSLDQNVIFRDLKASNILLDSDFNAKLSDFGLARDGPTGDNTHVSTRVLGTQGYAAPEYVATGHLTPRSDVYSYGVVLLELLTGRRAVEDDRPGFSEETLVDWAKPFLSDNRRVLRIMDTKLGGQYSKKGAQAAAALALQCLNIDPKFRPPMVEVLAALEALNSSNSFTRTPKHESHATKQSGGPSQK

SEQ ID NO: 172730 - protein, 76 aa, Glycine max
  Coding DNA Sequence Number=SeqID_55952
MEKRDSSWMCIWIDTANGAWSHNIYMEHGIFVGWVRVEDEDTKEDLILEDSKEDPEEDLEEDLKHDPEEDPSKGSP

SEQ ID NO: 172731 - protein, 227 aa, Glycine max
  Coding DNA Sequence Number=SeqID_55953
VPTIKAELQRLTEDNNTLRMMLQVLSSNTTYVSYKQQSETRFDFMEDKADLIIGNYTDGKLVSSLMASRARVTRGHNVKSLTERMAEEQRKVPQTEGMQARRGFTSFNFNICNTTRVPRSKAIVDFIVPNYKTVTTRMNDGCFFCTYPAWEAPAELTTSCMCDKWQVLEESANLIGDFTFELQDAIPVSALTAAGSGSSSSVRQQQQQCRASHRCRETPLPLAFPAS

SEQ ID NO: 172732 - protein, 573 aa, Glycine max
  Coding DNA Sequence Number=SeqID_55954
  Gene Ontology: Mol. function=ATP-dependent helicase activity; Cellular component=nucleus; Biological process=rRNA processing
  Homolog annotation: Hit_ID=Q7FGZ2; Match level="QueryCoverage=69%, HitCoverage=85%, E-value=1e-133, Identity=57%"; Hit description=DEAD- box ATP-dependent RNA helicase 1
  Pfam annotation: Domain name=DEAD; Domain location=208-397; Score =154.3; E_value=3.2e-43; Accession=PF00270.19; Description=DEADDEAH box helicase
  Pfam annotation: Domain name=Helicase_C; Domain location=468-544; Score=82.7; E_value=1.1e-21; Accession=PF00271.21; Description =Helicase conserved C-terminal domain
  Pfam annotation: Domain name=RRM_1; Domain location=38-109; Score =102.6; E_value=1.1e-27; Accession=PF00076.12; Description=RNA recognition motif. (a.k.a. RRM, R
  Pfam annotation: Domain name=ResIII; Domain location=204-392; Score =13.0; E_value=3.7e-06; Accession=PF04851.6; Description=Type III restriction enzyme, res subunit
  Pfam annotation: Domain name=zf-CCCH; Domain location=131-156; Score =28.2; E_value=2.8e-05; Accession=PF00642.15; Description=Zinc finger C-x8-C-x5-C-x3-H type (and similar)
  Pfam module annotation: Pfam domain module=DEAD::Helicase_C::RRM _1::ResIII::zf-CCCH; Domain location=208-397::468-544::38-109::204 -392::131-156
MNPLTLVKRTQNINAREAALGIGDQASWHTKYKDSAYVFVGGIPFNLTEGDLLAVFAKYGEVVDVNLVRDKGTGKSKGFAFLAYEDQRSTNLAVDNLNGAQVLGRIIRVDHVDKYKKKEEEDKETEQQKREARGVCRAFQRGECTQGASCKFSHDEQACLIHTLAVLPWMRHPVDITRCQELPVCSVPLMKRRLQSVLEENMGISKLFPVQVALWQETVGPGDFERDLCINSPTGSGKTLAYALPIVQNLSTDTGGRLRALIVVPTRDLALQVKCVFDTLASPLGLRIGLAAGQSSLRHELSSLIYLPGEDDGPDPGFLSPLWFQSKVDILVATPGRLVDHVNKLSLKHLRYLVVDEADRLLREDYQSWLPTVLKLTQSRLAKIVLSATLTRDPGRLAQLNLHHPLFLSAGKMRYRLPEYLECYKLICERKVKPLYLVALLKSLGEEKCIVFTRSVESTHHLCKLLNCFGDLKIGIKEFSGLKHQRVRSKTVGEFRRGEFQVLVSSDAMTRGMDVEGVRNVINYDMPKYTKTYVHRAGRTARAGQTGRCFTLMSKDEIQPYAFEPKKEATMSL

SEQ ID NO: 172733 - protein, 313 aa, Glycine max
  Coding DNA Sequence Number=SeqID_55955
MEFILIQTIEYDQHPQPPGRSIQDCQNVSSVAGNSSNLGTANVIQDYNAYTSYRSSSNPYGYGSMGYSGYYNNYQQQPNHTYSQPVGAYQNTGAPYQPISSFQNTGSYAGSASYSSTYYNSADYQTTGGYHNSSGYGNQATMWNSGSYFSHPTGNNSTDEVSSTLGTNSTNEVPSSSISPEPIATTFLPAYTDHLPSQPVVCSNPVIFTPAPPTLVHSNTKSHTLLVRLDNTHPIYTREKVGIIKPTLFVTHAEPKNTMSALPNPTWHEPKYTKSALCLLLTQSKYIRYLLAKTTMDKANFVSSPMVGGYKLT

SEQ ID NO: 172734 - protein, 79 aa, Glycine max
  Coding DNA Sequence Number=SeqID_55956
MAPKKLPSKRARKTATGEGSSTAPPVEIEFNGCRFRSLLRKELWISAPKCGANGFLMRKDNNANTLREEVNLQVWMKRL

SEQ ID NO: 172735 - protein, 95 aa, Glycine max
  Coding DNA Sequence Number=SeqID_55957
MAEALSLLLQLNNQLSLPCLHHPQLFLHLLGQLLEHLQPNDACMCAFGAPSSASGLRWTPRMVASAEVVVVHLLLADVADRVLVVVPVLACNIFQ

SEQ ID NO: 172736 - protein, 136 aa, Glycine max
  Coding DNA Sequence Number=SeqID_55958
MFCWSRYKLVVKMEQNREKANFHFWDVVCVKIFGKTADECRQELIAEHYIQSVISTLGLQDEQCISNKSLAVGAASSSQQDCHPTPSLSQSSEYDPGNAAFVTPAKRTSDQQGSSQFDSDDFATYELSTNKHIKAE

SEQ ID NO: 172737 - protein, 172 aa, Glycine max
  Coding DNA Sequence Number=SeqID_55959
  Gene Ontology: Mol. function=helicase activity
  Homolog annotation: Hit_ID=Q1SN45; Match level="QueryCoverage=61%, HitCoverage=6%, E-value=4e-19, Identity=41%"; Hit description=AAA ATPase
MSTPNSSPCTAPHTTTGCQPTQIGMTSQHINSGRYTIFNSKLIEHISDDTDDKLNITQGDIVTGYMDIGDPIWQCKQCKAKMWYDERINKDKQTKNPKFSLCCGDGKIQLAILHDAPQPLRQLLFDSRDSQAKKFQQNIRLYNLMFAFTSPGVKVDTSYNTRKGPPTLRIHG

SEQ ID NO: 172738 - protein, 96 aa, Glycine max
  Coding DNA Sequence Number=SeqID_55960
  Gene Ontology: Mol. function=ATP binding; Cellular component =membrane; Biological process=defense response
  Homolog annotation: Hit_ID=Q2HS00; Match level="QueryCoverage=90%, HitCoverage=8%, E-value=3e-19, Identity=52%"; Hit description=TIR
MASYGAFGKEQPMLGYEFLSRSAIFYCKGSPLALKVMGASLQLRSKEAWENQFEKFQKTKNMKIHRILKSSYDDLEPSEKEIFFDIACFFKGEEIS

SEQ ID NO: 172739 - protein, 99 aa, Glycine max
  Coding DNA Sequence Number=SeqID_55961
MAPQREKTMMENGELPTMEKKEEEETSNGTANQLAGSHTVAKKGGRMSRGKKKSQLLGANVYMKILKNQKAEPPALVLNEVHGGCEPTHEREAALETCP

SEQ ID NO: 172740 - protein, 58 aa, Glycine max
  Coding DNA Sequence Number=SeqID_55962
  Homolog annotation: Hit_ID=Q8S8Z5; Match level="QueryCoverage=47%, HitCoverage=4%, E-value=2e-08, Identity=100%"; Hit description =Syringolide-induced protein B13-1-1
MGMGVVFEEGIERVGKLPSSIMGCGQTRAVQTLETRKLYAVFGHKARFSDQLIRDSPN

SEQ ID NO: 172741 - protein, 343 aa, Glycine max
  Coding DNA Sequence Number=SeqID_55963
  Gene Ontology: Mol. function=protein binding; Cellular component =ribonucleoprotein complex; Biological process=translation
  Homolog annotation: Hit_ID=P49199; Match level="QueryCoverage=53%, HitCoverage=84%, E-value=8e-78, Identity=79%"; Hit description=40S ribosomal protein S8
  Pfam annotation: Domain name=Ribosomal_S8e; Domain location=144-322; Score=262.2; E_value=1.1e-75; Accession=PF01201.12; Description =Ribosomal protein S8e
VDEEEGMVTKPCWCWVMDGWFEFDLLELATKALLSLLMQKNKVEDNIYGVCDYTMTDLVDSGVRGLKLLLVGHGNKEYLQRFYAQEACHWWQEEGMEEEEKFPNVVAESEGCVCIRFLVVLIGMMHMVDLGVAVLRVLVFVLLGEGERKGYELGRQPANTKLSSNKTVRRIRVRGGNVKWRALRLDTGNYSWGSEAVTRKTRILDVVYNASNNELVRTQTLVKSAIVQVDAAPFKQWYLQHYGVEIGRKKKTAAKKETAEEGAAAVAVEEAKKSNHLQRKLEKRQKDRKLDAHIEEQFGGGRLLACISSRPGQCGRADGYILEGKELEFYMKKLQKKKGKGAA

SEQ ID NO: 172742 - protein, 80 aa, Glycine max
  Coding DNA Sequence Number=SeqID_55964
MDRPKRLSPREKTSGVATNVYSRKTLEKTKRTKVCVFLKMRVRELFTHEEGCCPCSYVSSGAMRNSDLRSSLSLKVCVLH

SEQ ID NO: 172743 - protein, 173 aa, Glycine max
  Coding DNA Sequence Number=SeqID_55965
  Gene Ontology: Mol. function=transferase activity; Cellular component= membrane; Biological process=protein metabolic process
  Homolog annotation: Hit_ID=Q09HS1; Match level="QueryCoverage=82%, HitCoverage=21%, E-value=1e-59, Identity=74%"; Hit description =Cellulose synthase-like C3
MAQKVWILSGLLLELWNHNLHMAGMEGKDDLALVQARWAFVNKDENLLTRLQNINLSFHFEVEQQVNGIFMNFFGFNGTAGVWRIKALEESGGWLDRTTVEDMDIAVRAHLCGWKFVFLNDVKCLCELPETYEAYKKQQHRWHSGPMQLFRLCFLDILRSKVLNSTHVFFQFF

SEQ ID NO: 172744 - protein, 83 aa, Glycine max
  Coding DNA Sequence Number=SeqID_55966
MGRQKCILRICGSGKNIWKIAQARWATNENRWKKGLTEDYMCLMCGGRMNNVLHCICDCLHAKEIWNHMVPNFANLFFFAEDL

SEQ ID NO: 172745 - protein, 319 aa, Glycine max
  Coding DNA Sequence Number=SeqID_55967
  Homolog annotation: Hit_ID=Q1S8R9; Match level="QueryCoverage=42%, HitCoverage=25%, E-value=3e-48, Identity=83%"; Hit description=Beta -Ig-H3/fasciclin
MPLLNRSGCVISTPPTKTFAKEERNIKLLKITFTTEEYLRGGVVRVPMKRIGGYGDATAWTQGLDLSAESEFPEIIDGEEAGNDVFAEEVWNGAREACAERGVGGSEDSGRTGPGNGTSGSGVGERRRGRRELVEAEGAKGASNPSMVAVTLGLQSMAAKETAQRSANRREKDEFSMRASESESEGEGENGAVLRSSLREYWGSVLVSYVVVRAHNDNKNPLVGIGIGVVTACVMGLTALDADATRIEYYATVGEPFCEYNYVSLASVHYTARFADGIVFDSSYKRLDLSPCALVIKGLDQGILGGEGVGNANCRFLCT

SEQ ID NO: 172746 - protein, 169 aa, Glycine max
  Coding DNA Sequence Number=SeqID_55968
MAEEEAKEKKSKDLTLKPSIPSSNESDEENAKGFESENLTLLVRKFKKFLKKNNSKGRFFQQMNNFKKNDSTSPNFTYFECGKLNYIKYECSIHLKKQQGGEKKGRSYNKKKTREKNDTSSHSNNEEEENLCLMANGEVESVFLNAFNEMHEEAQKLSLANNFLKPHEG

SEQ ID NO: 172747 - protein, 444 aa, Glycine max
  Coding DNA Sequence Number=SeqID_55969
  Gene Ontology: Biological process=cell adhesion
  Homolog annotation: Hit_ID=Q1S8R9; Match level="QueryCoverage=99%, HitCoverage=100%, E-value=1e-165, Identity=68%"; Hit description =Beta-Ig-H3/fasciclin
MENSSFSRRFALLCAVSFAAILCSPKVTATIEGFEAPFAPSTPPPPPPDIHDHSFFSHTAILPPILSHLGFHELATAAPSLSDAATTGSVAWTGPSTIFAPSDASLRTCFSCSVPNLLREHIVPGLFTIDYLRKLAFGTKIETLSPGRCITVTSDTLHRNTNNTAAKVFVGGVEITQPDLFNNGMVVVHGLQGYVSPLSPFSCDVERMNSLSFPFHPDHRSGHAQHHLHHSNSATVQPAAMMRLMLRDAMLRLRNNGFGILALAMKVKYAELVTLNNMTVFAVDDLSIFSGSHAYIGNVRFHIVPNHYLSIADLEKLPVGTALPTLERGQSLLITTSGRGETLAPMRINYVRVKVADVIRNVKIVVHSVYLPFPHINPVAAAYDSILGGGEGASEGAGNIADSADQTTQGTCSVVDGRGSCVLPTMPDQVQVKPMVEIEDHHGL

SEQ ID NO: 172748 - protein, 443 aa, Glycine max
  Coding DNA Sequence Number=SeqID_55970
  Gene Ontology: Mol. function=transferase activity; Biological process= protein metabolic process
  Homolog annotation: Hit_ID=Q9M3I0; Match level="QueryCoverage=65%, HitCoverage=40%, E-value=4e-69, Identity=46%"; Hit description =Putative glucosyltransferase
MSRTPNYEFQEWWNKQREKNTNTNNLDPLDDNLKKLEYGHSSPPPFTALDVDSSTAANSATSDHDRSGRKERSRSARQLTWVCLLKFQQLAASLGWLSHGLLFLLRTAHRRITDSASFRGDTSRLYRAIRFFLITVLLLLGFELVAFFKGWHFSPPDPSDVLGVIGVVYAAWLDVRATYLSPPLQSLANLCTVLFIVQSVDRVILILGCFWIKFRRLKPVASVDYDGPGQSVEDFPMVLVQIPMCNEREAEILPYKHTIAPYGSTMARLPSQFAYGGWQQIRHAIPPLRGHSHYLGVMRVWMFAVTFLARLAQVYQQSIGAVCILDWPKERMLVQVLDDSDEVDTQQLIKAEVHKWQQRGVRIIYRHRLIRTGYKAGNLKSAMNCDYVKDYEFVAIFDADFQPTPDFLKKTVPYFKGSAFDYGSDLLQSLETENKVLEGDSMI

SEQ ID NO: 172749 - protein, 105 aa, Glycine max
  Coding DNA Sequence Number=SeqID_55971
MDHILHFLSLELLKELDMDALFVSQYLHLSFSHITPTPNLILQTLNLSPEVGRIDFKAMHNVLYAASPAAGPKTLASVINCLIRVVQFFERMERDYGMKGDHHNA

SEQ ID NO: 172750 - protein, 129 aa, Glycine max
  Coding DNA Sequence Number=SeqID_55972
  Homolog annotation: Hit_ID=Q1SJ57; Match level="QueryCoverage=30%, HitCoverage=11%, E-value=8e-10, Identity=75%"; Hit description =Possible metal-binding region in RNase L inhibitor, RLI
MVVNGHNQVCWLVTWAALYGNSLPGCGDNSGFNKVEALCTVQPFYHLRLAVLFSVFLVKVYKLKFAKISQVFSQTQFSGKNLLSNILLRVTTPESEDKIQNSSDSEDGLPPLEKNMNHLSIANSDEESE

SEQ ID NO: 172751 - protein, 101 aa, Glycine max
  Coding DNA Sequence Number=SeqID_55973
MTRGGNPGSLNHNIDFMTVFEGRLFYMGCLATTDVEWVGFYSGSKAETDVEWIGFYIGYQSTDVENERRSKTYCGEAIGGEQAKVVQGDLCTNYSHFESLA

SEQ ID NO: 172752 - protein, 298 aa, Glycine max
  Coding DNA Sequence Number=SeqID_55974
  Gene Ontology: Mol. function=protein serine/threonine kinase activity
  Homolog annotation: Hit_ID=Q9FJP7; Match level="QueryCoverage=85%, HitCoverage=56%, E-value=6e-81, Identity=61%"; Hit description =Genomic DNA, chromosome 5, P1 clone:MQN23
  Pfam annotation: Domain name=DUF618; Domain location=72-139; Score =116.0; E_value=1.1e-31; Accession=PF04818.4; Description=Protein of unknown function, DUF618
MASIAFLYVFFLRILLLLLSLSLFFYDLGPAVTPTIDQNNCHLEKALSHWCIFHRSKAELVVGTWNKQFHNSEKVQRVPLLYLANDILQNSKRKGNEFVTEFWKVLPTALKDVLEKGDDQEKRAVFRLVDIWEERRVFGSQAKSLKNVILGEEAPPQLEFNKKRSRSVRIVKKDSRSIKTKLSIGGTAEKIVSAFHTVLNEHSNEDAEMSKCKAAVHRVRKMEKNVDIACTVVKDPKRKTLSKELVEEENILKECIENLKLVEASRTSLVTRLKEALHEQASHYVHESELENVRTQIQ

SEQ ID NO: 172753 - protein, 52 aa, Glycine max
  Coding DNA Sequence Number=SeqID_55975
MVLSAPSRKFSIDKCTVSLELDRVGLDNCSARQSVQGSSFYYVVLIMLFKSS

SEQ ID NO: 172754 - protein, 110 aa, Glycine max
  Coding DNA Sequence Number=SeqID_55976
  Homolog annotation: Hit_ID=Q1SKD7; Match level="QueryCoverage=99%, HitCoverage=29%, E-value=6e-10, Identity=33%"; Hit description =Ankyrin
MAPKKLSTKRSRRDAAAEGFSATPEFDSHHFQSAEHQQRFEAIKGWSFHRERHVQLMEDEYTNFQEEIARRRWTSLVTPMAKFDLEIVLEFYANAWPTEEGVRDMRSWVR

SEQ ID NO: 172755 - protein, 91 aa, Glycine max
  Coding DNA Sequence Number=SeqID_55977
  Homolog annotation: Hit_ID=Q6GLE1; Match level="QueryCoverage=41%, HitCoverage=18%, E-value=1e-07, Identity=63%"; Hit description =Coiled-coil domain-containing protein 25
MGKLGLPDVFGKTVFDEFLVLVLVKAHEDGEIAGFGARFEVEHHRVALLRFDAHGKKERGAVRVPRPVLSSTQIKIRGGGLLSLSESLRKS

SEQ ID NO: 172756 - protein, 472 aa, Glycine max
  Coding DNA Sequence Number=SeqID_55978
  Gene Ontology: Mol. function=ATP-dependent peptidase activity; Cellular component=integral to membrane; Biological process=ATP -dependent proteolysis
  Homolog annotation: Hit_ID=Q6EQH5; Match level="QueryCoverage=90%, HitCoverage=89%, E-value=1e-151, Identity=62%"; Hit description =Membrane protein-like
  Pfam annotation: Domain name=DUF81; Domain location=80-440; Score= -3.9; E_value=2.2e-05; Accession=PF01925.9; Description=Domain of unknown function DUF81
MVEFGTRMGSIWTVLFCFASVFAIVSAERSIVKMEVPRFNVTSREPQQSFLTKALNFLWQSGESGYQHVWPDMEFGWEIVLGTFVGFCGAAFGSVGGVGGGGIFVPMLSLIIGFDPKSSTAISKCMIMGAAVSTVYYNLKLRHPTLNMPIIDYDLALLIQPMLMLGISIGVVFNVVFPDWIVTILLIVLFLGTSTKAFFKGVETWKKETIMKKEAAKRQESNGSGAVVEYKPLPSGPEKDTKEQEMSIIENVYWKEFGLLVFVWVSFLALQIAKENYTTTCSTLYWVLNLLQVPVSVGVTAYEAAALFSGRRVIASTGEQGKDFTVLQLMIYCVFGVLAGVVGGMLGLGGGFVMGPLFLELGVPPQVSSATATFAMTFSSSMSVIEYYLLKRFPVPYALYFILVATIAAFVGQHIVRKLIILFGRASLIIFILASTIFVSAVSLGGVGIVNMVHKIQNHEYMGFEDLCKYGS

SEQ ID NO: 172757 - protein, 319 aa, Glycine max
  Coding DNA Sequence Number=SeqID_55979
MPSLVDFRYVWNIFKLERGIGEFSVISERIKHVAQAQVEEASYMRKRLDDEDSSYKASTSTTSVTDVNTKSEAATKKSAAAIAAEVADKLTASTSSQLIMTSVLSTFAAEEAKSACLTSETMSKPEKSIPISDPNVFMTSQQLIATPNHSYPSVLVPQPTLQNPAAASQGQYQMLCNSSSQHYLQSTGGVISSYGYGSIAPLPLGPPPPHMVGPMVPLTHQTMQITQQLPTPIGQHQPIKMTQQAPAPPNFRPLQLPGMVYYGCRSTSTKQQSLCLSCGVTGKKVGTWRLYVDHRSSTKHAVRARLACMIVFDCRRSNI

SEQ ID NO: 172758 - protein, 141 aa, Glycine max
  Coding DNA Sequence Number=SeqID_55980
  Gene Ontology: Mol. function=protein serine/threonine kinase activity; Biological process=protein amino acid phosphorylation
  Homolog annotation: Hit_ID=Q49N12; Match level="QueryCoverage=92%, HitCoverage=13%, E-value=3e-31, Identity=55%"; Hit description =Putative receptor-like protein kinase 2
MNPRNNSHANRSKTQQSFNSFHINCGGERELSSEGIVYDPDLDPSGAATSKIMGSNWAFSNTGHFLDAQKPVSETYIQQQNKTGLSKLYQTARVSPISLTYYGFCLENGDYTVLLHFAEIMFTDDNTYSSLGRRIFDVYIQ

SEQ ID NO: 172759 - protein, 125 aa, Glycine max
  Coding DNA Sequence Number=SeqID_55981
  Homolog annotation: Hit_ID=Q1S979; Match level="QueryCoverage=44%, HitCoverage=9%, E-value=1e-13, Identity=63%"; Hit description =Leucine-rich repeat
MKDFNIANEAGGVGKNITRSFPAHVRNNSLIIRFYWAGKGTTAIPYGPLISAISVTHVSNDTNLLLLCNTCTETVSTTTSGSMSTGVIVGIVVAAIVLVILIVLGWRIYIGKRNSFGKGGFSRIK

SEQ ID NO: 172760 - protein, 243 aa, Glycine max
  Coding DNA Sequence Number=SeqID_55982
  Gene Ontology: Mol. function=zinc ion binding
  Homolog annotation: Hit_ID=Q2R1H8; Match level="QueryCoverage=70%, HitCoverage=54%, E-value=9e-51, Identity=60%"; Hit description=Zinc finger, C3HC4 type family protein, expressed
MAYFQISVIASLAYLVYQIDGYEKYWLRLVWGFGSELSFYYICGALVFFVLLGLSGCFITCSDPRIRSDLGQPCREICLCCCQPGVCADRHLHGTPYMYGTPYMSTDCNACCENCGTECCGCTCMRGSEDEAGLPLLFIMVLFFLCISGYNDRTTDMAASLSHTCEKDANKEIYFCGLDETQEPNAVTGFKGTVVLQLSHGPKIWKVYSRKGESGKRKVVGGEAIMLSENWVGLKAVEDGRWL

SEQ ID NO: 172761 - protein, 254 aa, Glycine max
  Coding DNA Sequence Number=SeqID_55983
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q8RZF8; Match level="QueryCoverage=88%, HitCoverage=56%, E-value=4e-67, Identity=53%"; Hit description =Lustrin A-like
  Pfam annotation: Domain name=DUF231; Domain location=193-254; Score= -63.8; E_value=0.022; Accession=PF03005.6; Description=Arabidopsis proteins of unknown function
MMFTLWLRPLIQTSVFLWVVASHSPQGCDFSQGKWVIDEASFHPLYDASRDCPFIGFDCLKNGRPDKEYLKYKWMPSGCDLPRFDGTKFLEKSTGKKIMFVGDSISNNMWQSLTCLLHIAVPNSNYTFTSQIQELSVFSIPEYRTSIMWLKNGFLVDLVHDKEKGRILKLDSISSGDQWKNVDVLIFNTYHWWTHTGQSQGWDYFQVGNELIKNMDHMEAFKIGLTTWAKWVDSNIDPSKTKVLFQGIAASHVE

SEQ ID NO: 172762 - protein, 227 aa, Glycine max
  Coding DNA Sequence Number=SeqID_55984
MRKDKVTSHNLPPQKKSQDSVRFGALKPGKTSSTSPEHFGPLDPDRRDTEHQNIEISEESEKEKERERRKNTQVLRPNARNFSANNRAVRAASQHVKCCVTGCPMRQPVFTGKSSFKSSSIDATRVKCLTRVIVLSNHGKKHNRKWSSTKKYLKGQLKDVDEVREYCLKKRELENTSASKDCTGGAPRLHWRGIDLTKREKIKKDGWRRWWHVAALMVPKKGGLGWR

SEQ ID NO: 172763 - protein, 266 aa, Glycine max
  Coding DNA Sequence Number=SeqID_55985
  Gene Ontology: Mol. function=oxidoreductase activity; Cellular component=membrane; Biological process=electron transport
  Homolog annotation: Hit_ID=Q2LAL2; Match level="QueryCoverage=98%, HitCoverage=60%, E-value=8e-66, Identity=48%"; Hit description =Cytochrome P450 monooxygenase CYP76O2
MDFVISSILLLLACITIHVLSNTITRKRNHNKLPPGPSPLTLLENLVELGKKPKQTLAKLARLHGPIMRLKLGQLTTIVISSPDIAKEVFQTHDLLFSNRTIPHSTSVHNHSHNSVAFLPISPLWRDLRKICNNQLFSHKSLDASQNLRRKKTQELLGDVHRSSLSGETEEYKVIVENLGRAIATPNLEDFFPMLKMVDPQGIRRRATTYVSKLFAIFDRLIDKRLEIGDGTNSDDMLDILLNISQEDGQKIDHKKIKHLFLDRSL

SEQ ID NO: 172764 - protein, 193 aa, Glycine max
  Coding DNA Sequence Number=SeqID_55986
  Gene Ontology: Mol. function=monooxygenase activity; Cellular component=membrane; Biological process=electron transport
  Homolog annotation: Hit_ID=Q1WCN9; Match level="QueryCoverage=97%, HitCoverage=52%, E-value=9e-80, Identity=71%"; Hit description =Cytochrome P450 monooxygenase CYP76X3
  Pfam annotation: Domain name=p450; Domain location=1-193; Score= -146.8; E_value=0.00027; Accession=PF00067.12; Description=Cytochrome P450
MDLIVAGTDTTSYTMEWAMAELINNPDTMSKAKRELEQTIGIGNPIEESDIARLPYLRAIIKETLRMHPGAPLLLPRKANVDVEINGYTIPQGAQIIINEWAIGRNPSVWENPNLFSPERFLGSEIDVKGRHFQLTPFGGGRRICPGLPLAIRMLHLMLGSLINGFDWKFQNGVNPDIDMGQPLRAVPFRINK

SEQ ID NO: 172765 - protein, 191 aa, Glycine max
  Coding DNA Sequence Number=SeqID_55987
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=92%, HitCoverage=41%, E-value=2e-83, Identity=83%"; Hit description =Pyridine nucleotide-disulphide oxidoreductase, class I; FAD -dependent pyridine ...
  Homolog annotation: Hit description=nucleotide-disulphide oxidoreductase
MLGKSTFGLSMWLLKWLPIRLVDRFLLMVSWLLLGDTSKLGLDRPRLGPLELKNLSGKTPVLDVGTLAKIKGGDIKVRPGIKRLKRQTVEFVDGRTENFDAIILATGYKSNVPYWLKEEDMFSKKDGYPRRPFPNGWKGRNGLYAVGFTKKGLLGASMDAKRIAEDIEQSWKAGANHRTTFARSHLPQPNS

SEQ ID NO: 172766 - protein, 244 aa, Glycine max
  Coding DNA Sequence Number=SeqID_55988
  Gene Ontology: Mol. function=GTP binding; Cellular component =intracellular; Biological process=cell division
  Homolog annotation: Hit_ID=Q8LBI3; Match level="QueryCoverage=93%, HitCoverage=71%, E-value=4e-97, Identity=75%"; Hit description =Putative GTP-binding protein
  Pfam annotation: Domain name=MMR_HSR1; Domain location=62-183; Score =112.7; E_value=1e-30; Accession=PF01926.13; Description=GTPase of unknown function
  Pfam annotation: Domain name=Miro; Domain location=63-183; Score=2.2; E_value=0.0034; Accession=PF08477.3; Description=Miro-like protein
  Pfam module annotation: Pfam domain module=MMR_HSR1::Miro; Domain location=62-183::63-183
  Subcellular localization annotation: CTP_CleavageSite=48; ConfidenceScore=5.25e-01
MVLLHLPRFPLYLVTLSPSLTLRAYSKTTLLRPPKSTLTASEPAEFVKSSVKTEDCPSDGLAEFALVGRSNVGKSSLLNSLVRRKKLALTSKKPGKTQCINHFRINNSWYLVDLPGYGYASAPHELRMDWEKFTKDYFLNRSTLVSVFLLIDASIPAKQIDLDYASWLGQNQIPMTLIFTKCDKRKKKKNGGKRPEENVNDFQDLIRGFFQSVPPWIMTSSVTNQGRDEILLHMAQLRNYWLKH

SEQ ID NO: 172767 - protein, 497 aa, Glycine max
  Coding DNA Sequence Number=SeqID_55989
  Gene Ontology: Mol. function=structural constituent of ribosome; Cellular component=intracellular; Biological process=translation
  Homolog annotation: Hit_ID=Q1RT07; Match level="QueryCoverage=78%, HitCoverage=100%, E-value=1e-150, Identity=68%"; Hit description =Ribosomal protein S5, eukaryotic and archaeal form
  Pfam annotation: Domain name=Ribosomal_S5; Domain location=339-405; Score=57.9; E_value=3.4e-14; Accession=PF00333.10; Description =Ribosomal protein S5, N-terminal domain
  Pfam annotation: Domain name=Ribosomal_S5_C; Domain location=415-488; Score=53.9; E_value=5.3e-13; Accession=PF03719.5; Description =Ribosomal protein S5, C-terminal domain
  Pfam module annotation: Pfam domain module=Ribosomal_S5::Ribosomal_S5_ C; Domain location=339-405::415-488
  Subcellular localization annotation: CTP_CleavageSite=60; ConfidenceScore=5.15e-01
MGYIHHGRTGLRHILRFRTATGVVSNSGRSQSRAAFPSHSPILGNVLFFSTGDKYLNEITAEVERDRRRERNERLRLGLDTADIDTESEQDYMGVGPLIAKLEKEMLKESPELNRYEEPTDSDDDSDEETKDEADKKMSDFEKKRDKHTDLLKNFIEAETLDDAFKCMTKIDNFENKHFRLRSEYRVIGELMNRLKVSTELKDKFVLQNKLNRALRLVRWKEAYDPDNPANYGVIQREQPTADAKEEAEFEKEKQKQIEEGDNADADDDDEQEFDDMKEKDNVLMAKLEAIDRKLEEKLAELEYTFGRKGKALEEEIKDLAEERNELTEQKRKPLYRKGFDTRLIDMNRTCKVTKGGQVVKYTAMVACGNYNGVIGFAKAKGPAVPVALQKAYEKCFQNLHYVERHEEHTIAHAVQTSYKKTKVYLWPAPTTTGMKAGRSVEAILHLAGLKNVKSKVIGSRNPHNTVKAVFKALNAIETPRDVQEKFGRTVVEKYLL

SEQ ID NO: 172768 - protein, 873 aa, Glycine max
  Coding DNA Sequence Number=SeqID_55990
  Gene Ontology: Mol. function=RNA-directed DNA polymerase activity; Cellular component=chromatin; Biological process=chromatin assembly or disassembly
  Pfam annotation: Domain name=Chromo; Domain location=780-833; Score =25.8; E_value=0.00016; Accession=PF00385.14; Description='chromo' (CHRromatin Organisation MOdifier
  Pfam annotation: Domain name=Integrase_Zn; Domain location=422-463; Score=9.1; E_value=0.024; Accession=PF02022.9; Description=Integrase Zinc binding domain
  Pfam annotation: Domain name=rve; Domain location=478-634; Score =112.4; E_value=1.3e-30; Accession=PF00665.16; Description=Integrase core domain
  Pfam annotation: Domain name=zf-H2C2; Domain location=419-460; Score =5.8; E_value=0.061; Accession=PF09337.1; Description=His(2)-Cys(2) zinc finger
  Pfam module annotation: Pfam domain module=Chromo::Integrase _Zn::rve::zf-H2C2; Domain location=780-833::422-463::478-634::419-460
MPTIDELLDDLGQASCFSKLDLRQGFHQIHMADGDIHKTAFRTLLGHYEFRVMPFGLSNAPSTFQSAMNDTLRPFLRKYVAVFFDDILVYSPNLDTHVSHLDSVLSTLSDKQFLLRQSKCLFAQSQLNYLGHIISAQGIAPDPEKISAMLAWPIPISPTALRGFLGLTGFYRKFIKGYAAIAFPLTSLLRKDKFSWSPEAHTAFTALQQAMISAPVLANPNFSLPFIIEIDASATAMGAVLLQEDHPIAFFSKVLCPRLQKASAYIRELHAITSSVRKWRHYLLGAPFTILTDHRSLKDLMTQVIQTPEQQFYLSKLLGYDYTIRYKPGAANVVADALSRMTPPEATCLALTMPHPLFLSELRRTLLQDPRYVTLLQDIQSTPANHPEFSLHHDLILRKKRIWIPFPCVITQSLLEEFHASPIGGHSGTAKTLHRLQQNFDWPTIRADVRQFVAQCSVCQQTKYETRKPAGLLQPLPIPTSIWEDQALDFITGLPPSQGFTVIMVVVDRFSKAAHFAALPTHHSAYKVAVLFLDTVCKLHGFPRSLVSDRDPIFISHFWRDLFKLSGTKLRMSTAYHPQTDGQTEVLNRTLEQYLRAFVHHQPSRWFRFLSLAEWSYNTAIHSGTGLSPFEVVYGRPPPTVVQYLQGSSTIEAVDQLLISRQDLHTQLQRRLRKVQDSMKASADKHRRDFSVAVGDWVYVRLRPYRQTSVAPSYHKLSKRFYGPFEVVERIGAVAYRLLLPASSRIHPVFHISLLKPHKGPLPATLATLPSASLDHHPLPTPLHILDWKLDHSLDPPATMVLVQWDGLAPEESTWERWEELRQAHNLEDKVAFGDGCIDSNIGGCIDSSIDSSNNRPRRISRRPNYLKEYVQA

SEQ ID NO: 172769 - protein, 563 aa, Glycine max
  Coding DNA Sequence Number=SeqID_55991
  Gene Ontology: Mol. function=protein serine/threonine kinase activity; Cellular component=membrane; Biological process=protein amino acid phosphorylation
  Homolog annotation: Hit_ID=Q94JZ6; Match level="QueryCoverage=60%, HitCoverage=54%, E-value=2e-99, Identity=53%"; Hit description =Protein kinase-like protein
  Pfam annotation: Domain name=Extensin_2; Domain location=1-318; Score= -140.8; E_value=0.085; Accession=PF04554.4; Description=Extensin-like region
  Pfam annotation: Domain name=Pkinase; Domain location=295-494; Score =65.9; E_value=1.3e-16; Accession=PF00069.15; Description=Protein kinase domain
  Pfam annotation: Domain name=Pkinase_Tyr; Domain location=295-541; Score=32.6; E_value=1.8e-14; Accession=PF07714.7; Description =Protein tyrosine kinase
  Pfam module annotation: Pfam domain module=Extensin_2::Pkinase::Pkinas e_Tyr; Domain location=1-318::295-494::295-541
  Subcellular localization annotation: CTP_CleavageSite=40; ConfidenceScore=5.46e-01
MFAVAYYSPAASPPLPPFDITPPPSPSMYPTPPAPPVTPPPSAVTPLPLTEPLLPSPSPVSLPPPFPLSPSTPTAASQPPPLPFATAPATTTFPPFAVALSPPTPTATFPPALPEMPSRPPATVATVTVPPPFMTEPTLVTPWFPALQSSAPEVNLPSTTRSGSLPVAVNVQKPSIFHVSSGLIVGFVIGAIVFVFVFTVGSVLRWNRKKNKHKNLSTPHCKESSPSLGSKGSHVIRVPSNPKLPPRPLTEGGGASCSFNSVSVKAIPNNAPRGAFGPVNGIFTYDELLLATKCFSESNLLGEGGFGYVYKGVLPCGKEIAVKQLKSGSQQGEREFQAEVATINRVHHKHLVEFVGYSDTRAERLLVYEFVPNNTLEFHLHGNPAIIHRDIKASNILLDFKFEPKVSDFGLAKIFPNNDSCISHLTTRVMGTFGYLAPEYASSGKLTDKSDLYSYGIMLLELITGRPPITTAGSRNESLIDWARPLLAQALQDGDFDNLVDPRLWKSYEADEMERMITCAAACVRHSARLRPRMSQIVGALEGVVSLTDLVGDVTTGLTTDTV

SEQ ID NO: 172770 - protein, 242 aa, Glycine max
  Coding DNA Sequence Number=SeqID_55992
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=98%, HitCoverage=55%, E-value=2e-99, Identity=72%"; Hit description =Pyridine nucleotide-disulphide oxidoreductase, class I; FAD -dependent pyridine ...
  Homolog annotation: Hit description=nucleotide-disulphide oxidoreductase
  Subcellular localization annotation: CTP_CleavageSite=59; ConfidenceScore=5.26e-01
MEYFLREIEGKQAHDPLFMNNNKSSLSSSSSSSFSTVWVHGPVIVGAGPSGLAAAACLREKSVPSVILERSNCIASLWQLKTYDRLRLHLPKQFCELPFMGFPSHFPTYPSKQQFVQYLENYAERFGIRPRFNETVQHAEFDAKLGLWRVKSVDKAEKTTEYVCRWLIVATGENAEAVVPDIEGVEEFGAPIKHTSLYKSGEEFRGKRVLVVGCGNSGMEVCLDLCNHNATPSLVVRDTVRT

SEQ ID NO: 172771 - protein, 106 aa, Glycine max
  Coding DNA Sequence Number=SeqID_55993
  Gene Ontology: Mol. function=catalytic activity; Cellular component =chloroplast; Biological process=metabolic process
  Homolog annotation: Hit_ID=Q5DQ95; Match level="QueryCoverage=96%, HitCoverage=28%, E-value=2e-33, Identity=65%"; Hit description=4 -amino-4-deoxychorismate lyase
  Subcellular localization annotation: CTP_CleavageSite=15; ConfidenceScore=5.15e-01
MGVKVVTSNVPIKPQFATTKSVNYLPNVGAFVAIWFDSDGFVAEGPSMNVAFVSKENEFVMPLRDNILSGCTAKRVLTLAESLVKEGKLCGIRMKNVNVEEGKKCR

SEQ ID NO: 172772 - protein, 159 aa, Glycine max
  Coding DNA Sequence Number=SeqID_55994
MWAFHTGRQLDWAHLVRYRMHKALRLNAPLPYPQLVTLFFRHFQIPLDSEPYVPIKRSFLIGAAMIASFGYHKERDGSWVKKGVPPADDEGHIPVEDNSTLLQRLMDKFDAMELQVDMRFDAMESRITRVEEDVSFIRTCFDPPPPPPHPLRLYVIILT

SEQ ID NO: 172773 - protein, 46 aa, Glycine max
  Coding DNA Sequence Number=SeqID_55995
  Homolog annotation: Hit_ID=Q1SJ67; Match level="QueryCoverage=78%, HitCoverage=10%, E-value=6e-08, Identity=70%"; Hit description=CAMP response element binding (CREB) protein
MSWKLRTINPKFAQSPQALKIFPQSKQKSTSLTYDDQPVSHTVYFS

SEQ ID NO: 172774 - protein, 122 aa, Glycine max
  Coding DNA Sequence Number=SeqID_55996
  Gene Ontology: Mol. function=calcium ion binding; Cellular component =plasma membrane; Biological process=G-protein coupled receptor protein signaling pathway
  Homolog annotation: Hit_ID=Q39890; Match level="QueryCoverage=97%, HitCoverage=97%, E-value=1e-33, Identity=52%"; Hit description =Calmodulin
  Pfam annotation: Domain name=efhand; Domain location=12-40; Score =35.5; E_value=1.9e-07; Accession=PF00036.22; Description=EF hand
  Pfam annotation: Domain name=efhand; Domain location=49-77; Score =29.5; E_value=1.2e-05; Accession=PF00036.22; Description=EF hand
  Pfam annotation: Domain name=efhand; Domain location=95-122; Score =30.6; E_value=5.6e-06; Accession=PF00036.22; Description=EF hand
  Pfam module annotation: Pfam domain module=efhand::efhand::efhand; Domain location=12-40::49-77::95-122
MKEVLSEDLIVEFLEAFCLFDRDGDGCITMEELASALRTLNQNNPRKEELQIMMNEVDMDGSGTIEFGQFLNLMARQMKLLSVMRNIGVKVTEEELEHMIRVADLDGDGRVNYEEFMRMMTI

SEQ ID NO: 172775 - protein, 46 aa, Glycine max
  Coding DNA Sequence Number=SeqID_55997
MDPYLIRSASTNIPHVPRPSIPCSHPWNQLQETSSSAILAMENQDE

SEQ ID NO: 172776 - protein, 477 aa, Glycine max
  Coding DNA Sequence Number=SeqID_55998
  Gene Ontology: Mol. function=oxidoreductase activity; Cellular component=membrane; Biological process=electron transport
  Homolog annotation: Hit_ID=Q8W228; Match level="QueryCoverage=95%, HitCoverage=90%, E-value=1e-137, Identity=54%"; Hit description =Cytochrome P450
  Pfam annotation: Domain name=p450; Domain location=8-467; Score =384.5; E_value=1.6e-112; Accession=PF00067.12; Description =Cytochrome P450
KNKAKKLPPGPRGLPILGSLHKLGPNPHRDLHQLAQKYGPVMHLRLGFVPTIVVSSPQAAELFLKTHDLVFASRPPLEAAKYISWEQRNLSFAEYGSYWRNVRKMCTLELLSHTKINSFRSMREEELDLMVKLLREAAKDGAVVDLSAKVSTLSADMSCRMVLGKKYMDRDLDEKGFKAVMQEGMHLAATPNMGDYIPYIAALDLQGLTKRMKVVGKIFDDFFEKIIDEHLQSEKGEDRTKDFVDVMLDFVGTEESEYRIERPNIKAILLDMLAGSMDTSATAIEWTLSELLKNPRVMKKVQMELETVVGMKRKVEESDLDKLVYLDMVVKESMRLHPVAPLLIPHQSTEDCMVGDLFIPKKSRVIVNAWAIMRDPSAWDEAEKFWPERFEGSSIDVRGRDFELIPFGSGRRGCPGLQLGLTVVRLTVAQIVHCFDWKLPKDILPDDLDMKEEFGLTMPRANHLHAIPTYRLSNERD

SEQ ID NO: 172777 - protein, 65 aa, Glycine max
  Coding DNA Sequence Number=SeqID_55999
MDFHDPISWEAISEGVVASGTSATITGGCEKQGKAGSVNARKKVVSHKKVFLRMKTTSIPTPCLR

SEQ ID NO: 172778 - protein, 92 aa, Glycine max
  Coding DNA Sequence Number=SeqID_56000
MWLANWLPQLNHFREVNENRSLQHACQYKDLAHADIFQDVSSYSELLVILMPRRLTCNHDINMSSMSILNLQWPTSNERFKYMEQGPKTVFQ

SEQ ID NO: 172779 - protein, 1151 aa, Glycine max
  Coding DNA Sequence Number=SeqID_56001
  Gene Ontology: Mol. function=DNA binding; Cellular component=beta -galactosidase complex; Biological process=DNA integration
  Homolog annotation: Hit_ID=Q1S1E0; Match level="QueryCoverage=99%, HitCoverage=91%, E-value=0.0, Identity=42%"; Hit description =Integrase, catalytic region
  Pfam annotation: Domain name=rve; Domain location=380-535; Score =107.5; E_value=4e-29; Accession=PF00665.16; Description=Integrase core domain
  Pfam module annotation: Pfam domain module=RVT_2::Retrotrans _gag::rve; Domain location=735-990::69-184::380-535
  Subcellular localization annotation: CTP_CleavageSite=39; ConfidenceScore=5.04e-01
MDSCLYLHPSENPTVALVSPVLDPSNYHSWSRSMMTALSAKNKVKFVDGSVPEPPKTDQTHGAWHRCNNMVVSWIVHSVSTSIRQNILWMDKTEEIWRDQKSRYSQGNLLRIYDLQQEASSMKQGDLSITKYFTKLRIVWDEIQNFRPDPVCSCTVQCTCSALAIIVQRKLEDRAMQFLRGLNEQYSNVRSHILLMDPLPTISKIFSTGHTENVCYKKHGLPSNYDGRSKASNIKNGKTCTHCGKSGHTVDVRYRKHGFPLGYRFSNSRNTTNNIVTADSKVTDDQTQHHESQEVHFSPKQYGALLALIQQPSHGNSASTSSNVKQVASVSSCSIDPASITGKPLPFDTNTQARIGTVEVRNGLYHLTPNHIAAHTVQSVITHPKYIWGPCSKLSLNGHCHFLTIVDDHSRFTWVHLMHTKAEARKNIIDFTAYVETQFNSKIKTIRTYNGFEFSMHDFYALKGIIHQTTCVETPEQNGIVERKHQHLLNVTRALLFQANLPHSFWCFALLHVAYLINCIPTPFLQNISPYEKLHGNPCDISNLRVFGCLCYISTLKAHRQKLDPRAHPCIFLGFKPHTKGYLVYDLHSHNINASHHVVVFYEDHFPSLHETQTSHTNNSSPSPAPFTNNHTIFKPFPSPASSSLVPTNHIDNHQPSTLRRSSKDKHPPTYLQDYHRFLTSTTATTSTNVRYPLNSILSYSRLSPSYRHFIMSISVTTEPTSYAEASRHDCWLKAMSAELHALQMNNTWTLTTLPPHKDAIGCRWVYKIKYNADGIIERYKARLVAKGYTQKEGLDFLDTFSPVAKLTTVRFLLALATLNGWHLRQLDVNNAFLHGELDKEVYMQLPPGLSVDNPHLVCRLQRSLYGLKQANRQWFTRLSSFLLSHGFQQASANHSLFLSFTGNSTTALLVYVDDIVLTGNNIDTIRHITTLLDQAFKIKDLCTLKFFLGLEVARSQHGIHLCQRKYTLDILSDFGMLGSRPNTTPMDYATRLHATLGDPLSAEASSSYRRLVGRLIYLTNTRPDIAHSVQQLSQYMAHPTTAHSQAASRVLRYLKGTPGSGIFFSATGPLQPKAFNDSDWAGCRDSRRSVIYLAHSIISWRSKKQSTVSRSSSEAEYQALASRYNLRAAVAHLPSSRFPHFVCSISHSLL

SEQ ID NO: 172780 - protein, 833 aa, Glycine max
  Coding DNA Sequence Number=SeqID_56002
  Gene Ontology: Mol. function=protein kinase activity; Cellular component=plastoglobule; Biological process=protein amino acid phosphorylation
  Homolog annotation: Hit_ID=Q93Y08; Match level="QueryCoverage=95%, HitCoverage=94%, E-value=0.0, Identity=69%"; Hit description=ABC transporter-like
  Pfam annotation: Domain name=ABC1; Domain location=273-393; Score =186.0; E_value=8.9e-53; Accession=PF03109.7; Description=ABC1 family
  Subcellular localization annotation: CTP_CleavageSite=46; ConfidenceScore=5.31e-01
MASSSSLLLLELKFLAPQITPKRRRSLSRFCSQNSRYNVALRTRIRAFKEEGAVIDRVNDVKWSGNGVAASEYGANGSVNGYANGVSGVRESENANGSLVKYVNDNGNGNGVAAEVVEDSAEASKRMEDGRKKRLEEIGKEEAWFKKQTGEAPIEVAVAPGGRWSRFKTYSMIQRTLEIWGFVITFIFKSWLNNRKFSYKGGMTEEKKTSRRKALAKWLKESILRLGPTFIKVGQQFSTRVDILPQEYVDQLSELQDQVPPFPSETAIAIVEEELGSPLAGVFDHFEYEPIAAASLGQVHRARLRGQEVVVKVQRPGLKALFDIDLKNLRIIAEYLQKIDPKSDGAKRDWVAIYDECASVLYQEIDYTKEAANAELFASNFKNLDYVKVPTIIWDYTTPQILTMEYVPGIKINKIQALDQLGLDRKRLGRYAVESYLEQILSHGFFHADPSISDSFGLSSNCICYPRYKKQCCLCHIDYHLLSWEASLGLIHKGIRLEHPGNIAVDDVNGGRLIFYDFGMMGSISQNIREGLLEAFYGIYEKNPDKVLQSMIQMGVLVPTGDMTAVKRTAQFFLNSFEERLAAQRREREMATAELGFKQPLSKEEKVMKKKERLAAIGNAPGLCKFGWMEWIIPIPMLGEDLLAIAADQPFRFPATFTFVVRAFSVLDGIGKGLDPRFDITEIAKPYALELLRFREAGVEVILKAVTNLFLHDFRKRWDRQSQAFYNLFRQADRVEKLAEIIQRLEQGDLKLRVRTLESERAFQRIATVQKTIGNAIASGSLINLATILYLNSIRVPATIAYVFCAIFGFQVLFGIVKIKKLDERERLITGTA

SEQ ID NO: 172781 - protein, 348 aa, Glycine max
  Coding DNA Sequence Number=SeqID_56003
  Gene Ontology: Mol. function=shikimate kinase activity; Cellular component=chloroplast; Biological process=aromatic amino acid family biosynthetic process
  Homolog annotation: Hit_ID=Q30CZ9; Match level="QueryCoverage=92%, HitCoverage=99%, E-value=5e-96, Identity=58%"; Hit description =Putative shikimate kinase
  Pfam annotation: Domain name=SKI; Domain location=107-314; Score =155.8; E_value=1.2e-43; Accession=PF01202.12; Description=Shikimate kinase
  Subcellular localization annotation: CTP_CleavageSite=54; ConfidenceScore=5.56e-01
MDVKAAQRLQLSAVVQPERFGRRPPFSTCRLGVSREPQSLRVFVSPMMMRRRTTALEVSSSYDNISASILESGSVHAPLDEELILKNRSQETQPYLNGRCIYLVGMMGSGKTTVGKIMSQVLGYSFCDSDALVEEEVGGNSVADIFEQHGETFFRNKEPLSGAFFLVTTSLKLSKLWLEGEVLELCAVHTEVLHKLSLLHRLVISTGGGAVMRPINWKYMHKGVSVWLDVPVEALAQRIAAVGTNSRPLLNYEAGDPYTRAFMRLSAIFEERGEAYANANARVSLKKIAIKLSKRDVSELSPTDIAIEALEQIDNFLKGEGGDIDTGERGVVIRVRLINLCMPSSKEG

SEQ ID NO: 172782 - protein, 259 aa, Glycine max
  Coding DNA Sequence Number=SeqID_56004
  Gene Ontology: Mol. function=structural constituent of ribosome; Cellular component=intracellular; Biological process=translation
  Homolog annotation: Hit_ID=Q1S9B3; Match level="QueryCoverage=99%, HitCoverage=100%, E-value=3e-86, Identity=66%"; Hit description =Ribosomal protein L6E; Ribosomal protein L6, N-terminal
  Pfam annotation: Domain name=Ribosomal_L6e; Domain location=152-259; Score=236.4; E_value=6e-68; Accession=PF01159.9; Description =Ribosomal protein L6e
  Pfam annotation: Domain name=Ribosomal_L6e_N; Domain location=1-54; Score=104.4; E_value=3.4e-28; Accession=PF03868.5; Description =Ribosomal protein L6, N-terminal domain
  Pfam module annotation: Pfam domain module=Ribosomal_L6e::Ribosomal _L6e_N; Domain location=152-259::1-54
MAPKITRKVSRNPELIRGIGKYSRSQMYHKRGIWAIKAKNGGVLPRHDPKPKPEAPAEKPPKFYPADDIKKPLVNKHKPKPAKLRASITPGTVLILLAGRFKGKRVVFLKQLPSGLLLVTALDSAFLKCTLCSTHFWSGLCFSLATSGPFKINGVPLRRVNQSYVIGTSTKVDVSAVNVDQFDDKYFAKEAQKKKKKGEGEFFEAEKEEKSVLPQQKKDDQKTVDSALIKAIGSVPDLKTYLGARFSLKAGVKPHELVF

SEQ ID NO: 172783 - protein, 283 aa, Glycine max
  Coding DNA Sequence Number=SeqID_56005
  Homolog annotation: Hit_ID=Q9ZPQ3; Match level="QueryCoverage=99%, HitCoverage=91%, E-value=1e-111, Identity=66%"; Hit description =Ethanol tolerance protein GEKO1
  Pfam annotation: Domain name=DUF516; Domain location=55-283; Score =226.5; E_value=6e-65; Accession=PF04414.3; Description=Protein of unknown function (DUF516)
MVALLVATTSDPASINPANALLGMPGWKPGPHFQDDMKSYVNEGVRVLVHGKSIVAEDELDKRWEEVTGEVIDEVIFFSKHTAASNKPALTVHPIGVPHLRQGDVPPQGGRPGWAALPNPRMGPWLRLLKNLAQAHNLVPEFEFVAAKLHSQVTLEAASSSTEDYWKRQDAAQVMAQLVWEGLGLGGVSDVGNWSRENDNKKILLGIGGGHYAPRHVDVVLKDNVWVGHLLSGYSLPMEDPNQSKGEKNVEIGGTWRQSIKAAYEATYSAFPGGEILAHLDHK

SEQ ID NO: 172784 - protein, 628 aa, Glycine max
  Coding DNA Sequence Number=SeqID_56006
  Gene Ontology: Mol. function=binding; Cellular component =intracellular; Biological process=metabolic process
  Homolog annotation: Hit_ID=Q1RY75; Match level="QueryCoverage=94%, HitCoverage=72%, E-value=0.0, Identity=45%"; Hit description =Tetratricopeptide-like helical
  Pfam annotation: Domain name=PPR; Domain location=107-141; Score =38.5; E_value=2.3e-08; Accession=PF01535.11; Description=PPR repeat
  Pfam annotation: Domain name=PPR; Domain location=179-213; Score =40.5; E_value=5.6e-09; Accession=PF01535.11; Description=PPR repeat
  Pfam annotation: Domain name=PPR; Domain location=280-314; Score =37.5; E_value=4.5e-08; Accession=PF01535.11; Description=PPR repeat
  Pfam annotation: Domain name=PPR; Domain location=31-65; Score=19.3; E_value=0.014; Accession=PF01535.11; Description=PPR repeat
  Pfam annotation: Domain name=PPR; Domain location=350-384; Score=6.9; E_value=1.1; Accession=PF01535.11; Description=PPR repeat
  Pfam annotation: Domain name=PPR; Domain location=447-481; Score =18.4; E_value=0.026; Accession=PF01535.11; Description=PPR repeat
  Pfam annotation: Domain name=PPR; Domain location=493-527; Score=6.8; E_value=1.2; Accession=PF01535.11; Description=PPR repeat
  Pfam annotation: Domain name=PPR; Domain location=67-101; Score=3.8; E_value=2.6; Accession=PF01535.11; Description=PPR repeat
  Pfam module annotation: Pfam domain module=PPR::PPR::PPR::PPR::PPR::PP R::PPR::PPR; Domain location=107-141::179-213::280-314::31-65::350 -384::447-481::493-527::67-101
  Subcellular localization annotation: CTP_CleavageSite=59; ConfidenceScore=5.15e-01
MPTLWCWVFTNMNLLSDAQKLFDVMSHRNLVTWSSMVSMYTQHGYNVEALVLFCRFMRSCSEESNEYILASVVRACTQLGSLSHALQVHAFVVKGGFVQDAYKLKPVTWTTIIAGYAKLGRSEVSLKLLDQMRGGDVYPDRGFDMDVSVVNGIIDFYLKCQKVKKGRTLFNQLEDKDVVSWTTMIAGCMQNSFHGDAMDLFVEMVRMGWKPDAFGFTSVLNSCGSLQALEKGRQVHAYAVKVNIDDDDFVKNGLIDMYAKCDSLTNARKVFDLVAAINVVSYNAMIEGYSRQDKLVEALDLFREMRLSLSPPTLLTFVSLLGLSASLFLLELSIQIHCLIIKYGASLDNFAGSALIDVYSKCSCVGDARLVFEEIYDKDIVVWNAMFSAASNIASLRYGQQFHNQVIKIGLDDDPFVTNSPLDMYAKCGSIKEAHKAFSSTNQRDIACWNSMISTYAQHGDAAKALEVHAGLLDLGLHHFESMSKFGIEPGIDHYACMVSLLGRAGKIYEAKEFIEKMPIKPAAVVWRSLLSACRVSGHIELGTHAAEMAISCDPADSGSYILLSNIFASKGTWANVRRVREKMDMSRVVKEPGWSWIEVKEGNAKLEFRWTKTQLIGRIVDYVLTGT

SEQ ID NO: 172785 - protein, 84 aa, Glycine max
  Coding DNA Sequence Number=SeqID_56007
MSIVEKLHLSSLYFLQSFRGTGWVEYDGSKGTFKEAVEKIFGKSKETVEESAEGAAKVVEEAIHKTTEKVKESSHSEHESKAEL

SEQ ID NO: 172786 - protein, 295 aa, Glycine max
  Coding DNA Sequence Number=SeqID_56008
  Gene Ontology: Mol. function=oxidoreductase activity; Cellular component=intracellular; Biological process=auxin mediated signaling pathway
  Homolog annotation: Hit_ID=Q338B1; Match level="QueryCoverage=94%, HitCoverage=81%, E-value=1e-107, Identity=62%"; Hit description =Auxin-induced protein PCNT115, putative, expressed
  Pfam annotation: Domain name=Aldo_ket_red; Domain location=6-293; Score=172.8; E_value=8.5e-49; Accession=PF00248.11; Description =Aldoketo reductase family
MDIPRLKLGTQGLEVSKLGFGCAGLSGVFDGPVPDEVVISLIKYAFSNGITFFDTSDFYGPYTNEVLVGKALKELPRDQIQIASKFGIVKVESNDAIVRGDPEYVRSCCEASLRRLGVEYIDLYYPHRIDTTVPIEETMGELKKLVEEGKVKYIGLSEASPDTIRRAHAIHPITALQMEWSLWSREIEDQLLPLCRELGIGIVPFSPLGRGFFGGKGVIESIPADSYLAIQPRFQGQKLDKNKTFYFRMEKLAEKHGCTTPQLALAWLLHQGNDVVPIPGERFFHFIMYMYVRKH

SEQ ID NO: 172787 - protein, 162 aa, Glycine max
  Coding DNA Sequence Number=SeqID_56009
  Homolog annotation: Hit_ID=Q338G4; Match level="QueryCoverage=41%, HitCoverage=52%, E-value=7e-13, Identity=52%"; Hit description =Expressed protein
MTANAALFLFQRTGTSRFFLFFRILLSVVCFTLMDRRKEKNGPWLSVPQFGDWDQKGQVPDYSLDFSKIRETRKQNKTNISRASLGNEEEFMDSTTSSSVNTGHSSEHPQPHYHQTNSPTVRFLSSQASLFFIFGKLFNTITVDPHKYCSYSLYVASKSSSV

SEQ ID NO: 172788 - protein, 770 aa, Glycine max
  Coding DNA Sequence Number=SeqID_56010
  Gene Ontology: Mol. function=DNA binding; Cellular component=nucleus; Biological process=regulation of transcription, DNA-dependent
  Homolog annotation: Hit_ID=Q948S5; Match level="QueryCoverage=97%, HitCoverage=79%, E-value=1e-116, Identity=36%"; Hit description=Myb
MDSYLASGLLTQLQNVPLVGNPNQPIASISSRLQQSGDDNGPRGAEGEEVSQSSQESAKAGHFSSAREMRSVVLQTGEEYKPNEKPSQASCSEPYYVSLDEVTASLQDMAGQGICTSQFIEQKYSHKPRNSTNGDCQLDLLDLTHISSMDFGPESSQLQNDRVVPGESHDMVNIPFQTSMGLGVATTMGSISVKPEHILMSDDECCRILISEAIGDECFSSGDYNKGVNMVNLSGCTSFLCQSLPSVQSVVSSTGDRLTYTVEPNQLVGSEDQQFVSRTQDNIIYANDLSSSPCIHRIDSTEMQEPSDVVKDDSKLVPVNSFGCGSDAKQTSYPTDEKPNVPTEQEDTGALCYEPPRFPSLDIPFLSCDLIQSGGDMQQEFSPLGIRQFMMSSMNMNLTPFRLWDSPSRDDSPDALLKSAAKTFTGTPSILKKRNRDLLSPLSDKRIDKRLEIEMTSTLIKNFSRLDVMFDDNETPVADLLPASSMQKRDSGTSVEGDKGSCRQDLVKVERAEDKKKSVILDDKKSEDDSGGNNSQDKVKQQPLDVDSEIKNDASAAAEIVQQPSEILVEHDMNDLLLYSPDQEHERLSVAVTCVQSISSSGSGENSGDHTGNDGGLETCNIFGGTPFRKSIESPSAWKSPWLINTFLSSPRIDTEITIEDFGYFMSPCDRSYDAIGLMKQISEQTAAQYASAQEILGNETPKALPKEASRNDRDGDQENIDAHDQHGNHSQLASSALVERRVLDFSECGTPVRGDSSSKSSAMSFSSPS

SEQ ID NO: 172789 - protein, 62 aa, Glycine max
  Coding DNA Sequence Number=SeqID_56011
MCIGLRPQWMPMEPKSFMLKLSNDDLKEITEAIPISEVVGDRNIEPFMRCSWKFANTPANHS

SEQ ID NO: 172790 - protein, 323 aa, Glycine max
  Coding DNA Sequence Number=SeqID_56012
WTHLHFGDVAECQLVFNHWRKLLKIGAGLKVTGESGSGARADEGQHGGHERPNGHHDGGHVEHEEIMENNVVAVATTSATTEVDPTHPSGLNPVNPPISDMVGEGGKALGSTGGPHLVQVQNKHSFHPYGLPPNYTPPDVAHTPDENVNNSTSILIESQQPQSDHAHVPQPIGETHEAPRDHNLTNFGPHLEYATEGQAIGGVPLPNTLGGPQYRSQPQLLHFALEILPPAMVEREKFSHIEERLRAIEGGRDYAFTDMAKLCLVPDVVIPPKFKVSNFDKYKGTTCPKNHLKMYYRKMGACAKDEKLLMHFFQESLVGAVVT

SEQ ID NO: 172791 - protein, 63 aa, Glycine max
  Coding DNA Sequence Number=SeqID_56013
MWDRHKLKGALKLGVFTPKARLQRVRQGLSLLIQEKERILGEEEGKTNLRGRESIEMYHKYKN

SEQ ID NO: 172792 - protein, 87 aa, Glycine max
  Coding DNA Sequence Number=SeqID_56014
  Subcellular localization annotation: CTP_CleavageSite=49; ConfidenceScore=5.13e-01
MLQNLTDYVIIPFLPSGTLRNFTNCALTLPFNFRHVTELHGLCYNAFLLASTMSRNFTNCLTMGAKYLEVVKRGSHPNNGWSLDEIR

SEQ ID NO: 172793 - protein, 116 aa, Glycine max
  Coding DNA Sequence Number=SeqID_56015
  Subcellular localization annotation: CTP_CleavageSite=70; ConfidenceScore=5.54e-01
MGVQIATRPTWAFQDVPPEGGCFWRKKPSSPGRARKSKPRRFRNVSVTFLWVISRRFSTVLRRYSSFFVLQPAKSKDAPRTTLVPTMTSTCTWSRLDMIDAPMCSWDAWPGSPTLS

SEQ ID NO: 172794 - protein, 225 aa, Glycine max
  Coding DNA Sequence Number=SeqID_56016
  Gene Ontology: Mol. function=transcription factor binding; Cellular component=intracellular; Biological process=regulation of transcription, DNA-dependent
  Homolog annotation: Hit_ID=Q1RTV3; Match level="QueryCoverage=94%, HitCoverage=100%, E-value=2e-90, Identity=82%"; Hit description=Ras GTPase; Sigma-54 factor, interaction region
  Pfam annotation: Domain name=Arf; Domain location=1-165; Score=-89.5; E_value=0.0074; Accession=PF00025.11; Description=ADP-ribosylation factor family
  Pfam annotation: Domain name=Miro; Domain location=12-117; Score =23.0; E_value=3.2e-05; Accession=PF08477.3; Description=Miro-like protein
  Pfam annotation: Domain name=Ras; Domain location=12-167; Score =214.1; E_value=3.1e-61; Accession=PF00071.12; Description=Ras family
  Pfam module annotation: Pfam domain module=Arf::Miro::Ras; Domain location=1-165::12-117::12-167
MDISQRKRTLLKIIVLGDSGKFSQQYKATIGADFVTKEIQVDDKLVTLQIWDTAGQERFHSIGAAFYRGADCCVLVYDVNIHKTFDTLNNWHDEFLKQGDMNDPEAFPFVLLGNKVDVDGGNSRRVTEKKARDWCASRGNIPYFETSAKEGYNVEEAFLCVAKIALENEHDQDIASATQIQFLLVSNIVLFMAVIFEESLKQFQKQNNEVVVHAEVGCKKINVFY

SEQ ID NO: 172795 - protein, 91 aa, Glycine max
  Coding DNA Sequence Number=SeqID_56017
MAARSGEPRLTPEVTGSPKRAGSFRLKSFEGPCESEASLGDLGSKKLRKKTLLPLLFGIFHIPDQNVERSPAEDIEVPKNVKTEDIEVLKM

SEQ ID NO: 172796 - protein, 839 aa, Glycine max
  Coding DNA Sequence Number=SeqID_56018
  Gene Ontology: Mol. function=helicase activity; Cellular component =nucleus; Biological process=metabolic process
  Homolog annotation: Hit_ID=Q1RTU9; Match level="QueryCoverage=94%, HitCoverage=69%, E-value=0.0, Identity=76%"; Hit description =DEAD/DEAH box helicase, N-terminal
  Pfam annotation: Domain name=DEAD; Domain location=92-254; Score= -44.1; E_value=0.03; Accession=PF00270.19; Description=DEADDEAH box helicase
  Pfam annotation: Domain name=DUF1726; Domain location=2-36; Score= -29.1; E_value=0.051; Accession=PF08351.1; Description=Domain of unknown function (DUF1726)
  Pfam annotation: Domain name=DUF699; Domain location=115-312; Score =385.3; E_value=9.5e-113; Accession=PF05127.4; Description=Putative ATPase (DUF699)
  Pfam module annotation: Pfam domain module=DEAD::DUF1726::DUF699; Domain location=92-254::2-36::115-312
DVHDRFRTESHSEAAGRFNERFLLSLASCKACVVMDDELNILPISSHIRSITPVPVKEDSDELSEAEQDLKNLKEQLNEDFPVGPLIKKCCTLDQGKAVVTFLDAILDKTLRSTVALLAARGRGKSAALGLSVAGAIAVGYSNIFVTAPSPENLKTLFDFICEGFVALDYKEHIDFDVVKSANPEFKKATVRINIYKHHRQTIQYILPHEHEKLSQVELLVVDEAAAIPLPVVKSLLGPYLVFLSSTVNGYEGTGRSLSLKLLQQLEEQSHVSAKSTKDTGRLFKKIELSESIRYASGDPVESWLNSLLCLDVSNAIPNISRLPPPSECDLYYVNRDTLFSYHRDSELFLQRMMALYVASHYKNSPNDLQLMADAPAHHLFVLLGPVDESKNQLPDILCVIQVSLEGQISRKSAIQSLTDGHQPFGDQIPWKFCEQFRDTVFPSLSGARIVRIAAHPSAMRLGYGSQAVELLIRIPAYAVFCCKPTALGPGGLSYYEGQITRISEINVEDKVQAPRLRVTEAAEKVSLLEENIKPRTDLPHLLVHLRERQPEKLHYIGVSFGLTLDLLRFWRKHKFAPFYIGQIPNTVTGEHTCMILKPLNNDEIEADGSNQLGFFSPFYQDFRQRFAKLLASTFRGMEYKLALRSIGRGEDEVQSRGTPPQVSKWISVIPNLLVSSWNPVVGSSLVNAFANWTPKGIIIDPKINFKCQDPTETSSDKCLQSVRGYLSPHDMKRLEAYVDNLADFHLILDLVPTLAHLYFQEKLPVTLSYAQASVLLCIGLQNQNISYIEIYNNKILISLDSVINGRTWWKAEILTHKHTIALYGTAVETSSQIGYGSW

SEQ ID NO: 172797 - protein, 357 aa, Glycine max
  Coding DNA Sequence Number=SeqID_56019
  Gene Ontology: Mol. function=calcium ion binding
  Homolog annotation: Hit_ID=Q5JMC7; Match level="QueryCoverage=96%, HitCoverage=74%, E-value=1e-125, Identity=56%"; Hit description =Violaxanthin de-epoxidase-related-like
  Pfam annotation: Domain name=VDE; Domain location=132-343; Score= -48.6; E_value=0.056; Accession=PF07137.2; Description=Violaxanthin de-epoxidase (VDE)
MTMKLQRELLNADILVIVAVTNKESVEWINNNRKTIENVICLDSSPDLKNKLGGYDVPSEVRGSMFGNFFGNSQSEKAKESYEVVQTVSEAWDRHNSDDIRFCLLVLINAYIRPVPVLKNLRAKGFSTLNCMLKNCGRQKNNCLELEAEIPDKPYVPPMIKFRGKNLSYEMTEDLFVGWLGSLEWSWRVVAGQNPAYDQFPCQYQLFYRGKAKGSFWYEPVFQVKTLEGQLVWRRRKYRVRRGKVPGTFYFSVLDNGVVSNEFWTIVDVADNLSWGLFHYRGAARVAGQSYTGAVLVSPDGAFPNDRERTKIVAALDKCEIKEWELYTVDNCSCIDPPLGIPEGSSLHTIVQIEVPK

SEQ ID NO: 172798 - protein, 71 aa, Glycine max
  Coding DNA Sequence Number=SeqID_56020
MTCSQDADLRGLAAPLPTTATILTGGAAICSAVRAEKTVVGGRKRVCGGEGKESEAWLQIQRHVNVILSLS

SEQ ID NO: 172799 - protein, 50 aa, Glycine max
  Coding DNA Sequence Number=SeqID_56021
MEEFETQVACPGDQPSSSRGGGAFVAQEPDTEEPPALAPTPWLVWYEMSV

SEQ ID NO: 172800 - protein, 156 aa, Glycine max
  Coding DNA Sequence Number=SeqID_56022
  Gene Ontology: Mol. function=helicase activity; Cellular component =nucleus; Biological process=metabolic process
  Homolog annotation: Hit_ID=Q1RTU9; Match level="QueryCoverage=98%, HitCoverage=14%, E-value=4e-43, Identity=65%"; Hit description =DEAD/DEAH box helicase, N-terminal
  Pfam annotation: Domain name=DUF1726; Domain location=97-156; Score =78.5; E_value=2.1e-20; Accession=PF08351.1; Description=Domain of unknown function (DUF1726)
MASEQGIGLCSSSLATSPVTSLYCVQIVNLHYMLSKAQIKSRPTVLWCYKDKLELSSHKKKRSKQIKKLVQRGLYDPEKGDSFELFVASGGLTYCLYKDSERVLGNTFGMCVLQDFEALTPNLLARTIETVEGGGLVVLLLRSLSSLTRLYTMVMV

SEQ ID NO: 172801 - protein, 86 aa, Glycine max
  Coding DNA Sequence Number=SeqID_56023
MVENGGGACHPTRPGELGCFLQKQPPSGGTSWKAQVGLNLTDCVTMFPFDFRHVTELHVSCNDGCQVPLSDQAKVVFHQTTVPGRN

SEQ ID NO: 172802 - protein, 81 aa, Glycine max
  Coding DNA Sequence Number=SeqID_56024
  Subcellular localization annotation: CTP_CleavageSite=24; ConfidenceScore=5.59e-01
MEINHKFGDPSRMAPPPPRKSNRSAMSSSSWASSSPLESVSVDVCVGLQDCTGTLFSREELLQSHFLRRHVCKGRVQGNSI

SEQ ID NO: 172803 - protein, 208 aa, Glycine max
  Coding DNA Sequence Number=SeqID_56025
  Homolog annotation: Hit_ID=Q47522; Match level="QueryCoverage=18%, HitCoverage=48%, E-value=1e-15, Identity=100%"; Hit description=LacZ protein
YDGVLRVLQWLLFLSAVPPVQLLTGWCVTAKAPPDISAGKCSGRVPFAIQAAQLLGRAIGAGLFAITPAGERGMCCKAIKLGNANSQSTWDVSTTDDPEAFIQQVSWPGVQPSTDGGHQAYRYRRPRGGARYQLLFPLVRVNFELGVIMVIAVSFGKPVVPAALMNRPTRGERRFAYWALAECILAYYVGTDEGVSEVLHVAGEKGCT

SEQ ID NO: 172804 - protein, 78 aa, Glycine max
  Coding DNA Sequence Number=SeqID_56026
MKNERRTAKNVPGIDHENVVAARAGLLPPEATSPSRTFKMGPDASTPPCLISAPPFLCFWLISFRNIAKLYGLRGDDC

SEQ ID NO: 172805 - protein, 1525 aa, Glycine max
  Coding DNA Sequence Number=SeqID_56027
  Homolog annotation: Hit_ID=UPI000060EA85; Match level="QueryCoverage =89%, HitCoverage=46%, E-value=8e-14, Identity=23%"; Hit description =UPI000060EA85 related cluster
ENGLGLEHLLHRGRALAAFNQILGHRIQNLKSEGESSTSAHGQTNIQSDVQTLLSPLGQSEETLLSSVLPIAIMHFEDSMLVASCAFLMELCGLSANKLHADIAVLKRISLFYKSSENNENLRQLSPKGSVFHAISHEGDVTESLARALADEYLHKDSPVTGTETVSKQPSRALMLVLHHLEKASLPRLVDGKTYGSWLLSGNGDGNELRSQRKAASQNWTLVTNFCRLHQLPLSTKYLAVLARDNDWIEFLSEAQIGGYSFDTVVQVASKEFSDLRLRLHMLTVLRAMQSKKKASTVLFLDSLEKGSETTFPDENMGVPVELFQILAECEKQKCSGEALLRKAKELSWSILAMVASCFLDVSSLSCLTVWLEITAARETSSIKVNDIASQIADNVGAAVNATNALPVGDRVLTFHYNRQSPKRRRLITPVSLDSSASAISDISSSSISEKIFDSQGKTMENDRKIEHFGCINVPSNSDEGPASLSKMVAVLCEQQLFLPLLRAFEMFLPSCPLLPFIRALQAFSQMRLSEASAHLGSFSARIKEEPIYLQENVGREAQIGASWISSTASTAADAVLSTCPSPYEKRCLLQLLAATDFGDGGHTAAYYRRIYWKINLAEPLLRKDNELHLGDEISDDASLLSALENNRHWEQARNWAKQLEANGAPWKSATHHVTESQAESMVAEWKEFLWDVPEERVALWSHCHTLFIRYSFPSLQAGLFFLKHAEAVEKDLPARELHELLLLSLQWLSGMISLSNPVCPLQLLREIETKVWLLAVESETQVKSEGDFNFTFSTRESGIKNDSSIIDRTASIIAKMDNHINTMRSRIVEKYESRENNQIPHKNQVMDAGLSTTFAGNMKTKRRAKGYMASRRPPLESTDKNADTDDGSSTIGLKNELQLQEENIKVEMSFSRWEERVGTAELERAVLSLLEFGQIVAAKQLQYKFSPGQIPSEFRLVDAALKLAAISTPPSNVSVPMLDEEVRSVMQSYGIMNDKHYVDPLQGFNKQPIELLQLLSLKAQDSFEEANFLVQTHPMPAASIAQILAESFLKGVLAAHRGGYMDSQKEEGPAPLLWRFSDFLKWAELCPSEPEIGHALMRLVITGQEIPHACEATHHIIHEPSPKVLGVRGCIGKNPNPTSAKDSAKIEYISGGQLSPYELAFGVELLILSHHFYKSSSCLDGVDVLVALAATRVDAYVLEGDFPCLARLITGVGNFYALNFILGILIENGQLDLLLQKYSAAADTNTGTAEAVRGFRMAVLTSLKHFNPNDLDAFAMVYNHFDMKHETAALLESRAEQSCEQWFHRYNKDQNEDLLDSMRYFIEAAEVHSSIDAGNKTRKDCAQASLLSLQIRMPDFQWLYRSETNARRALVEQSRFQEALIVAEAYNLNQPSEWALVLWNQMLKPEVMEEFVAEFVAVLPLQPSMLIDLARFYRAEVAARGDQSHFSVWLTGGGLPAEWAKYLGRSFRCLLKRTRDLKLRMQLATVATGFGDVIDACTEEMDKVADNAAPLVLRKGHGGAYLPL

SEQ ID NO: 172806 - protein, 930 aa, Glycine max
  Coding DNA Sequence Number=SeqID_56028
MEEDGKDMNNGGGRAISLARKCYARSVMTVSFQPPRSTPDIIFVDVDFKGVSPHDNDVVVIFVAMMGFNIQHILVDQDSSANVMYWDAFIGLKVPKDLLSPYLGALVRFVMEEIEVQGYAGLEITFGNEGVKTLTIQYLIVNESPSYNVFLGRPLLNKLEAIGKKRALWTNKTTRVSCVRIGPLARFYRLGPSLIVELKEVEIVEAKKMKISTTLTPQLQADLLELTTPFTDKIQGEEAIIPISVKARQRSPRGFYASEYRQQRDGGLGRGRRGGGDIFVEAGRLAAEYLVSQGLLPPNALPPPPKWQQNHKSPAEGGGRQSALTRLGSVDGRRKLGGFDEFGQKGGGRRRGSFNRSNGMDWGKEHRRNGSWSDRVRAGGGEDDDYESGGFTVRHQGEEDQHQYQYQYQQQHQNSVDDASVKSNSNLNEFVPRSEDGGDLNDKDRDKERVNAEVLEVKPSGVGKDASDVDMEVGVGNDLESVSVGLKEVKDGGSSDDDSERLRNVSAQLSDQENSSSGGVVANLVSLCKSVKVPTRRRSSVTRKNLKAENNPDGSGTAQDVGDLQVAEEVVPENESVKGSSSGDLLGEKSYDIVHVDADVAEVEPVHAAEDVKELDAVCKAGEVQYVTCQSGQDSGFMQDNNQESGATLPEYGGCSSLAEERGEKRVAEDDDDVREDNKKLREWVPSLVPKTGGGGYFLHSNPIEVKESSVEDEISHIDKVTMASDQGSLMSSGSQFTEGGDRPFLQCSEEKPSLLSSFRTCDLNLIEASEVHENHVDHPVLIYPPAVSETKKAVPIDIDLTMSHASVSGKFNTHATNGKEIEVIDLENDDSIQEEKSIDNMDRKTETMFPGLEGFSSHAQNAADMHDVQDGYGLMISELLGPDFPNCSSVPGDINSVHNEMGLQSGTGTLAEDDSIYMSLGELSMTDFY

SEQ ID NO: 172807 - protein, 732 aa, Glycine max
  Coding DNA Sequence Number=SeqID_56029
  Gene Ontology: Mol. function=voltage-gated chloride channel activity; Cellular component=integral to membrane; Biological process=chloride transport
  Homolog annotation: Hit_ID=Q8RXR2; Match level="QueryCoverage=76%, HitCoverage=70%, E-value=1e-178, Identity=58%"; Hit description =Chloride channel protein CLC-f
  Pfam annotation: Domain name=Voltage_CLC; Domain location=172-513; Score=80.6; E_value=5.1e-21; Accession=PF00654.10; Description =Voltage gated chloride channel
MSESDQRRLLGASEDDVESGGSELALAVVNGSSGNNNNNNKGFRDLLRLSGHRHSLKRIEKEEDRDRDRDRGIDRDRRDQNRHLHDVDLDSSVDVLGDSAPPEWALLLIGCLIGLTTGLFVALFNKGTNVAATAVAKSPKTLTLWSKSRLRNLDIEGAAWLRIQRLADTWHRILLIPVTGGVIVGMMCGIFPTIKAIQAAVTLGTGCSLGPEGPSVDIGKSCANGFSLMMEHDRERKIALVAAGAAAGFNAPVAGCFFAIETVLRPLRAENSPPFTTAMIILASVISSTVSNVLQGTQSAFTIPEYDLKSAAELPLYLILGMLCGVISVALTRLVAWFTKLFKIIQDKFGIPTVVCPALGGFGAGIIALKYPGILYWGFTNVEEILRTGKSASAPGIWLLAQLVAAKVIATALCKGSGLVGGLYAPSLMIGAAAGAVFGGFSAEVINSAIPGNTAVAQPPAYALVGMAATLASACSVPLTSVLLLFELTKDYRILLPLMGAVGLAIWVPSVTNRVKESETPDSSKSARGYSPISHAGYDNEDNWRQANDGNDLELRIVDGTNLEPIDKELLLDNLQVEKRFFAFPSDDCHFHLLMLTLQHTMSKQYLKVLSSATLNDAIKCMHDSQQNCVLVVDKEDFLEGILTDGDVKRCLSQKSNDTSNGDSGIVDQTAIGNGEFAEHLPRGKENASTIGDLVAGASRQYSWRVWSQIQFSFSERDTLFQLFQIKEGTFF

SEQ ID NO: 172808 - protein, 637 aa, Glycine max
  Coding DNA Sequence Number=SeqID_56030
LLALATCFATKMLHKYGLLQHKKDTCIAEGFNKTGLLSLPPIEPVKLKTEVDFAQKLCEIAHFLEIIRNLQCRHRSIFLRASQGLVDSGEESSLISTDMLQEESQLSILPSDLESLDVLNQHELSFPLPGGNNNENLVLVPVDSESHLVSDEFGSISHLTPLEGILGKKVLPVENPREMMARWKLNNLDLKTVVRDALLSGRLPLAVLHLHQMNDFVADKEPHDTFTEVRDIGRAVAYELFLKGETELAVATLQRLGENIESYLKQLLFGTVRRSLRIQIAEEMKRYGYLGPYEWKILDDMSLIECSLTTGRKNFHELRLVILFVPVHVYEKSLYPSSSFWKTYNRRLKEISIAPDSVLPVENKLRLLHNHSFHSHVIECGEIDGIVFDAWIDISESSSALEVDEDDAHVGYWAAAAVWFDAWDQRTVDRMILNQSVHSDNPILWESQLEYHVCRNHWKEVFRLLDLMPAYVLSAGSLQLNLDLLQPASSLGCNMNMKSSNYGNFLCSFEELDSVFMEVPDVQMYRFSPDICSGWMRMLVEEKLAKRFIFLKEYWEGTLEMITLLARSGFISGRDKICLEDDLTKMSSVRDGAVQALHKIFVHHCAQYNLPNLLDLYLDHHRLALENDSLYALQETA

SEQ ID NO: 172809 - protein, 560 aa, Glycine max
  Coding DNA Sequence Number=SeqID_56031
ENWQEPADSVRDASDHSSLSSCGADTKLDCFSSVFGVVINGFYKCRRVFSSASNCLLDNWGIWWVSMVKLDERINIVQSVEWMDFQFSDNLLVCLNSSGLIVLYSAMSGEYMTHLNVLQETCGLNPHFNLQGLEKLYSHDNIYAKQECSIKDNMSDQQSDSFRRSFKRLVVASHTSLLAVVDECGVIYVISLREYIPDKSYSSEKLLPHCQQFGLGMLVGWGVGGSDIDRQAVYSNLSGHFQSNDLNIKHGSVASLDKAVAGNALQKTNGCTFKEKGNLVGSYSSGFSATSKVNNGHKFLGYDVQSPVMRKILLPNFRVSEDDSICFSPLGITIFSKKKCVKNQKGSQLIHFNLQVKLEVRDDNFLDSVYDVYHFDGKDVIGEAIGCTFQGCFYIVRDGGLSVYIPSISILSNFLPVEYIGYRQSSKDMGISVLLKDNLKIKEPTKRFSPWKVEILDRVLLYEGTEMADQLCLKNGWDIKVSRIRQLQIALDYLKFYEIERGNINVIKLGPVINLVEGVRSLEMLVDVDLAEEGILRLLFAAVYLILNKGGNDSETSAAS

SEQ ID NO: 172810 - protein, 130 aa, Glycine max
  Coding DNA Sequence Number=SeqID_56032
MDFPLSSEDPAILQLHNWDLSETRIGLSDFREAFLSPTREILLLHSYEREALLLPLSKGGVLHSGGAEGGYDYENHNPGSADVSPEASTRPSESVLVNDSPCTSGSDTDIDTDLAGIKCSKSNSCPYISD

SEQ ID NO: 172811 - protein, 78 aa, Glycine max
  Coding DNA Sequence Number=SeqID_56033
MAACNNHGGSRDDNHCNGCDDGHYSGCNSGHGSSVGNSHDGDGEFVAYASILVDKKFKECLLTQLDGNSKNIENIMFT

SEQ ID NO: 172812 - protein, 543 aa, Glycine max
  Coding DNA Sequence Number=SeqID_56034
  Homolog annotation: Hit_ID=Q9FH18; Match level="QueryCoverage=85%, HitCoverage=86%, E-value=4e-24, Identity=28%"; Hit description =Arabidopsis thaliana genomic DNA, chromosome 5, TAC clone:K24C1
MDLGSESVEENEVNHDGNGNGGSYDDDEIIGFGLEGNSDVNGSDQKGTVGEVEVGSSGEGVNSKGTPTKGFGLKKWKRIRRNVVKDPSSSVDSGKVLKRGLSGNANLSESQSFLRDVKEKSDGSSNMFGNVVFSDGNVIHGSSLDSRYALGSGFVVGTDSENSEDRSSKSSTAASEPKLRQAKSRSKNVNSKHLANSAQRVQQGKGRTEGSNKPGGGGTVKIEKENSFSSLESDSRSSNFKQGVFLVTSNGKHSGKPNVYDGVNSGEAHTSEHFTEGVEGGYGNENVVEDEDLLQENLGTNLSWDVAEEKSVNNPSSAIEDPLIESVSCLQAVQEALQEELQKFREIGIEAVSLDDDSAKCSSASAGTTIDLGLNKSSQSGQSGAEEIKQTASSSSDPQGVLALRDSRIAELETSSSSVKISREESARTVDSSDEKCKVVESELEDLFRLRIEAEVECLAISKVMQNLKDGAVFHQTLLEEQEKLSKSQVQVLNKLVDAESKASVLKNKAEELEKYCGDSVVVEESFVLQRRLSQNSGMVVPT

SEQ ID NO: 172813 - protein, 192 aa, Glycine max
  Coding DNA Sequence Number=SeqID_56035
MEFRNFDPRYTGELLKHMDSQNEVLMEAYRSMFHELRKLQVEEEMLMRKMHEVMSAHGPTKSLMSRFIIPVLKAVNYGWLSNGNRFLWFLDSLQVDEEESVAPEAVLATREGERNGKTISEAQLVEEATWEASETETETIKEKFPSLCFEENAEIREGDIDGNPVPMVLGQTTSEKALKVYTKRPKAKVPKS

SEQ ID NO: 172814 - protein, 47 aa, Glycine max
  Coding DNA Sequence Number=SeqID_56036
MEGRVGIVAASHPAVRGLGSVGWGKAVLLQVREGGAFTREAKKDVRK

SEQ ID NO: 172815 - protein, 163 aa, Glycine max
  Coding DNA Sequence Number=SeqID_56037
  Homolog annotation: Hit_ID=O81190; Match level="QueryCoverage=37%, HitCoverage=11%, E-value=1e-09, Identity=35%"; Hit description =Putative transposase
MEFSASSAIACCWSLVTTWNWSLILRSIMDCMNALGDDWWRMFGHQTPNLQSLMIHSKKRNRLDHKKLHNMVYVKYNQKLKERHNARDEIDPIRLNDIAECAASKGRQKVVEEDDEEVEFKENDEESKEEKLVNFEESKGEEGEGYASLDYKEDDYVELEEED

SEQ ID NO: 172816 - protein, 172 aa, Glycine max
  Coding DNA Sequence Number=SeqID_56038
MSSSVQTISVILILRPLSFRNNKLGGKCAETDSTPFIIQAQQPEWVNTQRQILRPLSFRNNKLGGKRAETDYAPFIIQAQQPERVNTQRQILCPLSFRNNKLRGKHAETDSAPFIIQAQQPEWVNAQRQILRPLSFRNNKLGGKRAETNYGHSVHFFAIQRRSCPVARRDKL

SEQ ID NO: 172817 - protein, 77 aa, Glycine max
  Coding DNA Sequence Number=SeqID_56039
  Gene Ontology: Mol. function=sequence-specific DNA binding; Cellular component=nucleus; Biological process=regulation of transcription
  Homolog annotation: Hit_ID=Q2PJS2; Match level="QueryCoverage=94%, HitCoverage=31%, E-value=9e-27, Identity=90%"; Hit description=WRKY40
  Pfam annotation: Domain name=WRKY; Domain location=57-77; Score= -13.4; E_value=0.031; Accession=PF03106.6; Description=WRKY DNA -binding domain
MNLGHLEKWLIASAVKEVELMIIISEISATKMKKIKARRKVREPRFCFKTMSDMDELDDGYKWRKYGQKVVKGTHHP

SEQ ID NO: 172818 - protein, 105 aa, Glycine max
  Coding DNA Sequence Number=SeqID_56040
  Gene Ontology: Mol. function=sequence-specific DNA binding; Cellular component=nucleus; Biological process=regulation of transcription
  Homolog annotation: Hit_ID=Q2PJS2; Match level="QueryCoverage=99%, HitCoverage=44%, E-value=2e-26, Identity=61%"; Hit description=WRKY40
  Subcellular localization annotation: CTP_CleavageSite=69; ConfidenceScore=5.16e-01
MSTTSHSIVHHSLFEEQDQMPTQIGFFPFPTNLTFPPLGCHQSSLKAFSSLAPSSSLVISQQDSVSNLTAETLFSTTAQKSREDLTSSFRGAQFLSLHRLSVNPW

SEQ ID NO: 172819 - protein, 216 aa, Glycine max
  Coding DNA Sequence Number=SeqID_56041
  Gene Ontology: Mol. function=helicase activity
  Homolog annotation: Hit_ID=Q2R1R7; Match level="QueryCoverage=62%, HitCoverage=8%, E-value=3e-25, Identity=44%"; Hit description=AT hook motif-containing protein, putative
MQNYQHAKRSDSAKARINRKLIASDSSKSEDSESTQVIVSDSSESENSESTQGSGSNFMTPFEDCQSPTNQPVINTEGYSDLGDQLIQCRYCNAQMWYDERIAKNKNCQNPRFSLCWGDGKVELPLLQNPPQYLQQLLFHDDTIDSKNYQHNLRAYNIMFAFTSAGIKLDKTINNSRGPPTIRIQGQPCHRIGSLLPMPGNKPKFAQLYIFDTEHE

SEQ ID NO: 172820 - protein, 181 aa, Glycine max
  Coding DNA Sequence Number=SeqID_56042
MPRKIKVLLLELLLLLNTAKKILILSELRLLQVALISKSLGIKSPAVDLLCIQENRTTIIQFRRTMNVRSKAIVHFPILKPPNRRFRLGYKPTYANVRGSAQERRGRSMGQPQGPQVKGIPLCHINKSFVSTSWMCEGRVAMIHDEVPQEQPNWVRSCPPKFELGNWQVVEQPRISMANIM

SEQ ID NO: 172821 - protein, 165 aa, Glycine max
  Coding DNA Sequence Number=SeqID_56043
  Gene Ontology: Mol. function=nucleic acid binding
MAEELRRVTVEDYSSSTVPQFFTRNNLKSWDEVVEKFLKKYFLESKTTKGKAAISFFHQLPDESLSDALERFRDGLRPQSKQLLDASAEGKIIMKTPDEAMDLIESMAASDIGILRDRAHIPTKKSLLELTSQDAMLAQNKLLSKQLETITETLSCRMYNFWWSS

SEQ ID NO: 172822 - protein, 197 aa, Glycine max
  Coding DNA Sequence Number=SeqID_56044
MGDRQVVDQQHMGDPQLPSSPPSKDDMVSCVMALEAALLPCLPARELQAIDRSPHPSHQSGWNFFICNTYHKNHSAEVKLLKLIENDQREGKCLLCSSPVLETIFAKWFSHLAMHVDVDRYARDFMEAAKKLQLYFISLQREDKPTKVEMLRKEIALMEEELNIKNELIKKQENLIQEWKKELKDQLDKHKIELDRV

SEQ ID NO: 172823 - protein, 652 aa, Glycine max
  Coding DNA Sequence Number=SeqID_56045
  Gene Ontology: Mol. function=transferase activity; Cellular component= membrane; Biological process=metabolic process
  Homolog annotation: Hit_ID=Q1SJC3; Match level="QueryCoverage=99%, HitCoverage=100%, E-value=0.0, Identity=85%"; Hit description=Plant neutral invertase; Glycoside transferase, six-hairpin
  Pfam annotation: Domain name=GDE_C; Domain location=203-606; Score= -245.4; E_value=0.095; Accession=PF06202.4; Description=Amylo-alpha-1, 6-glucosidase
  Pfam annotation: Domain name=Invertase_neut; Domain location=161-633; Score=1229.3; E_value=0; Accession=PF04853.3; Description=Plant neutral invertase
  Pfam module annotation: Pfam domain module=GDE_C::Invertase_neut; Domain location=203-606::161-633
  Subcellular localization annotation: CTP_CleavageSite=41; ConfidenceScore=5.27e-01
MSLGTSKVVFQVLSRAVPQTGYNDSLVNSSELALHSRFRVKCMKKRSSRHRDFIECSSMLQSRLRTQQFQWMGVSFHDYKTYSRPWWHTCKCQQAESVSGVTTGDGNGSRLVNDVETTNTLSNGMRAKHILEFEDVQAQQLKREKEVLASNLTNGSIKGSFNTIDLNSIEEEAWDLLRESVVYYCGNPIGTIAAKDPTSSNVLNYDQVFIRDFIPSGIAFLLKGEYDIVRNFILYTLQLQSWEKTMDCHSPGQGLMPASFKVRTVPLDGDDSATEEVLDPDFGEAAIGRVAPVDSGLWWIILLRAYGKCSGDLSVQERVDVQTGIKMILRLCLADGFDMFPTLLVTDGSCMIDRRMGIHGHPLEIQALFYSALLCARGMLTPEDGSADLIQALNNRLVALSFHIREYYWIDLKKLNEIYRYKTEEYSYDAVNKFNIYPDQISPWLVEWMPNKGGYLIGNLQPAHMDFRFFSLGNLWSVVNSLATEEQSHAILDLIEAKWSDLVAEMPFKICYPALDGQEWQIITGSDPKNTPWSYHNAGSWPTLLWQLTAACIKMKRTHIAAKAVEIAERRISRDRWPEYYDTKRSRFIGKQSQLYQTWSIAGYLVAKLLLADPSKANILITEEDSELVNALISANPRGKRGRKNLRQTYIV

SEQ ID NO: 172824 - protein, 149 aa, Glycine max
  Coding DNA Sequence Number=SeqID_56046
  Gene Ontology: Mol. function=protein binding; Biological process=two -component signal transduction system (phosphorelay)
  Homolog annotation: Hit_ID=Q659H7; Match level="QueryCoverage=88%, HitCoverage=87%, E-value=5e-15, Identity=31%"; Hit description =Putative histidine-containing phosphotransfer protein 3
MEFFKVQLSDTFKSMKQQGLVDDQFTFVYSLKKNVEDNFYIEVIPEFCCEVRDGLKFLTQTMNDQTLNYKLMKEYVYKVKGSSSSFGACRLAKALTDFERTIDAASKEECSKALKQVQREFSALEEKLHICLKLERSLVLKAIEGMANM

SEQ ID NO: 172825 - protein, 114 aa, Glycine max
  Coding DNA Sequence Number=SeqID_56047
MEHFLEQVAWPEAQLPLVRPNEAAPPEPTPVQVNSEPANRQSPVVNPPSSLELEAVPPSPPLIVIYDASSDEAAAPPNSPAAEIANPHVSLIGGIDDLSNSSSGEVVALTNSPV

SEQ ID NO: 172826 - protein, 88 aa, Glycine max
  Coding DNA Sequence Number=SeqID_56048
MGDNASHFDGGGTIANRCASGYKGQVVWWVWVMAEAFGGEHIGVKERGSMKVICYWRDIWQLLVRHIGASWFDIDRPRHDRAVTRRDQ

SEQ ID NO: 172827 - protein, 426 aa, Glycine max
  Coding DNA Sequence Number=SeqID_56049
  Gene Ontology: Mol. function=binding; Cellular component =intracellular; Biological process=protein kinase C activation
  Homolog annotation: Hit_ID=Q2L3D0; Match level="QueryCoverage=91%, HitCoverage=92%, E-value=1e-139, Identity=42%"; Hit description =Selenium binding protein
  Pfam annotation: Domain name=PPR; Domain location=114-148; Score =40.6; E_value=5.6e-09; Accession=PF01535.11; Description=PPR repeat
  Pfam annotation: Domain name=PPR; Domain location=13-47; Score=43.8; E_value=5.9e-10; Accession=PF01535.11; Description=PPR repeat
  Pfam annotation: Domain name=PPR; Domain location=149-183; Score =22.0; E_value=0.0021; Accession=PF01535.11; Description=PPR repeat
  Pfam annotation: Domain name=PPR; Domain location=184-218; Score =11.0; E_value=0.37; Accession=PF01535.11; Description=PPR repeat
  Pfam annotation: Domain name=PPR; Domain location=250-284; Score =15.1; E_value=0.12; Accession=PF01535.11; Description=PPR repeat
  Pfam annotation: Domain name=PPR; Domain location=48-82; Score=6.3; E_ value=1.3; Accession=PF01535.11; Description=PPR repeat
  Pfam module annotation: Pfam domain module=PPR::PPR::PPR::PPR::PPR::PP R; Domain location=114-148::13-47::149-183::184-218::250-284::48-82
MLVFDKLGCKNEVSWNALIAGYARKGEGEELLALFVRMQREGYRPTEFTYSALLSSCSSMGCLEQGKWLHAHLMKSSQKLVGYVGNTLLHMYAKSGSIRDAEKVFDKLVKVDVVSCNSMLIGYAQHGLGKEAAQQFDEMIRFGIEPNDITFLSVLTACSHARLLDEGKHYFGLMRKYNIEPKVSHYATIVDLLGRAGLLDQAKSFIEEMPIEPTVAIWGALLGASKMHKNTEMGAYAAQRVFELDPSYPGTHTLLANIYASAGRWEDVAKVRKIMKDSGVKKEPACSWVEVENSVHVFVANDVAHPQKEKIHKMWEKLNQKIKEIGYVPDTSHVLLFVDQQEKELNLQYHSEKLALSFALLNTPPGSTIRIMKNIRTPIGFIIFVMASARVGITGSANYYQYHLIIERYHGIVFVPNIIPNCSAST

SEQ ID NO: 172828 - protein, 309 aa, Glycine max
  Coding DNA Sequence Number=SeqID_56050
MKFKAAEIETHNSGALISCWEGNLLMLFDSCAEDKTNNEGVQTEKGSCVEGQVSLKAKVLSPTIYLGLNINNLIMWGRTAMKGLSLLRSPNNSCQLISNRKNQFIVKSSTARKTLNEVINNKINLFPAEITLHRINQRPNEPKQYNNLHKHDPSRKSNQTHEHGINQIHHDPPKTLHHISHFHQTGTTIKRSVLRSSTVKRQIRPQKPTIEAIKHENPTIQQKSMIEIYLSGSERGVERRAPERCGDGGAEGEGGKAMYLAAPEDDIMSLTRTSTLGDRERERERELRGNVKKIESNGEVGPTQGNHSS

SEQ ID NO: 172829 - protein, 760 aa, Glycine max
  Coding DNA Sequence Number=SeqID_56051
  Gene Ontology: Mol. function=transporter activity; Cellular component= intracellular; Biological process=transport
  Homolog annotation: Hit_ID=Q6ZCZ7; Match level="QueryCoverage=68%, HitCoverage=99%, E-value=1e-146, Identity=59%"; Hit description =Phosphatidylinositol transfer-like
  Pfam annotation: Domain name=CRAL_TRIO; Domain location=398-585; Score=97.4; E_value=4.3e-26; Accession=PF00650.10; Description =CRALTRIO domain
  Pfam annotation: Domain name=CRAL_TRIO_N; Domain location=312-381; Score=38.4; E_value=2.4e-08; Accession=PF03765.5; Description =CRALTRIO, N-terminus
  Pfam module annotation: Pfam domain module=CRAL_TRIO::CRAL_TRIO_N; Domain location=398-585::312-381
  Subcellular localization annotation: CTP_CleavageSite=65; ConfidenceScore=5.16e-01
MGNASVLGQSGLEHASPLATGGIFSNGGADVNGWASRFQSESSSTQSWLSPQGSSSGIIVKKTVRVDIPVDAYPNFNFVGRLLGPRGNSLKRVEASTECRVLIRGRGSIKDPAREEMMRGKPGYEHLNEPLHILVEAELPVEIVDARLMQARDILEDLLKPVDESQDFYKKQQLRELAMLNGTLREEGSPMSGSVSPFHNSLGDAVNECPDLRSGHWHHSASSNLFYVQCVYIEFGGGLKMVARSKGPIEFGQCSNDEIRERRSDVENSEDERRPSRIGNLKKKAMNASSRFTHSLKKRGKRKIDYRVPSMSIEDVRDAREETAVHELRQKLVERGSLPPRHDDYHTLLRFLKARDLNIEKTVQMWEEMLTWRKEYGTDTILEDFEFGELEEVLQYYPQGYHGVDKEGRPVYIERLGKAHPSRLMHATTIDRYLKYHVQEFERTLQEKFPACSIAAKRRISSTTTILDVQGLGMKNFSRTAANLLSAVTKIDSSYYPETLHHMYVVNAGSGFKKMLWPAAQKFLDSKTIAKIQILDSKSLYKLLEVIDSSQLPDFLGGSCTCAAEGGCLRSNKGPWNDPDIMKERSSDTSTAESGSDMNDYSSPNRHRSCPCPHLAPVHEEVKAPDLNGYYSCDDSALAVEKVIESDHFHLNREQPLQTNDIGNVACRTDSGATVETASERDYVLPCVQRLQRLEKVFEELNNKPDGMPQEKEQMLMDSMDRIKSVEFDLEKTKRVLHAAVMKQLEIVELLENLKKSNCR

SEQ ID NO: 172830 - protein, 101 aa, Glycine max
  Coding DNA Sequence Number=SeqID_56052
MDISEDTNIPVILGKPFMLTASCIIDIGKRKLELGFEDQKIDFDLFVEDKPAPEHNVCLHVMEGGQEVLKRKPRAKRISVHVLSCESQALNAQPLHLRLIS

SEQ ID NO: 172831 - protein, 221 aa, Glycine max
  Coding DNA Sequence Number=SeqID_56053
  Gene Ontology: Mol. function=metal ion binding; Cellular component =intracellular; Biological process=protein amino acid phosphorylation
  Homolog annotation: Hit_ID=Q2L3W7; Match level="QueryCoverage=73%, HitCoverage=53%, E-value=1e-35, Identity=37%"; Hit description =Selenium binding protein
  Pfam annotation: Domain name=PPR; Domain location=141-175; Score =38.6; E_value=2.2e-08; Accession=PF01535.11; Description=PPR repeat
  Pfam annotation: Domain name=PPR; Domain location=75-109; Score=10.7; E_value=0.4; Accession=PF01535.11; Description=PPR repeat
  Pfam module annotation: Pfam domain module=PPR::PPR; Domain location =141-175::75-109
MMIQCERSSSVLKSLLQIVSPCKRDLGSFRRLWQHSESTFCVIDDRNLLRPSLNSKTGLHVLDLIDCGSLEPDRTLYNTLLKRCTQLGKLKEGKLVHFHVLNSNFKHDLVIQNSLLFMYARCGSLEGARRLFDEMPHRDMVSWTSMITGYAQNDRASDALLLFPRMLSDGAEPNEFTLSSLVKCCGYMASYNCGRQIHACCWKYGCHSNVFVGSSLVDMYA

SEQ ID NO: 172832 - protein, 831 aa, Glycine max
  Coding DNA Sequence Number=SeqID_56054
  Gene Ontology: Mol. function=protein serine/threonine kinase activity; Biological process=protein amino acid phosphorylation
  Homolog annotation: Hit_ID=Q9LFA2; Match level="QueryCoverage=93%, HitCoverage=92%, E-value=1e-162, Identity=58%"; Hit description =Protein kinase-like
  Pfam annotation: Domain name=Pkinase; Domain location=445-779; Score =243.8; E_value=3.6e-70; Accession=PF00069.15; Description=Protein kinase domain
  Pfam annotation: Domain name=Pkinase_Tyr; Domain location=445-779; Score=-13.5; E_value=1.2e-11; Accession=PF07714.7; Description =Protein tyrosine kinase
  Pfam module annotation: Pfam domain module=Pkinase::Pkinase_Tyr; Domain location=445-779::445-779
MDTSGNTCEIVESREEIISEFKMDEKPESSCAHKSGKKYSIEDDINQLFQAIEIKSSSRSRSSSSLQKSALKRPIKVTSSQASGIGISEPVSLKQALRGLCISQASEMAALKRLTKPCSSSRVSEAGTIKRLYTAVVDEGKGNLVEISLVPEISAPSDKLSGVTISSSIDNHSSPLVDATKPKEIITGFSSQDRIVSPPLEVEGEKPIMGIGKPILANLSPVASASEEVPEVRMDPASSSKASLGSSMSDKGHEANFPSGSCPPSSSTGNGADKYTSSNTCLSKPIFNNLNFLKKKVKQDLSSAASCSTPCTSNLDKEGGNSDFKHEMKDNAKQSPCSSNHSIEVNSINGGTDSSKSGFSLNCNKRTKFLVTKVDEKSRSKEKGEYSQSSKSSIGEYSSSTSISEESSLSSSSRGGHRPHMSKHLRWEAVRAVQQQHGNLNLKHFKLLRRLGSGDIGTVYLAELIGTSCLFALKVMDNEFLASRKKMFRSQTEREILQMLDHPFLPTLYSHIASDKLSCLVMEYCPGGDLHVLRQRQSYKSFSEQAARFYVAEVLLALEYLHMLGVVYRDLKPENILVREDGHIMLTDFDLSLRCSVNPMLVKSSSPDTDATKKTSSPCSEASCIHPFCLQPDWQVSCFTPILLSAGAKSRKMKADIASQAGPLPQLVVEPTSARSNSFVGTYEYLAPEIIKGEGHGSAVDWWTFGIFLFELLYGKTPFKGQSNEDTLANVVSQSLKFPGTPIVSFHARDLIRGLLIKDPENRLGSVKGAAEIKQHPFFEGLNWALIRCAAPPELPKFLDFGSSAPSVAANKENANDLEDIEDCEEGGNLN

SEQ ID NO: 172833 - protein, 79 aa, Glycine max
  Coding DNA Sequence Number=SeqID_56055
MGLALGLEHSKGRLSLMLLPRLTLAMTQASTDMRCYKVVEEREGRSLMANRRSRGETNGSEKRGNNMSHMHSMLTEPLD

SEQ ID NO: 172834 - protein, 222 aa, Glycine max
  Coding DNA Sequence Number=SeqID_56056
MQFLSAKSKKTWSRQNEKYKNPENNSCWRRPPVEEVLAKLTTNFNKVHSRQCADEAELAEHVVGLTCSLASCQFRKKLSRLSVNANGALIPKDYVDRNLIKKSLCVLHICFVFSTCVPHHDFHDYRLKALVAMPKVQPRFAIAIGKKYPTMKSLLSVYMDPSKSEHEKEFLLQDLMTEGLLGGDRRLGEVCSKRVYRILMAQSGCIRTDDVENGADFFERQS

SEQ ID NO: 172835 - protein, 308 aa, Glycine max
  Coding DNA Sequence Number=SeqID_56057
MVIFPLCRRLKCLSTETIAVSLCHPETVESDDTHRQIMVIRTLLAIQRQSDNQVRWHAKTIMVIRTRFAIQRQSNPMACEDHHDDDVFSHCMLSKGDNDPHLHFEDNNVFSHCMLSKGDNDLHLHFEDDDVFSHCMLSKGDNDPHLHFEDDNVFNHCMLSKGDNDPHLHFKDDNVFSHCMLSKGNNDLHLHFKDDNVFGHYMLSKGDNDPHLYFEDDNVFSHCMPSKGDNALIYILKMTMSSVIACFQKATMTFIYISKTTMSSKEEERRERKKKDEKTKPKRFRIASVIDSYIVLRPFFIVLRSSSG

SEQ ID NO: 172836 - protein, 69 aa, Glycine max
  Coding DNA Sequence Number=SeqID_56058
  Homolog annotation: Hit_ID=Q1SN43; Match level="QueryCoverage=91%, HitCoverage=11%, E-value=3e-09, Identity=45%"; Hit description =Nucleic acid-binding, OB-fold, subgroup
MAGAYQYVFAIIIEKENWTIKVKVIRLWYFPSFSGSKAPFSLEMVLMDEEGGKVRASVGKTLTYNLKVF

SEQ ID NO: 172837 - protein, 50 aa, Glycine max
  Coding DNA Sequence Number=SeqID_56059
MAFGCLRLRISAGSFSAGYSCESQLDLPPWESIKFIIIHYNITNIDEEGE

SEQ ID NO: 172838 - protein, 105 aa, Glycine max
  Coding DNA Sequence Number=SeqID_56060
MATKFMLHRQTPSQVAKDQLTMKDKRDKEEKLEKQKKMKDSKTLSSKAKGKEKEEKDSSKKIVKKENHFATKGDIKRALLLKQGDIKIQKNVLREEAQSFENLWI

SEQ ID NO: 172839 - protein, 84 aa, Glycine max
  Coding DNA Sequence Number=SeqID_56061
MAFSINRHAGEEEKRSSSLKPERKTQKNKEKRKRGAEALQSCDHGSWITSFVISLCVLFSFMRGKKLADTTPFDPEITKAERKN

SEQ ID NO: 172840 - protein, 556 aa, Glycine max
  Coding DNA Sequence Number=SeqID_56062
  Gene Ontology: Mol. function=ubiquitin thiolesterase activity; Cellular component=nucleus; Biological process=ubiquitin-dependent protein catabolic process
  Homolog annotation: Hit_ID=Q1SJA4; Match level="QueryCoverage=47%, HitCoverage=96%, E-value=1e-86, Identity=64%"; Hit description =Putative ubiquitin-specific protease UBP27-related
  Pfam annotation: Domain name=UCH; Domain location=50-550; Score =106.4; E_value=8.3e-29; Accession=PF00443.19; Description=Ubiquitin carboxyl-terminal hydrolase
MRFDENAMNWIGATVGDLVGTVGAILSLKDTKVAIPFTFAADNSSFEKSLFVPGLQNLQNNCFLNVVLQALASCFCFQSFLHGVIGECGSKDLDENMPLALALATLLEELSSVSAERVTLSPRKMMLAMSNNIPNFNLTSQQDAAEAFLHLLCLLREEFGGCYAPKMSSLADIFASNNRILTPIQRDCQSEQERWQQLFLGPFDGILGSRLTCQSCSSLISINFEHFDCLPLSPVLSDTSSMRVGCTLVDCLKQFIVAEHVENYRCSHCWHNAAIKYLSIMEGNEVELKMIRRCSDPEICNCRKMYNLDKLPWSNRFSHTLKQLSIARCPRILCIQLKRVYMNVFGELVKLQGHISFPLILDVLSFMTTRLGVKTQDIDVQSLPLNLKYNRRNFFPNHSDLQSEISTLKFSGLYGATREQINSDGVIDDGFVSSTNGQALHSDTVFPCSGSSESIHSDTHMQSIDQVDVSCNLVPQETCLYQLVSVVEHFGKAGSGHYTVYRSVRVESSEDVSDDYLNQTPMRWFCISDSQVHAVSVEGVLSSEASLLFYERIPRN

SEQ ID NO: 172841 - protein, 43 aa, Glycine max
  Coding DNA Sequence Number=SeqID_56063
MRLHYHQASRRLSKTTDRPLLLMAHIDPGIGPNISKCVRCAGV

SEQ ID NO: 172842 - protein, 75 aa, Glycine max
  Coding DNA Sequence Number=SeqID_56064
MGTRGCISYSPVLAIRQLGYPMRGAPLEDELATIISRGFNKSNVETLQKVGKAWEVLQKRTRNSGAVTMGPSVAI

SEQ ID NO: 172843 - protein, 291 aa, Glycine max
  Coding DNA Sequence Number=SeqID_56065
MWLKGVKTPVVLSGNRDECAKHAYALSLFITTVKILDFQMNTLSTFIPADEQLSLTGQAKHHFASISFPLNKAKCICALSPCCAKCTLFAKSECHFVEAELSAPCYAKLQPSLMASKKRKAPSTPTQARFDRSRFISQEALERYIDIVVPRKILPERNVILHHTEFDEFTEELEYRNWHKELTNFVDGSIDVAIIKEFYANLYDPEDKPPKQVRVRGRLVKFDADTLNSFLKTPVILEEGEDELTPPEPFYFGADAHMAQEEGTSTYPIPEPSPAPIPEETQPSTLVTEPE

SEQ ID NO: 172844 - protein, 164 aa, Glycine max
  Coding DNA Sequence Number=SeqID_56066
  Gene Ontology: Mol. function=transferase activity; Biological process= DNA integration
  Homolog annotation: Hit_ID=Q1SPQ1; Match level="QueryCoverage=88%, HitCoverage=28%, E-value=2e-09, Identity=35%"; Hit description =Polynucleotidyl transferase, Ribonuclease H fold
MEENKDKRSLKTENRVEGWCGGLCSLWKVGMEWWVRPWDQTDEERDVEEEGSNEGWPCGKVKWLDGEVEEMDGGDWLNVGWLVKGLRVLEREKCHEQGGIFQVKVRDKGTLEERYHHTGKVERYEPLSRCETLLKAVICKQQLQSYRGLGRGQSNISQALMSAT

SEQ ID NO: 172845 - protein, 456 aa, Glycine max
  Coding DNA Sequence Number=SeqID_56067
  Gene Ontology: Mol. function=RNA-directed DNA polymerase activity; Cellular component=chromatin; Biological process=chromatin assembly or disassembly
MAPTKANKEVDEALQAITAQLEVLQTQLENKQQLQDSRRLHLQQSMDSRQEALQTFLANLKEQLTVQQPSPPPFMLGMSLPPFTSSIPTSFSPIYVTTPISTPSSFSFFTINNAEQYFQYYQVPFEQRLSLASFYMKCDALSWFKWMSRNCQFSDWPSFTCFLELCFGQSSYTNHRAELFKLRQTCFVFDYPTSFEKLCNRVIGLKPESTLNCFISGLQPEIRHELAVFHPSSISHAISLAKLIEDKLKDNHSKPYRSTNFHSSTASRETPHVTITQPLSTIPIKSVPSTYIQECWAQGLCYYCDEKFVAGFKCDNGRFLLLIEDNEDILIHSYNISFTFVAEEASEPFHLQLSSHALLGQPSPKSLKFQGCIGGLAVMAKEEKVQVTDDSLSEADLLSEWHLLSEAYSSLSGVQPARPARSLFLLKLSAPSLPKPKFTYSCLASQSRKASLRKLK

SEQ ID NO: 172846 - protein, 98 aa, Glycine max
  Coding DNA Sequence Number=SeqID_56068
  Homolog annotation: Hit_ID=Q1STZ2; Match level="QueryCoverage=67%, HitCoverage=14%, E-value=1e-07, Identity=37%"; Hit description=IMP dehydrogenase/GMP reductase
MGLEVMSLQELGELIGQLQRQAFRKAYGKIWELAMIEVSTKAIASITQYYYQPLGCFTFEDFQLVPTIEEFKEILGCPLEGRKPYLFSGFYPSMSRIT

SEQ ID NO: 172847 - protein, 116 aa, Glycine max
  Coding DNA Sequence Number=SeqID_56069
MLSMKRLIESNAATATAANAAIEADPTHPSATNQAHHPAPDMVGRGGEVLGSIGGPHLGYNRNAYPYDLPPNYMPPTMPEIVDHAIPIAFEGQQPQPIGGVKQVASDILRRGEGVN

SEQ ID NO: 172848 - protein, 187 aa, Glycine max
  Coding DNA Sequence Number=SeqID_56070
  Gene Ontology: Mol. function=nucleic acid binding; Cellular component= nucleus; Biological process=DNA integration
  Homolog annotation: Hit_ID=Q1S1X7; Match level="QueryCoverage=97%, HitCoverage=18%, E-value=8e-22, Identity=32%"; Hit description =Integrase, catalytic region; Zinc finger, CCHC-type; Peptidase aspartic, catalytic
MAFAKPVCTPLITSIHLTKLNAIRLDSKREHMSHVPYASVIGSLMYAMVCTRLDLAQAVNMVSTLRVQLILDWSIKVTHLVPFVGYSDSNYAIDLDARRSMTGYAFTIDNSLVSWKVHFIPQFPCPLYWLNTWVWQNQQKKPRIKSIMKGLTHINIRYHFIHIEKRIAIQKVDTKKNLVDMFTKHIP

SEQ ID NO: 172849 - protein, 49 aa, Glycine max
  Coding DNA Sequence Number=SeqID_56071
MAQSTQDKDETGVLLFQVAAAAFILGQNEAVALRCCSSSEACHIIVDLF

SEQ ID NO: 172850 - protein, 210 aa, Glycine max
  Coding DNA Sequence Number=SeqID_56072
  Homolog annotation: Hit_ID=Q1RXN8; Match level="QueryCoverage=46%, HitCoverage=7%, E-value=7e-36, Identity=71%"; Hit description =Peptidase S8 and S53, subtilisin, kexin, sedolisin; Integrase, catalytic region; Zinc finger, CCHC-type
MILENSMIREGLRTHVTASFAAGFVAANPVAMIKTRVPWHFISGFRLSYANSKSSPDVLVQKLVGLYCNWVWCRDPVLNFDLVLLYHCNMNQQVVSFVGTHAKVNKIIQEMTTKFDIEKFTGSNDFGLWKIKMEAILIQQGCDEALKGESNMPSTLTQAKKKSMIDKARSAIILCLGDKAPREVAKEKTVAGIWAKLESLYMTKSLAHKL

SEQ ID NO: 172851 - protein, 194 aa, Glycine max
  Coding DNA Sequence Number=SeqID_56073
MAKIQGSKEGKTYSNIYKEERTQPWSMGSEIYPGVLMNPKTFFSSSSPILLESSIQYPWGVGLHQTLCPKLLQEPIKHPTPSYYRFVVPMPKIVIPFDPHSPPTDNVMSSTRSNSSYEDIEVISLTLMSPQSVLHESRVPPKATLAGLKSKDEEEDLKEDMSLEEDPSMDEEDLIIEPKFMEGDSLQDSSKESI

SEQ ID NO: 172852 - protein, 196 aa, Glycine max
  Coding DNA Sequence Number=SeqID_56074
  Gene Ontology: Mol. function=nucleic acid binding; Cellular component= nucleus; Biological process=DNA integration
  Homolog annotation: Hit_ID=Q1RXN8; Match level="QueryCoverage=98%, HitCoverage=17%, E-value=4e-73, Identity=61%"; Hit description =Peptidase S8 and S53, subtilisin, kexin, sedolisin; Integrase, catalytic region; Zinc finger, CCHC-type
  Pfam annotation: Domain name=rve; Domain location=15-174; Score=85.3; E_value=1.9e-22; Accession=PF00665.16; Description=Integrase core domain
MGKSHSVKFGTCKHTSTRAFEYAHADLWGPSRIQTHGDGSYFLSIIDDYSRRKFKEWHTQIENQQGTKLKVLRTDNGLEFVSDQFNTFYTHHGIKRHKTVAGTPQQNSLAEMMNRTILEIVRCMLLGAGLPKSPSSALEYKTLMEVWSGSPANYSNLRVFGALTFAHVKKDKLKARAIKCLFLGNAKGVKGYRAVE

SEQ ID NO: 172853 - protein, 72 aa, Glycine max
  Coding DNA Sequence Number=SeqID_56075
  Gene Ontology: Mol. function=kinase activity
  Homolog annotation: Hit_ID=Q9AY37; Match level="QueryCoverage=71%, HitCoverage=11%, E-value=3e-23, Identity=88%"; Hit description =Putative phosphatidylinositol-4-phosphate 5-kinase
MRGVKVMMCEGDFPEFLLENETRCMVLAYIVLRIAIVMKEPGMKAEGKDLECIHLEMVKPNLVTGKMESLTF

SEQ ID NO: 172854 - protein, 90 aa, Glycine max
  Coding DNA Sequence Number=SeqID_56076
MPDKSEPTNENPMKNSWGDPSTLKDVNPRAEICLDAHHSNLKVLVLLGLHGLTQHVDDDWVDTPHAGIGHGVLTNHGYSSALIKNAKCGL

SEQ ID NO: 172855 - protein, 182 aa, Glycine max
  Coding DNA Sequence Number=SeqID_56077
  Gene Ontology: Mol. function=nucleic acid binding; Biological process= DNA integration
  Homolog annotation: Hit_ID=Q1T4S3; Match level="QueryCoverage=88%, HitCoverage=10%, E-value=5e-27, Identity=39%"; Hit description=Zinc finger, CCHC-type
MATNSVSSSSASAFLSSISQKLDDSNISLWQQQIEALSLSSNLTNFKGLLGIHKSRYDSLLKQIARQEWRILHMRRGNSRTGFFSPGCNRLCLYINSVSNHWLCSFMRSGNESMIIFTNRREPKQGRFKLNCMQRCLKISRRASSCLGSKQFPIRLPLSKVQFLFRNTLKLYLKDFYKTIIQ

SEQ ID NO: 172856 - protein, 253 aa, Glycine max
  Coding DNA Sequence Number=SeqID_56078
  Homolog annotation: Hit_ID=Q1SAD1; Match level="QueryCoverage=21%, HitCoverage=17%, E-value=4e-07, Identity=50%"; Hit description =Peptidase aspartic, catalytic
MKDLMNMWEDLDDTSSDEDNEEANICLMEDIASEGSESNQEDEELENKLKDLQKELNELHNHQKEERYGLWRECAQVHKDYEDFKMSKHNIWVECEEHKKSVSFLNNELLKNQEFKGQPQDVVKLHEEIRTLKITLSKIFNETNTLNKLLGYYRSSLANLEIAMMGRDRPKKGLPNPFMTNTKGPKKVWVPMKWIFLIPDVLDYKKQTPIMVPGRWLLTTHDRRKVYVLITDSLSWWNNHFQRESKRQNSWGR

SEQ ID NO: 172857 - protein, 1070 aa, Glycine max
  Coding DNA Sequence Number=SeqID_56079
  Gene Ontology: Mol. function=cellulose synthase (UDP-forming) activity; Cellular component=membrane; Biological process=cellulose biosynthetic process
  Homolog annotation: Hit_ID=Q1SRY4; Match level="QueryCoverage=99%, HitCoverage=97%, E-value=0.0, Identity=88%"; Hit description=Zinc finger, RING-type; Cellulose synthase; Zinc finger, FYVE/PHD- type
  Pfam annotation: Domain name=Cellulose_synt; Domain location=245 -1063; Score=2108.3; E_value=0; Accession=PF03552.5; Description =Cellulose synthase
  Pfam annotation: Domain name=PHD; Domain location=11-60; Score=5.2; E_ value=0.017; Accession=PF00628.19; Description=PHD-finger
  Pfam annotation: Domain name=zf-C3HC4; Domain location=12-57; Score =5.0; E_value=0.048; Accession=PF00097.15; Description=Zinc finger, C3HC4 type (RING finger)
  Pfam module annotation: Pfam domain module=Cellulose_synt::PHD::zf -C3HC4; Domain location=245-1063::11-60::12-57
IKSVRELSGQICQICGDEIEITVDGEPFVACNECAFPVCRPCYEYERREGNQACPQCKTRYKRIKGSPRVEGDEEEDDTDDLDNEFDYGDVDALGPQPMSESLYSGRPNTGRGANNGSGMATNLEHGSAPQNSDIPLLTYGEEDPEISSNSHALIVPSHMNHGNRVHPMPYNDPSIPLQPRPMAPKKDIAVYGYGSVAWKDRMEEWKKRQSDKLQVVKHEGSNDGNFGDDFEDSDLPMMDEGRQPLSRKLPIPSSKINPYRMIIVLRLVVLGLFFHYRILHPVNDAYGLWLTSVICEIWFAVSWIMDQFPKWYPIQRETYLDRLSLRYEKEGKPSELSSVDVFVSTVDPMKEPPLITANTVLSILAVDYPVDKVACYVSDDGAAMLTFEALSETSEFARRWVPFCKKYNIEPRAPEWYFGQKMDYLKNKVHPAFVRERRAMKRDYEEFKVRINSLVATAQKVPEDGWTMQDGTPWPGNNVRDHPGMIQVFRGQDGVRDVEGNELPRLVYVSREKRPGFDHHKKAGAMNALVRASAIITNAPYLLNVDCDHYINNSKALREAMCFMMDPQLGKKVCYVQFPQRFDGIDRHDRYSNRNVVFFDINMKGLDGIQGPIYVGTGCVFRRYALYGYDAPAKKKPPSKTCNCWPKWCCLCCGSRKKKNANTKKEKKRKVKHSEASKQIHALENIEAGNEGTNNEKTSNLTQTKLEKRFGQSPVFVASTLLDNGGVPQGVSPASLLKEAIQVISCGYEDKTEWGKEVGWIYGSVTEDILTGFKMHCHGWRSVYCIPKRPAFKGSAPINLSDRLHQVLRWALGSVEIFFSRHCPIWYGYGGGLKWLERFSYINSVVYPWTSLPLLVYCTLPAICLLTGKFIVPEISNYASIVFMALFISIAATGILEMQWGGVSIDDWWRNEQFWVIGGVSSHLFALFQGLLKVLAGVNTNFTVTSKAADDGEFSELYIFKWTSLLIPPMTLLIMNIVGVVVGVSDAINNGYDSWGPLFGRLFFALWVILHLYPFLKGLLGKQDRMPTIILVWSILLASILTLMWVRINPFVSRDGPVLEICGLNCDES

SEQ ID NO: 172858 - protein, 103 aa, Glycine max
  Coding DNA Sequence Number=SeqID_56080
  Pfam annotation: Domain name=zf-CCHC; Domain location=60-77; Score =8.4; E_value=0.041; Accession=PF00098.13; Description=Zinc knuckle
MVNLLTRELSRLRLKHGNGAVEKPTEAKVANDNILDPLVIRTKGASRTMSSRSATSIWEHKCKKYGRTGHNKRKCTASIFNNGVVSQVGEAGSIMNIETWRAS

SEQ ID NO: 172859 - protein, 797 aa, Glycine max
  Coding DNA Sequence Number=SeqID_56081
  Gene Ontology: Mol. function=DNA binding; Cellular component=beta -galactosidase complex; Biological process=DNA integration
  Homolog annotation: Hit_ID=Q1T2A5; Match level="QueryCoverage=68%, HitCoverage=61%, E-value=1e-160, Identity=52%"; Hit description =Integrase, catalytic region
  Pfam annotation: Domain name=zf-CCHC; Domain location=117-134; Score =5.1; E_value=0.14; Accession=PF00098.13; Description=Zinc knuckle
  Pfam annotation: Domain name=zf-CCHC; Domain location=153-170; Score =13.1; E_value=0.0067; Accession=PF00098.13; Description=Zinc knuckle
  Pfam module annotation: Pfam domain module=RVT_2::zf-CCHC::zf-CCHC; Domain location=315-570::117-134::153-170
MKQGSLSVTEYFTRLCVIWDEIENFRPDSVCSCNIRCSCTAFTIIAQRKLEDRAMQFLRGLNEQYTNIRSHVLLMDPIPAISKIFSYVAQQERQLLGHAGPNINFEPKDISINATKTTCDFCGCIGHVESVCYKKHGVPASYDGRNKNNNGRKTCTYCGKIGHTVDVCYRKHGYPPGYKPYGGRTTVNNMMTMEDKATNDQAQQHESQEVVHFSPEQYKALLALIQQPPAGSTAQSKQVASVSSCTVNTPLNPDYHRDLASSTPKASVIVRYPLSSVLSYSRLSPVHRKFVMTISSAAEPSSYAEASRHDCWIKAMKAELQALQTNNTWRLTLLPPHKTAIGCRWIYKIKYRADGSIERYKACLVAKGYTQMEGLDYLDTFSPVAKLTTVRVLLALAAQNQWHLRKLDVNNAFLHGELEEEVYMQIPPGLAVENPKLVCRLQRSLYGLKQANRQWFTKLSSFLVSHGFQQSNSDHSLFLKLTRSVTTILLVYVDDIILTGNSILEIQDITTLLDQEFKIKDLGDLKFFLGLEIACTTDGIHLCQRKYALDILSDSGMLGCKPHSTPMDYSMKLQMNSGNSLSDESSSSYRRLIGKLIYLTNTRPDIVYAVQQLSQYLKGSPGSGLFFAATGTPQLRAFSDSDWAGCKDSQKSTTGFLVYLGSSLISWQSKKQSTVSRSSSEVEYQALASTTCELQWLTYILQDIGVAFIQPATLYCDNQSAIQIATNPVFHERTKHIEIDCHIIRHKVTAGLVKLLPVSSSMQLVDIFTKALPPATFQHLCNKLVMMNIHSQLEGGS

SEQ ID NO: 172860 - protein, 129 aa, Glycine max
  Coding DNA Sequence Number=SeqID_56082
  Gene Ontology: Mol. function=nucleic acid binding
  Homolog annotation: Hit_ID=Q1T6D0; Match level="QueryCoverage=99%, HitCoverage=30%, E-value=3e-26, Identity=41%"; Hit description=Zinc finger, CCHC-type; Lipocalin
MAQDFVFSASGMGGGGFRKEPPDGGGVDKRVLFKDKVVGNKKPMVHIADSIFEGLCAPWEVALVVKLLGKSIGYNVMKGRLTRLWRLTVGFDIMDISNNFYMVKFDTGMDKTKVMEEGPWMIFDHYLTV

SEQ ID NO: 172861 - protein, 226 aa, Glycine max
  Coding DNA Sequence Number=SeqID_56083
  Gene Ontology: Mol. function=DNA binding; Biological process=DNA integration
  Homolog annotation: Hit_ID=Q1SAI8; Match level="QueryCoverage=98%, HitCoverage=26%, E-value=4e-22, Identity=49%"; Hit description =Integrase, catalytic region
MAETSKFHSSLAITNVKTLIPITLDLESGQYHSWVALFKVHVKVHNVLEHIIPPTDAKENVVYDKAKVDDLPLLKRLNAAVLQWIYATVSSDILTSILIDDDLAEHAWHSVVDLFHDNKNSRALKKTRILAVETPKNVARTPVVAQTVAPWASWACPPSPYPSYKNWARPTFSPRPPQPGFLDRSLSRQLTMQMHPTQLILKQLFILSALLNLIRHGTWTLGRHLT

SEQ ID NO: 172862 - protein, 171 aa, Glycine max
  Coding DNA Sequence Number=SeqID_56084
  Gene Ontology: Mol. function=DNA binding; Cellular component =mitochondrion; Biological process=DNA integration
  Homolog annotation: Hit_ID=Q1SAI8; Match level="QueryCoverage=98%, HitCoverage=13%, E-value=3e-77, Identity=72%"; Hit description =Integrase, catalytic region
MDDHMHALKRILRYVQDWGDCPDTRKSTSGYCVFLGDNLLSWSSKCQPTLSRSSVEAEYQGVANVVSESCWLRNLLLKLHCPVHTTTLVYCDNVSAIYLAGNPVQHQRTKHIKMDIHFVGEKVSRGQVCILHVPSRYQIADIFTKGLPLVLFQDFRDNLSVRQPPASTVGV

SEQ ID NO: 172863 - protein, 242 aa, Glycine max
  Coding DNA Sequence Number=SeqID_56085
  Gene Ontology: Mol. function=transferase activity; Cellular component= cytoplasm; Biological process=DNA integration
  Homolog annotation: Hit_ID=Q1T0C4; Match level="QueryCoverage=94%, HitCoverage=32%, E-value=1e-58, Identity=52%"; Hit description =Polynucleotidyl transferase, Ribonuclease H fold
MRWKWQHIFSTFYHENEFPFSKLHTYFSSTYDFLDNGLSPYVINHLQNQSTPHIQVSNHPSLAPAQSPGQPRSPNHATPSSPQPSQPTSSPPQSAQSTSTNTESSSSTLGQSDLNPHLDHTQHLPLPPIFQPISSSKNKPITRSQHGIFRPNKKYQHGFLTNVTKPPLPHNPVSALQDPNWKMAMDDEYIALIKNKTWDLVPGPPDVNVIQSMWIFRHKEKSDGSFERHKARLVGNGAGQQI

SEQ ID NO: 172864 - protein, 41 aa, Glycine max
  Coding DNA Sequence Number=SeqID_56086
MEDAPVSFDSPARKRVHVVYVRGGRSALTLSDGPFMGDKHG

SEQ ID NO: 172865 - protein, 314 aa, Glycine max
  Coding DNA Sequence Number=SeqID_56087
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=32%, E-value=1e-175, Identity=91%"; Hit description=DNA -directed RNA polymerase beta chain
  Pfam annotation: Domain name=RNA_pol_Rpb2_3; Domain location=42-111; Score=135.4; E_value=1.5e-37; Accession=PF04565.7; Description=RNA polymerase Rpb2, domain 3
  Pfam annotation: Domain name=RNA_pol_Rpb2_6; Domain location=215-314; Score=-210.9; E_value=0.076; Accession=PF00562.18; Description=RNA polymerase Rpb2, domain 6
  Pfam module annotation: Pfam domain module=RNA_pol_Rpb2_3::RNA_pol _Rpb2_6; Domain location=42-111::215-314
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQLLMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERL

SEQ ID NO: 172866 - protein, 179 aa, Glycine max; identical to SEQ ID NO: 138662
  Coding DNA Sequence Number=SeqID_56088
  Gene Ontology: Mol. function=transition metal ion binding; Cellular component=viral capsid
  Homolog annotation: Hit_ID=Q4J0M2; Match level="QueryCoverage=99%, HitCoverage=61%, E-value=8e-76, Identity=79%"; Hit description =Manganese containing catalase
  Pfam annotation: Domain name=Mn_catalase; Domain location=1-179; Score=231.9; E_value=1.4e-66; Accession=PF05067.3; Description =Manganese containing catalase

SEQ ID NO: 172867 - protein, 146 aa, Glycine max
  Coding DNA Sequence Number=SeqID_56089
MCIFYPSYDMRLSMEEVQVCAYVHNIIKPPEEVEFVMGKHLATRGDFKDLHPNSIFDTKWDLMHVYNFEDVFNKYTSEWIPSFDQLSEIYSHIHDEDNLYYLMVICFKTQKVYDMDSFLIEEVLPKRKTNIHQVVTLYFDKIRLFV

SEQ ID NO: 172868 - protein, 155 aa, Glycine max
  Coding DNA Sequence Number=SeqID_56090
  Gene Ontology: Mol. function=structural molecule activity; Cellular component=vacuole
  Homolog annotation: Hit_ID=Q94CJ4; Match level="QueryCoverage=57%, HitCoverage=41%, E-value=3e-27, Identity=62%"; Hit description=21 kDa extracellular calmodulin-binding protein
  Pfam annotation: Domain name=Alginate_lyase2; Domain location=43-154; Score=-67.9; E_value=0.067; Accession=PF08787.1; Description=Alginate lyase
MGALYQIVLLNIAMYFASVMHTTSRSMPLMPVDLTLGFTELSLNISNFKNHKPYNLPVRERYRFKNGVHKLWVHVTDKPLSPHSNTNPRSEIRTEGYDYSRGVWQFEGQGFVPKDTSGFMKPRVMEEVPIIPNLVSTRNMILLAIWSQGGKILEV

SEQ ID NO: 172869 - protein, 110 aa, Glycine max
  Coding DNA Sequence Number=SeqID_56091
  Homolog annotation: Hit_ID=Q1G1I8; Match level="QueryCoverage=42%, HitCoverage=5%, E-value=1e-14, Identity=76%"; Hit description =Pentatricopeptide repeat protein
MDRAEALVREMEEQGIDAPIDIYHTMMDGYTMIGNEEKCLIVFDRLKHEVLHSHPPNHLLPRTQDSRSSQDPNINSTRGQALCNSYAKTQAYMQYGTMSVKNHPGAFRST

SEQ ID NO: 172870 - protein, 94 aa, Glycine max
  Coding DNA Sequence Number=SeqID_56092
MEESSGYLFFHCNKILPVWWESLSWVNMVGAFPHNPKQHFLQHIYGVTEGIRANGWKWWWLFSYYGHGSEIWRRILALTTITGLAILVQGLLSS

SEQ ID NO: 172871 - protein, 136 aa, Glycine max
  Coding DNA Sequence Number=SeqID_56093
  Homolog annotation: Hit_ID=Q10MT0; Match level="QueryCoverage=49%, HitCoverage=46%, E-value=2e-11, Identity=45%"; Hit description=ECA1 protein, putative, expressed
  Pfam annotation: Domain name=DUF1278; Domain location=17-129; Score =73.3; E_value=7.7e-19; Accession=PF06915.2; Description=Protein of unknown function (DUF1278)
MPVILELSPQKHQFHFMALKHGLFLLALACFVAYGTATRDLAMKSPKQNHVECWSNLIVLKSCYNEIMHFFINGQADIGPNCCCAITVITHDCWPEILTSLGYTHLEALNIRGYCDAAASSPALAPAADGPANPIY

SEQ ID NO: 172872 - protein, 85 aa, Glycine max
  Coding DNA Sequence Number=SeqID_56094
  Gene Ontology: Mol. function=structural molecule activity; Cellular component=viral capsid
  Homolog annotation: Hit_ID=Q1SRA6; Match level="QueryCoverage=99%, HitCoverage=53%, E-value=2e-23, Identity=46%"; Hit description=24 kDa protein SC24
GYDYSRGVWQFEGHGFVPNGTSGVCIMQVFGARPKRATTLMLDVSNVKIYVDGVQVYEANGQGGSFHFFKFGVYTQDDPSSYMES

SEQ ID NO: 172873 - protein, 165 aa, Glycine max
  Coding DNA Sequence Number=SeqID_56095
  Gene Ontology: Mol. function=nucleic acid binding; Cellular component= mitochondrion; Biological process=metabolic process
  Homolog annotation: Hit_ID=Q40452; Match level="QueryCoverage=87%, HitCoverage=75%, E-value=9e-65, Identity=43%"; Hit description=A membrane-associated salt-inducible protein
  Pfam annotation: Domain name=PPR; Domain location=21-55; Score=34.6; E_value=3.5e-07; Accession=PF01535.11; Description=PPR repeat
  Pfam annotation: Domain name=PPR; Domain location=56-90; Score=31.7; E_value=2.5e-06; Accession=PF01535.11; Description=PPR repeat
  Pfam annotation: Domain name=PPR; Domain location=91-125; Score=42.9; E_value=1.1e-09; Accession=PF01535.11; Description=PPR repeat
  Pfam module annotation: Pfam domain module=PPR::PPR::PPR; Domain location=21-55::56-90::91-125
MTKAVAILDEMNVAGVGPNEHTYTTLMQGYASLGDTEKAFQYFTVLRNEGLEIDVYTYEALLKSCCKSGRMQSALAVTKEMSAKNIPRNTFVYNILIDGWARRGDVWEAADLMQQMRKEGLLPDIHTYTSFINACCKAGDMQWTKNKGINVSFGSSSSSFSIAMN

SEQ ID NO: 172874 - protein, 283 aa, Glycine max
  Coding DNA Sequence Number=SeqID_56096
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=100%, E-value=2e-40, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDALTYKGLHVLAFRGLHVFSFRGLHTLDFRGLHALTFRGLHILTFRGLHAFAFRGLHVLAFRGLHVLTFRGLHILALRGLQSSSSEDIKGLHVLVYRGLHALAFRRLHALDFKGLHVLAFRVLHALAFRGIHVLTFREDCAFRGLHVLAFRGLQVLTFRGLQVLAVRGLHVLAFRGLHVLAFRGLHVLILGGQHVLTFRGLHVLTFRGLHVLAFSGLHVLAFRGMHVLAFRGLHILAFIGLHVLAFRGRHTHTFRGPHILTFRGLHAHQHDHSYTDMDDIAT

SEQ ID NO: 172875 - protein, 131 aa, Glycine max
  Coding DNA Sequence Number=SeqID_56097
  Subcellular localization annotation: CTP_CleavageSite=87; ConfidenceScore=5.38e-01
MIISTALALGRGNRGFPVLNGLNLRNRGRGPPHHAPPATASNLISSHTSANTDLRPKSAFLGSRSTFSITLFLAKSGTKLGEDYGAVCEKENAEHLGMKKKSLLRSISFSENLRKQREHEEGASSFLVPRN

SEQ ID NO: 172876 - protein, 44 aa, Glycine max
  Coding DNA Sequence Number=SeqID_56098
MAVLTLTIKSKTNWREKKPSKKFRVRASSDQSSCKSCVLGDLLK

SEQ ID NO: 172877 - protein, 106 aa, Glycine max
  Coding DNA Sequence Number=SeqID_56099
MLGFTRDSPQISASPHQLDLAPYASEPYNAQWNAPGLLRDKHTLRSSRILGEMEVDEPWLGLWLPLDYQVDMGARIAFVDNWAVGKEKEWQSQHGLLPHSHPLHLP

SEQ ID NO: 172878 - protein, 266 aa, Glycine max
  Coding DNA Sequence Number=SeqID_56100
  Gene Ontology: Mol. function=C-terminal processing peptidase activity; Cellular component=integral to membrane; Biological process=proteolysis
  Homolog annotation: Hit_ID=Q0X8R4; Match level="QueryCoverage=94%, HitCoverage=52%, E-value=1e-115, Identity=89%"; Hit description =Carboxyl-terminal protease precursor
SASWPLVDTTVTSGGRKGCRDGDGRVQQAARVVAQVQNQALHVGFLLVQLFDLAHEVVHRAFLELAQADPAVAGLDDLALDGLRLDFLARDGHGEAAAFILAQDGQLHLGVGLAAHALDGVVERQALDGRVVDLGDQVAGLQARAEGGGAFDGRDNLDQAVFLRDLDAYADEAARGAFAEFLVGLLVEVLRMRIEAGHHAGDGIGDQLLVIDRLDIVGLDQAEDGGQLLDLFQRQRGHGTAGHGLQGNRGKRPRGSLKTAQQAQFP

SEQ ID NO: 172879 - protein, 117 aa, Glycine max
  Coding DNA Sequence Number=SeqID_56101
MGTSLSPICPFRIQWMQLSNQGHEMPKQVLPLSALPYVDASAQHMTILTDHGHPLQWNVTVNNPSIGQQCIAHPWYEFLANNDFSPGDEISFYFRTYHKVWELSIIKQQQWDDTDSD

SEQ ID NO: 172880 - protein, 518 aa, Glycine max
  Coding DNA Sequence Number=SeqID_56102
  Homolog annotation: Hit_ID=Q69L69; Match level="QueryCoverage=40%, HitCoverage=28%, E-value=1e-08, Identity=25%"; Hit description =Calcineurin-like phosphoesterase-like protein
MQLRVAGYVGEGCSYDDDAVGLAIQAGETVLMTSSSSNIKIKSGPVDEDVLWIQDMHVSQHIWNEEEDRKLHIRLHELSPRLCMDGSPLIGPTNLKWADLCGELLGVRPEEEVNNHDGNLQQVEMFTRAWILRFIGGVLFVDKGSSKVSLRWLRRGNQHIANDDLILFCHKLDIMKRHEFVWEPYTTNVMSVLPPICLVGSVAWCAMVSLICFQVIECHQPDIVLRQFGMQQPIPWCPSQPLNIHGITLKEKHDENLGQLLGLMINQWNNRADFRIDGYPRQEGLLSFNSDYMVWYRRKTKMFVDPKNANTTTLAEVAETLQYMVSPQGRNTWTVDDLVSYVEKITILSEEQERITEPVSHGPAIEHQFATQEFHILPSSVETQGIARRREVVEAESYLYPQMVERGHGMYYTPPTFSQYPFEGHQSDTSASEHSLGGVAKIYPNFSWPTMTPSQQHDAPIPTPNAPLDGSSQSISFLILVDFGRPLARIVVGSGINVHESSKGGIAASFPRGHHCAE

SEQ ID NO: 172881 - protein, 370 aa, Glycine max
  Coding DNA Sequence Number=SeqID_56103
  Gene Ontology: Mol. function=RNA-directed DNA polymerase activity; Biological process=RNA-dependent DNA replication
  Homolog annotation: Hit_ID=Q1SQP0; Match level="QueryCoverage=97%, HitCoverage=77%, E-value=3e-45, Identity=32%"; Hit description=RNA -directed DNA polymerase
MAKVLSRRLKKVLPYIIDKCQYAFMEGRQLLHSAVIANEVVEEEKRCNKSYLVFKVDYEKAYDSVCWDFLSYMMNRMGFCTKWIKWIEGCLKSTSISILVNGIPTDEFFPQGGLREGDPLAPFLFNIVAEWLIGLMKEAQEKKLFEGIKVGRDGLDISLLQYAADTIFFGKASLENVKAIKGSKEGGRQAGDVAVMVLGGEVQTNRRLPGLYLENGNGTYSTIRENCSHVYNAFKEKSWCTSGIEWKIGCGSKVKFWKDRWLAVWEWQLEWKRLFREAEIDIVAKYMEDIEGVIVQPNQHDRWGWRVDPSKSLPTKVNFRRRNVDLNDVSCPFCRPKEEDASHLFFNCYKILPLWWESLSWLNIVDVSPE

SEQ ID NO: 172882 - protein, 327 aa, Glycine max
  Coding DNA Sequence Number=SeqID_56104
  Gene Ontology: Mol. function=aminoacyl-tRNA ligase activity; Cellular component=mitochondrion; Biological process=glycyl-tRNA aminoacylation
  Homolog annotation: Hit_ID=Q8L785; Match level="QueryCoverage=87%, HitCoverage=26%, E-value=1e-105, Identity=67%"; Hit description =Glycyl-tRNA synthetase 2, chloroplast/mitochondrial precursor
  Pfam annotation: Domain name=tRNA_synt_2f; Domain location=3-327; Score=74.8; E_value=1e-22; Accession=PF02092.7; Description=Glycyl -tRNA synthetase beta subunit
  Subcellular localization annotation: CTP_CleavageSite=20; ConfidenceScore=5.03e-01
MAITPCCTCPFPRTKPPPLRLKLRQPERGHGSFPTGRKVIEINLGFWSRNCGNSSFGLLNTSSAVIQVETAESYSVSMKNVVINVSVEDRKKIIFEQSNALAESVNGQILIPKGLLDEVVNLVEAPFPVLGKFKETFLDLLKDLLIMVMQKHQKYFAVCDANGQLLPYFVAVANGAIDETTVRKGNEAVLWARYEDAKFFYEMDTCKRFSEFRKQLKNILFHEKLGTMLDKMTRVENMVTKLSCLLDINEDVQQIIRDASSLAMSVLATAVVTEFTSLSGIMGRHYALRDGYSDQIAEALLEITLPRFSGDILPKSDADIVLAIADR

SEQ ID NO: 172883 - protein, 135 aa, Glycine max
  Coding DNA Sequence Number=SeqID_56105
  Pfam annotation: Domain name=RRM_1; Domain location=1-62; Score=7.6; E_value=0.028; Accession=PF00076.12; Description=RNA recognition motif. (a.k.a. RRM, R
MGEKELWIEFNKWEGFREVYIVRNRNRSGRRYKFVRFKGVDNAKKLKRQLGNLVLEGLKLYVNLPKHEREQNPIETINKKHQPKEEATIAKQHHPNQAWVMCWGILLHSWDEENITKIVNGIGEVVDVDDDIEDL

SEQ ID NO: 172884 - protein, 217 aa, Glycine max
  Coding DNA Sequence Number=SeqID_56106
  Gene Ontology: Mol. function=RNA-directed DNA polymerase activity; Biological process=RNA-dependent DNA replication
  Homolog annotation: Hit_ID=Q1T5K4; Match level="QueryCoverage=74%, HitCoverage=19%, E-value=2e-09, Identity=22%"; Hit description=RNA -directed DNA polymerase
MEMKVKGTGFIYLEGKWAGDFNCIRSPSERVGVCQRIQSGGSLKEFNDWIADFEVEEVPNKSFKKVVQDYWMENSVTSWGGYVLKEKLKKLKQRLKEWNINQLGDAQEKLKKVELELNKLEKEGDSRQLNEQEDKLRKQLQENLWWAASSFESIAGQKARSRWIKEGDDNSRYFHLDELEFKRPRLDGIKFKSIDQQHNDMLVTRIEEEEVRATIWD

SEQ ID NO: 172885 - protein, 134 aa, Glycine max
  Coding DNA Sequence Number=SeqID_56107
  Gene Ontology: Mol. function=ATPase activity, coupled to transmembrane movement of substances; Cellular component=integral to membrane; Biological process=transport
  Homolog annotation: Hit_ID=Q1SJN0; Match level="QueryCoverage=100%, HitCoverage=27%, E-value=5e-47, Identity=67%"; Hit description=ABC transporter, transmembrane region
MHADGLDWFLMIFGLFGAIGDGIGTPLVLFITSKIMNNIGGFSSNIGSTFIHSINENAVVLLYLAGGSFIACFLEGYCWTRTGERQAARMRVRYLKAVLRQEVAYFDLHVTSTSEVITSVSNDSLVIQDCLSEK

SEQ ID NO: 172886 - protein, 1050 aa, Glycine max
  Coding DNA Sequence Number=SeqID_56108
  Gene Ontology: Mol. function=ATPase activity, coupled to transmembrane movement of substances; Cellular component=integral to membrane; Biological process=transport
  Homolog annotation: Hit_ID=Q1SJM7; Match level="QueryCoverage=99%, HitCoverage=92%, E-value=0.0, Identity=56%"; Hit description=Cyclic peptide transporter
  Pfam annotation: Domain name=ABC_membrane; Domain location=471-748; Score=161.6; E_value=2e-45; Accession=PF00664.13; Description=ABC transporter transmembrane region
  Pfam annotation: Domain name=ABC_tran; Domain location=184-368; Score= 221.4; E_value=2e-63; Accession=PF00005.17; Description=ABC transporter
  Pfam annotation: Domain name=ABC_tran; Domain location=822-1007; Score=199.8; E_value=6.2e-57; Accession=PF00005.17; Description=ABC transporter
  Pfam annotation: Domain name=Dynamin_N; Domain location=187-353; Score=-44.4; E_value=0.068; Accession=PF00350.13; Description =Dynamin family
  Pfam module annotation: Pfam domain module=ABC_membrane::ABC _tran::ABC_tran::Dynamin_N; Domain location=471-748::184-368::822 -1007::187-353
MIRLARKIREESNKAGTIAEQAISSIRTVYSFVGESKTINAFSDALQGSVKLGLRQGLAKGLAIGSKGAVFAIWSFMCYYGSRLVMYHGAKGGTVFAVGSVICIGGSALGASLSELKYFTEACAAGERIMEIIKRVPNIDSENMAGEILERVSGEVEFDNVKFVYPSRPDSVILNDFCLKIPAGNTVALVGGSGSGKSTLISLLQRFYDPIEGEIRLDGVAINRLQLKWFRSQMGLVSQEPTLFATSIKENILFGKEDANEEDIVEAAKAANAHDFISQLPQGYNTRVGEKGVQISGGQKQRIAIARAIIKKPQILLLDEATSALDSESERKVQEALDKIVLDRTTIVVAHRLSTIRDAHVIIVLENGKIIEMGSHGELTQIDNGLYTSLVHFQQIEKSKNDTLFHPSILNEDMQNTSSDIVISHSISTNAMAQFSLVDEDNAKIAKDDQKLSPPSFWKLLALNLPEWKQACLGCLNATLFGAIEPLYAFAMGSMISIFFLTDHDEIKKKVVIYCLFFMGLAVFSLVVNIIQHYSFAYMGEYLSKRVKESMLSKILNFEVAWFDQDKNSTGVICSRLTKEANIVRSLVGDRMALLVQTISAVVIACTMGLIIAWRFAIILIVVQPIGIASFYTRLVLLKGMSKKAIKAQDETSKIAIEAISNLRTITAFSSQDQVIKMLKKAQEGPIRENIRQSWFAGIGLGCARSLTTFTRALEYWYGGKLVFDGYITSKQLFQTCLILANTGRVIADASSLTSDVAKGADAIGLVFSILNRNTKIDSDEMTAYMPQKLIGHIEFQDVYFAYPSRPNVMIFQEFSIKIDAGISTAVVGQSGSGKSTIMGLIERFYDPLKGIVMIDGRDIRSYHLRSLRNYISLVSQEPTLFNGTIRENIAYGAFDMTNEVEIIEAARIANAHDFIAGMKDGYDTWCGDRGVQLSGGQKQRIAIARAVLKNPKVLLLDEATSALDSQSEKVVQDALERVMVGRTSVVVAHRLSTIKNCNRIVVLNKGRVVEEGTHLCLLSKGPSGVYYSMVSLQRSATTTSAIDNEFSIN

SEQ ID NO: 172887 - protein, 144 aa, Glycine max
  Coding DNA Sequence Number=SeqID_56109
  Gene Ontology: Mol. function=ubiquitin thiolesterase activity; Biological process=ubiquitin-dependent protein catabolic process
  Homolog annotation: Hit_ID=Q9C585; Match level="QueryCoverage=38%, HitCoverage=6%, E-value=4e-17, Identity=67%"; Hit description =Ubiquitin-specific protease-like protein
  Pfam annotation: Domain name=UCH; Domain location=7-132; Score=-44.2; E_value=0.00091; Accession=PF00443.19; Description=Ubiquitin carboxyl- terminal hydrolase
MLVGVVVGVVGFVFDKNDGVNKRTAAMGNDADSNSGTEDDIHSSTDFEFYLQGLERAKIIVNKPLTQPTGIISLPTAMCLYAISCHYGVLGGGHYTAFVRYGYDKWYDFDDSRVESISEDMIKTPAAYVLFYRKIKMKILDAIV

SEQ ID NO: 172888 - protein, 358 aa, Glycine max
  Coding DNA Sequence Number=SeqID_56110
MVAEMMVEAGASEVVVVDVAAGVDADERQSKRMKGDDANDGEDGGCKKEPEKDRAINHAWEHFSGRQRMEGEEERRSVEARAALGCLGCPIPEDKAEEDRRSVEAREDEAEELATALKKETVVAVTAAAMVAGLKKETVVAATVTAVVAASMQETGSAGEISRSESIAARLAMAASSRSRLASRGSTSAIEEQQRRGQGVERGKGNTFDPFHLAMHIITSNQQISTIGLKLIPNLTMHANKATPNTSTNKRSKPKAETEATMENELNGNRRIPDATTTICPHDPHDNNGDFNGDRAMVQATMATLTEAEETVVEMLVVFTKLSPLLRRDRDLKRCLVEVFYKMCLNTRFFEGLENHGK

SEQ ID NO: 172889 - protein, 53 aa, Glycine max
  Coding DNA Sequence Number=SeqID_56111
  Gene Ontology: Mol. function=hydrolase activity; Cellular component =membrane; Biological process=carbohydrate metabolic process
  Homolog annotation: Hit_ID=Q8RZK0; Match level="QueryCoverage=90%, HitCoverage=17%, E-value=3e-17, Identity=83%"; Hit description=Beta 1,3-glucanase-like
  Pfam annotation: Domain name=X8; Domain location=2-53; Score=36.7; E _value=8.6e-09; Accession=PF07983.3; Description=X8 domain
MVALDYACGYGGADCSAIQPGASCYNPNTVCDHASYAFNDYYQKNPAPTSLKA

SEQ ID NO: 172890 - protein, 97 aa, Glycine max
  Coding DNA Sequence Number=SeqID_56112
  Subcellular localization annotation: CTP_CleavageSite=55; ConfidenceScore=5.14e-01
MERYVITLECTWEPFQVVLSAFGITSFACQLSFSSYALKRGTLFMNINNLNSSIRTNNNNNNNKTMTNQMTSNKMMTSIDTLPFNLSIAHLATQNYY

SEQ ID NO: 172891 - protein, 108 aa, Glycine max
  Coding DNA Sequence Number=SeqID_56113
  Gene Ontology: Mol. function=ATPase activity, coupled to transmembrane movement of substances; Cellular component=integral to membrane; Biological process=transport
  Homolog annotation: Hit_ID=Q1SJN0; Match level="QueryCoverage=88%, HitCoverage=19%, E-value=5e-20, Identity=48%"; Hit description=ABC transporter, transmembrane region
MCKMRVDQNHTIVNTKKKKKKNGSIRSIFMHADSLDWFLMVLGVFGAMGDGFTTPISVYIMSGIVNNVGGVLKMTPSTFIHNVNKYSLALTYLACASFFASFLVLNFL

SEQ ID NO: 172892 - protein, 54 aa, Glycine max
  Coding DNA Sequence Number=SeqID_56114
MSVARCGEGEGTGVERCGGRWQQTRHAEGGDCVGNVRITYGSSWCVNLMDQVDQ

SEQ ID NO: 172893 - protein, 284 aa, Glycine max
  Coding DNA Sequence Number=SeqID_56115
  Gene Ontology: Mol. function=nucleic acid binding
MEEDSLHVPVMERLRSCTTDGDILHLVRDAFENENEINVYFHHEVDPILEEVPQMLYLECDPIPEAVENEDDLDDMLVLVSMLVLESREMVVSRGMLMLVNREMVRDAGEQRDAGERRDVDAGEQRDGGGEERDVADSEEEKEVDNDEWFTNFSCMMNEVEAEVETNDEDVEVYPQYSQSSGVGEQKLELGMKFGTLYEFKSALREYSILMGKEFKWKKNDKQRARAKCKKTFCDWEIYCAKNEVRNSFQIKTFKHNHNCCREVNNKQANRQWVVSKLKGKLRM

SEQ ID NO: 172894 - protein, 79 aa, Glycine max
  Coding DNA Sequence Number=SeqID_56116
  Gene Ontology: Mol. function=ATPase activity, coupled to transmembrane movement of substances; Cellular component=integral to membrane; Biological process=transport
  Homolog annotation: Hit_ID=Q1SQG9; Match level="QueryCoverage=78%, HitCoverage=11%, E-value=1e-13, Identity=53%"; Hit description=ABC transporter, transmembrane region, type 1
MREDQNHIGVDTKKKNGSIGSIFMHADGLDWFLMVLGVFGAMGDGFSSPVMMYFIGRIVNNIGDVSKITPIFTGVVIFC

SEQ ID NO: 172895 - protein, 467 aa, Glycine max
  Coding DNA Sequence Number=SeqID_56117
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=90%, HitCoverage=80%, E-value=2e-79, Identity=41%"; Hit description =Inositol polyphosphate related phosphatase
  Pfam annotation: Domain name=Exo_endo_phos; Domain location=70-415; Score=153.4; E_value=6.1e-43; Accession=PF03372.13; Description =EndonucleaseExonucleasephosphatase family
MEVENDQKPRRYHQRLRNWFNSKQKEDRPSSFSLNEIQDGVEDESDDYEGNLSLRSLELDPCISTNKLRVFVGTWNVAGRSPVGSLAVDLDEWLNLKNAADIYVLGFQEIVPLKTLTVIGAEDPAVATSWNQLIGKTLNAKFGCPWMTPMQNSSSCDDDDNNYQYVENPNTKGGNNNNRNNDKYTLVASKKMVGVFISVWMREEVLRKHSVSNVRVCSVACGVMGYLGNKGSVAVSMSIEGTSFCFVAAHLASGEKKGDEGRRNHQVAEIFRRTSFSRTTKDHNHFPLTILGHDRIFWFGDLNYRLYLEDNFARHLIRKQDWKALQEFDQLQKELEEGGVFEGWKEGDIEFAPTYKYSSSTTNRYCGSLPSRSGEKQRTPAWCDRILWYGKGVEQLHYFRSESKFSDHRPVSALFSTQIEIKSSNRGLMELHNIPPTMLNPKNGMNRGDEDGKSSLLSLLTKNLQGF

SEQ ID NO: 172896 - protein, 1128 aa, Glycine max
  Coding DNA Sequence Number=SeqID_56118
  Gene Ontology: Mol. function=ATPase activity, coupled to transmembrane movement of substances; Cellular component=integral to membrane; Biological process=transport
  Homolog annotation: Hit_ID=Q1SJM7; Match level="QueryCoverage=99%, HitCoverage=98%, E-value=0.0, Identity=52%"; Hit description=Cyclic peptide transporter
  Pfam annotation: Domain name=ABC_membrane; Domain location=553-830; Score=151.5; E_value=2.2e-42; Accession=PF00664.13; Description=ABC transporter transmembrane region
  Pfam annotation: Domain name=ABC_tran; Domain location=266-450; Score= 216.3; E_value=7.1e-62; Accession=PF00005.17; Description=ABC transporter
  Pfam annotation: Domain name=ABC_tran; Domain location=904-1089; Score=206.7; E_value=5.2e-59; Accession=PF00005.17; Description=ABC transporter
  Pfam module annotation: Pfam domain module=ABC_membrane::ABC _tran::ABC_tran; Domain location=553-830::266-450::904-1089
MRVKYLKAVLRQDVSYFDLHVTSKSEVLTCVSSDSLVIQEVLSEKVFVGSYIAAFVLLWKLAIVAFPFVVLLVIPGLIYGKTMMGLARRIREESNKAGTIAEQAIFSIRTVYSFVGESKTINAFSEALQGSVKLGLRQGLAKGLAIGSNGVVFAIWSFMVYYGSRLVMYHGAKGGTVFAVGSVICIGGSALGASLSELKYITEACVAGERIMEMIKRVPNIDSENMAGVILEKVSGEVEFDHVKFIYPSRPDNVILNDFCLRIPAGKTLALVGGSGSGKSTVISLLQRFYDPIEGEIRLDGVAYHRLQLKWLRSQMGLVSQEPTLFATSIKKNILFGREDANEEEIVEAAKAANAHDFISQLPQGYNTQVGEKGVQISGGQKQKIAIARAIIKKPQILLLDEATSALDSESERKVQEALDKIVLDRTTIIIAHRLSTIRDAHVIIVLENGKIMEMGSHDELIQNNNGYYTSLVHFQQVEKSKNDAFFHPLISNGDMQNTSSHMARHSVSTNSMAQFSFVDGDNTEKVRDDDQKLPSPSFWRLLSSNLREWKQTCFGCLSALLFGAIEPLYAFAMGSMVSIFFLSNHDEIKRKIILYSLFFVGLAVLSLVLNIIQHYSFAYMGEYLTKRLKEKMLSKILNFEIAWFDRDENSTGVVCSRLIKEANIVRSLVGDRMAQLVQTISSVVIACTMGLIIAWRYAIVIIVVQPIIIACFYTRCVLLKGMSEKAIKAQDKSSKIAIEAISNFRTITSFSSQDHVIKMLKKAQEGPSHESIQQSWFVGIGLGCARSLKTLTQALEFWYGGKLVFHGYITSKALFEICLIFANIGRVIADASSLANDIAKGVTVSGLVFSILDRNTKIEPHETNAYKPQKLTGDIELQDVYFAYPSRPNVMIFQDFSMKIEAGKSTALVGQSGSGKSTIIGLIERFYDPLEGIVTMDGIDIRSYHLRSLRNYIALVSQEPTLFNGTIRENIAYGAFDKTNEAEIIEAARIANAHDFIASMKDGYDTWCGDRGLQLSGGQKQRIAIARAVLKNPNVLLLDEATSAIDSQAENVVQNALERVMVGRTSVVVAHRLNTIKNCNQIVVLDKGRVVEEGNHTSLLAKGPNGVYYSLASLQRSLVTTSVINTE

SEQ ID NO: 172897 - protein, 110 aa, Glycine max
  Coding DNA Sequence Number=SeqID_56119
MSYGIDAVNSCHGTACRKETREVHVCFPVCFAAMCVPWQIQRMNGEGREISVCQCTFNANPMPTDSQHAQSYGGGETVVLDVENGHNLLCEVVAEKRKILTTQICQFRGS

SEQ ID NO: 172898 - protein, 166 aa, Glycine max
  Coding DNA Sequence Number=SeqID_56120
  Gene Ontology: Mol. function=glutathione transferase activity; Cellular component=cytoplasm; Biological process=auxin mediated signaling pathway
  Homolog annotation: Hit_ID=Q9FQF0; Match level="QueryCoverage=99%, HitCoverage=91%, E-value=2e-62, Identity=62%"; Hit description =Glutathione S-transferase GST 8
  Pfam annotation: Domain name=GST_C; Domain location=60-158; Score =70.6; E_value=4.9e-18; Accession=PF00043.15; Description=Glutathione S-transferase, C-terminal domain
  Pfam annotation: Domain name=GST_N; Domain location=6-80; Score=36.7; E_value=8.1e-08; Accession=PF02798.10; Description=Glutathione S -transferase, N-terminal domain
  Pfam module annotation: Pfam domain module=GST_C::GST_N; Domain location=60-158::6-80
MASSQEEVTLLGVIGSPFACRVKIALKLKGVEYKYVEENLVNKSELLHKSNPVHKKVPVFIHNEKPIVFGAAQKAAFTADEKEREKNVEEEHEALQFLENEIKDKKFFGGEEVGLVDIAAVYLAFWIPMFQEIAGLELFTSEKFPKLYKWSQQILNHPVAKRMSAP

SEQ ID NO: 172899 - protein, 254 aa, Glycine max
  Coding DNA Sequence Number=SeqID_56121
  Gene Ontology: Mol. function=glutathione transferase activity; Cellular component=cytoplasm; Biological process=auxin mediated signaling pathway
  Homolog annotation: Hit_ID=Q9FQF0; Match level="QueryCoverage=99%, HitCoverage=100%, E-value=1e-107, Identity=76%"; Hit description =Glutathione S-transferase GST 8
  Pfam annotation: Domain name=GST_C; Domain location=133-227; Score =53.6; E_value=6.5e-13; Accession=PF00043.15; Description=Glutathione S-transferase, C-terminal domain
  Pfam annotation: Domain name=GST_N; Domain location=6-79; Score=88.9; E_value=1.6e-23; Accession=PF02798.10; Description=Glutathione S -transferase, N-terminal domain
  Pfam module annotation: Pfam domain module=GST_C::GST_N; Domain location=133-227::6-79
MASSQEEVTLLGVIGSPFACRVKIALKLKGVEYKYVEENLANKSDLLLKSNPVHKKVPVFIHNEKPIAESLVIVEYIDETWKNNPILPSDPYQRALARFWSKFIDDKITLFTLRWLARFCNISIACVKKNMLESALIVGAAWNAVFTVDEKEREKNVVETYEALQFLENEIKDKKFFGGEEVGLVDIAGVYIAFWVPLIQEIAGLELLSSEKFPKLYKWSQEFVNHPIVKEGLPPRDPVFAFFKGRYESLSASR

SEQ ID NO: 172900 - protein, 101 aa, Glycine max
  Coding DNA Sequence Number=SeqID_56122
RIAARHPWWHCRMKLPENAQQLPLADMEKSSEQEAATEPQRRRRRSDSAWETSSFVNPNLFGEEEEATLREREFIDADLSATLDNLRGTELPPMHLTNVVT

SEQ ID NO: 172901 - protein, 177 aa, Glycine max
  Coding DNA Sequence Number=SeqID_56123
  Homolog annotation: Hit_ID=Q9LSJ1; Match level="QueryCoverage=96%, HitCoverage=88%, E-value=5e-16, Identity=34%"; Hit description =Arabidopsis thaliana genomic DNA, chromosome 3, P1 clone: MFJ20
MEMKREIITKEEEHKEDSMHTIVFTAGTFLLMVCLKHFLVEQWRAWVFLILNVILLAILFMSMRPAKLEDHSSGSEISVEEVKSDNNKLEKKRSRETEEGKDCYTKQCCSSTSSSTYVHVENEKEEDEEEEEEEEEQVPVLSKEELNERVEAFIAMFRQHLISDVKQAENFSLHKIE

SEQ ID NO: 172902 - protein, 94 aa, Glycine max
  Coding DNA Sequence Number=SeqID_56124
AFFDAAGTGLFWLLLLGIIVTALLPHLVICREAEKIAYDRVVESGQYICLLPDFIGCYPKDRGFVITAEQKKKKLIACYNPCLLDDVEFIPSFC

SEQ ID NO: 172903 - protein, 100 aa, Glycine max
  Coding DNA Sequence Number=SeqID_56125
LIILLFRFDIELERETRRFWIVERRARTVAGVDLIILKLKKSNKQRKRPAVVFLHSSYSNKESLRPLLKAYASRGYIAISVDSRYHGERATNTTTYIDVQ

SEQ ID NO: 172904 - protein, 77 aa, Glycine max
  Coding DNA Sequence Number=SeqID_56126
MVFCNSIRVFLGKTLENVKTIFQPMLVFNDTVLSPRVVTDVERDTKTTGMAMILSKVLYNFTTTQGLKNTRAPRAKG

SEQ ID NO: 172905 - protein, 79 aa, Glycine max
  Coding DNA Sequence Number=SeqID_56127
MPYIYDTGFQWAIDNDKCQGRVDSIKPLFEVARDHLGKVAIDKEVARKVWDRIAPGLASQFNSPYSIPTIAPHPLLILN

SEQ ID NO: 172906 - protein, 152 aa, Glycine max
  Coding DNA Sequence Number=SeqID_56128
  Homolog annotation: Hit_ID=UPI00005DC2DD; Match level="QueryCoverage =36%, HitCoverage=7%, E-value=3e-19, Identity=73%"; Hit description =nucleic acid binding / ubiquitin-protein ligase/ zinc ion binding
MNKKIRVNRGLGIVYTLVAKTRLHSVLQMQQRRSSQMKCRRATHVEHTSRCKQGPYATHSKGSTQAAQQSSISSPISFSLLLILDYGSQKAQTLIPMPRSRHEVRGGGVEGQGFGEGVEDKGLGDGRGEVVGGGDDEEDEAVGGGGDKLCEG

SEQ ID NO: 172907 - protein, 121 aa, Glycine max
  Coding DNA Sequence Number=SeqID_56129
GFRWAIDNDEFQGRVETIKPLFEVARDDLGKAAIDKDVVEKVWDRIAPGFASQFDSPYSIPAIAPRPLLILNANLELKHLLGCLGTLGAEDPQCPLGGLEIPRTKASKAYRMFNCSDNFKV

SEQ ID NO: 172908 - protein, 91 aa, Glycine max
  Coding DNA Sequence Number=SeqID_56130
MSCAEDPRCPLGGLEIPRAKATKAYRKFHCLDNFRVYPLKLDEIKLDGVFGWEFFLEYVWNEFIAEAGIGHQVTRFMIKESADWFDRFLNP

SEQ ID NO: 172909 - protein, 33 aa, Glycine max
  Coding DNA Sequence Number=SeqID_56131
MDVLCLVGTSVKPTKHRGRARKASIAARSIKPS

SEQ ID NO: 172910 - protein, 706 aa, Glycine max
  Coding DNA Sequence Number=SeqID_56132
  Gene Ontology: Mol. function=RNA-directed DNA polymerase activity; Cellular component=chromatin; Biological process=RNA-dependent DNA replication
MDAPRIEEVKRLTDEVIHWNEMEEKMLMQRSKIDWIRAEDGNNAFFHAYLKSRQNAKRIKVIHKDDGTILTTQKEITQEVLAFYGKLMDHDSRSLQHVDIDALRRGDHLTMVQREDLVRPVTVKEIEDALNGISDLKSPGVDGYSSKFFKSCWNIVKEDVVNAAQEFFAQDQLFLPFNQTMVTLVPKSDNASTVKEYRPIAVCTTFYKILSKILTAKLNKVLPSVVSLSQATFIPGQAKRGIRQGDPISPLLFVVMMEYLNRLLVKLQLDPNFNHHAKCEKLGIIHLTFADDVLLFCRGDVMSVEMMLHVINKFSATTGFVVNPNKCRIYFGGVDGTTKSKIQQISSYEEGQLPVRYLGVPLTSKKLNIKYYLPLIDKITTRIRHWTSKLLSIAGRVQMCLPIPMSVIKKIDSMCRSFVWSGSTEITRKSLIAWNSVCRPKGQGGLNIFNLKVWNHIAMLKCLWNLCKKADNLWVKWIHAHYIKNSSVMNTMITNNFSWVLKNVLSQREYIHTLQPVWDELLNSERFKMKKAYDKMMEADRVHWSGLVRKNCARPRAIHTTWLACHGRLGTKDRLVRFGMITDKICSLCKEVEETQNHILFSCKIATDIWSNVLNWIGIDHVPQEWPLELDWLLNLTNRKGWRAYLLKLSVTETIYGIWIHRNSKIFGDNTYRNTSKDVSDGIIENIVYRGWGSKKLRKHIASLMI

SEQ ID NO: 172911 - protein, 763 aa, Glycine max
  Coding DNA Sequence Number=SeqID_56133
  Gene Ontology: Mol. function=protein serine/threonine kinase activity; Cellular component=cytoplasm; Biological process=protein amino acid phosphorylation
  Homolog annotation: Hit_ID=Q5I6E9; Match level="QueryCoverage=86%, HitCoverage=93%, E-value=0.0, Identity=77%"; Hit description=AvrPto -dependent Pto-interacting protein 3
  Pfam annotation: Domain name=Pkinase; Domain location=367-700; Score =235.4; E_value=1.2e-67; Accession=PF00069.15; Description=Protein kinase domain
  Pfam annotation: Domain name=Pkinase_Tyr; Domain location=367-694; Score=-24.7; E_value=5.9e-11; Accession=PF07714.7; Description =Protein tyrosine kinase
  Pfam module annotation: Pfam domain module=Pkinase::Pkinase_Tyr; Domain location=367-700::367-694
MERVAEPKVLPRTLPILVEVSNSRTAAARESGQRLNRQEVSGVGGISLREVNQLSRTRDVHVPITHLASIREVAQLTNARIYLVQEDTGFDARSSEESLTFEPTMTWKGNGSSPEEAEEFVPDIETLKGSSDSFEDGGSSLFAGASHPPEPVDTDLMRTVFVPIGQNKSEAGCLIKNLPTKGPFLEDLSIRVPAKKPSPAVLSPEESLVEELNGIGNLSFLGPRTLQSTENSLLPPDAEEKECVWDASLPPSGNVSPLSSIDSIGVVTAMSIVNSCASTYRSDAMTSDGMLSLDRNCDSNKGSVRGDSLESAKTSVSRPSDSSGLSDDSNWSNITGSANKPHKGNDPRWKAILAIRLRDGILGMSHFRLLKRLGCGDIGSVYLSELSGTRCYFAMKVMDKASLASRKKLTRVQTEREILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIRTSYDGDPSKRAGGAFCVQPACIEPSSMCIQPACFIPRLFPQKNKKSRKPRADPGLPSSTLPELVAEPTQARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPMENEVPAGKVVGPVDPVGVGSTSKRIAGTDNMKSGGKYLDFEFF

SEQ ID NO: 172912 - protein, 799 aa, Glycine max
  Coding DNA Sequence Number=SeqID_56134
  Homolog annotation: Hit_ID=Q56W45; Match level="QueryCoverage=99%, HitCoverage=99%, E-value=0.0, Identity=52%"; Hit description=BZIP -like protein
  Pfam annotation: Domain name=DUF630; Domain location=1-60; Score =129.1; E_value=1.3e-35; Accession=PF04783.3; Description=Protein of unknown function (DUF630)
  Pfam annotation: Domain name=DUF632; Domain location=343-676; Score =506.3; E_value=3.5e-149; Accession=PF04782.3; Description=Protein of unknown function (DUF632)
  Pfam module annotation: Pfam domain module=DUF630::DUF632; Domain location=1-60::343-676
MGCTASKLDNEETVRRCKERRRFMKDAVYARHHLAAAHSDYCRCLRLTGSALYTFAAGEPLAVSDDTPAVILKTTTTAAADNPQTHPPPPSAAATSPKLPRIITSDVTRRRKPPSKLPHILSESSLCSTPGSEYSNFFATAPTSKPPHPPPPSAAARRRKPTPKLPHILSESSLCSSPRSEYSNFFPRAQQVQSTTPTSQASSVWNWENFYPPPSPPGSDYFRQKNHKSETPNLETSESESESTYNPFGSKVQRIRKIENITNVDSISQQQNAEREVLESESEYGYLREPVQTEREEVLCSEWEDRYSSSSSSSSEEEGTAKNRSPAKAESDAGGDAPEKKDEKVDDDVAEAAKVAVRHRDLKEIVEAVRENFEKAAMAGDQLSEMLEVSKAHLDRSFKQLRKTLYHSNSILSNLSSSWTSKPPLVVKYRFDAGSLDGPGGSKSLCATLERLLAWEKKLYQEVKAREGVKIEHENKLSALQSQECKGGDEAKLDKTKASITRLQSLIVVTSQAVSTTSAAINGLRDSDLVPQLVELCHGILYMWKSMHQYHEIQSNIVQQVRGLVNQSSEGHSTSESHKQATRDLESAVSAWHSSFCRLIKFQRDFILSLHGWLKLNLIPVNNDNNSSSEPSGVLSFCDEWKLALDRVPDTVASEAIKSFINVVHVISVKQSEELKIKRRTENSSKEFEKKSSSLRSIERKFYSSYSMVGITPPESGPGNGQGLDARDPLAEKKMELAAHQRRVEDEMVRHSKAVEVTRAMTLNNLQTGLPGVFQALTSFSTLFTEALESVCSRSYAIK

SEQ ID NO: 172913 - protein, 209 aa, Glycine max
  Coding DNA Sequence Number=SeqID_56135
  Gene Ontology: Mol. function=RNA-directed DNA polymerase activity; Biological process=RNA-dependent DNA replication
  Homolog annotation: Hit_ID=Q1SQN7; Match level="QueryCoverage=68%, HitCoverage=31%, E-value=3e-18, Identity=43%"; Hit description=RNA -directed DNA polymerase
MKRRSYCTILVLIGSGRAKQLASDLKVNFFKSKVVGIGVDEASMRRYAKVLNCEIMKTRFIYLGIPIGANHRRASTWEPIVQKFKNKWSTWKQRTLSIGGRGRRKITWVGWEDICLPKEKGGNGNGGYIVIIIAFGNKYYVLNIAKGPAEKRYMTNGLTKMYIGGWVMEGDMGLWVGGSWEWNFHWRSDMNLHVLIKEAMVPIGITHVH

SEQ ID NO: 172914 - protein, 247 aa, Glycine max
  Coding DNA Sequence Number=SeqID_56136
  Homolog annotation: Hit_ID=Q33A96; Match level="QueryCoverage=39%, HitCoverage=22%, E-value=3e-28, Identity=63%"; Hit description =Endonuclease/exonuclease/phosphatase family protein, putative, expressed
MPRVHSSRPHLLCLHLPPLPPHALPPPLLCRLLLHLLAPPSPLHQPLVLPHHHPPPRIPRQNTTQRHLDDSSPSLVISNDTSSFPYTFRGGLWSAIRVPWIATRRACGAVEVDRDASCVSFTTVNILALIYKRIDPQALAHKLIYYASLLTAIRKECLRVMDYKELLFNDCGNRVAQLLHVQSVTPFVQNPKGSVPQEFLIVNSHLLFPHDSSMCIVRLNEVYQILQYVELYQRENRLKSMPIILCG

SEQ ID NO: 172915 - protein, 175 aa, Glycine max
  Coding DNA Sequence Number=SeqID_56137
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=79%, HitCoverage=57%, E-value=1e-49, Identity=70%"; Hit description=MADS -box protein GmNMH7
  Pfam annotation: Domain name=K-box; Domain location=54-151; Score =29.9; E_value=1.3e-06; Accession=PF01486.8; Description=K-box region
  Pfam annotation: Domain name=SRF-TF; Domain location=9-45; Score =33.0; E_value=1.1e-06; Accession=PF00319.9; Description=SRF-type transcription factor (DNA-binding and dimerisation domain)
  Pfam module annotation: Pfam domain module=K-box::SRF-TF; Domain location=54-151::9-45
MARGKIQIKRIENTTKKANELTVLCDAKVSIIMFSSTGKLHKIEQSTKQFFDQYQMTLGVDIWNSHYENMQENLKKLKEVNRNLRKEFRYIYLSSLRSISLRMGDCLNELGMEDLRLLEEGMDKAAKVVRERKLRELVLQDIGTYDWPVEECHYCCRCLVCMMLWNFFHAGPLVT

SEQ ID NO: 172916 - protein, 338 aa, Glycine max
  Coding DNA Sequence Number=SeqID_56138
  Gene Ontology: Mol. function=cellulose synthase (UDP-forming) activity; Cellular component=membrane; Biological process=cellulose biosynthetic process
  Homolog annotation: Hit_ID=Q2HVN9; Match level="QueryCoverage=43%, HitCoverage=13%, E-value=3e-66, Identity=86%"; Hit description =Armadillo-like helical
MGRVEYSPLFETRRCRGRFSHITKGEDGNWAWLGMLASELWFGFYWVLTQALRWNLVFRQPFKNRLSQRYEKKLPRVDIFVCTADPDIEPAMMVINTVLSVMAYDYPTEKLSVYLSGDVGSQITFYALLKASNFAKHWVPFCKRFKVEPRSPSAYFKSIVSSGYPTDPSQAKELGAIKNGKQMVEEWALTALAYVADSSEVQFQKYYDVVMPYLKAILVNANDKSNRMLRAKAMECISLVGMVVGKEKFRDDAKQVMDVLMSLQQSQLDADDPTASYMLQAWARLCKCLGQDFLPYMGFVMPPLLQSAQLKPDVTITSADSDTEFDEDDDRCPFSYCY

SEQ ID NO: 172917 - protein, 122 aa, Glycine max
  Coding DNA Sequence Number=SeqID_56139
MTVGGNRRRRQSDDSIVIKFIDNEDDFQITIFKFGRGMVCHIEVKVWVVVKTVEFDPWDKLKDLRKKLVLKQASGIILIALDEVQVHILENEIEIQEYTTVSSDAILLATDELDVVSPTRLL

SEQ ID NO: 172918 - protein, 145 aa, Glycine max
  Coding DNA Sequence Number=SeqID_56140
MARERGGGGTATKGGAHQQDETNQIANPKTNNEKEEEREGGVKERRREKGREEREGMRGYLGDPSSFSSYSAKWRDATGIADLDDEASADLRTNPLQEEGDDAILPRKGPITRAMARRLQEDWARDAREGPRVLISLRVDFEPMG

SEQ ID NO: 172919 - protein, 171 aa, Glycine max
  Coding DNA Sequence Number=SeqID_56141
MISPVKVGNFIFRCGVEMMPPGSLSVLLPIKAKYDVFASTNVNGAALVDEDHGHYEVSDYDEDNHGIVLVDEVDTPKVSTSEIDVGVPDGMKVTLAGLTLLSSIGESARDGVDYTSDLLGRLLFLWRLSTASWLVVSMSSLIFHFVSSSVCVMIPMVLLLVSLLLGSRLAP

SEQ ID NO: 172920 - protein, 283 aa, Glycine max
  Coding DNA Sequence Number=SeqID_56142
  Gene Ontology: Mol. function=RNA-directed DNA polymerase activity; Biological process=RNA-dependent DNA replication
MLDTNTFQQLQKRIAEMERCHKEELRKMKAHHNQLEACARHPHGDEHSANILPERTQGELHPRRTVNTQDDPNEHLDAFLTQENLYTNDDAIMCRVFLMSLKRETLTWYDRLPPTSINSFDTLVECFSAQYATNRSHRMTLAALANLQQADDEFLQKFMDKFGCIAIQIQNFNPEVALHSMLLALWPDNFADSLWEKCSGSGMKFDKSDISTTSEKEAPRYEHYASLMANRTIILKEAFNLEVPIKLPSRKLPKSGSDTAKFSRYHHDIGHNTDDCRALKDKM

SEQ ID NO: 172921 - protein, 445 aa, Glycine max
  Coding DNA Sequence Number=SeqID_56143
  Subcellular localization annotation: CTP_CleavageSite=26; ConfidenceScore=5.12e-01
MPEVVALTSRKVMSLSSPQARMSVIRCRVWVDMLLVLQARSIVSGIPSLTMSSFLFDSAIGLGGSNFEGSIQQPLMDQEVIFNGGPSSENTRYGAFDSESSSSGRLTASHHIGGRHLLHHTKWVRDDVLNYMSSLTSATTVAALQCQVKLKSPEDSCKIVVHACGNDDFPFLRAASGSFPFFFMYRCVFEVMGLFFPLKIFQYALLEHMKLMSKIGWVSLNNVSKKLFEFDSNIFHRFKDHFFKADPTRFKSFDEDLLTFMEKVDKVVLEQLLASLDARAILSLPSVSDPLAALDGKVKPVGGTMSPSVVAPAVGESGQPVAEVSPTVEVVPNVPSSVLAKRKRDENTGVKGLKKSRASSSLRSLRQVAGLTPDLGYPSSLQDVSPAPSTIEAPTYVVVVFVTLASPPPPTMLVQEVAPVVAEVSAAAILGDPVVAPPPPSLHPC

SEQ ID NO: 172922 - protein, 128 aa, Glycine max
  Coding DNA Sequence Number=SeqID_56144
MSKLRFAATIRRSPSTPMKATGEERSPVFLDCDPTSSLSKLRVSSPTPMRSWQQQRLHYQEQSLDLGDDIFEEVEDKIIEAKGTKVLCSVLASKPKWLGLRSASLPTNLSRNLHLVSVQLLISNSTVE

SEQ ID NO: 172923 - protein, 196 aa, Glycine max
  Coding DNA Sequence Number=SeqID_56145
MSLEAAKKARTRVMKWCSPSLRISVAEVGRNNLKTSIESSQEVAKKSLEKAAERVRCLEDDLAKSREEYNNRPNHMLLNLTVKGSREGSILMWVYDRAALPDMMTTPTLHLGFPSRLLIYLHAFCIACNVWVLNLKFCVFRSETIKTEAKGILERNVEFSQLVVDYQQKWRESSESLIAAEELWRKLTMEVNTLFH

SEQ ID NO: 172924 - protein, 217 aa, Glycine max
  Coding DNA Sequence Number=SeqID_56146
  Gene Ontology: Mol. function=RNA-directed DNA polymerase activity; Biological process=RNA-dependent DNA replication
MCLNTEKCTFGVGGCKFLGFMITHRGIEANLNKCTAILEMCSLTNVQQVRKLNDRLASLSMFLLKLAEKVWRKPELTGRMVAWSIKLLEFDHHYEPCGHTKTQFKGSGAGIILKGPDHVTLEQALSLNFKASNNQVEYETFIASLKLATKVGPRSYDSTQTRNLSKDRLPTVEVKRIRFQVLWKKIDAKIGRKSLEEKLKIGTTRLVHKIGPTRLLA

SEQ ID NO: 172925 - protein, 134 aa, Glycine max
  Coding DNA Sequence Number=SeqID_56147
  Gene Ontology: Mol. function=RNA-directed DNA polymerase activity; Biological process=RNA-dependent DNA replication
  Subcellular localization annotation: CTP_CleavageSite=55; ConfidenceScore=5.28e-01
MTVLRRKPEGGTLSSHQGTYQTSPTANGATQLMSVDEGSPPSNMLRIHPSIFSTSSSSVPRVCPKDAYPLPNIDMLVDGVSGFQVLSFLDTYSGYNQIRMHAPNEEKMEFITEDANFYYRAMPFGLKNANARHQ

SEQ ID NO: 172926 - protein, 128 aa, Glycine max
  Coding DNA Sequence Number=SeqID_56148
MEERSSVGTILPYGKRFFRMYVQKKVLPYESTEERSSIRDIRSYGRTFFRGFIGRTFFRANDFHTSTNTKEALKGWEIENTDLEGGDDANAPTKLQKWTKVAASNRRTQGRSGRVRVEEGETNGRSWE

SEQ ID NO: 172927 - protein, 123 aa, Glycine max
  Coding DNA Sequence Number=SeqID_56149
  Subcellular localization annotation: CTP_CleavageSite=24; ConfidenceScore=5.15e-01
MNLSIAVVGVATYLSAGGQGKIKRASSKKGKCTGVATNLYLRKTLEKAKRVCKFQRKGFGSCLHAGKEMRGFSTLAACPGELLLQPKVILLAQASSANLGELVTSPLSYLGPRANQGLEKGLK

SEQ ID NO: 172928 - protein, 110 aa, Glycine max
  Coding DNA Sequence Number=SeqID_56150
MKKKRDSEEEKKTKSELAREKKKEVVPSSGKEAPYPLVSSKKDKEQHFSCFLDIFKKLEITIPFGEAFRRDCEDFPNVMARARQHNDDGIGNPRKATKKARAQEALVFKG

SEQ ID NO: 172929 - protein, 95 aa, Glycine max
  Coding DNA Sequence Number=SeqID_56151
MALTSNIKNGLNDIVARGHIDNDDLHAGFHRLGHQEGKGVILGLFLEPAGLPCGFLVGGFVRGSFSRGWFVAGDGGQRGHWEEELVWLSQEDVKS

SEQ ID NO: 172930 - protein, 128 aa, Glycine max
  Coding DNA Sequence Number=SeqID_56152
MVDIMLYERPRPKSVNKKTMGLVFDKDWEDITEETVDIMLYERPSPKSVDKKTMGYVVVIAIPKEEYREGLEDCKSYLHSRILLAKGVPPPRVSDLQAKALASFGTLAYGPNWKRLLQFFFLLSLRFT

SEQ ID NO: 172931 - protein, 451 aa, Glycine max
  Coding DNA Sequence Number=SeqID_56153
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P08470; Match level="QueryCoverage=91%, HitCoverage=91%, E-value=0.0, Identity=86%"; Hit description=PTS system sucrose-specific EIIBC component (EIIBC-Scr) (EII-Scr) [Includes: ...
  Homolog annotation: Hit description=Sucrose-specific phosphotransferas e enzyme IIB component (EC 2.7.1.69) (PTS system sucrose-specific EIIB component); Sucrose permease IIC component (PTS system sucrose -specific EIIC component)]
  Pfam annotation: Domain name=PTS_EIIB; Domain location=2-19; Score =1.6; E_value=0.1; Accession=PF00367.11; Description=phosphotransferas e system, EIIB
  Pfam annotation: Domain name=PTS_EIIC; Domain location=88-373; Score =244.5; E_value=2.2e-70; Accession=PF02378.9; Description =Phosphotransferase system, EIIC
  Pfam module annotation: Pfam domain module=PTS_EIIB::PTS_EIIC; Domain location=2-19::88-373
RRSCATRLRLVLVDDAKADTAAIGKLDGVKGCFRNAGQLQVIFGTGVVNKVYAAFIREAGISETSKSEAADIAARKLNPFQRIARLLSNIFVPIIPAIVASGLLMGLLGMVKTYGWVNPDNALYIMLDMCSSAAFIILPILIGFTAAREFGGNPFLGATLGGILTHPALTNAWGVAAGFHTMNFFGIEVAMIGYQGTVFPVLLAVWFMSVLEKQLRRVIPDALDLILTPFLTVIIAGFVALLVIGPAGRMLGDGISFVLSTLIAHAGWLAGLVFGGLYSVIVITGVHHSFHAIEAGLLGNPAIGVNFLLPIWAMANVAQGGACLAVWFKTNDVKIKAISLPSGFSALLGITEAAIFGINLRFMKPFIAGLIGGALGGAWVVSVHVYMTAVGLTGLPGMAIVQASSLLNYAIGMAVMRGQPRALNDAHYPGWHLAPVTGLLNDPNGFIHFAG

SEQ ID NO: 172932 - protein, 235 aa, Glycine max
  Coding DNA Sequence Number=SeqID_56154
  Gene Ontology: Mol. function=DNA binding; Cellular component =chromatin; Biological process=chromosome organization and biogenesis (sensu Eukaryota)
  Homolog annotation: Hit_ID=Q9LTA2; Match level="QueryCoverage=69%, HitCoverage=58%, E-value=1e-14, Identity=29%"; Hit description =Similarity to AT-hook DNA-binding protein
  Pfam annotation: Domain name=DUF296; Domain location=82-207; Score =74.8; E_value=2.7e-19; Accession=PF03479.5; Description=Domain of unknown function (DUF296)
  Subcellular localization annotation: CTP_CleavageSite=74; ConfidenceScore=5.40e-01
MAISTSQNSVSFDLDLTSSWLNHTSSSSQCPRCPPSPATNQPLENLPLTNPPTKKPHGRPAGSKNKPKITPFLVAQPVEPCMKVIIVNVTPSSDIIESILDVAHRGHVSLTVLSASGTITGVTLNNSSHGVDALTLRGPFTLLSLNGSYLYNNHYALHPGATPAPPLSFGISFSTSQGQVFGGAIGGRVIADNDVSLTICTFKNPVMYKYASRDKERDTVMDWSPWVVNDVKVTT

SEQ ID NO: 172933 - protein, 229 aa, Glycine max
  Coding DNA Sequence Number=SeqID_56155
  Subcellular localization annotation: CTP_CleavageSite=16; ConfidenceScore=5.02e-01
MDMNLGALISGQITSMAQSNSSRLGFLALIIALCKSRGVTSDSLVFERLSSVINLAYIKKNCWNPDDRTVTIRGASRARTRPAEAPSTSTAPPPARTPAAPSATAPADFQRLEAMLQSIHQGQIILLQSLQMHIEDESSETTTPEPLVRRKKADQTQEVAATSEKSLEATSEPSELVADTTSLQQVAYPCTLEDQTMPVLSLNTSPTTTHVLHLTDEEDVQTEDTQDRS

SEQ ID NO: 172934 - protein, 34 aa, Glycine max
  Coding DNA Sequence Number=SeqID_56156
MTISVVEHDNDEEITQRRWGDCIVFDTQVGAYTL

SEQ ID NO: 172935 - protein, 162 aa, Glycine max
  Coding DNA Sequence Number=SeqID_56157
  Gene Ontology: Mol. function=DNA binding; Biological process =metabolic process
  Homolog annotation: Hit_ID=Q49KC8; Match level="QueryCoverage=98%, HitCoverage=43%, E-value=6e-61, Identity=67%"; Hit description =Transposase
METKAITSIKREVMGSFLIEKVLVAIKEKWPREDLGSPIFIQQDNARTHINHDDLEFFQAATQDGFDIRLMCQPANPSDLNVLDLGFFSATQSLQLKESPKPIDELVSAVLCMIEIMKAKGSNKYKIPHVNKERLEREGQLPTQMKCDLVLAEEVFTYVNTS

SEQ ID NO: 172936 - protein, 161 aa, Glycine max
  Coding DNA Sequence Number=SeqID_56158
  Subcellular localization annotation: CTP_CleavageSite=18; ConfidenceScore=5.60e-01
MATPPNSPPPKLATPFSPSMSKKTRKATQLRSLATRPAGVERPMAEFDILESSDLRTKKKILQTALTHDKESEDDKLCEKYDIRKEKWTQICKSCRDPSWKDVQKKVQAIHKQTTAPHMLSRIGYDFLEKKLMEEKQKKRLEEATPSKSTSIVIDPPSPII

SEQ ID NO: 172937 - protein, 43 aa, Glycine max
  Coding DNA Sequence Number=SeqID_56159
  Homolog annotation: Hit_ID=Q2QTX4; Match level="QueryCoverage=70%, HitCoverage=8%, E-value=2e-07, Identity=70%"; Hit description =Exodeoxyribonuclease III family protein, expressed
MEHAPGESCWMPTDFYTKIRTWSEVSHGLETQWGGPHNVGRVP

SEQ ID NO: 172938 - protein, 61 aa, Glycine max
  Coding DNA Sequence Number=SeqID_56160
MEFGVTIYLARVIATIELSSRYGSKLAYDTGIWGESYRLFAAKFLFGMAFVDNWVVGKERS

SEQ ID NO: 172939 - protein, 79 aa, Glycine max
  Coding DNA Sequence Number=SeqID_56161
MDRISHLELALVLVSVRVMKYPKVGSHGVCLHILEALPLVGYIVRTLGVESEVEEMGKILKNLVVSLVSNNRASLVVGA

SEQ ID NO: 172940 - protein, 85 aa, Glycine max
  Coding DNA Sequence Number=SeqID_56162
MAQVVEGKVEAQHPKFGQTQVVVGGSSMMDKRSSVTRDDLGRNISRDGDGDNIESCQEVPYIHQLYDVRQMGLWGRAKLGNKTVD

SEQ ID NO: 172941 - protein, 47 aa, Glycine max
  Coding DNA Sequence Number=SeqID_56163
MVSKVWSFNGGFNGEEEEEKSNVRSLHAVSLVLVPRISMHPSGPVFK

SEQ ID NO: 172942 - protein, 103 aa, Glycine max
  Coding DNA Sequence Number=SeqID_56164
  Homolog annotation: Hit_ID=Q2HV31; Match level="QueryCoverage=44%, HitCoverage=7%, E-value=4e-12, Identity=78%"; Hit description =Prefoldin
MVQVQPINKRRNEVDRKVEANLKAIEEIKAITDMALRNAKMADSAKVEVEGELRLVEEQLREGPIIPLLSRGTSRGYSRFQLSGNCPAYILFIICYSFSNHST

SEQ ID NO: 172943 - protein, 90 aa, Glycine max
  Coding DNA Sequence Number=SeqID_56165
  Gene Ontology: Mol. function=DNA binding; Biological process=DNA integration
  Homolog annotation: Hit_ID=Q0KIN0; Match level="QueryCoverage=97%, HitCoverage=5%, E-value=1e-20, Identity=53%"; Hit description =Integrase core domain containing protein
MALATWELMWVKKLLKELKFYEIQHMQLHCDNQAELHIALNPIFHDRTKHIEFDYHFVQQKLLAKEISMGKSSSNDQLEGDLNQPISVPG

SEQ ID NO: 172944 - protein, 181 aa, Glycine max
  Coding DNA Sequence Number=SeqID_56166
  Homolog annotation: Hit_ID=Q2HUH8; Match level="QueryCoverage=46%, HitCoverage=21%, E-value=2e-10, Identity=38%"; Hit description =Histidine triad (HIT) protein; Homeodomain-like
MPPSSNVEPPTSGISQNPHFFYVSTTPNQPKHDSIIGVDQSLTQYWERIKEAYNNDKECGEFTRREVTQLKYRWNQIHPPVQNFNNCYKYEVTHKRSVSSEKDITADAHMIYSQDTGTPIEVEEYDTTSPMSCPIRQKAKKRKSKGKGHVSASNSLDLSGTKSVVKDKNPNIAKLIKLKEL

SEQ ID NO: 172945 - protein, 76 aa, Glycine max
  Coding DNA Sequence Number=SeqID_56167
MHYSSLISNTSIIHIMDPKIDLDALLDQMVDEELEDNTEQEVIRLILESQQQVGNTRKHKNEKKGGMRNHQERHDQ

SEQ ID NO: 172946 - protein, 106 aa, Glycine max
  Coding DNA Sequence Number=SeqID_56168
  Pfam annotation: Domain name=Myb_DNA-binding; Domain location=20-65; Score=19.0; E_value=0.017; Accession=PF00249.21; Description=Myb -like DNA-binding domain
MVCGAAVNQRTRSGRLHLWRKSDENEEKAAFLQAVSSFGKDFRMILRHVGTKSKDRCKKFFIKGQNSHRLDLMRHRLENIGSLLNEVNLSSTTNTNYAQVGKLLVG

SEQ ID NO: 172947 - protein, 177 aa, Glycine max
  Coding DNA Sequence Number=SeqID_56169
MEMDGSGIDGASHIGRRNEFLEGLCGFEEVATSNADLDEFRVELGVQEVRDHVGDLGDEIRVEGVVGGEGFGGEGLRWNRCVLLRGHGRWRQSSESEKEGLEELRDGEGATNECAYKKPSWVKSKKVPTMPFFEPSHDSGSDSSITFQSPKDHKRKFWKNANNASLCLSSKRSIDNV

SEQ ID NO: 172948 - protein, 127 aa, Glycine max
  Coding DNA Sequence Number=SeqID_56170
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=89%, HitCoverage=14%, E-value=7e-23, Identity=48%"; Hit description =Lipoxygenase
  Subcellular localization annotation: CTP_CleavageSite=54; ConfidenceScore=5.09e-01
MALAKELMGFSSFVSASYKVFLHNKHGTFWVNTILLPSDNTRVVRLRKGAKFPMAAISEDLIKTTLTVHAEKPVQFKDFKETILKHLDAINDRIGTRNIVLELISTEIDPSKPAFHNSPFESFSFSS

SEQ ID NO: 172949 - protein, 250 aa, Glycine max
  Coding DNA Sequence Number=SeqID_56171
  Homolog annotation: Hit_ID=O82171; Match level="QueryCoverage=16%, HitCoverage=10%, E-value=3e-10, Identity=73%"; Hit description =Expressed protein
  Pfam annotation: Domain name=ArfGap; Domain location=143-226; Score= -36.6; E_value=0.034; Accession=PF01412.9; Description=Putative GTPase activating protein for Arf
  Pfam annotation: Domain name=SWIRM; Domain location=47-132; Score= -0.6; E_value=0.1; Accession=PF04433.7; Description=SWIRM domain
  Pfam module annotation: Pfam domain module=ArfGap::SWIRM; Domain location=143-226::47-132
MELSHTIGAALRPLVEWPFAPTPVGTVPFSSCAYWGVVACSLYSNFPHPVASNGRLEEGFHKIILEGCHSKTVFAKPSEKDVVLRRSTSCNKYKEEPFSRHTLTEVRKSHVGDVTFLHKVFLFLEHWGLINFDTTPPSSHADEEYIEEEYCKMCLDFNVKNPTCASITYGIFLSMDCSTVHRSLDMHISFVRLVFADFVSMPLPVPKSSPQATHLRFFTIFVNSLQPLNTHWNPSPLCSGFLQAKRRTVS

SEQ ID NO: 172950 - protein, 99 aa, Glycine max
  Coding DNA Sequence Number=SeqID_56172
  Gene Ontology: Mol. function=structural constituent of ribosome; Cellular component=ribonucleoprotein complex; Biological process =translation
  Homolog annotation: Hit_ID=P29344; Match level="QueryCoverage=51%, HitCoverage=13%, E-value=3e-12, Identity=74%"; Hit description=30S ribosomal protein S1, chloroplast precursor
MAQTFRQRIAQVEAMARADMLRQSGLTIKDDEILGPFTSYFPEEGLDLSEVNYCYFEAGENKEALVKLVTYVHSNSTTKGIKIKSNYKKDNKNKIGEKR

SEQ ID NO: 172951 - protein, 48 aa, Glycine max
  Coding DNA Sequence Number=SeqID_56173
MEKKVSLEVKPEEGDRGKWVLDSSVEYKGRVPLRASIGSWKDAFFIIV

SEQ ID NO: 172952 - protein, 141 aa, Glycine max
  Coding DNA Sequence Number=SeqID_56174
MLSKTACAGDSEKVSKKNQNNKVTSLAEKAMSLQFDLVWECCRQLQAQDLTVKVDRVFSTYEFSIEVAARFLVNPNLTSATRMALRLSSKTKGVSTLDIWPWKYLVLWMSESATMFANVVSAQVISQLNEPNTSVETIDKT

SEQ ID NO: 172953 - protein, 205 aa, Glycine max
  Coding DNA Sequence Number=SeqID_56175
  Gene Ontology: Mol. function=sequence-specific DNA binding
  Homolog annotation: Hit_ID=Q8X3N0; Match level="QueryCoverage=45%, HitCoverage=73%, E-value=2e-16, Identity=48%"; Hit description=, complete genome
  Pfam annotation: Domain name=DUF1044; Domain location=1-109; Score =95.6; E_value=1.5e-25; Accession=PF06296.2; Description=Protein of unknown function (DUF1044)
  Pfam annotation: Domain name=HTH_3; Domain location=150-204; Score =46.7; E_value=8e-11; Accession=PF01381.12; Description=Helix-turn -helix
  Pfam module annotation: Pfam domain module=DUF1044::HTH_3; Domain location=1-109::150-204
MIADIKLCLAARELIAGQYEASLGGGVYKKRIPLGAGKSGGARAIVAFKSQKHLFFVNGYAKSTTKSGIREIKEDELNLYRQVASQLFAMTTEQERAAIKARKMREEIAHDFNPLGVVSDELTEKIDSRVRLRELRTSLPVLQLMSGEAIRELRERHGLSQAMLAAYIGLSPATVVKWEREEKKPNGAALRLLNIIDRKGLEVLR

SEQ ID NO: 172954 - protein, 299 aa, Glycine max
  Coding DNA Sequence Number=SeqID_56176
  Gene Ontology: Mol. function=transcription factor activity; Cellular component=membrane; Biological process=regulation of transcription, DNA-dependent
  Homolog annotation: Hit_ID=Q2DB59; Match level="QueryCoverage=99%, HitCoverage=96%, E-value=2e-62, Identity=47%"; Hit description =Putative LysR-family transcriptional regulator
  Pfam annotation: Domain name=HTH_1; Domain location=3-62; Score=79.6; E_value=9.8e-21; Accession=PF00126.17; Description=Bacterial regulatory helix-turn-helix protein, lysR family
  Pfam annotation: Domain name=LysR_substrate; Domain location=86-297; Score=101.0; E_value=3.6e-27; Accession=PF03466.10; Description=LysR substrate binding domain
  Pfam module annotation: Pfam domain module=HTH_1::LysR_substrate; Domain location=3-62::86-297
MELRQMRHFIAVAEHENFTRAAQSMHIVQSALSTSIKQLEEELGTPLFIRSTRQVRLTMAGKVFLDYARTIGAFVEKASQEVAAIVALKTGTLSIGTVQSVPPFIDLPQLLETFIRRFPDFDVKLCQGSSAKLNAKVHNQQIDLAIMPVEEVSDRLSSRIIACDEIVVAFAADYAGFTAMQPDVTMAHLAQQSFIDFEAGQGTRKVNDNSFALQGLSRKVTFEVSDLETLLSLVERNMGIALLPEQVVKARSTTLHYCRISDVDMCWELAVAWLSDRPGSMNVYDRPVQEFMDILGSSD

SEQ ID NO: 172955 - protein, 143 aa, Glycine max
  Coding DNA Sequence Number=SeqID_56177
GLILSVLIYILPTFENGPRRVQRNARNWNQRGGTQTEAGFQHPKRSNFSPLWLSMKSNQRKKKFQQLLPPFHVAFFSSSSPPLLPPLRLQIPLHFYPKLQGIAIFGVLEHTSTSWGFKFQVEKCEILRVRKAKFGVSGNWSLK

SEQ ID NO: 172956 - protein, 49 aa, Glycine max
  Coding DNA Sequence Number=SeqID_56178
MDKDFTLHFNQWSSNLKEGLDQTYLREVAKEKKHRLLTMLECNEHDARP

SEQ ID NO: 172957 - protein, 457 aa, Glycine max
  Coding DNA Sequence Number=SeqID_56179
  Gene Ontology: Mol. function=RNA-directed DNA polymerase activity; Cellular component=chromatin; Biological process=chromatin assembly or disassembly
MVPPANGGVETKQSGEKGYVVLQIVSIPSSSFISGISLDLPLAVMAEATHNQAALWEHEEHLKHCITSKLENFDSEINATDQGGPHHRDERHANSNYSCGAHLARIDFPRFSGDAVQQWIYQCETYFAIDGTPMDFRVKLVVIHFKGKALQWHTSFVKTLPEGNLPKWTESTNILIDHFGEVCDDPMAKLMQLRQKGIVVEYHDQFGAITSRLEPQDVRKAFQLAKLYESASSSYIPTKTFPKFQKTQPSTKAILPTPNLTHKPIDSQFTLNPTQRQPNKKLTPAFMAERRSKGLCYFCYEPYSPNHALTHKKLEIHVLEGVAKKLGCLITDIPILSVAIADGARDSLKSGIVQKSSSPFASLVVLVGKKNGTWILCVDYRDLNKQKINDRFLIPLVNDLLDELHGSKMFSKIDLWSGYNQVRMEDSDIHKTAFKTHGGHFEYLVMPFGLTNAPATF

SEQ ID NO: 172958 - protein, 68 aa, Glycine max
  Coding DNA Sequence Number=SeqID_56180
MNSEKAKVKLKSDLGEAKDDILKNSRSRLILGDSSSQDPNRQGELFLEAEVLAKRVIEEPTQPITWFF

SEQ ID NO: 172959 - protein, 128 aa, Glycine max
  Coding DNA Sequence Number=SeqID_56181
MVPKNRLRIYTRLCLGGNVVIIFVENEDGLLHQTVVFLYYHLLFTISSYSPPVYFIYHLFDYYLPRSCSHSVHDSQSITLSPSVGASSWEPCFVTLSPSISCLSRHYSVHGLCIAIECLILVNGVEVH

SEQ ID NO: 172960 - protein, 183 aa, Glycine max
  Coding DNA Sequence Number=SeqID_56182
MTEWAKAGKFQAEKDEGKQKKHPEDDWAPPPPLPTSSPRTTMVTLGPQNEGPSKRPRLELVLIATLFYRDDKFDKADIESQLALVEYAKAEQALVEAAKGNETLLQLAEDSQKSLKDTKTNFTLALQDEVEHLVEYAKDEQALVEAAKGNETLLQLAEDSQKSLKDTKTKLSEAETQEKSLKT

SEQ ID NO: 172961 - protein, 804 aa, Glycine max
  Coding DNA Sequence Number=SeqID_56183
  Gene Ontology: Mol. function=RNA-directed DNA polymerase activity; Cellular component=chromatin; Biological process=chromatin assembly or disassembly
  Pfam annotation: Domain name=Chromo; Domain location=424-478; Score =28.1; E_value=3.1e-05; Accession=PF00385.14; Description='chromo' (CHRromatin Organisation MOdifier
  Pfam annotation: Domain name=rve; Domain location=172-336; Score =16.7; E_value=0.00024; Accession=PF00665.16; Description=Integrase core domain
  Pfam module annotation: Pfam domain module=Chromo::rve; Domain location=424-478::172-336
MAVKNWPIPTSLKQLRGFLGLTRYYRRFVRGFGGIARPLTNMLKKNNFHWSDKAKAAFQSLKDSLIQSPVLALLDFSKVFVVEVDASGYGIGVADPDIQKLIQDLKIGASSHKHHTWNHNDFRRKGRLVVGKDLTLWTDLLQWIHAGPTSGHLGREATLKRLKSVVYWRGMTKDVRIFVLNCEVCHKCKYDKSAYPGLPNSKGKQVIYVVVDRLSKAAHFMSLTHPYTATEVAQSFLHNVLMLHGFPDSITSDRDPIFVSQFWKDLMAFQGVQLQLSSAYHPQTDGQSENGGTIPTITLPYSAVLRGDVWPASSNLPSLFSGMKQLADKKRSDRLYEIGDFVYVKLHPYKQISVAFRLNAKLAPKYFGPFQIEDKIGVVVYKLKLPQGSKIHYVFHVSQLKSHVGEAPVSNFLPIDSDGVMGGKEPELILDRATIKRGNRAVPKVLVKWKHQLIEDATWEFFYDLKKMWLIIAAQLPGRTDNDINKYWNTKLKRKLMGLLPSSHQRIAPCQQFSSQNPSSFPSHSSLSSSQYRDYYYNNSNHYYIPAPTSYFISLEPISAPSSNHRNTITTSNSLPFYQHQERPWSVRVLGSITPSQTIPCLCLVVKQVAARLMEAANMNKFMNINHDGGQEYVNQWTQNPNGYIFQIEQTTLDYDLEVIRNLICSKSSSNSNNRYLSVDENKTEEKDSPNQLLYHFEQPIDRLPLIPGILDIIGIRYTGGGCERFGGGTMLSSKVPLIEEGSNDNLFHHHEGSDATGGNVSSIPNAGSALFGVAIEKGLCPNFAIRPNPGEDEAKLSLPPSFS

SEQ ID NO: 172962 - protein, 149 aa, Glycine max
  Coding DNA Sequence Number=SeqID_56184
MGAPVHLSNSAGSGNCNRIGFHYLLHAYHGLHHCGHFLFHGLHVGLHLLLHLLYFTHYSSSSTGSVSCTDLHYLLYAIMVSIIVAIFSFKASVSAFICSCTSYTSPITLALAQNAMNNATNEKDGCETGSNRDINNPKCVGSRRSSDVT

SEQ ID NO: 172963 - protein, 87 aa, Glycine max
  Coding DNA Sequence Number=SeqID_56185
MSSHISKTKMPSVIACFQKVTMTIIYMVEDDDVFSHCMPSKGNNDPHLHFEDDNVFSHCMPSKVTMSSSTFRRRQCLQSLHAFRRRQ

SEQ ID NO: 172964 - protein, 77 aa, Glycine max
  Coding DNA Sequence Number=SeqID_56186
MATMMEAMMNMKKMMEVNAAVVAATSTVAELDPTPPYGFHQVNHLASDMVVRGGKELGRAGGPHFVQVQNEHSFPPE

SEQ ID NO: 172965 - protein, 87 aa, Glycine max
  Coding DNA Sequence Number=SeqID_56187
MEFSRIAVPSILKRPIKGCISSNNNPRTKLGYDKEVASPELVPHPSPAPVLEDLESSAPALVPDQPLAQDPLAALVLDLNEHAEDHL

SEQ ID NO: 172966 - protein, 146 aa, Glycine max
  Coding DNA Sequence Number=SeqID_56188
ALWGNNSELKLRREERDQSRVDSLILKDELKVCLRSKRSLSQHLCETQTNMLAIISKYQEELNLATAHEHKVADEYARVYVEKQAIGRVFDSLHQEAIMSMDRFALTLNGSQELPRLLAKAKAMAETYSAPEEIHGLLSYCQHMID

SEQ ID NO: 172967 - protein, 110 aa, Glycine max
  Coding DNA Sequence Number=SeqID_56189
MKKILGLQAPMELASSGNQSTRASSRKAGVAAHDVQRYVKESDRAAQCTRQDKMSNEELKLQDPRCRIQCPGHPARKYWTHKSVISLTDCAGSTMSDTMSRTSCPKILDT

SEQ ID NO: 172968 - protein, 164 aa, Glycine max
  Coding DNA Sequence Number=SeqID_56190
MAPTRHPLDPDKSNKALGFPALITGLCQSYGVPVTPSKVIPPPITRAFIEKYCTPRQAQGDAHQAADAPPPPRQADPAGSLGVERYLHHLVCQQAANHHGQGQGSAPFACPTPEQFGAEVAWPGDWPDAQVGEELAGSLGEPDESHMDEDMIDLLGFLGGSGAT

SEQ ID NO: 172969 - protein, 126 aa, Glycine max
  Coding DNA Sequence Number=SeqID_56191
GRVPPKRDAWRDLTGRWDRGGSGGLPDTTTSDGLPGATSSGGALGATTSGSLSSATTSGKRDMAGPPLVDAPDRLPQVVAPGAPPLLVAPGRPPLVVVPGRPPLPPLSHRPVKSRHMSRSGGTRPS

SEQ ID NO: 172970 - protein, 82 aa, Glycine max
  Coding DNA Sequence Number=SeqID_56192
KRRSRDESRHRLVTKRARRTKSVSYLCFPLISDKRKFESKYFRNASVSDSVEILHRSSSFFIRSSFVLHSSRFSFLPFFNVL

SEQ ID NO: 172971 - protein, 54 aa, Glycine max
  Coding DNA Sequence Number=SeqID_56193
MSCAPPRFEQNGCVLGVADNVQQGVNGFTLCSVGFEVIYARVPFEGLRVAPTGS

SEQ ID NO: 172972 - protein, 138 aa, Glycine max
  Coding DNA Sequence Number=SeqID_56194
MDNIRFTAPFRVQKNLLQVPFTYQRQWLCNYPKYVLFHYDGEIHFIRTLPAAASKFVYGSKKSITIHHGLSKSTKWPLTIHHDIPAITQPWFNLIHEKNLRPGDEVVFYYPFHDHALELLIRKAIEWNNSNTDLDFDE

SEQ ID NO: 172973 - protein, 288 aa, Glycine max
  Coding DNA Sequence Number=SeqID_56195
  Gene Ontology: Cellular component=extracellular region; Biological process=sexual reproduction
  Homolog annotation: Hit_ID=Q9M0I2; Match level="QueryCoverage=85%, HitCoverage=86%, E-value=4e-81, Identity=61%"; Hit description =Expansin-B3 precursor
  Pfam annotation: Domain name=DPBB_1; Domain location=78-158; Score =113.7; E_value=5.2e-31; Accession=PF03330.8; Description=Rare lipoprotein A (RlpA)-like double
  Pfam annotation: Domain name=Pollen_allerg_1; Domain location=194 -271; Score=21.3; E_value=3.8e-05; Accession=PF01357.11; Description =Pollen allergen
  Pfam module annotation: Pfam domain module=DPBB_1::Pollen_allerg_1; Domain location=78-158::194-271
MQLHRVSAASKLSLTCLSLALKLVLLYAAEAQLQHRGPDLHWYPGTATWYGDPEGDGSTGGACGYGTMVDVKPFRARVGALGPLLFMKGEGCGACYKVKCLDKSICSRRAVTVIITDECPGCPSDQTHFDLSGAAFGRMAIAGENGPLRDRGQIPVIYRSVADLTESNCPTYDNSKFWGRVSLEHVPQHYHHWHFRIDRLSSKDLKACDMGPMLNSNIPHFSLTAGSTEWLQMNHLWGANWCIIGGPLRGPFSVKLSSSTGRSLSARDVIPTNWVPKATYTSRLNFYP

SEQ ID NO: 172974 - protein, 53 aa, Glycine max
  Coding DNA Sequence Number=SeqID_56196
  Gene Ontology: Mol. function=hydrolase activity; Biological process =aromatic compound metabolic process
  Homolog annotation: Hit_ID=Q9ZP87; Match level="QueryCoverage=98%, HitCoverage=17%, E-value=4e-13, Identity=58%"; Hit description =Epoxide hydrolase
MGEKDYVFKFPGMEDYIRSGAVKNFVPDLEIVYIPEGSHFVHEQMPEKAKGLV

SEQ ID NO: 172975 - protein, 89 aa, Glycine max
  Coding DNA Sequence Number=SeqID_56197
VTGCTLYGGAHGSGLCIPTKETSHEVNYMGNQPGQNFNAVQGGPPNRPQQQGPSLSERTTKLEETLAQFMQVSLTNHKSTESAIKNLEV

SEQ ID NO: 172976 - protein, 245 aa, Glycine max
  Coding DNA Sequence Number=SeqID_56198
  Gene Ontology: Mol. function=hydrolase activity; Cellular component =peroxisome; Biological process=aromatic compound metabolic process
  Homolog annotation: Hit_ID=Q9ZP87; Match level="QueryCoverage=99%, HitCoverage=73%, E-value=4e-83, Identity=62%"; Hit description =Epoxide hydrolase
MEKIQHSEVEVKGLKLHVAEIGSGHFLSAYWNTLQNSSKAVVFLHGFPEIWYTWRHQMIAVANAGYRAIAFDFRGYGLSEQPAEPEKETMFDLVHEIVGLLDALSISKAFLVGKDFGAIPGHLTTAVHPERVAGIITLGIPFMLPGPSAVESHLLLPKGFYITRWREPGRAEADFGRFPVKSVIRNIYILFSRSEVPIAADDQEIMDLFDPSTALPPWFSEEDLATYASLYEKSGFKYALQVPYR

SEQ ID NO: 172977 - protein, 43 aa, Glycine max
  Coding DNA Sequence Number=SeqID_56199
MECRIFVKDSKSLCKSSSTSWRCSTMPFSIAQALDLAWRGRGR

SEQ ID NO: 172978 - protein, 53 aa, Glycine max
  Coding DNA Sequence Number=SeqID_56200
MYFFKDRRARVFRRRERQFKAPVLEVHYVSAIVLSKESYDVVRVEEEVSVVSS

SEQ ID NO: 172979 - protein, 78 aa, Glycine max
  Coding DNA Sequence Number=SeqID_56201
MEMLKKEGNKMGIWAHNRIKSSSEAWESGTSDADQWRKIRWMTGEMKENEELVLVGLRSLRKLGHHHKDGRNEGSAKK

SEQ ID NO: 172980 - protein, 330 aa, Glycine max
  Coding DNA Sequence Number=SeqID_56202
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=4e-41, Identity=33%"; Hit description= UPI00006A17C9 related cluster
RIHVLAFRGLPVLTFRGLHALPFKGLHVLASIRLHALTFRGLHVITFRRLHALTFRGLHVLAFRGLDALAIRGLHVVTFIGLHVLAFRGLHVLAFRGLHVLAFRGLHVLTFRGQHVLAFRGLHVLTFKGLHALAFRGLHVLTFIGLHTLTFKGLHVLTFIGLHVLTFIGLQALTFRGLHRTTFPPLQRTTRPPLQRATRPRLQRTTHPHLLRTTRPCLPRATRPPFQRTTRPRLQRATRPPFYRATCLCLQRTTFLASRGLHVLAFRGLHALTFNRLHVLAFRGLHALAFRGLHILAFRGLHALAFIVLHVLAFIGLHICTFRELKVLRP

SEQ ID NO: 172981 - protein, 112 aa, Glycine max
  Coding DNA Sequence Number=SeqID_56203
  Subcellular localization annotation: CTP_CleavageSite=55; ConfidenceScore=5.12e-01
MRGYVMVTRTFCQPGANEPVDARRVTSSSAPFVIISRQLMVTRTFRQPGANEPINAQRLNHLLHVLSSLPVKSGYMRGYLMVIHTFGQPGANEPVDARGLTSSSAPFVVLHL

SEQ ID NO: 172982 - protein, 242 aa, Glycine max
  Coding DNA Sequence Number=SeqID_56204
  Gene Ontology: Cellular component=extracellular region; Biological process=cellulose and pectin-containing cell wall organization and biogenesis
  Homolog annotation: Hit_ID=Q9SZM1; Match level="QueryCoverage=97%, HitCoverage=97%, E-value=7e-82, Identity=59%"; Hit description =Expansin-A20 precursor
  Pfam annotation: Domain name=DPBB_1; Domain location=62-137; Score =116.1; E_value=9.9e-32; Accession=PF03330.8; Description=Rare lipoprotein A (RlpA)-like double
  Pfam annotation: Domain name=Pollen_allerg_1; Domain location=148 -225; Score=135.0; E_value=2.1e-37; Accession=PF01357.11; Description= Pollen allergen
  Pfam module annotation: Pfam domain module=DPBB_1::Pollen_allerg_1; Domain location=62-137::148-225
MGVLQSTLLYLILVHSCKIVAYKDQEWKKATATYANDTEGSLITEGACGYGDLHRASYGKHSAGLSTILFNRGSTCGACYEISPSVVVTVTDFCAPNYGLSVDYGGWCNFPREHFEMSRAAFAEIAKNKADIVPVQYRRVKCARSGGMRFTMCGSSHFYQVLISNVGLDGEVFAVKVKGSRTGWIPMARNWGQNWHCNFNFQNQPLSFEVTSSSGKTLTSYNVAPTNWMFGQTFEGKQFEHE

SEQ ID NO: 172983 - protein, 742 aa, Glycine max
  Coding DNA Sequence Number=SeqID_56205
  Gene Ontology: Mol. function=alcohol dehydrogenase activity; Cellular component=membrane; Biological process=electron transport
  Homolog annotation: Hit_ID=O34215; Match level="QueryCoverage=58%, HitCoverage=98%, E-value=0.0, Identity=81%"; Hit description =Gluconate 2-dehydrogenase cytochrome c subunit precursor
  Pfam annotation: Domain name=Cytochrom_C; Domain location=316-404; Score=40.2; E_value=6.9e-09; Accession=PF00034.11; Description =Cytochrome c
MAMIKSLTALLLGTLSFAALAEDTAADALVQRGEYLARAGDCVACHSTAGGKPFAGGLPMATPIGTIYSTNITPDKATGIGDYSYDDFQKAVRHGVANNGDTLYPAMPYPSYAVVSDDDMKALYAYFMHGVAPVAQANKESDIPWPLSMRWPLAIWRGLFAPDVKAFQPAAQEDPALARGRYLVEGLGHCGACHTPRSFTMQEKALNNGQGNDYLAGSSAPIDGWTASNLRGDNRDGLGRWSEADLQQFLRYGRNDHTAAFGGMTEVVQHSLQYLSDADISAIARYLKSLGAKDPSQAVFREDDAVARALWKGDDSQPGAGVYVDSCAACHKTDGSGYQRFYPALRGNPVVMAEDPTSLIHIVLVGGTLPGVKGAPTAITMPAFGWRLNDSQVADVVNFIRSSWGNGVQTKVTAKQVAKLRQDDSVQLKQGSADIRDDHMSVGYYDPTKPGQENYVNSPYQYWKGVVEDKSVSYIEFAINGQLFTTQVQADGSWEYQLPLRLEEGSHNLTVRFFDRAGNAGIPFQTRLEVDLSPPDMPAIMRVLDDFGPVQGPVGNKGFTDDKTPAISGYAEPDSIVRLYSNGVLTGSVQAAKNGQWTITPALSDGEQRLSVTATDKFGQVSVDSPVYTLFVNSPRIDKPQLLEVYDNEGVNTGVIKAGSESDDRSPRLSGNAPLDAENVIIFVNGVRVGVAPVIDGQWRWESNVDLLGYGENTITTRAQNNRGELSDASEPFTYTVVPTAP

SEQ ID NO: 172984 - protein, 241 aa, Glycine max
  Coding DNA Sequence Number=SeqID_56206
  Gene Ontology: Mol. function=transferase activity; Cellular component= integral to membrane; Biological process=negative regulation of transcription
  Homolog annotation: Hit_ID=Q1T0X6; Match level="QueryCoverage=96%, HitCoverage=54%, E-value=1e-113, Identity=78%"; Hit description =Lanthionine synthetase C-like; Glycoside transferase, six- hairpin
  Pfam annotation: Domain name=LANC_like; Domain location=1-241; Score =173.6; E_value=5.1e-49; Accession=PF05147.3; Description=Lanthionine synthetase C-like protein
MTKPCVVQIKLSKDLPDELLYGRAVVVDEVIKNGRALGRKGRCPLMFEWYGEKYWGAAHGLAGIMHVLMDMELKPDELEDVRGTLKYMISNRFRSGNYPVSEDDRKSDALVHWCHGAPGMALTLVKAAKVFGDKEFLDAAIEAAEVVWNRGLLKKVGICHGISGNAYVFLSLYQLTGDVKYLYRAKAFACFLLDRAHKLISRGEMHGGDRPYSMFEGLGGMAYLFLDMSDPSLSKFPAYEL

SEQ ID NO: 172985 - protein, 95 aa, Glycine max
  Coding DNA Sequence Number=SeqID_56207
MTGHGKNVLSVAVDDILQVGSQDLFVKDGKTQLLIKGDAQDVVKLDDILGDGGDVGDWVKQQGSTTVAGVKYQVYSHSGVDADVLIQEGVKTELV

SEQ ID NO: 172986 - protein, 1045 aa, Glycine max
  Coding DNA Sequence Number=SeqID_56208
  Homolog annotation: Hit_ID=Q7N104; Match level="QueryCoverage=43%, HitCoverage=95%, E-value=0.0, Identity=74%"; Hit description =Aminobenzoyl-glutamate transport protein
  Pfam annotation: Domain name=ABG_transport; Domain location=196-590; Score=493.7; E_value=2.1e-145; Accession=PF03806.4; Description=AbgT putative transporter family
  Pfam annotation: Domain name=MFS_1; Domain location=677-1032; Score= -2.5; E_value=0.00041; Accession=PF07690.6; Description=Major Facilitator Superfamily
  Pfam annotation: Domain name=Sugar_tr; Domain location=673-991; Score= -143.2; E_value=0.022; Accession=PF00083.14; Description=Sugar (and other) transporter
  Pfam module annotation: Pfam domain module=ABG_transport::MFS _1::Sugar_tr; Domain location=196-590::677-1032::673-991
AQEQAFAAEIRATLSKDDLRNARLNAARTGGEAGIAWAEELGDKVLMDEVAPYAVTRELLYGSTDVGDVSCVTPTAQCFAPCFAFGTPLHTWQLVAQGRTPIAHKGMCLAAKVLAATALTLLHDDAALARCREEFDRVRREQPYVCPIPAGGRHLWRPGTNASPLKKYKQYANITDKTTHEDLPMEVMTENRSPGKLFSWIERVGNKVPNPFLLFVYLIVVLMIATALLSSLDVAVKNPANGELVRVNNLLSVAGIQWILPNIIKNFSGFTPLGSILALVIGAGLAEKVGLLQSLMVKMASRVSRRYASYMVLFIAFFSHISSDAALVVMPPLGALIFLAVGRHPVAGLLAAIAGVASGFTANLLIVTTDVLLSGISTEAAKAVSDTVHVSVIDNWFFMASSVIVLTVAGALLTDKFVEPRLPVWNSGHHDRLPPLTAQENRGLKAAGLAALVFIGVMALLVVPEHAPLRNPKTGGIIPSPFIQGIVPIIILFFFVVAIAYGAVTQQIRRADDIPRLLVDPMKSMAGFIVMVFPLSQFVAFFNWSNMGKFMAIGLTDRLGDLVDPCAGICADVYAARLSPGVCPDDFPHRRFRRAAAGADVAVSAAVPRFPAALSKRRAARHLLRADLPVSAGVLCDVDRAAAGVATDRIATERQTLAGRIDALPSSAGLWRFITLLALGGFFELYDLFETGYISAGLVAAGVFHTGTAGVFGIADQAAFASATFLGLFVGASLLTPYADRFGRRLTFMCALAWYGAFSLLMAFQHSAEMIILCRFLVGIVPVGADGGADVMVAGTANPARPRRLALGRDRRCAVLAGDLVYPEKPAGVGALAGAAGAASGRAPDDFSQRDAATQLPKKGRFSEIWAPAYRQRTLMLVVMNFFQAIGFFGFGNWLPALLSGKGATVTHSLLYAFFITLAYQLGSLICSRYADRLENKWQIVFSSLMTVVFGTLFALTSNPLLMVPAVDRLQQYSDWPDSAVCRQSGGDRVYRAEYADGDAVGRDLRAEDAGAGSGEHLNRMGAGWAAAGSARQCAPFGAARFIAR

SEQ ID NO: 172987 - protein, 412 aa, Glycine max
  Coding DNA Sequence Number=SeqID_56209
  Gene Ontology: Mol. function=nucleoside transporter activity; Cellular component=integral to membrane; Biological process=entry of virus into host cell
  Homolog annotation: Hit_ID=P0A927; Match level="QueryCoverage=64%, HitCoverage=92%, E-value=1e-131, Identity=79%"; Hit description =Nucleoside-specific channel-forming protein tsx precursor
  Pfam annotation: Domain name=Channel_Tsx; Domain location=178-329; Score=314.6; E_value=1.8e-91; Accession=PF03502.4; Description =Nucleoside-specific channel-forming protein, Tsx
  Subcellular localization annotation: CTP_CleavageSite=37; ConfidenceScore=5.13e-01
PHKAGDVNNGKNDPLIGQQLFTLSYPLKSAFGAGYMEASSRQSVGESWRLTLSGNSLSVQRKAVTPLSSGSDKIPHNPDNVNGCGVPFVTRPLCTLRGPENPARQTGDNSTLPIPWDRFHPIAAFARRSRASGALLASSWTGAAQAAESDPQYLSDWWHQSVNVVGSYHTRFGPQFNNDVYLEYEAFTKKDWFDFYGYLDLTNFFGVGNSNANGIFDHGSPMFMEIEPRFSIDKLTGTSLAFGPFKEWYFANNYIYDMGRNSDSRQNTWYMGLGTDIDTHSDIGLSLNVYAKYQWENYGAANENSWDGYRFKVKYFVPITDLWGGKLSYIGFTNFDWGSDLRDKSDRSRTSNSIASSHILSLNYDHWHVSTVARYFHNGGQWADGQELNFGNGPFEVKSTGWGYYLVVGYNF

SEQ ID NO: 172988 - protein, 71 aa, Glycine max
  Coding DNA Sequence Number=SeqID_56210
  Gene Ontology: Mol. function=transcription factor activity; Biological process=regulation of transcription, DNA-dependent
  Homolog annotation: Hit_ID=Q7N101; Match level="QueryCoverage=97%, HitCoverage=23%, E-value=9e-14, Identity=51%"; Hit description =Putative transcriptional regulator AbgR
MACTSLVANIDFVSIIARDVIEDPTHGGQLIALDLDDPLPKATFYLIQRKDTALTPMSAYMAQLFRRYCQP

SEQ ID NO: 172989 - protein, 691 aa, Glycine max
  Coding DNA Sequence Number=SeqID_56211
  Gene Ontology: Mol. function=calcium ion binding; Cellular component =extracellular region; Biological process=pathogenesis
  Homolog annotation: Hit_ID=Q8XQP2; Match level="QueryCoverage=73%, HitCoverage=85%, E-value=2e-54, Identity=30%"; Hit description =Probable hemagglutinin/hemolysin-related protein
MVNIGTQYNRPERAHQEAGTKGHQRQHQRSKRIVARKKGFCNGGGVVAKHHKIVHLKKVTAACRRANRCDPVHHCTLQKYKQSFDPFSSINTLRVGTPYPLLSGSLPAHAGEVIEFIINDHRYSTPIAADGSWSFQPPCALSEGSHDVVACISDSGEPHPFSVDVALSVPDKPAITALFDDVGSETGPVGRGHTIDDTTPKVQGYALPGSTVRLYDHDRLIGSTVASKSGEWSLEPLLGAGGHQLTVTATDEFGRVSEPSDHFDITVVDSGPVPPTISYAIDDVGTVQGQLASGSTTDDFSPLIVGRAEPNSIVYLFAQNDHGGIGYKGSVKTDANGDWVIQSRAMISGDGIYTFYASYENSKDDYRPDFSLNMSALENLRPAIDCARDDTGAHTGQVYHRGTTDDKTPVLEGRGAPGSIVEIEYNLSNSGWHSAGSVTVDAQGNWQFAGFELTYFGEWGFRSRGVADGKASAWSDKFELLVIPGAPLEPTIDYAWDNAGPLQGPVYQHDSTDDTTPTLHGSGTPGQVIEIEYGVQGEGLRHAGSVLVDADGKWSFTSPYLHQPGVWEYQARASTGEMKSNWSSKFVLNVSPDAAFDQQAQDEAQPDALTLHQLLSEGGKGLFVEDDSTQLLVNGKPGDSVQLQDILPAGEAVDGWTQQTGTLTIAGTQYHVWSHGDAELLVQDGVKIELV

SEQ ID NO: 172990 - protein, 302 aa, Glycine max
  Coding DNA Sequence Number=SeqID_56212
  Gene Ontology: Mol. function=metalloendopeptidase activity; Cellular component=periplasmic space; Biological process=proteolysis
  Homolog annotation: Hit_ID=Q6D8I0; Match level="QueryCoverage=90%, HitCoverage=28%, E-value=1e-123, Identity=77%"; Hit description =Protease III
  Pfam annotation: Domain name=Peptidase_M16; Domain location=55-193; Score=171.1; E_value=2.8e-48; Accession=PF00675.10; Description =Insulinase (Peptidase family M16)
MRIYARWIGALLLSMLALNAFADDGRGWQPIDETIRKSDHDPRSYQAITLSNGMTVLLVSDAAAPKSLAALTLPIGSLDDPDSQLGLAHYLEHMVLMGSKNYPQPDNLAEFLKKHGGSHNASTASYRTAFYLEVENDALQPAVDRLADAIAQPLLDPTNADRERHAVNAELTMARSRDGLRMAQVGAETLNPAHPGSRYSGGNLDTLSDKPDSNLHQALLDFYHRHYSANLMKAVIYSNKPLPEMATIAAQTFGRVANHQASVPDITVPVVTDAQKGIIIHYVPAQPRKHLKIEFRIANDSD

SEQ ID NO: 172991 - protein, 446 aa, Glycine max
  Coding DNA Sequence Number=SeqID_56213
  Gene Ontology: Mol. function=exodeoxyribonuclease V activity; Cellular component=exodeoxyribonuclease V complex; Biological process=response to DNA damage stimulus
  Homolog annotation: Hit_ID=UPI00005F7FF0; Match level="QueryCoverage =97%, HitCoverage=38%, E-value=1e-138, Identity=54%"; Hit description= COG1330: Exonuclease V gamma subunit
MNDGVYPRTLAPLGFDLMQQQTRKGDRSRRDDDRYLFLEALISAQQQLYISYIGRAIQDNTERYPSVLVTELVDYLAQSFCLPGDEACEPDVSEQRVRAHLQCLHSRMPFAAENFQPGSHVQSFAAEWLPAATGSGVAQPGFVQPLPVQPLTTLSLEQLLRFWRHPVRAWFQQRLGVAFWMEESELPDSEPFAPDSLERYQINAELLNTLVNGDDPAQLYAHHRAAGNLPYGAFGELFWQSQTEEMQEVAAEVSAQRLPAESWEVNLTLGATQLTGWLTQVQADGLLRWRPGVLNINDGLLLWLEHLVYCALGGNGISRMYGRKQSRWRFAAVAPAQAQAQLAEYVAACEAGLAQPLLLLNKSGGAWLDASFDSKSGQLQEDDATQKKALSKLLQAWQGGYQVEGEGSDPYLQRLCRTLDEPTQQQIIAAARQWYLPVRLAHQDDV

SEQ ID NO: 172992 - protein, 500 aa, Glycine max
  Coding DNA Sequence Number=SeqID_56214
  Gene Ontology: Mol. function=transcription factor activity; Biological process=regulation of transcription, DNA-dependent
  Homolog annotation: Hit_ID=Q885B8; Match level="QueryCoverage=26%, HitCoverage=32%, E-value=2e-38, Identity=63%"; Hit description=Major facilitator family transporter
  Pfam annotation: Domain name=HTH_1; Domain location=18-77; Score =65.1; E_value=2.2e-16; Accession=PF00126.17; Description=Bacterial regulatory helix-turn-helix protein, lysR family
  Pfam annotation: Domain name=LysR_substrate; Domain location=101-286; Score=18.6; E_value=4.8e-05; Accession=PF03466.10; Description=LysR substrate binding domain
  Pfam annotation: Domain name=MFS_1; Domain location=276-491; Score= -46.7; E_value=0.043; Accession=PF07690.6; Description=Major Facilitator Superfamily
  Pfam module annotation: Pfam domain module=HTH_1::LysR_substrate::MFS_ 1; Domain location=18-77::101-286::276-491
AVLTLSNQPENMDNSDNLTAMMLFARVVERQSFSEAARTLGISKSHVSREIARLEVRLGIKLLQRTTRKVALTELGQAYYPFCTRMLEEMHRADAFVQQVHQQPAGNVRLQAPITFGCQCVVPTLNTFIRRHIHINVDLELTTSDDPQPSADVAIVIRARAPEVANYRELSSIDWGLYASPAYLAAHPAIDHPERLMRHDLLLFHGPAHTAALPFRRDKQRLALDHGAAQCGPGRNRRGVSAGLYDAGGAGARRDSAGAAGMADGSPAQLPAAERAAAALVTGHLALRRADHYAGCAPAKKAKNRDITMSHSSIALAPEQQHWRRNLWEPAAIARWSGAAYGATFLSAALTAPLWGKLADRYGRKLMLIRASLGMAVAMSLIGMATAPWQLVALRLLAGLLGGYASGSTILVAAQTPKAQTGWALGVLSSGIMAGNVVGPLLGGVLPPLIGIRHTFWLTGAVIFLAFLATTFLLKEAPRAAKKAAAGEGDEPEASINRPV

SEQ ID NO: 172993 - protein, 40 aa, Glycine max
  Coding DNA Sequence Number=SeqID_56215
MAHKFCFEALDHSLRDIIKHNSKDSTIFGDPASHSKRQPQ

SEQ ID NO: 172994 - protein, 88 aa, Glycine max
  Coding DNA Sequence Number=SeqID_56216
MNPVETWAVRFKFRSQLRQSSVLDVSEELHHIRSLIATLGLKSSDYDPGNSTCLTPTKRISCQQTSYDFDSDEHAQYPLSTNKHIKVE

SEQ ID NO: 172995 - protein, 69 aa, Glycine max
  Coding DNA Sequence Number=SeqID_56217
MSCQHDFVGYSFTGKNPKKFDIPSKCTIDELKDLIKQVTPQGIPPYGIHESQTVMEMEDDVSRSQHDSM

SEQ ID NO: 172996 - protein, 193 aa, Glycine max
  Coding DNA Sequence Number=SeqID_56218
  Gene Ontology: Mol. function=RNA-directed DNA polymerase activity; Cellular component=intracellular; Biological process=RNA-dependent DNA replication
WILLLQEFDLVIKDKKGSENVVVDHLSGLVNEDVTSKEAEIRDKFPDESLFLIEGRPWFADMANFKAAGICVASEEAKGILWHCHNSPCGGHYGRSKIVAKVLQSGFFWPTIFKDAHHHVLKCDQCQRIGGISRRNEMPLQNIMEVEVFDCWGIDFMGLFPSSAGNEYILVAVDYVSKWVEAMAMQGMMLKLW

SEQ ID NO: 172997 - protein, 241 aa, Glycine max
  Coding DNA Sequence Number=SeqID_56219
  Gene Ontology: Mol. function=chitin binding; Cellular component =extracellular region; Biological process=chitin metabolic process
  Homolog annotation: Hit_ID=UPI000044A8F0; Match level="QueryCoverage =51%, HitCoverage=99%, E-value=1e-20, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LQVLTFRGLHALAFRGLHVLTFRVLHAFTFIGLHALSFRGLHILAFRGLHALACRGLHAFAFRGLHVLTFRGLHIVAFSGLHVLTFRGLHALIGLHALAFRGLHILAFRGLHVLAFRGLHVFSFSGIHICAFRELKGQLGEHNQRRRLSHSYRAYRGKILLRPLQGDEDCAHKTPSGPEEVQQGPGVSSSDYGPLSVIRSARHPQQGRHRARYHNSLGTASSGQQMHRHHLQSPPQLIYKG

SEQ ID NO: 172998 - protein, 66 aa, Glycine max
  Coding DNA Sequence Number=SeqID_56220
MEKSDTKTFNDKKEMKAYITWEDNDMDSFRDSKNEVMNLSLMAKNYESEEEMHSMTCIKNQSNLQN

SEQ ID NO: 172999 - protein, 68 aa, Glycine max
  Coding DNA Sequence Number=SeqID_56221
MEDAPVSLASLARKRKVITSQDLSDNTNSLTAPNYMGHQVYHMLTIAEEPMDFLGGRVRVHHFFGLRQ

SEQ ID NO: 173000 - protein, 158 aa, Glycine max
  Coding DNA Sequence Number=SeqID_56222
  Homolog annotation: Hit_ID=Q1SWX1; Match level="QueryCoverage=98%, HitCoverage=30%, E-value=4e-10, Identity=26%"; Hit description=IMP dehydrogenase/GMP reductase
MGSSQAPSLKNRFYQIKIKSLGVASLKELGQLMGQLQRQAFRKANGKIWELTMAEVSIEAIASLAQFYDQPLRCFTFGDFQLTPMVEEFEEILGCPLGGRKPYLFSGFYPSLARVSKIVKISTQELDREKQVENGVVGVPTKCLEAEARTLASQDELA

SEQ ID NO: 173001 - protein, 348 aa, Glycine max
  Coding DNA Sequence Number=SeqID_56223
  Homolog annotation: Hit_ID=Q1SFC5; Match level="QueryCoverage=58%, HitCoverage=26%, E-value=8e-25, Identity=36%"; Hit description =Asp/Glu racemase
MALQIHEGQNFGFGRLLLAVLYESLGEACDDLKKSKDGSSFLVSGPMWLLQLWLNATFEQEMGLIIPQDYAEEVANRSIEGQRALRLTPKSLNQSSQKLFLKYMRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSHFCTMGFVTWWEKYYSTRSIGDTTIMISRLESGFTQPTVENIRSNLQARGKTIMTKKSTETSRADVRPKKPTGVKIQEGKQEEKEEEERPLIRKRKLPSTSTKSAEQTETGNSQA

SEQ ID NO: 173002 - protein, 89 aa, Glycine max
  Coding DNA Sequence Number=SeqID_56224
MRLPGKESLLMKSPITINEILDVSISFLNDHLEETLGSTKIEENHSKCINLAQCGARKKRSLAHGISVGNQREKTILGRGFLSFFLFIW

SEQ ID NO: 173003 - protein, 369 aa, Glycine max
  Coding DNA Sequence Number=SeqID_56225
  Gene Ontology: Mol. function=catalytic activity; Cellular component =integral to membrane; Biological process=metabolic process
  Homolog annotation: Hit_ID=Q2KWX1; Match level="QueryCoverage=59%, HitCoverage=56%, E-value=2e-79, Identity=66%"; Hit description =Putative membrane protein
VFLADVEQFAALRQGLVEIGARETEPRAGRRVAGLVVGGRFGVAARVVALEQAVEDHGDAEQDGGIQGHRPQREAIAQRRHLRSAQHRGQGHCAAGRMQAAQPEHGGNRQRGGRGGGHAGVGDRLGAEHADQGRDEIARHDRPGLGQRAGGRGEQQHGGSAHGRDEPRIGAAQRMVSDPFGAEQPDQRAYRAIELLACIDADRRWRERTQPALDCHTQNLLLAVPDISGDDNLSRGAPGGGMSLCLQVGSRQAGQDALGLVGQHHFDAAAIGGIGFAADQVEPLQPVDQFGGGVRSHQQAFGDLAHVQAASAGRAGAAALDGQQRLVLLRHQFKAGGGVFAEGGELAQRVAEIGQQFVVRGGGQGGGLG

SEQ ID NO: 173004 - protein, 151 aa, Glycine max
  Coding DNA Sequence Number=SeqID_56226
MTIICLCVPPDSIVSGWQKVAWITIIFLRMSSGSPPLDDKRCRMTIICLCVPPDSIVSGWEKGARMNINCLRMSSGSPPLHYKRCRMTIICLCGAPDSIVSGWQKGVRMNIICLRLSSGSPPLDDKRCRMTIICLCVPPDSIVSGWRKVHG

SEQ ID NO: 173005 - protein, 241 aa, Glycine max
  Coding DNA Sequence Number=SeqID_56227
SEFLIGGYVGARASLLSTAPLFVTMTQELVARGDTLRLSAPRHSVTLSVIDEQRPVWSFAPFPEMSASSGGDFFKSHKLSRTTSCDMHPLSSKGGGPDDTRRYLTVIRTFCHPEAASPMIRGDTLRLSAPFCHPEAAGPMTSRDQVWSFCTLVSSRGGGPDDTRRYLTVIRNLLSSRGGGPDDKQRPNLAAGPMTSRDQVWSFCTLVSSRGGGPDDTQRYLTVIRTLLSSRGGGPDDKQRP

SEQ ID NO: 173006 - protein, 82 aa, Glycine max
  Coding DNA Sequence Number=SeqID_56228
MLQTNQCFSLVMNRVLACVTNLAGSTGETAYMEHLAVSTGEIALTQYLSCTHLAKKNGGISAALACAASGTPFSPVLLAASP

SEQ ID NO: 173007 - protein, 36 aa, Glycine max
  Coding DNA Sequence Number=SeqID_56229
MGLGLASKISSSSISQVTNILTHRLCGLITAKYELF

SEQ ID NO: 173008 - protein, 87 aa, Glycine max
  Coding DNA Sequence Number=SeqID_56230
MAIIPSHDCDLQAKVVDFVAPNGGLYIPKLQVVSPMEYTNDVPAWKFNMDEEFNLDFDYRSITSHNNSGDPLFIWHWLGTKRIRIFF

SEQ ID NO: 173009 - protein, 124 aa, Glycine max
  Coding DNA Sequence Number=SeqID_56231
MIESFQQQQQMSVLELYVEKDIAGESFEEDDIVDGISDTDDEVTDIVEPVSIVHPTEGVPGIQNPFWNDALHYNNINCSHPDEEDICGLDMPTTFNVGQELYVGMNFDSKDAVKNALKQYVMKA

SEQ ID NO: 173010 - protein, 465 aa, Glycine max
  Coding DNA Sequence Number=SeqID_56232
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O80919; Match level="QueryCoverage=71%, HitCoverage=83%, E-value=1e-108, Identity=53%"; Hit description =Expressed protein
  Pfam annotation: Domain name=DUF231; Domain location=296-465; Score =212.3; E_value=1.1e-60; Accession=PF03005.6; Description=Arabidopsis proteins of unknown function
MEKARASYVAVSPMQKARPSCVACLANGEGKSFSYVARVASAEGETFLSPVSPMEKARPSPTWPVSGPVTPMPVADHVHNHQEVSSATFVKPNLSGHLKQAAEVLDRFSRCNSTVEYNGRKVAWLGDSQHSGKWVFDNVSHPLYNESDCPYMSDQLACHKHGRSDLGYQYWRWQPHNCNLKRWNVKEMWEKLRGKRLMFVGDSLNRGQWISMVCLLQSVIPADKRSMSPNAHLTIFRAEEYNATVEFLWAPLLVESNSDDPVNHRLDERIIRPDTVLRHASLWENADILVFNTYLWWRQGPVKLLWTAEENGACEELDGHGAMELAMGAWADWVSSKVDPLMKRVFFVTMSPTHLWSREWKPGSKGNCYGEKDPIDLEGYWGSGSDLPTMSTVEKILRHLNSKVSVINITQLSEYRKDGHPSIFRKFWEPLRPEQLSNPPSYSDCIHWCLPGVPDVWNELLFHFL

SEQ ID NO: 173011 - protein, 797 aa, Glycine max
  Coding DNA Sequence Number=SeqID_56233
  Gene Ontology: Mol. function=RNA-directed DNA polymerase activity; Cellular component=chromatin; Biological process=chromatin assembly or disassembly
  Pfam annotation: Domain name=Chromo; Domain location=692-740; Score =28.6; E_value=2.3e-05; Accession=PF00385.14; Description='chromo' (CHRromatin Organisation MOdifier
  Pfam annotation: Domain name=RnaseH; Domain location=180-297; Score= -17.3; E_value=0.0023; Accession=PF00075.14; Description=RNase H
  Pfam annotation: Domain name=rve; Domain location=408-564; Score =94.0; E_value=4.5e-25; Accession=PF00665.16; Description=Integrase core domain
  Pfam annotation: Domain name=zf-H2C2; Domain location=349-390; Score =24.4; E_value=0.0002; Accession=PF09337.1; Description=His(2)-Cys(2) zinc finger
  Pfam module annotation: Pfam domain module=Chromo::RVT_1::RnaseH::rve: :zf-H2C2; Domain location=692-740::1-163::180-297::408-564::349-390
ESMLQKGLIRPSTSPFFSPVLLVRKHDESWRFCVDYRALNAITIRDRFPIPTIDELLDELGQAYIAKTAFCTHHGHYEFKVMPFELCNTPSTFQATMNMLFRPFLHWFLIVFFDDILIYSITFNDHVLHLQQAFQVLLDNQFVLKLSKCTFAQPQVEYLGHVVLQRGVEPVSSKVDALPFTVETDASGIGMGAVLSQRGHPIAYFSKPFPPKLRHSSAYVRELFAVTTAVKKWCQYLLGHRFTIITDHRSLKELLTQVVQTPEQHTYLARLMGYDFQIQFRFGATNQAADALSRLSKEESSFSLILSDIQATPAKYPDFSISNNLILRKGRIWLPPHLPLLTTLLTKYHATPTGGHLGIAKTIAQLMDKFYWDGLRDDVARFVSNCLDCQHSKYETKCVAGLLCPLPVPHRPWEDLSLDFITGLPAFQGNTTILVVVDRFSKGIHLGMLPTSHTAYTVAALFMNIVGKIHGLPRSMISDRDPLFLSRFWQDLFRLSGTHLRMSSSYHPQSDGQTEALNRAIEQYLRAFVHRRPSSWGKLLMWVEWSHNTSWNVATGSTPYRITFGRKPFNYPEYLAEDSKLEVVDDMLTNREDTFRLIRKKLLKAQELMKKPHRQTSAKPQSSSSGKLSKRFYGPFTITERIGPVAYRLKLPEGARIHPVFHCSILKPFKGTPTPADSVSLPDQFAHDQPIVSPLAILDYRYNSDILGSPWEVLVQWSGLAPDETSWESWSQLSREYHLEGKVNFQGPWDDRQTGVQQVTKVQQAIQEQGANINKKVQTEGRAKRVITKPSYLKDFV

SEQ ID NO: 173012 - protein, 145 aa, Glycine max
  Coding DNA Sequence Number=SeqID_56234
MACQVRVEQVPQSLKRAVRAIILQPWILSNKVFKFLCDIEFGYVVVNPLIFPFLGRVLLAPAMVECCHRRSVHLHGDFDIVRNQVFDVFVGDVIIGGVPIPLNASAIVPISGAAAGKGCCSYSSVHFIPMEDEAESPLPNAPQML

SEQ ID NO: 173013 - protein, 262 aa, Glycine max
  Coding DNA Sequence Number=SeqID_56235
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=66%, HitCoverage=12%, E-value=1e-20, Identity=30%"; Hit description=Chromo
MADQPHGTSSSPIETAILKLTTLQVSLGETVQSMAQKFDELLLRLPSTSPSPSSQPIPSISPVPSHQHRMKLDIPRFNGTDPFGWTRFAPSHYDDPTGNLFKLTQRGSVTQYLSEFKELANRIVGLPPQFLLSCFISGLTPKIRREVQSLQPLTLVQAAGLARLQEEKLLDTHSTFRNHTPPVLSVPQPRPISMPGLLQAPSSPAPSSQPPPLVKRLSPAKIASCCERGLCFTYEEKYHRGHRCDSRVFLLVAAEDDNPDPI

SEQ ID NO: 173014 - protein, 56 aa, Glycine max
  Coding DNA Sequence Number=SeqID_56236
MVTRLKIDHQIQDGHWTQNDVKWSLDVTPDAGHGNDPWMRHGMLDAKRITGRDIGH

SEQ ID NO: 173015 - protein, 162 aa, Glycine max
  Coding DNA Sequence Number=SeqID_56237
  Homolog annotation: Hit_ID=Q9LHL7; Match level="QueryCoverage=99%, HitCoverage=61%, E-value=2e-23, Identity=31%"; Hit description =Arabidopsis thaliana genomic DNA, chromosome 3, P1 clone: MEC18
  Pfam annotation: Domain name=Aha1_N; Domain location=17-124; Score= -25.8; E_value=0.0027; Accession=PF09229.1; Description=Activator of Hsp90 ATPase, N-terminal
MEDHLDGTNIHNWHWSENNCLDWFKTFFSNLPILDSEGNLFLKMTSLHALKGEAYVNASKGKIVSGYKFPQVFNVSDENANEDPKVKVIVNYEELSMAKGDPIKDEWEPKKVSSLMSLVATMTRATTTKVNAPLKENSTRKKEKEKEKKARKSISMIYRFNC

SEQ ID NO: 173016 - protein, 147 aa, Glycine max
  Coding DNA Sequence Number=SeqID_56238
  Subcellular localization annotation: CTP_CleavageSite=53; ConfidenceScore=5.54e-01
MATPPASPPPPLPPPPADASASSSMLKQTHKATWLRSLVTRPPGAERPVVNIDLATGKANGPHKKKLRTYLGIVTRDKVDVTYETLKEVPAAQKDLIWEDIQTVGERWRQLKSDLTRKWALAVNKDGVDDIVCEKYDISKEKWAQFG

SEQ ID NO: 173017 - protein, 54 aa, Glycine max
  Coding DNA Sequence Number=SeqID_56239
MKENGLDALSARRDNVLAGRAGCALSALLSGSTFSRVLFSLSESGSLAKRMSLA

SEQ ID NO: 173018 - protein, 172 aa, Glycine max
  Coding DNA Sequence Number=SeqID_56240
MASKKRRASSSRPQEPYDTSRFVSKIGWERYETNVHHRNILPKQNVELAYSQYDEFLRELERRQWHKNLTRQMENHIGLALVKEFYSNLEKYSAYFRYCHIHHDHQAIVTKLCLPGQGFVLNADGALWKLLRKDLTTLSQTWSVLSYSNLAPTSHTSDLNMDREQGWCMTWS

SEQ ID NO: 173019 - protein, 80 aa, Glycine max
  Coding DNA Sequence Number=SeqID_56241
  Gene Ontology: Mol. function=DNA binding; Biological process=DNA integration
  Homolog annotation: Hit_ID=Q1SKC8; Match level="QueryCoverage=79%, HitCoverage=15%, E-value=2e-19, Identity=71%"; Hit description =Integrase, catalytic region
MATPKNDAKTVVKFLKKNIFSRFGVLKVLISDGGSHFCNIQLQKVLRHYSVTHKVASPYHSQINEETVALRARGDEVECL

SEQ ID NO: 173020 - protein, 78 aa, Glycine max
  Coding DNA Sequence Number=SeqID_56242
MGMIVSLRGAEGLTGAGMGARGVGARTDASEGAQALAFRDPGNHKDLNIKESDTTPLAKHNAVIRAGKPNQEELDWAI

SEQ ID NO: 173021 - protein, 92 aa, Glycine max
  Coding DNA Sequence Number=SeqID_56243
MVEEVSALHKIDTWDIVSLPLGKSANGSCWVYKIKAKPDGYEEIQSSLGCQRVFSTVCSLGNFSFHHSLSLRHPISEYSFFLIFFLEVMCLF

SEQ ID NO: 173022 - protein, 69 aa, Glycine max
  Coding DNA Sequence Number=SeqID_56244
MQIAEDIDEFGLGMTRGTGLASLTGDLSSMQLASLTGELSLVSLLSSMQLASCGCTIPCTASPTCRSLY

SEQ ID NO: 173023 - protein, 135 aa, Glycine max
  Coding DNA Sequence Number=SeqID_56245
MSLIGERIEVGLKRGKFDHPAWTNEKTGANEEGENEGETHAATAVPTWKIPHQLNNIITQPISALLITHHPDSPQIPVSYANLLLYLLDNAMVAITLARVPQPPFFQGYGSNATCAYHGGISGHSIEHCMTLKRK

SEQ ID NO: 173024 - protein, 117 aa, Glycine max
  Coding DNA Sequence Number=SeqID_56246
MALVAHYDLEPHQMDKKTVFLNGDLEENIYMDQPMGFSIEGKEHKIDSRCFDDNKDDDKKPKRMISRLSQEQFKNKEKDSSESFFKKIQDSRFKNNQDQDSRLKDSRIKRRLNQDKY

SEQ ID NO: 173025 - protein, 304 aa, Glycine max
  Coding DNA Sequence Number=SeqID_56247
  Gene Ontology: Mol. function=4 iron, 4 sulfur cluster binding; Cellular component=integral to membrane; Biological process=electron transport
  Homolog annotation: Hit_ID=Q19KB4; Match level="QueryCoverage=99%, HitCoverage=76%, E-value=0.0, Identity=93%"; Hit description=PSI P700 apoprotein A2
  Pfam annotation: Domain name=PsaA_PsaB; Domain location=1-304; Score =240.1; E_value=4.8e-69; Accession=PF00223.9; Description=Photosystem I psaApsaB protein
AFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLGALDARGSKLMPDKKDFGYSFPCDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARL

SEQ ID NO: 173026 - protein, 54 aa, Glycine max
  Coding DNA Sequence Number=SeqID_56248
MGVALSRHSLSQRIGLARSFACPQAKREQLTCPQVIIACSDLVQRCMEQKLLIA

SEQ ID NO: 173027 - protein, 295 aa, Glycine max
  Coding DNA Sequence Number=SeqID_56249
  Gene Ontology: Mol. function=DNA binding
  Homolog annotation: Hit_ID=Q1RTB4; Match level="QueryCoverage=95%, HitCoverage=67%, E-value=2e-26, Identity=30%"; Hit description=IMP dehydrogenase/GMP reductase
KHGDYQTSKRFYQVKEKGLDTTSIKELGRLMEPLQMQALRKTYGKILDLTIAEVSIEAIASLTQYYDQPLRCFTFGDFQLVPTIEEFEEILGCPLGGRKPYLFSGCLPSLSRIATVVKDSARGLDRVKQTRNGIAGLPRKYLEDKARDMAIQGDWVPFMDVLALLIFGVVLFPNVDDARRVAHGLSVACPLSVFGWFHTCSSKTQGIHVRSKAIARYPNIPLIGTRGCINYNHVLAIRQLGYPMRGAPMEESMSPFLVRDFGVQNFKAIQRIHKAWETPLRKDQELRGIRNGIIG

SEQ ID NO: 173028 - protein, 151 aa, Glycine max
  Coding DNA Sequence Number=SeqID_56250
MVMGDFISRLSFPACLHFSGENTETFSSLTSYPELRRSEFLIGGYVGARASLLSTIPPFVAITQELVARGDTLRLSAPRHSVTPSVIDEQRPIWSSAPFLEMSAFSDGDFSSLTSYPELRRSKFLIGGYVGAEPCFCRPPHNLYHTDPEVM

SEQ ID NO: 173029 - protein, 185 aa, Glycine max
  Coding DNA Sequence Number=SeqID_56251
  Homolog annotation: Hit_ID=Q9AVH2; Match level="QueryCoverage=25%, HitCoverage=16%, E-value=5e-20, Identity=97%"; Hit description =Putative senescence-associated protein
MCPVVGFGPWLGLGKPLVEILPPGQLRGFCPLLAWLGSAVLGYGPVLSFGLVGPPPPPQKREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 173030 - protein, 93 aa, Glycine max
  Coding DNA Sequence Number=SeqID_56252
MAPRKLSAKRSRKDAAAEGTSAALEDDEYTNFQEDIARQGWTSLVTPMAKFEPEIVLEFYANAWPTKKSVRDMRRPQPVPGRPASVRGGPGVR

SEQ ID NO: 173031 - protein, 101 aa, Glycine max
  Coding DNA Sequence Number=SeqID_56253
SHVGATHEVYVSYDDMTYNVVNASSETYKARYDDIEDYVDGCNGDESDKLSDFEENTDVIDEVHSNDDINEIYVERGILGKPFERQVDDKMKFEKGEIVLE

SEQ ID NO: 173032 - protein, 274 aa, Glycine max
  Coding DNA Sequence Number=SeqID_56254
GVPLEEGLTPFIAQCFNSTNVGVLRRVCKAWEMVQKKDEELWGSSNGPIGGYHKWLKAYAQGLGWLPNLRATKEVEVEAPEEGEEVQALRMKLEQAQAVKEKFKSAVARIRKENAELRDINIATTKALVQKTKRARKKEHGRNKFRGEERDQSRVDGMILKDELKTCLRSKRSLSQQLCETETNMLAIISKYKEELDLATAHEHKVADEYARVYAEKEARGRVIDSLQQEATMWMDWFAFTLNGNQDLPRLLAKAKVMADAYFAPEEIHVLLSY

SEQ ID NO: 173033 - protein, 82 aa, Glycine max
  Coding DNA Sequence Number=SeqID_56255
MTLVSASYQTLSLTDSKRVFIWITTWLGSTEIVCADNHLGISPCHQTSRFKMIETVCTNNRLGIFACHLTSRVRMTKVQKTT

SEQ ID NO: 173034 - protein, 71 aa, Glycine max
  Coding DNA Sequence Number=SeqID_56256
  Subcellular localization annotation: CTP_CleavageSite=47; ConfidenceScore=5.66e-01
MTLSLAHHWAKRASTAKRSFSALSATKDSGRASISRSCAKRETSALSAAVVFSQAQRTTSTKRNIAYSEPI

SEQ ID NO: 173035 - protein, 121 aa, Glycine max
  Coding DNA Sequence Number=SeqID_56257
  Gene Ontology: Mol. function=transferase activity, transferring glycosyl groups; Cellular component=integral to membrane; Biological process=metabolic process
  Homolog annotation: Hit_ID=Q9SCP6; Match level="QueryCoverage=92%, HitCoverage=22%, E-value=2e-28, Identity=53%"; Hit description =Glucosyltransferase-like protein
MVLPLKQPHFVLVPLLAQGHMIPMVDMARILAERGVIITLVSTLNNASRFEQTVIRAAKSGIPIQLLQIPFPCQKVGLPLGCENLDTLPSRNLLRNFYIALEMTQEPLEKYLQTTLLLQVA

SEQ ID NO: 173036 - protein, 296 aa, Glycine max
  Coding DNA Sequence Number=SeqID_56258
ERRVQLREDEYMDFQEEIARRRWTLLVTPMAKFDPEIVLEFYANAWPTEEGVWDMCSWCEFSQRRSRADSFDEEATAQLLCIPGQDFARTAAGRRVWIMRTSMTTLTQTWMTLLLSNVLPSDHKSDLPLPKCQLVYVILTWMRVHVAQVIADVIYLFVAPTRHPLDPDKSNRALGFSALITGLYHSYGVPVTPNKGDAHQVAGALPPPRQADPAGPLGVDHYLQHLVRHLSQQGQGSAPFVCPTPEQFGAEVAWLGDWPDAQVGEEPTGSPDEANESRMDEDMTDLLGFLGGSGAT

SEQ ID NO: 173037 - protein, 163 aa, Glycine max
  Coding DNA Sequence Number=SeqID_56259
  Gene Ontology: Mol. function=zinc ion binding; Biological process =metabolic process
  Homolog annotation: Hit_ID=UPI0000196CCB; Match level="QueryCoverage =77%, HitCoverage=11%, E-value=3e-33, Identity=55%"; Hit description =protein binding / zinc ion binding
  Subcellular localization annotation: CTP_CleavageSite=35; ConfidenceScore=5.26e-01
MVYGLETPFKPFFVFIFSLFFVSIKVPSTYRRNVRGQEFGGMYCALLIVNTSYSLFFGCGSSSVVSAGMLRIFGSDVAELPLVATSNGNHGKGYFQTLFSCIERLLAFLNVKNLVLPAAEEAESIWTDKFGFSKMNPDELTNYRKNCHQMVFEHTSFSFLREL

SEQ ID NO: 173038 - protein, 87 aa, Glycine max
  Coding DNA Sequence Number=SeqID_56260
  Gene Ontology: Mol. function=transferase activity, transferring glycosyl groups; Cellular component=integral to membrane; Biological process=metabolic process
  Homolog annotation: Hit_ID=Q589Y3; Match level="QueryCoverage=97%, HitCoverage=17%, E-value=2e-23, Identity=59%"; Hit description =Glucosyltransferase NTGT4
MITWPLFAEQFLNEKFIVQVLKIGVRIGVEVPVRWGDEEKVGAMVKKSRIMEAIEMCMLGGEEEEKRRNRAIELGKMARNAIVKGGY

SEQ ID NO: 173039 - protein, 292 aa, Glycine max
  Coding DNA Sequence Number=SeqID_56261
  Gene Ontology: Mol. function=zinc ion binding; Cellular component =intracellular; Biological process=metabolic process
  Homolog annotation: Hit_ID=Q8RWG0; Match level="QueryCoverage=99%, HitCoverage=27%, E-value=1e-93, Identity=55%"; Hit description =Putative PHD-type zinc finger protein
  Pfam annotation: Domain name=PHD; Domain location=168-224; Score=3.4; E_value=0.026; Accession=PF00628.19; Description=PHD-finger
  Pfam annotation: Domain name=PHD; Domain location=80-123; Score=42.7; E_value=1.3e-09; Accession=PF00628.19; Description=PHD-finger
  Pfam module annotation: Pfam domain module=PHD::PHD; Domain location =168-224::80-123
MGSGIVCRCCNTEVFLKNLSALHSLRSMQAGLLARNHFNVSTIMLASYAYIYTSNGVSLHELAISLSKDRKYSAKDNDDLCIVCWDGGNLLLCDGCPRAFHKECAALSSIPRGDWYCQFCQNMFQREKFVAHNANAVAAGRVEGVDPIEQIANRCIRIVKDIEADLSSCALCRGVDFSRSGFGPRTIILCDQCEKEYHVGCLRDHKMAYLKELPEGNWLCCNDCTRIHSTLENLLVKGAERLPESLLGVIKKKQEEKGLEPIIDVRWRLLNGKIASPETRPLLLEAVSIFHR

SEQ ID NO: 173040 - protein, 73 aa, Glycine max
  Coding DNA Sequence Number=SeqID_56262
  Gene Ontology: Mol. function=structural constituent of ribosome; Cellular component=ribonucleoprotein complex; Biological process =translation
  Homolog annotation: Hit_ID=Q2PMP7; Match level="QueryCoverage=89%, HitCoverage=30%, E-value=1e-30, Identity=96%"; Hit description =Chloroplast 30S ribosomal protein S3
  Pfam annotation: Domain name=Ribosomal_S3_C; Domain location=1-70; Score=100.1; E_value=6.7e-27; Accession=PF00189.10; Description =Ribosomal protein S3, C-terminal domain
MGFPKFLIEEQAGTKGVQVQIAGRIDGKEIARVEWIREGRVPLQTIRAKIDYCCYTVRTIYGVLGIKVWIFSK

SEQ ID NO: 173041 - protein, 188 aa, Glycine max
  Coding DNA Sequence Number=SeqID_56263
  Homolog annotation: Hit_ID=Q9ZQA2; Match level="QueryCoverage=46%, HitCoverage=8%, E-value=3e-12, Identity=47%"; Hit description =Putative PHD-type zinc finger protein
MDAAVKPETEYAAVSTDQPRKVSVVNGYIVYTRAKRSLDSCNGFSEHAELKDNAEVEVKTENGECEKLKNESTEVVARTRKRSRRSALEAKVECCDQMVVSETEQVVANGGSGINGALGAPRNKMELKMSKKIVVNRKPMTVKKLFDTGFLDGVSVVYMGGIKKASGLRGVIRDGGILCSCCLCNGRR

SEQ ID NO: 173042 - protein, 111 aa, Glycine max
  Coding DNA Sequence Number=SeqID_56264
MIEPKGNTDKNAPYASPPPPLPQRQRGLLFEKGCSLERKRVKWRFSIEHLPKHMPLPPPLLSTSDIHFSGKHGYKIQIDLPYVCILVEVVVVCILMQSYPAKALNRRLQED

SEQ ID NO: 173043 - protein, 122 aa, Glycine max
  Coding DNA Sequence Number=SeqID_56265
TGRRSPTAQKGPHFGRIFREEFDIPEASDSRTKRKLLQTRGGEMEADGVEDTVCEKSGISKEKWAQFCQTRRDPPERYDECMKAQAIQKQNTAPHVLSRGGYDYLEQKLLAEKTKKKLEEAA

SEQ ID NO: 173044 - protein, 174 aa, Glycine max
  Coding DNA Sequence Number=SeqID_56266
  Gene Ontology: Mol. function=oxidoreductase activity
  Homolog annotation: Hit_ID=UPI000034EE1D; Match level="QueryCoverage =81%, HitCoverage=43%, E-value=3e-34, Identity=55%"; Hit description =oxidoreductase, acting on paired donors, with incorporation or reduction of ...
  Homolog annotation: Hit description=molecular oxygen, 2-oxoglutarate as one donor, and incorporation of one atom each of oxygen into both donors
MALNEQKGKDDIPESQYQKGVKHLCEKGHLNAVPKKYILPVSERPTKSSVEDSNVVKQNLQLPIIDFSELLGPNRPQVLRSLANACQQYGFFQLVNHCISEDVVRSMIDVSGRFFDLPLEERAKYMTTDMRAPGFLETPVPSLTRFTPPLACFTSGLSVSSGLLVYYYKQVRFS

SEQ ID NO: 173045 - protein, 178 aa, Glycine max
  Coding DNA Sequence Number=SeqID_56267
  Gene Ontology: Mol. function=oxidoreductase activity; Cellular component=proton-transporting two-sector ATPase complex; Biological process=ATP synthesis coupled proton transport
  Homolog annotation: Hit_ID=UPI000034EE1D; Match level="QueryCoverage =99%, HitCoverage=47%, E-value=1e-65, Identity=67%"; Hit description =oxidoreductase, acting on paired donors, with incorporation or reduction of ...
  Homolog annotation: Hit description=molecular oxygen, 2-oxoglutarate as one donor, and incorporation of one atom each of oxygen into both donors
  Pfam annotation: Domain name=2OG-FeII_Oxy; Domain location=28-127; Score=159.1; E_value=1.2e-44; Accession=PF03171.10; Description=2OG -Fe(II) oxygenase superfamily
MEAILESLGIVEANQEEDDNILKEFENGSQMMVANFYPPCPQPDLTLGMPPHSDYGFLTLLLQDEVEGLQIQHQDKWVTVQPIPNAFVVNVGDHLEIYSNGKYKSVLHRVVANEIKSRVSVASLHSLPFNCTVRPSPKLVDEANPKRYMDTDFGTFLAYVSSTEPNKKDFLESRKVLH

SEQ ID NO: 173046 - protein, 361 aa, Glycine max
  Coding DNA Sequence Number=SeqID_56268
  Gene Ontology: Mol. function=nucleic acid binding; Cellular component= intracellular; Biological process=regulation of transcription
  Homolog annotation: Hit_ID=Q43614; Match level="QueryCoverage=75%, HitCoverage=97%, E-value=7e-45, Identity=39%"; Hit description=DNA -binding protein
  Pfam annotation: Domain name=zf-C2H2; Domain location=173-195; Score =18.1; E_value=0.031; Accession=PF00096.16; Description=Zinc finger, C2H2 type
  Pfam annotation: Domain name=zf-C2H2; Domain location=264-286; Score =22.1; E_value=0.0019; Accession=PF00096.16; Description=Zinc finger, C2H2 type
  Pfam module annotation: Pfam domain module=zf-C2H2::zf-C2H2; Domain location=173-195::264-286
MGLLQSQPNLTRFLASSCLTLHLSLSLSSLHTCNIRLPSLETQLWQTQNTLLAIRGAIIYISFHSLHCFFHSLFTMQKQEELHAVCKDYMQIIKGKRTKRQRLPSPLRLTMSTTCSSLGRSSTDNSVGFDIPTTSNESRNEEEDMANCLILLAQGHNNTPKPSRTNKGGLYLYECKTCNRCFPSFQALGGHRASHKKYSKASAEEKQGVATTFVNYEVDNNNNNHNHDDYCDPTSTPLTLQLSTALYNNSSSIRSTINAKAKVHECSICGAEFSSGQALGGHMRKHRNFLSAPIIGAINIANGGDGSPKVPEAKKHKDVLNLDLNLPAPEDDHLRESNLFPFQAKEKVIVFSATSLVDCHY

SEQ ID NO: 173047 - protein, 287 aa, Glycine max
  Coding DNA Sequence Number=SeqID_56269
  Gene Ontology: Cellular component=extracellular region; Biological process=cellulose and pectin-containing cell wall organization and biogenesis
  Homolog annotation: Hit_ID=Q06BI7; Match level="QueryCoverage=79%, HitCoverage=89%, E-value=3e-89, Identity=64%"; Hit description =Ripening-related expansin
  Pfam annotation: Domain name=DPBB_1; Domain location=96-182; Score =171.8; E_value=1.8e-48; Accession=PF03330.8; Description=Rare lipoprotein A (RlpA)-like double
  Pfam annotation: Domain name=Pollen_allerg_1; Domain location=193 -272; Score=97.8; E_value=3.2e-26; Accession=PF01357.11; Description =Pollen allergen
  Pfam module annotation: Pfam domain module=DPBB_1::Pollen_allerg_1; Domain location=96-182::193-272
MAFPLGALMTTTLLLFLVAFSLIPNVHATIRSSWGHAAHNMVGRDNKIVDLHKHHPVFGPGPWRQAYATFYEGGSGTFGGACGYDDVVKDGYGLDTAALSSVLFKHGEACGACYEIKCVNSTQWCKPKPSVFVTATNLCPPNYSQPGDNGGWCNPPRQHFDLAKPAYLKIAQYKAGIVPVQYRRVPCKKQGGIRFTITGNPYFNLVKVWNVGGAGDITEVQVKGDKKLINWTNLKRNWGEKWETNAMLVGETLTFRVKASDGRYSTSSSVAPKNWQFGQTFEGKNFP

SEQ ID NO: 173048 - protein, 131 aa, Glycine max
  Coding DNA Sequence Number=SeqID_56270
  Gene Ontology: Mol. function=phosphatidylinositol phosphate kinase activity; Biological process=phosphatidylinositol metabolic process
  Homolog annotation: Hit_ID=Q6KA01; Match level="QueryCoverage=83%, HitCoverage=13%, E-value=7e-33, Identity=64%"; Hit description =Putative phosphatidylinositol-4-phosphate 5-kinase
MHITPLTRQIETDSKFLEAQHIMDYSLLLSVHCRAPQHLRSLVSHNQSRSVDGLAMLAEEDPLEDEVSYPQGLVLVPRGADDDSVVVGSHMRGSRLRASSAGDEEVDLLLPGTARYGFLMFLARSFHLQVK

SEQ ID NO: 173049 - protein, 98 aa, Glycine max
  Coding DNA Sequence Number=SeqID_56271
  Gene Ontology: Mol. function=1-phosphatidylinositol-4-phosphate 5 -kinase activity; Biological process=phosphatidylinositol metabolic process
  Homolog annotation: Hit_ID=Q8L850; Match level="QueryCoverage=79%, HitCoverage=9%, E-value=1e-27, Identity=77%"; Hit description =Phosphatidylinositol-4-phosphate 5-kinase 9 (EC 2.7.1.68) (AtPIP5K9) ...
  Homolog annotation: Hit description=(1-phosphatidylinositol-4 -phosphate kinase 9) (PtdIns(4)P-5-kinase 9)
  Pfam annotation: Domain name=PIP5K; Domain location=1-76; Score= -143.5; E_value=0.027; Accession=PF01504.9; Description =Phosphatidylinositol-4-phosphate 5-Kinase
MPSRAEQISEKQEKQMFHEVYDVVLYLGIIDILQNYNMTKRIEHAYKSLQFDSLSISAVDPTFYSRRFLEFIQKVFPPNATTVGDHVGTLLMVVIGIE

SEQ ID NO: 173050 - protein, 984 aa, Glycine max
  Coding DNA Sequence Number=SeqID_56272
  Gene Ontology: Mol. function=snoRNA binding; Cellular component =nucleus; Biological process=ribosome biogenesis and assembly
  Homolog annotation: Hit_ID=Q9LVF2; Match level="QueryCoverage=99%, HitCoverage=98%, E-value=0.0, Identity=59%"; Hit description =Arabidopsis thaliana genomic DNA, chromosome 3, P1 clone: MIL23
  Pfam annotation: Domain name=Utp12; Domain location=740-984; Score =212.1; E_value=1.3e-60; Accession=PF04003.3; Description=Dip2Utp12 Family
  Pfam annotation: Domain name=WD40; Domain location=138-176; Score =36.6; E_value=8.6e-08; Accession=PF00400.22; Description=WD domain, G-beta repeat
  Pfam annotation: Domain name=WD40; Domain location=180-218; Score =27.0; E_value=6.9e-05; Accession=PF00400.22; Description=WD domain, G-beta repeat
  Pfam annotation: Domain name=WD40; Domain location=398-435; Score =26.3; E_value=0.00011; Accession=PF00400.22; Description=WD domain, G-beta repeat
  Pfam annotation: Domain name=WD40; Domain location=479-517; Score =37.2; E_value=5.8e-08; Accession=PF00400.22; Description=WD domain, G-beta repeat
  Pfam annotation: Domain name=WD40; Domain location=55-92; Score=30.1; E_value=7.8e-06; Accession=PF00400.22; Description=WD domain, G-beta repeat
  Pfam annotation: Domain name=WD40; Domain location=600-638; Score =40.3; E_value=6.8e-09; Accession=PF00400.22; Description=WD domain, G-beta repeat
  Pfam annotation: Domain name=WD40; Domain location=642-680; Score =34.8; E_value=3e-07; Accession=PF00400.22; Description=WD domain, G -beta repeat
  Pfam annotation: Domain name=WD40; Domain location=684-722; Score =47.0; E_value=6.4e-11; Accession=PF00400.22; Description=WD domain, G-beta repeat
  Pfam annotation: Domain name=WD40; Domain location=96-134; Score =46.5; E_value=8.8e-11; Accession=PF00400.22; Description=WD domain, G-beta repeat
  Pfam module annotation: Pfam domain module=Utp12::WD40::WD40::WD40::WD 40::WD40::WD40::WD40::WD40::WD40; Domain location=740-984::138 -176::180-218::398-435::479-517::55-92::600-638::642-680::684-722::96- 134
MVKAYLRYEPAASFGVIASVDSNISYDSSGKHLLSPALEKIGVWHVRQGLCTKTLTPSSSSRGPSPSVTSIASSPSSLIAGGYGDGSIRIWDSDKGTCETTLNGHKGAVTTLRYNKAGSLLASGSRDNDVILWDVVGETGLFRLRGHRDQVTDVVFMSSGKKLVSSSKDKFLRVWDIDTQHCMQIVGGHHSEIWSLDVDLDERYLVTGSADNELRFYAIKHESVDGESVNGGEESSVQNKWEVLRHFGEIQRQSKDRVATVQFNKSGSLLACQVAGKTVEIYRILDDAEAKRKAKRRVHRKKEKKHSKEALEGIENGDRNNENKGDDSSVTHGPMETSNPTVTVADVFKLLHTIRAGKKICSISFCPVTPKNSLASLALSLNNNLLEFYSIEQGETKKTLAIDLQGHRSDVRSVTLSSDNTFLMSTSHNAIKIWNPSTGSCLRTIDSGYGLCSLILPTNKYGLVGTKDGTIEIIDIGSGTCVEVMEAHGGSVRSIAALPHKNGFVTGSADHDVKFWEYQIKQKPGQAAKQLTVSNVSTMKMNDDALVVAISPDAKYIAVALLDSTVKPVYIHMEVSVQVFELTILHYELVVTHVHFADTFKFFLSLYGHKLPVLCMDISSDGDLIVTGSADKNIKIWGLDFGDCHKSIFAHADSVMAVQFVPKTHYVFSVGKDRLVKYWDADKFELLLTLEGHHADIWCLAVSNRGDFIVTGSHDRSIRLWDRTEEQFFIEEEKEKRLEEMFEADIDNAFENKYVSKEEIPEEGAVALAGKQTQETLSATDLIIERLDIAEAEEKRIAEHQEEKNNRNVAVFQANPLMNGLSPSDYVLSAFSDVHSNDLEQTLLKSISASGVSGMTIGALPFSDALKLLSYLKDWTSYSDKVELVCRIGTLLLQTHYNQLLTTPAARPILTVFSDIFHERVKGWKDIFGFNLAAMDHIQQMMASRSDALFHDARSKLLEIRARQSKRLEERSDTGEVKRKKKKT

SEQ ID NO: 173051 - protein, 231 aa, Glycine max
  Coding DNA Sequence Number=SeqID_56273
MNSRHRPLHASGVSILATVDIAIEKTQHINGPLGSTLRRVANLAKFATPFIYAMQIQWLTILSFIDDAILAIEKFTEKLFPPSTHVFDIVDEIVLMIVFLPEKFDGAVNKFSTIIHQVPFLDWALTLVISRLNRLVSTLNYWGHENSRVNEKTIGVDRSCNEGYLPMDSSDDINHESLENFPPMIPECEHKAVHDISLSSRVKGSYKEALERGKEETPNEKMERECEIVEN

SEQ ID NO: 173052 - protein, 86 aa, Glycine max
  Coding DNA Sequence Number=SeqID_56274
  Subcellular localization annotation: CTP_CleavageSite=61; ConfidenceScore=5.06e-01
MPRRLNPFLLHSPPIYSKIGEELATQLAQVSKVTSSRSNSLLEEGSGRPNFRRSYGNSRIMQKHLFSISATSRNFTDCASLLPFDF

SEQ ID NO: 173053 - protein, 114 aa, Glycine max
  Coding DNA Sequence Number=SeqID_56275
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=99%, HitCoverage=28%, E-value=5e-47, Identity=91%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTAIGIMDFQFMGGSMGSAVGEKITRLVEYATNQLLPLIWYVRPEERVCRRKFELDPNG

SEQ ID NO: 173054 - protein, 74 aa, Glycine max
  Coding DNA Sequence Number=SeqID_56276
MGETHEIPHHNLPDFKPCLGYAIEGKALGANINPSHYPPPSHPQRPSLNKPQSLPAAHPVPKHQPKRNFVAKSL

SEQ ID NO: 173055 - protein, 194 aa, Glycine max
  Coding DNA Sequence Number=SeqID_56277
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-20, Identity=36%"; Hit description= UPI00006A17C9 related cluster
MDPWRATRPHLERTTRPRLERTTRPHYQRAARPHLQRTTCPRLERATRPHLGTTCPRLERATRPHQQSTAYPHRQRTTRPHLQRATRPRHQRTAYPHHQRVTRPRLQRTTCPHLERATHPHLWVLVTFTVRGLHALTLKGLHVLASRGLHALTSRGLHLLALRGMHALTFRGLRVLIFSVLDIHTLKEFKVLCP

SEQ ID NO: 173056 - protein, 66 aa, Glycine max
  Coding DNA Sequence Number=SeqID_56278
  Subcellular localization annotation: CTP_CleavageSite=56; ConfidenceScore=5.31e-01
MTLPPSEKPPCPLSRTLPHCNYLSLLAAFLSLLRSSKPHRSSRVLFRNPLLVLDCCAVVSRGGRRD

SEQ ID NO: 173057 - protein, 83 aa, Glycine max
  Coding DNA Sequence Number=SeqID_56279
MGAFMRKDECYKLIKLLHDTNKCTSTSTSKTIDDVQEKRRGKRERKPKVHFDEVTYPMKSERKVRRLKIMRYLGLAPPVGSPF

SEQ ID NO: 173058 - protein, 300 aa, Glycine max
  Coding DNA Sequence Number=SeqID_56280
  Pfam annotation: Domain name=PWWP; Domain location=157-228; Score =11.0; E_value=0.001; Accession=PF00855.8; Description=PWWP domain
  Subcellular localization annotation: CTP_CleavageSite=64; ConfidenceScore=5.86e-01
MAKKRTTPQKKKTQTIIPMPKHSQQPRSSPPKRRTDFSFFTRSPSSFSNPTSGSSPGSSSGEVRLSNVASSSLQGRKMVMKQFSEDIMVQCSIYQEGRPVCSSESFDTPVVEVDSAVQDEILNLGGHRAACNEKIDISKMSESTRLESYVCDSSSLAATPGNVVWARTDGQVWWPAEILEETSALSNPGSGGHVLVQFYGNLPSAWIDPMTDISTFEDSFEDKSNNPSEDFQQALKKALQRKAQLSSCQKLTLDRSAHSDMQERSSGTILISTLNYVVYGEDENWDRNTKTQQGKVFTEE

SEQ ID NO: 173059 - protein, 201 aa, Glycine max
  Coding DNA Sequence Number=SeqID_56281
  Homolog annotation: Hit_ID=UPI0000E47A04; Match level="QueryCoverage =75%, HitCoverage=15%, E-value=1e-14, Identity=27%"; Hit description =PREDICTED: similar to KIAA1833 protein, partial
MQVEGRTIDFWFTLHFEASLAKVSAISNPDENYSLSEAWHSKIPLLVEAVKSLLEEQNLGVRKALSELIVVMASHCYLVGSSGELFIEYLVRHCAITDQNRSDLESTPNKRIEMKIGAVTPGELRAVCEKGLLLVTITIPEMEHILWPFLLRMIIPLTYTGAVATVCRCISELWRHRSYSNDMLSECKTRPDIPSAEVGYL

SEQ ID NO: 173060 - protein, 727 aa, Glycine max
  Coding DNA Sequence Number=SeqID_56282
  Gene Ontology: Mol. function=binding
  Homolog annotation: Hit_ID=Q10RT3; Match level="QueryCoverage=74%, HitCoverage=58%, E-value=1e-139, Identity=50%"; Hit description=HEAT repeat family protein, expressed
MGLVAASHLDTVLEKLKDILDNVGQSIFQRILSLFSDSFRTEESDDIHAALALMYGYAAKYAPSTVIEARINALVGTNMLSRLLHVRLPKAKQAVITAIDLLGNAVINAAESGSPFPLKRRDQLLDYILTLMGRDDEDGFADYNDLLRTQALAISACTTLVSVEPKLTVETRSHVMKATLGFFAIPNDPVDVVNPLIDNLITLLCAILLTGGEDGRSRAELLMLILRQIDQFVCSPVEYQRKRGCLAVHEMLLKFRMICVSGYCALGCRGSCAHNKQMDRTLYGNFSKLPSAFVLPSREALCLGDRVIMYLPRCADTNSEVRKISAQILDLLFSISLSLPRPAGSSISAEDIELSYSALSSLEDVIAILRNDTSIDPSEVFNRIVSSLCILLTKEEASVFDSLVATLHGCSVAICDKIKQSAEGAIQAVVEFVTKRGRELTEIDISSTCCYLIRGRALMVKLCLGDRLVMGLNLETASLHMQGQIHPLLVKKISSLAENTSPRTVFDEVLAAAGRDTITKDISRLRGGWPMQDAFYAFSQHMVLSVLFLEHVISVLSQIPILKGDVERLEDSQVDSHTEDGKLQAAIFALTAFFRGGGKVGKRAVEQNYASVLSELTLQLGSCHGLTYSGQHEPLSFQGKLGRYLNLNLLTAFQAFCECVGDLEMGKILARDGELLENERWISLIGDIAGCISIKRPKELEMSSILTASIALGGMLGYKCDVKSHIE

SEQ ID NO: 173061 - protein, 61 aa, Glycine max
  Coding DNA Sequence Number=SeqID_56283
MTNATARKEEEHTEIETHQESICQVTLIHHQLTNEEETPEVSSTPEYPYLATVGYVGGKDK

SEQ ID NO: 173062 - protein, 142 aa, Glycine max
  Coding DNA Sequence Number=SeqID_56284
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=84%, HitCoverage=36%, E-value=1e-29, Identity=44%"; Hit description =Glucosyltransferase-14
MAAAEAKQESIGQGSEREQGFKERNQTQVLNKWIKESGFEEKTKGVGLLIRGWAPQVLRIGVRVGVESPVIWGDEEKSGVLVKKEDVVRAIEKLMDEGNEREEKRKRARDLAEMAKKAVEGGSSHFNVTQLIQDIMQQSNKN

SEQ ID NO: 173063 - protein, 485 aa, Glycine max
  Coding DNA Sequence Number=SeqID_56285
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=95%, HitCoverage=99%, E-value=1e-158, Identity=60%"; Hit description =Glucosyltransferase-14
  Pfam annotation: Domain name=UDPGT; Domain location=8-482; Score= -78.2; E_value=1.1e-06; Accession=PF00201.9; Description=UDP -glucoronosyl and UDP-glucosyl transferase
MASEAAPHFVLFPLMAQGHMIPMMDIAKILVHRNVIVTVVTTPHNAARFTSIIDRYIESGFPIRLVQLQFPCEEAGVPDGCENLDMIPSLATATSFFKATQLLQQPAEKLFEELTPPSCIVSDMCLPYTTQIAKKFNVPRISFVGVSCFCLLCMHNINIHNVRESVTSESEYFVLPGIPEKIEMTLAQTGQPMNESWKQINEEIREAEMSSYGVVMNSFEELEPAYATGYKKIRGDKLWCIGPVSLINKDHLDKAQRGTASIDVSQHIKWLDCQKPGTVIYACLGSLCNLTTPQLKELGLALEASKRPFIWVIREGGHSEELEKWIKEYGFEERTNARSLLIRGWAPQILILSHPAIGGFITHCGWNSTLEAICAGVPMLTWPLFADQFLNESLVVHVLKVGVKVGVEIPLTWGKEVEIGVQVKKKDVERAIAKLMDETSESEKRRKRVRELAEMANRAVEKGGSSYSNVTLLIQDIMQKNKRDV

SEQ ID NO: 173064 - protein, 146 aa, Glycine max
  Coding DNA Sequence Number=SeqID_56286
MVGGDNESGTQLVDCGVEDAMKLSISVPTASHPHNGRSRSGSSVLVCCCGIVVEIWELSGSRWMIVEVIQPHLPVRLPCYDFTPVTSPAFDIPFFAVKVTTSGMASSHSVTGSVYKARERIHRRLADRQLLAIPTSWRRVVTYNPN

SEQ ID NO: 173065 - protein, 422 aa, Glycine max
  Coding DNA Sequence Number=SeqID_56287
  Gene Ontology: Mol. function=transferase activity, transferring glycosyl groups; Cellular component=integral to membrane; Biological process=metabolic process
  Homolog annotation: Hit_ID=Q8S9A0; Match level="QueryCoverage=96%, HitCoverage=86%, E-value=1e-169, Identity=69%"; Hit description =Glucosyltransferase-9
  Pfam annotation: Domain name=UDPGT; Domain location=1-403; Score= -112.8; E_value=6.1e-05; Accession=PF00201.9; Description=UDP -glucoronosyl and UDP-glucosyl transferase
LQIRLVQLHFPSKEAGLPEGCENFDMLTSMDMMYKVFHAISMLQKSAEELFEALIPKPSCIISDFCIPWTAQVAEKHHIPRISFHESEYFTIPGIPGQIQATKEQIPMMISNSDEEMKHFGDQMRDAEMKSYGLIINTFEELEKAYVTDYKKVRNDKVWCIGPVSFCNKDDLDKAQRGDQASINEHHCLKWLDLQKSKSVVYVCFGSLCNLIPSQLVELALALEDTKRPFVWVIREGSKYQELEKWISEEGFEERTKGRGLIIRGWAPQVLILSHHAIGGFLTHCGWNSTLEGIGAGLPMITWPLFADQFLNEKLVTKVLKIGVSVGVEVPMKFGEEEKTGVLVKKEDINRAICMVMDDDGEESKERRERATKLSEMAKRAVENGGSSHLDLSLLIQDIMQQSSSKEEIMSTPKESQFSCNV

SEQ ID NO: 173066 - protein, 493 aa, Glycine max
  Coding DNA Sequence Number=SeqID_56288
  Gene Ontology: Mol. function=transferase activity, transferring glycosyl groups; Cellular component=integral to membrane; Biological process=metabolic process
  Homolog annotation: Hit_ID=Q589Y3; Match level="QueryCoverage=97%, HitCoverage=98%, E-value=1e-139, Identity=50%"; Hit description =Glucosyltransferase NTGT4
  Pfam annotation: Domain name=UDPGT; Domain location=9-485; Score= -79.9; E_value=1.3e-06; Accession=PF00201.9; Description=UDP -glucoronosyl and UDP-glucosyl transferase
  Subcellular localization annotation: CTP_CleavageSite=31; ConfidenceScore=5.19e-01
MAFQAHHQHFLLVPFMSQSHLIPFTHLAKLLASNGVSVTIVLTPLNAAKFNTLIDQAKALKLKIQFHVLPFPSAEAGLPEGCENLDTLPSPQYKHLFFSASNMLKEPLEKWLSELETLPTCMVSDICLPWTTTVASKFKIPRVVFHGISCFALLCSHKIGHSKVHENVTSMSEPFVVPDLPDAIEFTKAQLPGAMSQDSKAWKHAVEQFKAGEHSAAGILVNTFEELEKMYVRGYEKVGRKIWCIGPLSLHDKLFLERAGRDGNETSLDESECLNFLSSNKPCSVIYVCFGSLCRINASQLKEIALGLEASSHPFIWVIGKSDCSQEIEKWLEEENFQERNRRKGVIIRGWAPQVEILSHPSTGGFLSHCGWNSTLEAVSAGIPMITWPMSAEQFINEKLIVQVLKIGVRIGVEAPVDPMETQKALVKKECVKKAVDQLMEQGGDGEQRRNRAREIKEMAQKAVEDGGSSASNCELFIQEIGAVEDGGSSASK

SEQ ID NO: 173067 - protein, 559 aa, Glycine max
  Coding DNA Sequence Number=SeqID_56289
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=92%, HitCoverage=99%, E-value=1e-153, Identity=55%"; Hit description =Glucosyltransferase-14
  Pfam annotation: Domain name=UDPGT; Domain location=9-482; Score= -87.8; E_value=3.4e-06; Accession=PF00201.9; Description=UDP -glucoronosyl and UDP-glucosyl transferase
MVSEAQKPHFVLFPLMAQGHMIPMMDIAKILVHRNVIVTVVTTPHNAARFTPIFDRYIESGFPVRLVQLQFPCEEAGVPKGCENLDMIPSLATATSFFKAANLLQQPVEKLFEELTPPPSCIISDMCLPYTIHIAKKFNIPRISFGGVGCFYLLCLHNIRIHNVGENITSESEKFVVPGIPDKIEMTKAQAGQPMNESWNQFGYDVMAAEMGTYGVITNSFEELEPAYVRDYKNIRGDKVWCIGPVSLINKDHLDKAQRGRASIDVSQYLEWLDCQKPGTVIYACLGSLCNLTTPQLIELGLALEASERPFIWVIREGGHSEELEKWIKEYGFEESTNARSLLIRGWAPQLLILAHPAIGGFITHCGWNSTIEAICAGVPMLTWPLFADQFLNESLVVHVLKVGLKVGVEIPLTWGKEVEIGVQVKKKDVERAIAKLMDETSESEERRKRVRELAEMANRAVEKGEVPMNWGEEEKTGVLVKKEDIKRAICMLMDDDGEEIKERRERATKLCEMAKKAVEKGGSSHLEMTWLIQDIMQQSSSKEDIKLTPKESQFTCSA

SEQ ID NO: 173068 - protein, 170 aa, Glycine max
  Coding DNA Sequence Number=SeqID_56290
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSINAIRSCEVRFEVSDPTSDWDPLFINRGSSGTACRRKKIRQFTAKWGRRIDDLLKTDRQWGYERSLAIPQGSL

SEQ ID NO: 173069 - protein, 84 aa, Glycine max
  Coding DNA Sequence Number=SeqID_56291
  Subcellular localization annotation: CTP_CleavageSite=48; ConfidenceScore=5.67e-01
MPITRCKSISWSVSSRHGNRTHKTPSGPGKVQQGPGVSSSGYGPLSVLQGARTPPARSRHHRDRTCKTPSGPEEVQQGLGVVKR

SEQ ID NO: 173070 - protein, 214 aa, Glycine max
  Coding DNA Sequence Number=SeqID_56292
  Gene Ontology: Mol. function=hydrolase activity
  Homolog annotation: Hit_ID=Q28TG5; Match level="QueryCoverage=89%, HitCoverage=29%, E-value=2e-23, Identity=35%"; Hit description =Metallophosphoesterase precursor
MEPRHAKFGGDLVDRRIQGQVIIDDVTQGGAHARPGLTDQRRHDRLLVVADVLQAGGLRIGEHQHLETTTAVMAIRLQGEIPVAGDVAGGGDAAVLQRRRTVRTVVAPERRQAIGRLRERIRIGLDHEHGLAITHRQAVAAVGGGLDEGLAVGDLHPGQARIGRAAPRPAVALQIDLAGDHGVRGPGRRGQQQAAQPRGRQFHGRDPAERDAVL
